United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 24

SEQ ID NO: 97577 - DNA, 966 bp, Glycine max
  Peptide Sequence Number=SeqID_214355
atgtacctgaggaagactttgcaaaactgcaacgcatacttgaagaccattgagcactcagaaagggtagaaaattcaaaccctagcgaagcatccactgtcgccgtcgcacactcgcacgccgctcacaggtttatgggctacgctgatgtcctgaatttgttgttggccgtggtggttttaaattctggttacatcacaatcaagtccacgtattgctcaagtttgtatgaacactgtgttgctgcacggcgatcgatacatgttgtgaatcttgaccctgctgctgaaaattttgactatcctgttgcgatggatataagggaactcatttccctagatgatgttatggaggaacttggattgggtcctaatggtggtcttgtctactgcatggaacaccttgaagataacctagatgattggctcactgaggaactggacaattatttagatgatgattacttggttttcgactgccctggtcagatagaactatattcacatgtcccagtgcttaagaattttgtggaacatttgaaacggaaaaattttagtgtttgtgctgtttacttacttgattcacagttcatgacagacgtgaccaagtttataagtggatgcatggcatgtctttctgcgatggttcaacttgaactacctcatgttaatatcctctcaaagatggaccttgtgactaaaaagaaggatcttgaagattttttggatccagagcccacctttttattgtctgaattgaatcaacggatgggtcctcagtatgcaaagctgaataaggctttgattgaattggtaaataactatagcatggtgagttttataccattagacttaaggaaggaaaaaagtatacaatatgtactggcccaaattgacaactgcattcaatatggagaagatgcagatgtgaaggttaaggattttgaccctgaggatgatgagtag

SEQ ID NO: 97578 - DNA, 375 bp, Glycine max
  Peptide Sequence Number=SeqID_214356
atgaaccacttcttccggaaagttcccggaagaggtttttccgggagtcttccggaagaagtgttcttccggaagacgtttggttacttccggaagaacccttcttccggaaactttctggaaaatgttcttccggaacttccggaagaacccctaacgggtcttccggaagtctccgccgtcagcctcctttccccattttttctggcgtcctctcctctcgtcttctaccctaaggttactatcctaagcaaaggggagttagggagactaacctcgttcgcggagaagaagaagacaaggttcgcacttgccttgccggagaagaagaagcagttcgcggagaagggagaagaagcttcgcggaaggaatga

SEQ ID NO: 97579 - DNA, 1257 bp, Glycine max
  Peptide Sequence Number=SeqID_214357
atgaatgatatcatggaagatcaagaggactcacatgatgacattgatggcttattatatgacacatttagaaatatagcagaagtagagggactaagtgagaggcctaatggggatgctagaaagtttttcaatttggttaaccaagcaaaacaagaattgtacccaggatgcaaaaacttctctattttatcatttgaatttgctcaagtaaatggtgagtttgagcgaccaaagcatgaatataaagttcctgcaaagattttgcgatactttcctttgatccctagacttcaacggttattcatgtgttcaaggacaactgagcaaataaggtggcatgaacacgaacgcgtaaaggatgggaaactaaggcatcctgttgatggccaagcatggaaggactttgataggcttcattctaattttgcttttaagtgtcgtaatataagacttggcttatcaagtggtggattcaatccatttagaactatgagcatatcacatagtacatggcctgtcatgatggttgtatataactatccaccttggttgtgcatgaaacttgaatatacaatgttgttattattgattcctggaccatgttctctaggaaatgacatcaatgtgtatcttcaaccactgattgaggaacttaaggtgttatgggatttcggagtgaagacatatgatgcctcaaaaaatcaagtgtttcaaatgcgtgcaactcttttatggactattagtgactaccttgggtatgcgccacttttgttagaagggaaaaatatcctagaaagcttaacgactttcgaaaataaatttgggaaggagaaaggcaagaaaaagaaaagaattatcggtccttgggagaagaggactcttttggacatctctggcaagacaaaagatcacattaatgctcgttatgatttgcaagaaatgggaattagaaagaaccttcatccaagggatattggtggaggtcgtgtgaagtttgcaaaagcatgttttttaatgactacaaaaaagaagtctattttttgtggtatcttgaaagatgccaaattgctagatgggagtgcaacaaatatttcaaaatgcatgcatatcactgacaaaatatctggctacaagagtcatgatacacatatcatgttacattacttattacaaatagcaattagaagcacaatgcctagtgtggtggttgatcttttaattcaccttggatccttctttcgctctttgtgttag

SEQ ID NO: 97580 - DNA, 99 bp, Glycine max
  Peptide Sequence Number=SeqID_214358
atgcttttgttaaatggtagtcacagttcgatacttcaaaggcagctccagaccaggtttctgagaggaggtgctctacacaaagaacaacttttgtaa

SEQ ID NO: 97581 - DNA, 475 bp, Glycine max
  Peptide Sequence Number=SeqID_214359
gaaagaaagcctcaagaggctaacattaacctcccatacttccatgggaagtacaatgtagaggctaacttagtttgggaaataagggtagagcaacaacttaaaaagaagtctacttcaaaatcttatggctctcactcttatccaaagaaagaccaaggtcgaggcatcttaggggtgacaccttctaagcccaaagatgataaggggaagacaatagaaaagcaagtccctaaggctactacttcaccttcctctagtgaaagtgaaaaagcaaaaggggaagaatctagtgaagaaatctacccccaagatgaaggacaaccattagtggttaaagacaagtgtaaggagacacttgctagcattgccacatctcttgggcttgagtttattcctcaagtaaagaagttgttgtatgagggtttggttcgcaagagcttaaatccttgtgctttgttggtgcccaaaatag

SEQ ID NO: 97582 - DNA, 372 bp, Glycine max
  Peptide Sequence Number=SeqID_214360
atgaagaagaagtcactcaagcgaaaatgtttattgagactcgcaaagcccgaccgaaaggaaaaaaaagtggatgaagaaacacaagttgctattttaaaaagaaaagaagaaatttcttctcttaagaaggagcatgcaaatgagttgaataactgggctaggaggtttgaaggattggaagcacttctaagatgcttcatgaagcaaagcaacccaaatttggatgatgaagctttggatgacatgataagaaatattgtagctaatgaaaatagtaacgcaacaatgcgatcctctgcatcaactaacgttcctaattttgaaaaggttggagaccaagaagatcgtgttcaagatacaggagattga

SEQ ID NO: 97583 - DNA, 699 bp, Glycine max
  Peptide Sequence Number=SeqID_214361
gacaacagaaacgcacttcgtttagagatctgatgatgggccaaaaagcaccagtggcacctagacctaaggtggaccttttgaagtacgaagatggtaatcacttgaagccaaaagttcatttggacaagaaggttgtggaaggtttatctaccccttggcaagacgcgttggtgatcaagcttttggagaaatttgttggttttaatactatgaaggataggctcacaaggctattgaaattttggatatttatcttgaatatttcatggtcaagtttgataatgagaatgacagaaggaagcatactattggcaatgccaacaacgatagggatgccaatgaagggagattttggcttcaagatcattggtatcgagttgaataggaaggcctccataggatttgtgctacatgcggctactatggacactttgcgagagagtggagacaagagtacgacaatgccgccagaaaccctagttgctaatccaaggaatgtttcaaccaacaattctgcaactagggccccacaaatagatgatgcattacatggtatcgagcccacaacgttcttacaacaaaatgtgaatgttgaaaccagtttgaacatggatgaagacacaattgctccacaggcagatatggaagtggtgccctcatctattcctcaagaaactcatagctcaggccaacaaa

SEQ ID NO: 97584 - DNA, 501 bp, Glycine max
  Peptide Sequence Number=SeqID_214362
atgggtaagcacaaacttctcttgctggccctcactctccaccttctccatgtctcagctgcaccttccgctacttccccagcaaaaattgttagtgggtttctctccaatgccgtgcctgctttcaccaagtgggtgtggtcgctcaaggccaccaccaaaacggcggtttcgagcaggtcgatgatgaagttcgagagtgggtacaacgtggagactgtgtttgatggaagcaagcttgggatcgagccttatgctgtggaggtgttgcccaatggggagcttctcattcttgattcggctaatagtaacatttataggatttcatcctcgctttctttgtgtaagtttgttgctgttgttgagaatttgaaagttcagctgccttttgctggatctggaatggcgattagtgcacctgatgaagataatgttcgttgcaattgtgcagacagccgacccaagctggttgcaggatcagctgaagggtattctggacat

SEQ ID NO: 97585 - DNA, 225 bp, Glycine max
  Peptide Sequence Number=SeqID_214363
atgggtggatttcttggtactctatcatctctatttgccaccaagctaggttctatagctattgaaggaccttgtaacatcccaaaacccaggacatggaaacttgtggagcatagcaaatgggccagttggaaccagcttggaaacatgtcctccactgaacctctgcagactattagtggttttggcttttgggaaccaaagttagaaagttctgaaggctaa

SEQ ID NO: 97586 - DNA, 537 bp, Glycine max
  Peptide Sequence Number=SeqID_214364
atggtttggcaaacaataagttggcaaccagaccctgacttcttaattgatgatgttgttcaatggatcaagaggaatgtttttggatccaaaggagtgttctttgcgattatttggtggttcatttggagatcgaggaatgaagaggctcaccctcgtcaatccgttttggttcattggtctccccctcttcagccttttcgggagctcaacaccgacgagagttctttgggtaatccaggaacctcaagttttggcggagtgattcgcgataatcttggacaagtgactattgcaaaccattggcaccatattaaagataacatgtttggaacattcataatgtggattcctaatatggactcccttgagactatgatggtggataatatcccttatgctgaacctaaccttccgatttcagcttatgaggatgacactggatggccttggcctgctcttaatgttattatgtcgcctcagatttgtatagaactattgccattaatcccccttcaattcgcaaggtctggatga

SEQ ID NO: 97587 - DNA, 213 bp, Glycine max
  Peptide Sequence Number=SeqID_214365
atggtcgcaccatatattgatatgagtaatgtccaagtgcaaatccttgataatgaaaatgaagaagctgagtttgtcgtcgttggcaccaacgaggaaggaaacgacaacgtttggactgttagggtaatagaggaggtggaggcgcgcgattgcgaggaagagggaagtggcatcattttgattggggaaagagaagaaggaggcaactga

SEQ ID NO: 97588 - DNA, 237 bp, Glycine max
  Peptide Sequence Number=SeqID_214366
atggacaagtggagagaggcaaaaactgcaaaagtacccctaaaaccaaacatgaggaagagagaagtttcagtcaaggttgtttttggaattgtgcaaaatgtagatgaagttaagaggtggccacttgtttgcctaaatgcagggagaaaaattcccgtgttgaaagtgacacaagagacattggtccccactaggtttcattctgcccacttgttcccaaattccaaacagtag

SEQ ID NO: 97589 - DNA, 788 bp, Glycine max
  Peptide Sequence Number=SeqID_214367
gggtcacgacaattgctggtggaaaatggagccgcggagggggccatgttgatggaccaagtgaagaagctaaattttctggtgactttgatgtggcttatgttggaagtagctgttcgctactcgtcatagacagaggaaaccgagccatcagggagatccaactccattttgatgattgtgcttatcaatatggcagtggattcccacttgggattgcaatgcttgttggggctggattctttggttacatgctggcattactgcagcgtaggcttggtacaattgtgtcatcccaggaagctcaggttccagtaacagtaacatcttcggttcctccaagtccatatcaaaagccctttaaatctgtcaggcctcctttaattccagcagaatgtgaacctgacaagcaggaagaaggtttcttcggatcccttgggaagcttattgccaacaccggaaagctttgtgatccccgacgaagaccagcccccttccatcgacacaagggccccaaccccacgaaaaacctatcctttcatgtccaaggatgcagagaaaatgcaacaactgcgacaaagccgagcattctacagcggatgggatggagatctccagcagcaacagcaacagaaacaccatcatcgccatcatgcaggagcaggataggaagcaggaatctgtggttatcaagcctgtggattatggggaatcaatgtattgagtatataacagctaggaagtttagatttttagaagtaatgatctcaatggagagggaagaatga

SEQ ID NO: 97590 - DNA, 168 bp, Glycine max
  Peptide Sequence Number=SeqID_214368
atgaaatcaaccactgctacctgtgctgctttgaaggtcctatcttcgtatggatatgatagatctcctacctcggctggaacttgcctctgcaactttaaggataccaccagcgtcgtattcgatgatggacatcttaggtcaatcggcttaatcccgaacagctga

SEQ ID NO: 97591 - DNA, 309 bp, Glycine max
  Peptide Sequence Number=SeqID_214369
atgtcgaaaggcggttcgcttcaaaaggacgtgccatggagagcatcgtcttcttctgcgaagcccatccccaaaattcaccacagtccccttcttcgcgtatcccaaacacctgtttccgattacggtatctccgtcatgaggcatccggaccctataggtggtggattgggtcatgaggccatagtggaaccagctggccctgattgtctcgtacctggccagaaaatgcccatccaattacttggcctccagaaaatgcttgagcaagcttcatcggttcctagaactgaaccattgcgaaagtga

SEQ ID NO: 97592 - DNA, 726 bp, Glycine max
  Peptide Sequence Number=SeqID_214370
atggctcatggcggccaccgatggtcgtggatggtggagaagaaggtgttagggtttgggtgggactccacttttggtgctaagcgcaaaaattctcgttcagcgcaattccctctcaggttggaatttgcattgaacgcgacaattcttgctgagctcaattcctcttgcactaagcgcaacaattctcgctcaactggcgtctaccctgacttatcttccttcaccggaagtggcgtctaccctgacttatcttccttcattggaagtggcgtctaccctgacttatcttccctctttggaagtggtgtcatccaaatctccatagcctgtatcaagcgatccgctcctagtcaggatcctatggcacaaccatactactctgtccatggtggaattccacaagactgcaataggggacacatgggtgtggctaagaccttacataggctacaagaaaatttcttctggcctaatatgtgcaaggactttcaaacatatgttgctcaatgccttgtcaataagtcaatcccatatgctatttgggaggacttctccttagatttcatcaccgacctcccttcttctcgagggtataataccatcttggtggtcatctatggtaaacctcttccctctctttccagttatcctcttggattgtcacaggttgaagttgtcgctgagttcatctctaccggggagacaatccatgctatactttag

SEQ ID NO: 97593 - DNA, 442 bp, Glycine max
  Peptide Sequence Number=SeqID_214371
atgctccaaccatatgggatcaacataggcttaaaggagtactcaaacccggagacccccaaggcctacactccgaagagtccgtcagggcctcttcctcctgattcaggaggattgcatcacactctttctgctaaatggagatggtatgtttcttcaccaaaatcaagctttgtgtgtgaatatcctaaagtccaagtatggggcggaaaaatttggaaggggagtgaaaaatgggtgatggaggggagacaaggttttggatggactgttgagggagggaatgagagcttagttgatagatttccttcaaaattgcaaacaacaaatggaattaatgaaaaatgtgagaagatgggaattaggacgagtggaattggttacaagatgggtcaggcgcatacccaacttcttcggcatacaaggcaatatatgcatagag

SEQ ID NO: 97594 - DNA, 246 bp, Glycine max
  Peptide Sequence Number=SeqID_214372
atgcgagcacagccagaggaggaggcagggatcacgcccacaagacacccagtggacccaaagaagtccaacagggtcctggggtttccagctctgattatgggtcccccagtaaggtcatcaggccccctattaacagggctttcatcgaaaagtactgcgcccccaggcaggcgcagggcgaggcaccacattagcctggggacgaccaacagcaggcaacaaaagcaccgccaccacctctag

SEQ ID NO: 97595 - DNA, 786 bp, Glycine max
  Peptide Sequence Number=SeqID_214373
atggcggtgacaatagagtcccgcgacaacggagggaagccaggccaaaaaaaccctaaggatataatcagtgtcattaatgacaaagagggggcccttcatgatcatccataccaccgcgcaccacaagaccttccatctgatttgcttactccgattgactcccacaagatgatgttgacaaaaatggtcgctgatagaatgagttcctggatattaaacttattagaggtagtgattgaagtccttcagacagcttactctaatcataatcccctcctgcttccttgtggtggcttccccaatctcgtggcaagaggccctttagattcattgctacatggtgcacccatgcggactatcagcatgttgtctgtaatgcttggcacatattgtcaccgaatccgctcctcctttcatatactaacatcatcgagtacgagtgagcaagggtttgaaacaacaatcagttacgaaattgtcgtggagcaaaaccgtcaccccccacaaacgttcagaacaacagtagcaatggctggagtttcacaatctatgaatatttcttgtgaccttcccatattgaaaggtgataattataaggtttggaaggagagaattctccttcatttaggttggatgaatattgactatgctataaggaaggatgagccatcgattattgctgaaactagcgaacctaatgtcgttgacctttatgaaaggtgggagagatctaattgtctctccgttatgttcataaaaatcaacacatccgctagtatctag

SEQ ID NO: 97596 - DNA, 513 bp, Glycine max
  Peptide Sequence Number=SeqID_214374
atggcttcttcttgttccggttcactactagtgcttccctttgtcatttcctcgactcttctatgtttctctgtggcttccaatgagttcgaagttggtggctcaaaagggtggattgttccacctgctaacgacaccaacttcttcaatgattgggcttcccaaaacaggtttcaggctggtgacaccattcggtttaagtacaagaaggactctgtgatggaggtgggagagggagattacacacactgcaacgccacacaccccacactcttctccaacaatggcaacactgtgttcaagcttaaccactcagggaccttctacttcatcagtggtgcatcagggcactgtgagaagggtcagaagatgattgtgagggtcatggctgatgagtctctttctcagcatgccaagtcttctggtcaccatgttccagtttcgccaattggggtctctcaaatgctctaccttcagtttgttttgacatgtgttgcttcttatgtagtttga

SEQ ID NO: 97597 - DNA, 1077 bp, Glycine max
  Peptide Sequence Number=SeqID_214375
atggcttccaacaaatcttcttttcattcggctcttgccgtatcaaacatcaggaatcatgtttccattattcttgaaatggaaaacgttcaatattcgacatgggcggaactcttcaagattcacgcacgctcaaccaaggtgcttgatcatatcatacctccggccaacgacacggggacggttccttctactgaggaagagagggagctatggtcaactttggatgccacggttctttcatggatttatgctaccatttctagtgacttattgcacaccattattgagcctgactcaacgactatggaggcttgggatagattgcgtgatatattccaagataatcaacattctcgtgccgttgccttggagcaagaattctccgccacttctatggagaatttcccaaatgtttcctcttattgtcaatgtctcaaatctctagcagatcaattaaagaacattggggctccggtgtctgatagtcgattggtattgcaattggttgggggtcttacacagccgtaccgtggagtgggtacattgatccgtcaaagcaacccccttcctcccttttacaaggctcgttccatactcactcttgaggaggccgggatggcaaaggaagcagccactgagtctgctatgatcgcctcttcgattaatgatgggtccccacaacctacgaaatcaggacattcgaagggaaaaaatggtgcgcaacattctggtggcggacggcgcaacaatgggggaggtcggaagaatgcaggttctggtggtggccagaactcgaccagcggtaaaggcggtggttgggggcagtcctctggtggccacggtgaaaccactcctccacaatggcagcagcaacaaccatttccatggggatggtataacccgacctggcctattcctccttgtccattcccaaatcaaggatgggttcggcccaatactcctcaacagcgccatgcagatttgctcggcccaaaactgcctcaacaggcctatgtacatcaagcagcatcgcctaatcctcatgggcagtggttcgtgcactccaaggattga

SEQ ID NO: 97598 - DNA, 1086 bp, Glycine max
  Peptide Sequence Number=SeqID_214376
atggaacctccaacaggattttgggcatcaatatggaactttgtttgctttctgccgtttttcgttggtctttggcttcttggcaacatcaaagtggctggcattgttgggagtgttataggtggagctgcctatggattttttgcaccaatatttgctacttttgaagctgtagagggaggaaaagagaacaaacttttccactgttttattgatggaacatggagcaccattagaaagaccttcgatattgtcaaggatgtgaaaaatgaatgctatgattcttatttctcgtttatggatgatctactacaactgaacgggaaatattatgagatcaggctgcgatatcttcctggtgctattgtggctgcggttcttgggatcattattgacatgcctgttatatcagttgttgccatatttaaaggcccttacatgcttttcaaagggtggaagcgtttgtttcatgatctcatgggtcgtgaaggccctttcttggagacaatatgtgtgccttttgctggccttgctattgttctgtggccactggctgttgttggggcagttctggcatctgtgttagccagtttcgttcttggtggatatgcaggttttattacttatcaggaatcctctttcttgtttggcctggggtacattgttgcagctgtgtccctttatgatgaatacagcaatgatattcttgacatgaaagaaggatcctgcttcccaaggcctcgatatcgaaaaattactgaattgaaattgtcaaggacaccttctcgttcaatttccctcccaaaaacaaagtccttaacaaagacactttctcatgcatattcactgaaagataatatacccgagttcaaaccatttgagctgttggatggcttgttcaaggaatgtcatcagcttggagaatcactggtttctgaaggggtgataacacatgaagacatacaagaagcaaagtcaggtaaagggagtagagtcattagaattggtttgccagcatattgccttctccaagtactcttgcgttctgcaaaagccaattcccctggtatattgataagtaagtga

SEQ ID NO: 97599 - DNA, 324 bp, Glycine max
  Peptide Sequence Number=SeqID_214377
atgaagtggttctacatgatttctcatcccttcatgagtccagcacagcctggggatcctcctagacatccacccgtgctacacgatgacacatttattgaaccagatattcctgagcacctggtgacaacaacagctatagacaaagcacctgaggcttgccaagcaatagttgaaaggttggaatggttgatcaacctaaggatagtcatagaaggtacaaaagcatacactgtcacgaaagactgcctaaccagaggtgtgactgcaaaacacaatgtatatgtacggtcacgaagaaggcaacgtatggaagacgtatga

SEQ ID NO: 97600 - DNA, 858 bp, Glycine max
  Peptide Sequence Number=SeqID_214378
aacgtcctccctttcagaggattacatgtcctcgtcgtcacagggctacaagtcctcgcctttagagggctacacgtcctcgccttcagaggactagacgtccttgcctgcagagggctacacgtcctcgccattagagggctacacgtcctactcttcagaggactacacgtcctcgccttgagagggctacacgtcctcgcctttagagggatacacatcctactcttcagaggactacacgtcctcgccttcagaggactacacgtccacgccttcagaggactacacatcctcccctatagaggattacatgtcctcgccgtcagagggctacacgtcctcgcctttagagggctacatgtcctcaacttcagaggacaacacgtcctcgccttcagaggactacacgtccaccccatcagtggactacatatcctctccttcagaggattacacatcctcggcatcagagggctacacatcctcgctttcagagggctacacgtcatcgccttcagaggactacacgtcctccctgatagagggctacatgccctcgccttcatagggctacacacccccactctgagggctacacgccctcgtcttaagcggactacattccctcgccggctacaccccttcgccttcagaggactacacgtcctcaccttaagaggactacacgtcctcgccatcaaagggctacaggtcctcaacttcggaggactacacgccctcacctttagaggactacacgtcctcgcctttagaggactacacgtcctcgccttcagagggctacaagtcctcgccttcagaggactacacgccctcaccttaagaggactacat

SEQ ID NO: 97601 - DNA, 495 bp, Glycine max
  Peptide Sequence Number=SeqID_214379
atggagcagcagcaggctgacgtggtggtgaccgtcggagaggaaaccagtcacgatctcacgcgggagcacattgcgcgcgccggcttccgcacggtatggcatcgcggacaaattgaccttgcgccaccgctgacgctgacgctggcgcagttcgtgcagtatcagcatgcgctggtctcctatcgcggcgtgagtgaaagtgcgctggacgccgcgttagcccgcgaggggctgacgcgccgcgtgcgttatgtcacgccgcacttctcggtgttaccgctaatgttgcagcgtctgccgctgttcgcgaccgttccccagggactggtgcagggatgggaacagcgctttgcgcttagcacggcggcggtgccgatcggcatgccggattatgcgctttcgctgctgtggcataacgcccgggcggaagaaccggcgcaccgctggctgcgcgccacgctgcgtcagctgatcgaacgcaagctggcgtga

SEQ ID NO: 97602 - DNA, 210 bp, Glycine max
  Peptide Sequence Number=SeqID_214380
atggcaactgcgagcttcgccgcgcgtcacgacgatgcacgcacgctactgttgctggcccctggttgggtgcgcactgacatgggtggcgccggggcgcgactgagcattgaggagagcatcctgaatctactcaacacggtggaaagccagaccggacgcggcggcctgcattatctagattacctcggccgtgtagtaccatggtaa

SEQ ID NO: 97603 - DNA, 195 bp, Glycine max
  Peptide Sequence Number=SeqID_214381
atggccaaatctactttgttgttctacaattcatcttggacctctcgaagaagagaaaaagctgcaaagttgaacgttgagaacaacaaaagagacatacccagaatcgaagaaagcttctgcaaagcttgggacgaaggagggggtgatccagagggcgataagatggttttgcaatgttcatacaaagcctga

SEQ ID NO: 97604 - DNA, 753 bp, Glycine max
  Peptide Sequence Number=SeqID_214382
atgattgcaaaactgaaaggatgttttgaagagttgatttgtgggaatttggcatgttgctggattctgatgtcactgattttgagcaattattcaatgagtatagagaaatatgatagtggtcaattgttgtcagacactattcaacctgctgatgttggccttaaagaagaaactgcagacgatgatcgagggcatggattttttggcactaatgcacttagtagattagctcgatgggctcaaccaataacatatgtggacattcatgaatgtgataattttacggtgagcttcaccattttaggacacaccagtgacaccactatgtgtatattttgtttccctacttcttcagttattcctctccatgaccatccggggatgactgtatttagcaaacttctctatggctctttacatgtgaaagcttatgactgggttgagcctccctgcatcatagaaagcaaagaaccaggatatgctcaagtgaggagagtagcgcctattgtagagaagatggtggaaaatagacttaggtggtttgggcatgtagagagaagaccggtagactctgtagtgaggagagtagaccagatggagagaaggcaaacaattcgaggcagaggaagacccaaaaagactataagagaggttatcaaaaaggatctcgaacttaatgatttggatagaagtatggtacttgatagaacattatggcggaagttgatccatgtagcccaccccacctag

SEQ ID NO: 97605 - DNA, 201 bp, Glycine max
  Peptide Sequence Number=SeqID_214383
atggtccactataatagtaaaattcttgtagtaggagaaggaaagggaaggtttaggcgcaaaaggggtgtcaggaggggtaaagggaatgaagaagaggaagggatgaaaaattttgaaatggggatcagaatagtctttttaccttcagtacaactagaaattgaatatacgactttagttattaggatgacgttctaa

SEQ ID NO: 97606 - DNA, 876 bp, Glycine max
  Peptide Sequence Number=SeqID_214384
atgaagctttacttctacaccacccacaaggcggccagtcgtgtggtggcacgagtcgaagctcaccattctgaagtccctgacgggccacgagatcgaggcccgctacgagctgggtcgcgagtgggcatagaagaggaggaggcgggtgatgccggagtggttgtggagttcaccgatggctttggggaacacgtggcggccgaagattttttcctgggagaggcattgggtttcggtgaagtggcaggtgtagctggcggcacccgagtggaacttcacgacgtggaccatgtcgttgctgtcaaagaagtggttccctgcgacgggctcgtagagtgggttcgcaccattgcgaatgtagacgcattcaatggatttagggatttttccaatcaccgggaggaactgatgcgccaggtgctttggcacgggggtgaagttgccagcgatttggacacgcgggttggcggttttggggagtgggtgttgccgctcatgggagaccaaggctcgattactggtttggtttctcttgccggggtggtggcggtggtggttgttgttgtttttgttgttgtggtgttggaggaggaattgattgcaaatgaatcatctggcaagcaagtagtaggtgaaactagtgtccaaattaactgttctgatggagatggattaactgaacttgagaaactattaaagcagaacactttcaccaagtatcctttgaatgatggagttatgactgaggatgtaatccaactaagaagatccactggagcacctggaatggctgttcttcaatttgcagttgttcctattgtagatgagtggggcagttgtacaaggctgttacatcgtgaagactacatagag

SEQ ID NO: 97607 - DNA, 189 bp, Glycine max
  Peptide Sequence Number=SeqID_214385
atggcgacaagtgtagtattgactgtgtcaagagtgataatagaccagatgccacacccatcaccattgatcaccatcggtagtgctacgtttcttggggatttacatctggctggcaactggagtggtttgaagacatcagttattttcaagacatggaagtgccccatgatgctcatgaatttgtag

SEQ ID NO: 97608 - DNA, 954 bp, Glycine max
  Peptide Sequence Number=SeqID_214386
atggttagaactagagcttcccagcgacgaaggcccacagcatttgcacgtaggcaactggaagctatccctattgctgagaatgttcatcacgtggatgacgcagttgacgaggtccacaaacaacctcaagaagcagccattgatgataaagttgttgatgcccaaggttttctaggcgggccacatgacacattagttctgactgcctatgttgatcatgctgcagtcattgtttggaatgaagaggaacgtcctgaattgaagttatcctcccatggaaggaaggttcagaaattcggcagggctactgtagagattgaaggcttagttgctgccattggattaagtcctttgattgcatgttccttggacactggcgattggagacttatatcgacttttgtagagagtgggcataaggaaactaacaattttcatctttctataggagaggtgactacaccctcgatgatcaaatgtgatgttgcacactggactgtagcaactcaagcttatctgctgcatttgctaggttgcactctttttgctaacaagagtgcaacacacatgcatgtggtgttcttggacacttttcgagacctcgaccaaagtggaagctacgcatggggaactgcagccctaatgcatatgtacggcaatttgaatgatgcatctaaaagcagcgacaaacaacttctcgaatatatcatactattacagtgttggatttatgagcattttccatttgttgttgaggctattactgttgaagattatcatgaaaggaaaccatgtgcttgttgctggacctctgggaaggcattaccagtgtcgacgtatcggaagcgtctagatagattgacgtctgatggtgtttgctggatgccttacggtgaccaccatgcaattagagagtttgagctgatttctttgttttccggacatatctga

SEQ ID NO: 97609 - DNA, 184 bp, Glycine max
  Peptide Sequence Number=SeqID_214387
atgactacatatgttaaaccagatattcctcagtactcggtggatgctactactgtggaggatgcttgccaagaaatagctgaaaggttaaaacgatggttgaacttgaggataatgacagaaggtactagagcatacaatgtgatggaagcattgcctaaggatagccagaggtgtcactacg

SEQ ID NO: 97610 - DNA, 438 bp, Glycine max
  Peptide Sequence Number=SeqID_214388
atgaatgagccaaaaggtgtgaatctagacatccttaagaagtattacaaagaagcttatgatgctgtgaggaagcacagctcaagtgcttatgcgatcatgtcaaatccattggatgcagattctaaagtgattctctcatttgtgaaaggctttgacagagtagtcattgatgtgcattactacaatctttattcctgcaaattcaacaacatgaatgctcaacaaaatattgacttcataagagaggatcctcaaatgctgagttttgtagcgcatatgaaaaacaaaagagtgggaaataagtggactggtgcatggcatgcgtctaaggaagacttaaaaaggtatgctcaagcacaattggatgtgtattctcgtgcaacttttggacgggcttattggtccaacaagtgtaggttcaacgatggatgctag

SEQ ID NO: 97611 - DNA, 672 bp, Glycine max
  Peptide Sequence Number=SeqID_214389
atggctttatggatgatagtgaagattcattttaggagctatcaaattcttctcaccaacgattcaacatcctatgttgtgcatctaaagatggaaacatttgttttgaacatgcacaacctcacttttcctacttctcgtgatggtttagaaatgagtaacagagtttcaaatgcttctacacaaggacttgatttgttacctcaagaggagtttctaagccttttgggtggtgcaaagactagcccaccagttcatcaatttctcgttaacactcttggaggtctgatgataaaggtgaaggcggacatacacccaatctccaattgcaaggtgagcatcgcggcgatgcttgtttgccatagttttcatagcctcctaggccttgtgcaggcggcgttgcagggtcgtgtgaattgcggccctgggaggtttgccataaacaacttcaaaaggggagatgtcggtgccggaatgtatggcacgcaattattgttccaagatgcggttaagaacttctgtttggccgttggactgtggatggtaagtcgtactcatccagagtttagtaccactcagacgaaaaagctcgcgccaaaagccactgatgaagatgggggagagcaccgaagtgagcccccttggaaaaacggtccacgaccaccattatga

SEQ ID NO: 97612 - DNA, 618 bp, Glycine max
  Peptide Sequence Number=SeqID_214390
atggatgggaaaaactctctacaaataactagaagtggtactggtgcttatgatgatgatggacatgccaaaaggactggttataaaaggacatgtgtagttggcttccttcaatttttgactttgtatagtactagtgttgattatgtactaaccacagcaactagtctgaggactttggttgcacttgcaaaaaatggaagaattatgggaagcttgacaggaataccaactgataaaattgctgacaaactttggttagtcttccaagcacttggtgacattgcctttgcttatccatactccattctccttcttcaaatccagagtctcctccacgaaaatcaaaccatgaaaaaggcctccatgattgcaatcttcattagaacattcttctacctgtgttgtagatgctttggatatgcatcttttggaaatgatacactaggaaacctcttgacagggtttggcttttttgagcctttctggctcattgaccttgctaatgctttcatcattcttcacttggtgggaggatatcagaatcttgctggtattttactttataacttgctagcagatgagtcatccttaggttcaactctactaaccatataa

SEQ ID NO: 97613 - DNA, 299 bp, Glycine max
  Peptide Sequence Number=SeqID_214391
atgccggagcaccatacccgccaagttacttctgataagctcaaggaagccgtcaatcaccttacacaaggccaagcttctttgaaccaaaatcacaataaccttaacaccaaaatggactccctcaatgccaaaatcaatttgattttggatcgcctcgccaccatcactgtcacaccaccgtcaccctcatcttccccgcatccacctccatctccagctcatcgtccacatatgaagctggatgtgccacgcttcaacggccatgaccctctcggctggatatttaaaatatccca

SEQ ID NO: 97614 - DNA, 346 bp, Glycine max
  Peptide Sequence Number=SeqID_214392
atgcctgagcggggcgaagccagaggaaactctgtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtg

SEQ ID NO: 97615 - DNA, 297 bp, Glycine max
  Peptide Sequence Number=SeqID_214393
atgtcatttaggacttatgagaaagtttgggttgtgcaagagagaaaaacaaatgaccaaagtgaacaaagagccatttctaggattttgtgggagcttgagaggattgatggggacccggcgttgagaggaacgaggataagggttacgtgggagtacgtgagctcagttggaggtgggaaacaggggatggtgggtttatacgtgatttgtggatgtggagaattgtcttgcaccatcgcccgaccgccacctagtaccacatgtgatgggtaccccataatcctacaagcttga

SEQ ID NO: 97616 - DNA, 105 bp, Glycine max
  Peptide Sequence Number=SeqID_214394
ctttgagggcaatgctggtgcactcagaaattttgaggtccttgatttcttacgagctaaaggagcttcaaaggatccaacaagagttattgccaaagtagcgca

SEQ ID NO: 97617 - DNA, 313 bp, Glycine max
  Peptide Sequence Number=SeqID_214395
ccaggtggcttggcctggagtccagccttctccttcgggaggggataaggcctccgcagcccaagagcctgtgctagaggatgacgagcccgtccctcgtgagccatttgtttatgagactgatccaactagtgctcaggaagaggtagcatcaccagagcccgttcctcacccatcaccagcaccagtccttgatgattcccagccatttgccccagcaccagtgcctgatcagcctcttgctcaggaccctccagctgcaccagtgttggaccttaacgagcatgcagaggatcatttgcagaatgattga

SEQ ID NO: 97618 - DNA, 633 bp, Glycine max
  Peptide Sequence Number=SeqID_214396
atgtcagaaaatggcttaaatgcagtgagaatacctgttggatggtggatagctaaagatccaaaccctcctaagccttttgttggtggatcattggaagcattggacaatgctttcatttgggcacaaaaccatgggataaaagtgatcatagacttgcatgcagctgaaggttcacagaataggtttgaacacagtggaactagagatggagaaatagaatggggagattcatacataccaaacacagtccaagtcatagacttcttagcagaaagatatggtaacaaaccaaacttaggaggaatagagctaatgaatgagccatttggtgtgaatctagagagccttaagaagtattacaaagaagcatatgatgctgtgaggaagcacaactcaagtgcttatgtgatcatgtcaaacccattggatgcagattctaaagtgcttctctcatttgtcaaagactttgacagagtagtcattgatgtgcattactacaatcttttttggaacggtttcgacagcatgactgttcaagaaaatattgacttcataagaaatgaacgtgtctctaatcttggtggcgtctcttccacaaatgctctgagttttgtagtcgatctcacctaa

SEQ ID NO: 97619 - DNA, 1953 bp, Glycine max
  Peptide Sequence Number=SeqID_214397
atgggtaatgttttgccatacaaagctgtgaatctagcaaactggctggttgtcgaaggatggatgcaagaaccctctctctttgatggaattgtcaacaaagatctcttggatggaactcaagtgcaacttaagtccacaaagttcaacaagtatctcacttctgaaaatgggggtggagctgatgttgtagccaaccgaggttctgcttctggttgggaaacattcaagctgtggaggatcagtgactcatccttcaacttgagagtgttcaacaagaaatttgttgggctggaaaatcatgggggtggaaacaaaattatatcagtttcagactcacctagccaaccggaaacatttgagattataaggaataataatgaccccttcaaaattagaatcaaagcatcaaatggtcggtttttacaggttcgatcggagacattagtgactgcagattatgaaggcacaaattgggatgaaagtgacccatcagtctttcgtatgaatattgtaccagacaccaccttacaaggagagtaccaacttactaatggttatggtcctgatagagctcctcaagtcatgagggatcactggaatacatacataaccgaagatgatttcagattcatgtctgcaaatggcttaaatgcagtgagaatacctgttggatggtggatagctaaagatccgaatcctcctaagccttttgttggaggatcattggcagcattggacaatgctttcatttgggcacaaaaccatgggatgaatgtgatcatagacttgcatgcagctgaaggttcacagaatggaaatgaccacagtggcgcaagagatggatatacagaatggggagattcatacataccaaacacagtccaagtcatagacttcttagcagaaagatatggtaccagaccaaacttaggagccatagagctgatgagtgggccacgaggtgtgaatctagagagccttaagaagtattacaaggaagcttatgatgctgtcagaaagcacaactcaagtgcttatgtgatcatgtcaaatccattggatgcagattctaaagtgcttctctcatttgtgcaagactttgacagagtagtcattgatgtgcattactataatcttttttcaagcgatttcaaccgcatgaatgttcaacaaaatattgacgtcataagaaatggacgagcctcagatcttagtgtcgtctcttcctcaaatgctctgagttttgtaggggagtggactggtgcgtggagcatacaaggtgcgtctaaggaagacctcaaaaggattaacgaatggagcctcagatggatgatccaaaacggttacatatgcctctcatgtcctcaaaatttgccatacaaagctgtgaatctaggaaactggcttgttgttgaagggtggatgcaagaaccctctctctttgatggaattgtcaacaatgacctcttggatggaactcaagtgcaacttaagtccacaaagttcaacaagtatctcacttctgaaaatgggggtggagctgatgttgtagccaaccgaggttctgcttctggttgggaaacattcaagctgtggaggatcagtgactcatccttcaacttgagagtgttcaacaagaaatttgttgggctggaaaatcatgggggtggaaacaaaattatatcagtttcagactcacctagccaaccagaaacatttgagattataagggataataatgaccccttcaaaattagaatcaaagcatcaaatggtctgtttttacaggttcgatcggagacatcagtgactgcagattatcacggcacaaattgggatgaaagtgacccatcagtctttcgtatgactattgtaccaggcaccaccttgcaaggagagtaccaacttactaatggttatggtcctgatagagctcctcaagtcatgaag

SEQ ID NO: 97620 - DNA, 243 bp, Glycine max
  Peptide Sequence Number=SeqID_214398
atggctgttcccataaaccaacacggggcttttcaatgtgttttgtcctcattcacacgcttattgggaaacttcctagaatgtcactcatcccataactactccaagccaaacacgtttaactatgtagttcttgacatagagatccttgtatcaaaagtcttcttggcagtgagtccatatacaaatattgaaagtcttcctagtaacatggaggctagacatcgtttcccatggctatga

SEQ ID NO: 97621 - DNA, 999 bp, Glycine max
  Peptide Sequence Number=SeqID_214399
cttgcgaattgcggaataaagatgaggctcgaggattttaagccttcggagactcagttctacgattttattgatctttcggggaatgaaatttcagggagtgcgattgggttggtgaatagtacggagtatttggtggggttttgggtttcggggaacatgttgaagtttgatttggggaagttaaggtttggggagaggtttaagtatttggatttgtcaggtaattcggtgtttgggaaggttccaaacagtgttgttgggcttgagaagttggatttgagttataaccatctttgtggtcagcttccaaagaataagtttccagctagtgcttttgtcgcatatgcctacaagttcagtgctccaatatggtcaatttcatggaaagagagaagcaaacacttctcacattcaaacaaggatgaatcagtattgatgaatcaaatattcttctctcttgggaaactgagcaagactgctgcaaatggaggcctccttgaaggactaattcctcaccaacttggaaacctctccaatctgcacacccttgatctaagttggaatatagatatcagtaccaatgatcttagttgtcttgttgagcttcatttggatgattgtgggcttccagatgtcaatcccaagtctctctctcatgttaatttctcaactactcttgaagttcttcatctcaggtcaaacaatctctcttcttcagtattcacatgggtagggaatgttggtggtggtagccttatggatctccagttagatagtaaccaattgaaaggaccaattcccaatgtgtttgcatgcatgtcttctcttgaatatcttgatctttctgaaaatgaatttgaagggtcaatactcaataccaaattcattccaggacctgtcaacaactcatttacagggccattccctgatattgctaaattttcatccttgaaaagcttttatgcaaattccaacaagttgaatgggactcttcca

SEQ ID NO: 97622 - DNA, 192 bp, Glycine max
  Peptide Sequence Number=SeqID_214400
ctcaaacattatatcagaattcccaacggtgagcattctcataattggactgcaaacgtagtgctcaaatttcacgacaatccaacggtgaacaagtttgagatcgtcatttttctgagacaggtttggtggcctacggaaaaaaaagagagggttttgggagaagagagaagaaacgaaattgtgaggtag

SEQ ID NO: 97623 - DNA, 216 bp, Glycine max
  Peptide Sequence Number=SeqID_214401
atggttcaagttgaagccagagaccataacatggctggactttgtggagtgtccaaaggaatttttaaaagggagatagataaaaagttgaagaagtcagagaccttaataagggtggactttgtggagtgtcctaaggttgaagtagtctatggttcaagttggaaaagtggggaccttaaaatggaggaccttgacatagacttgatggagtag

SEQ ID NO: 97624 - DNA, 648 bp, Glycine max
  Peptide Sequence Number=SeqID_214402
gtggaacaccagcgtcagggtgccgaacaccagcaccatcaggaaggtgatcagcgtcatcttctcgaccttgcggtatttaacccaggtgaacaccagcgccagtgcggtagcgacgatcaacgcgccggaagcgacgtaaatgtcgtacagcttgtaaaaagcgaaaaagacaatgaacgggaggaaatcaagaaactgcttcataaatcaatccatcatctgttcatcggccgactataccggattcggcgagctctgtgtaccgccgggcgctgccgattatcggcgtttggccggcggatttctgccgcgaaagcaggaatttgcataaacttacgtgagaaagcgcgggcgcattgccagcgcgcgccacaggccgcatacatgcagtggaaatctctccaggccctgacgcctggtttgacgcatttattgggctatcaacgcagttggctcaagccggatattcgcgccggcctttccgtcgccgccgtcgccttgccggtggccatcgcctatgccgagctgcccggggtcagcccgttgttggggctctattcctgtattttgccgatggtggcctatgcgctgttcggctcgtcgcgccagctgatcgtcgggcccgacgccgccacctgtgcgtga

SEQ ID NO: 97625 - DNA, 378 bp, Glycine max
  Peptide Sequence Number=SeqID_214403
atgattttaggggaagagaggttgaaaaggatcctagactttctatcacaaggagaatattgccaactggtagaggaaagtatagatgttgtgtgcaagaaaataaaagagcttcgcttacaagcacaatgcattgacaagaacaaggatgatgtcattgcattagtgatcaatgatgatacaaaatctaaggggttcaagcaacgacctagcataaagaggcacaaccaaaaacatctcaaaaattggcccgagttacaattaaagaagaagaaaaaagctctaactagaggtcaatcacaaagtcaaacatctaaggcaccccttgatgacagagatatttcaacattggatgacataaacattaagaatctttga

SEQ ID NO: 97626 - DNA, 384 bp, Glycine max
  Peptide Sequence Number=SeqID_214404
atgacaaaagaaaatggtgattggaagccaaaaagtgatttagagtttgaagatgtagaagaagcatgggaactttggagtaaatatggtgagaaagtagattttggagttagaaagcaagtcaaaaacaagcgaaaggaagatggtgttataacctcttgtagatatgtttgttacaaggaagggattagaaagccagataaaaggaatggacaagctaccaagcacagagctgagaccaaaactaattgctctgtaagaattgaaaagcataaccacccattacaactttcgaagacaacacacatgtttgcttcatatcgtaaaatcacacaagttcatgctcacaagattgagttaggtgaagactctggattatgctag

SEQ ID NO: 97627 - DNA, 285 bp, Glycine max
  Peptide Sequence Number=SeqID_214405
atggtgttggattacgggtattttggtaatgttgtctctttggatgctacttatgaccaagcaatgactaaggcacttgttgaagtaatgtctgagacacatcatggtttatgtacatggcacttgatgcaaaacggaattaaacacctcggcaatttgatgaaaagaggaagccattttctaagagatttcaagaaatgcatgtatgaatttgacactgaggttgagtttgaggaggcttggaccaagttgattgcaaactacaatattcaagaaaataactag

SEQ ID NO: 97628 - DNA, 502 bp, Glycine max
  Peptide Sequence Number=SeqID_214406
gattgaagttctagataaatgcttttgccatgacacagttgaagagattgttgatgcgatggaaaatgcggcaagtgaaacaaatgatgcatggtgcatttctaccctaaataaactcaaagaagcttctccattgagcttgaaggttgctttgagatctatacgggaaggtagatttcagacacttgatcaatgcttgttgcgtgagtaccgtatgactttacaagcaattcataggcagatatctggggacttttgtgagggagtgagggcacgcgtggtggacaaggactttgcaccaaagggtgttgtacaccttcccatgctccacaacccactgctcgaacatggtcgttacttccttgttactcctcctagttgcagtgcctccggagttggtggtggcggaattgcaccatgcccggtgacacgtcacgaatcggagaagcaaagcctatctatgaagaagatgaatgccatcgtttatgatgagttgggttga

SEQ ID NO: 97629 - DNA, 123 bp, Glycine max
  Peptide Sequence Number=SeqID_214407
atgaggctgaaaaggggtgaaaacccctgtgtgtatctttatgggattcgcgatgaacgcgctaagcgcgacttgctacgcttagcctgttcaccgcaattgctaagcgcacctgtgcgctaa

SEQ ID NO: 97630 - DNA, 372 bp, Glycine max
  Peptide Sequence Number=SeqID_214408
atgatgatgcagagcaaaagggcagggtggtggttgctcagaaaggcaaaggcaaagctgagtcttaacactgaccgaaacctctcttcttctcaacacctcattctcgacaaccccaatctcaatcaggttttggtcgaaggaaatggtttctccagaatggccattctcaatagaccctctgctctcaatgctctcaacaccaatatggcggctacactgcataaactttataggagctgggaagaggaccctgatattggttttgtgatgctcaagggcagcggccgagcatttgcagctggtggagatattgttgcgctttaccatttgataaacaaagtggaacttgtgaatgtggggatgatgtaa

SEQ ID NO: 97631 - DNA, 285 bp, Glycine max
  Peptide Sequence Number=SeqID_214409
atgactagagggtgtcacattcacgatgttttgggaccccaaattgggatccctatttggagaatcccatgggatcgccacaaaaatggtgccatttttgacagtgacgaggagggtggggccgtcggtgaacaccacattggatgcagagaccaacaactcatcatagttgaaccacacaaaaacatgtcattgcgagattgggcaagttggggattatcgttgatggtggtggtgttgaggaggatggcaagttgtcatcgacaacttgagagtgaacaatag

SEQ ID NO: 97632 - DNA, 291 bp, Glycine max
  Peptide Sequence Number=SeqID_214410
atggctgagttggtggatatccttaaccaggttgctcttctgaatggcattaccatgggtggtggggctggaatttcaatccctgggacatttcgagttgcaacagacaaaactatttttgctacccctgaagttcttattggattccaccctgatgctgcagcatctttttacctttcacatttacctggtcaattaggagaatacttggctctgactggggaaaagctcaacggagtagagatggttgcttgtgggcttgctacacactattcatcaagtgcagtttag

SEQ ID NO: 97633 - DNA, 348 bp, Glycine max
  Peptide Sequence Number=SeqID_214411
atggaggccatgaaagagcaaatggacacaatgatggaggccatgatgagcatgaagaagataatggaggtcaatgcagctgcaatagccgctaccagcaccattgctgaggtggacctgccccccccccccccctatgggcccaaccaaaaaaatcatcccaccccctatatgggaaggctggaaaggaaaaaattgggagggaccaacgggcctcatttaatggaaaaaaaaaaacatggcttcctggcctatgggttttttccccattttacccccccccatgggacgtacactcccaaagaaaatgtcaataactcccctcccaaactcattgagagccaataa

SEQ ID NO: 97634 - DNA, 2106 bp, Glycine max
  Peptide Sequence Number=SeqID_214412
atggctgaagcaactcgctctaagtccaccatggatcaacttgaagataaacaaaccaacacaaccaacacaccagcttcatccgctgccacccctcatacttccacaccatcggattctcaacatcgtttgaagctcaaagttcctcgcttcgacagctctgatccgactgggtggatatcacccagttctttgaatatcattataccccggaccatgaacttgacttcttggtctgccttgcttcatgcccttaaagcccggtttgccccatcaacttatgaggaccctacgggactattattcaagctcactcaacgtgcttctgtcaatgagtacttgtcggagtttgagtccctcacaaatcggattatcggccttcctacgccatttttgctaagttgcttcgtctccaggctcagcccggagatccgtcgcgaggtacaagctttgcaactgctatcattgattcaggcggcttccttagcccgcttacaggaggaaaaatttcttgatacacgacgtcctgaccgttacaaacctcctccgatcacaacagtcgtggatgaggatgaagccactctagaaacttcccttgcgaccctgaacccggttctaatgcgtggccaattttctctcaaactgcctaagtgctcttttgcccagaatcagattaaataccttggtcatttggtatcgaagaagggagtcgaaccggggtacgcaaccttagcaactccactgacgaagctcctaacttgtgaccaactcgtgtggtcatctgaagctgaccttgccttccaatcactcaaagataccataagcaatacccctgttctggttttaccaaacttcaacattccttttgttgttgagatagaagcttcaggttcgagaatgggggcggtgttatctcaggatggtcacccatcactttcatcaacaagcagttctgtcctaagttactgcattcctcgacctatgtttgagaactcgccgctatcacgacggccgtcaagaggtggcgccagtgcttattttgtcaaccttcgtaatgtaattcaagttgacccagcagcttatcctgattactctttgactcaagatttcattatgcagaaaggtcatatgagagtctgtaaaactttggctcatttgaaagataacttcacttggagcaccattatggaggatactcgaaagttcattgctagctgcttggattgccagcataccaagtatgaaactcagaaaccagttggattgctttgtcccttgccagtccctaatcgaccctgggagaatttatccatggacttcatcgtgggacttcctgtttatcgtggtcacataagcatcctcatagtggtagacaggttctcgaaggggcttcatttgggtatgctccacacccaccacactgcgcattcagtcgcccttctttttatggagatagttggcaaacttcatggcatgcccagaagtattgtttctgatcgagatctattgtttatcagtacttctaaaattgaggcagtggatgaaaaacttggtcaacggaaagctgtgtttgccttgttacgaagaaagttgttgaattcacaagctcgtatgaaacacattgcagacactcatcgaagggagcgcaaatttcaaattggtgattgggtgatggtgaagttgcgccctcatcgtcaagtattggccactaggtcatcatattcaaaactagctaagcgtttttatgggccattccaagttgaggatcgaattgggaatgttgcttataaattgaagcttagagttgcctccttcagcaatggaaaaccaacctgtcattacacctttgaccttccttgcaacaaaatggattccttcttcttctgggccaaagcaaatggtattggttcaatggtcgggttgcatcctgatgaaacctattgggaggagtggtctgaattgaaaacaacatacaaccttgaggacaaggtgttgcttgatgggctcggaaatgatacagcaaatactgggggtctgcaagaagcaagagccacaaggcccaaaaggaagagtggaccaccagcttacttgaaggattacgcgtag

SEQ ID NO: 97635 - DNA, 153 bp, Glycine max
  Peptide Sequence Number=SeqID_214413
atggagaaggtttggcattttgcgtggttgccctggggtaaccaacttgtcccgcactttctcgcccttcatcagccacagagttttcatcctgcaggaccttggaaccaagttaagaatgataattgtctaatcgaggcaagagtgatctga

SEQ ID NO: 97636 - DNA, 1125 bp, Glycine max
  Peptide Sequence Number=SeqID_214414
atgttggactatgaatgggggaacccgtccacgataatgctctccggaaacgaagacagctccgccgcgggctccgaccaaacccaccgtcaaatcttcgaccactatgcgtcccacacactcatccccgaccacttcctacacgcgccaacgcactccaccgccaccaccgccgccgcagccaccgtggatttcacccatcaccaccacttcaccccgcaaccccaccaccacaaccaaaaccacatgaaccaccaccaccaccatgccttcttcgacccacgcgcttttcatggcgcgtcgaacacctcttaccccccaccccattccatgctctcccttgacccgctacctcacgtcaacgcagttgggcctgggcacgggcccggttccgggccaggcggacttctccttgtcccaaagtctgaagacgtcggtcggcccatggactttgtcggctcacgaattggactcaacctcggaggacggacttacttctcatcctccgaggatgacttcgtgagccggctctaccgtcggtctaggcccgtggaaccgggttcgactgcctcgtcgaactcgccgcggtgtcaggccgagggatgcaatgctgatctgtcgcaggccaagcactaccaccgccgccacaaggtgtgcgagtttcactccaaagccgccaccgtcatcgccgccgggttgactcagcgattctgccagcaatgcagcaggcttggattggaagggtggggtggaaaaagacgaaagtgcccttgggggagtgttgataatgattgggtttgccgtacgtggggaaatcccgatggcatttgcgtccctaacatgttccatcttctttctgagtttgataacggaaaacgtagctgcaggaagagattggcagatcataatcgccgcagaagaaaaacacagcaaccaactcaagaaattcagaaatctcagtcttctttggagaatgttgcaagatctccaccggactccggagctcagtcttcctcgtcggtgactgtggcagtgtcgccgccagactatttccggcagaggccataccaaagcacgaacccttcatctactacttcaagctcattgtttttctcaagcgggtag

SEQ ID NO: 97637 - DNA, 642 bp, Glycine max
  Peptide Sequence Number=SeqID_214415
atgagtgtgagtgataacaggtttgtgatacacataaaggcgagggcatactttgagaatgtggaagtgataaggaagaagatgaatctaatgtttgttggagattatattggaaagatagtagtgaaaggtagtaggaatgttgtggatggatggaccacttttcaatctgttactgtttgtaagtattgtcaggcgtactgtataggttcacaaaatacatgtggcatcttacgtggcatttcgagacacatatcaactctccatgtcagccctagcacaggcgcatggatgcccaacccttggcagtcgggctcccaaaccgacagcataggccaacatgtgacaaacctggaagaggtctttggagagcttcgcgaatacgacaagtgcctcaacccgaaaaaatgtactttcggggttggcggagacaagttcttgggctttatgatcacacatcagggaatagaagtcaaccccaacaaatgcattgctattttggagatgtgtagtcctactaacatccaggaagtcttgaagctaaatggaatactagcatcccagagaagaggaagaaccagactggatgaccccctacaggaatttcctaatctgggggctattgcattcagacaagaatga

SEQ ID NO: 97638 - DNA, 1020 bp, Glycine max
  Peptide Sequence Number=SeqID_214416
atggttgtgaggaacatgtttggtttgcccctagttgaaggtcttgccaaccagtctagggactcactaagtgcaaatcttgggtttgacgagcctttggagaaacgaccagagaattgtccgtccagggtttttggagggattcaccagcaagcttggtgtgtgcaatgcgtgtgtcgtgctcttgcatacatacatggtgcttttgcatacgtgttactcgtgaggtggcacatactggagacttggtgtcgtgctcttgcatacatgacacttgtgaagtggcatgtactagacgctgtggtgctcttgcatacatggcacttacatggtgctcttgcatatgtgtcgcttgtgaagtttcatgtattggagacatggtgctcttgcatacatgtcccctatgaggtggcacgtactagagacttgattctagaaggaaggctcaccaagcacgttccttgggttttaagagcctgtgtagctatgaccatggatgcacctgtcttgacgacacaagaaaattatgaaaaggaagggatgtcaactgaagtagaacttcaggcttgttgtgaccctaaatgggccttcctagttagggcaaaccattcccgctcgggaatcttttctggcttcaccttggactcaccatacgaggtcactaagttgaaaggctcaaggctaaacttttgtattgaatctccttactgcttagagtttggtagcttcttccctgatcctagccatttcttggacttcgtctgttgtctcaagctctaccctcatgttttcttcattttgttgttgttggaacaacaatctctttgtcgatggttccccgacttcaacaagaataatggtgtatgtgcattatgtgagtcgggccctgaggatgactctattagctgcctctgcctggccgttggtttgaggatgttcgacagaggtgacaaggccatacctgcaaatgaggtgtttccaagtgaatttctccacctcattggccataatttcccgtag

SEQ ID NO: 97639 - DNA, 108 bp, Glycine max
  Peptide Sequence Number=SeqID_214417
atgagtttcagtgtcagtgaagatggtgaaccaaaacaggtgaaggtgacagtgtgctgcgaggattgggctggtctgaaccgggaggtagcccaggcgatccggtcg

SEQ ID NO: 97640 - DNA, 333 bp, Glycine max
  Peptide Sequence Number=SeqID_214418
atgctctctcgcgatttggagcagaaatgggcaccaaaggttgaagctttgtttggagcttcaatggagaatgagggagaaagaaaggcaacaatgggggaaggagattggaatcctgaatcccgatcaagttataacctttatgatcctattgctcgctccactgtgcaagtgtaccctggtgggtggagttcagtgtatgtgtaccctgacaaccctggaatgtggaacctaagatcacagaacttgcaaagctggtatttaggtgaagagctgtatgtgagggtttatgatgctgatcccaaccctgccaaggagaagccacctccatag

SEQ ID NO: 97641 - DNA, 720 bp, Glycine max
  Peptide Sequence Number=SeqID_214419
atgaagcttaattgcttctgctttttaacagttatcccaagtaccatattcaggcattgtaacttgtatccgcaagtgaattggatgcagattgtgtattgtgagctggagtctcttgatgttcatgtaggccaatcctacttagttcttgtcacaacaaaccaaaatattgctgattactacatagtagcctctcctaaactgagtaatgccacaaataataacactcttgttggtgttgttgtgcttcattatgacaactctaccacaccggctattgggtctcttccaagtggtccagatccatttgatatgcaattctccatcaaccaagaaaaatccattaggtggaacctcaccactggagctgcaaggcctaatccccagggaatgttccatgtaacaaatgtgacaataattgaaactttcattctaaatgcatcaacaacaactatttatgggttatcttgctactctgtcaacaatgtgtcttacttgatcccagatacaccactgaaactagctgatttcttttccaatagaactggtgtatatgaacttgatgctttttctaagaacacttcaaatgctaacgccgtgcgtggagttttcgtagctagtgccttgcataaaggttggactgagatagtgctagaaaacaatttagacatcattgatacttggcatttggatggatatagcttctttgttgttgggtaa

SEQ ID NO: 97642 - DNA, 405 bp, Glycine max
  Peptide Sequence Number=SeqID_214420
atggccacacctccaaccagatcgaacctggctcgctgcttctcgaggaagacagcaagtccactggttgcaataagtgcaatgagaatgacgttgaccaccactttattcaccacaaatagaagagtgggagagcaaaaagggcagatgaaggtccaaaggcatatcgagtggagaggcacaacaattgctcacgaatcgtgtcaaaggtgtgagatcgacaaaaagacaaaggatagtattgcaatagatctttttggctttattccatacctcacaacaagtaggataagcttgaacttgcggctaaaggaaaagaagcatggtagtgggctagtcagagagtgggtggcgttagaaaactgcccaggtggatcttgcatgctggtaaggggtggcatgtga

SEQ ID NO: 97643 - DNA, 663 bp, Glycine max
  Peptide Sequence Number=SeqID_214421
atgatccaaataactttgaggttgagacttgctaggttgattggtacttctacggatcaagatgtccccaagacttcccaagaacctcttgcagttgttgatcctcctcctcctccttgttatccttcattttgtctaagccttcttcctacaaaaaggttattcttgatcccctttggcaataggctacgcaagagtaactttttgccttacataagacagctacttgggatgtggtatctcttcctccaggaaaacatgctattagctcttgttggatttacaagatcaaaacaaagtttgatggttgcctctgtttgtcagtgggatatatttcaaatggatattaaaaattcattcttaaatggtgatctccaagaaaaggtctacataatacctcctctaggtatttctcataatctagggaggtgtaagttaaataagcctctctatggtctcaaacaagctccacgtgcttggcttgagaagttctccattatcattgcatctcgtggttttcattctagtgattatgattctgccttgtttctaaagaccactcctcaaggtcatattatactctccttatatgttgatgacatgcttatcacaggggatgatgaggatgagattgcagagttaaaattacagataacaagataa

SEQ ID NO: 97644 - DNA, 267 bp, Glycine max
  Peptide Sequence Number=SeqID_214422
atgacgaaattgaagacgaccttgtctcctgaaactaaggcagttgcacctaagtggattgaagtaaagagtcacgttcaaaccggctgttatgaatgtggatattatgtaatgcattggatctggaacatcatagccagcgacataaagagtgactggtccatgtggtttgctaatgacacaccgttggacatcgacatgatcaccacaattcgaaaaaaatgggcaacattttttttaaagatggcaataagtaaaaacggctaa

SEQ ID NO: 97645 - DNA, 393 bp, Glycine max
  Peptide Sequence Number=SeqID_214423
gttccacaaagtattccacacaatgaggatgcacatgtgccgaagccgactaatgtggacgcagatgatccgttgcgtggattgataaagtacagtttcgatatttacgacaacccacttgaaatcaactttgatgggagctttcttggaattgtagatgcatctgcatcgatattcattacatattcagatgttagtgaaataatagcaggagacaaaagtctgaacatatctatcatacaattatggttaatgtatattcatgagtggagtcagatattcagtcaaggtttcatgtatgcattccttgagccacagtcgttggtttgttcaaaggaaagacgcagcgaatgcgaacaatatcttctaagatggcttaaggaatctgactga

SEQ ID NO: 97646 - DNA, 414 bp, Glycine max
  Peptide Sequence Number=SeqID_214424
atgcgtaaccaaatccctaatccatactcatgttctttaaaccaaaacttagaactccaagccaccacaattgcaagcccagaaacaccaccatttggtactcacttcgaagaagataagagaggacataatggaggaaacaacgacggtgaagctcaccatgcacaaccagtaggcaaaggtcgtgatggtgcccttcatcctcgcacattggtcatcaaggcacttaagaaacacaaggaagatagaaaaaatacaaagaacaataagcataacgggaacatctcccacgatagaatctttgatattgcgagggtgatgaggtcgtgctccatggcgaaggatctcaatgacaccattaaggagatgttggggacttgtatatcaattgtgtgcacactgccaacttcttga

SEQ ID NO: 97647 - DNA, 348 bp, Glycine max
  Peptide Sequence Number=SeqID_214425
atgggaacatatatacagatagccatagacccagagagagacaatgtgcttctctctacacttgcactattgcaggcctcagctttgtttggttttggatggacaaagttgatatacttagagaaacagaaagtttttagttcctctaaatttctagatgaactaagactgagggcaccaaggaagggagagggagagggtgcggcgagtgaagagggcacagaggaaacccatagagaaaaaaagactgaggtatcaacgcaatggagtggacaaagtgagaaactaagggttttcagggttttggaggaaactgggaggctgtactgtacaatttcacaagcttag

SEQ ID NO: 97648 - DNA, 1248 bp, Glycine max
  Peptide Sequence Number=SeqID_214426
atggatgcccaaccagaaattcctaccaccactaacccaaaggtcgtaaggattaacacaaactcagctgagatcaatgtgggtacttcttcaacattgaagagcttgagaaatggggactcaataacgatatttaaaatacctatagagattactggagtggtgctaggtatgaaggttgtcatctcccttactaccatagcttatgccactaggtgtgtttacaaaaagctcatggagaaagtggacgagaacaccaaaaatgccatcattgtgaaagggaagtgcaaggcaatccaacaagtgtttggatccaccaacatcaatcaaatgaagcttggttttgaacctatcaatgtcatgggcattgataagaggattcagaaagtcatggagatgcaagcatccaagaggacaactagaaaatatttttccactaaaaaagaattgaagaagtacttgtatagagaaatgacttctccaggtgacttttcagaagtcatgaatcgagttcagaaggagaaggatatagcaataaaagcccttgtcctagctacttccagacctggtcaaaggaaccctatacagaagaaaatcatttggcaaactggcaagtttgagccaattttgagaccacaagagaattcccaagacatagttgatcccaatgacattattgaaagagatcctcaaccatttattgaaaaggtgtaccaatttgcctcaactcctaaatggaagagatatgaatggtatgagcatcaatccaggaaggagtataaagctttgaagaaaggcaaaagaaaaagcaaaggtaagaagaaaaggaagattgcatctgatgaagaaataaaggagctagaagaagctattgccaatagtttgaaagatatcacctatgcctacacctttactgaaactaagttgattattagactgtccaaactgaagtttgagcctttgcatcccatggaactaggtttctatcctactgaagaagacttgaagtgtgtaggaaaggccaagacacaagtatgggtgaaaaagcacgttgttgcttatcccccaacacttcaaataagggattctacagaattcaagttaagaggctacatgcattacaactttgatgacatcattgcatgtcaatctgacttcgacaactacctccacattattgtcaccaattttcaaaagaagcaagacattgtgaccttcgagttcaatgtagtgatgcattttgactag

SEQ ID NO: 97649 - DNA, 465 bp, Glycine max
  Peptide Sequence Number=SeqID_214427
atgtattgtttcctatcaatctctttggccatcaaggatccaaccaccttccacatgatattttcaatgcaaagaaggaatagattattgaacattggaataattgagcatagtaaaaaatgtctgcactggcatcacttccatagtcaggtttggtcaaagcctaatgaaaagtgtcgcaacccgccctccggcgggggcgcgaaaaggcctctcgttcgggccaagggtgcatctttcatcgaaggaaaactcgtggagtcgccaccaacgtttattcgaggaaaacgtcgaaaaaaccaaaaatacgatggtctgtgtattttgaaaatgagggttcgggagttgtttacgcacggggaagatgcagcggaagacaaaggagaagaagtgagaggaggcgccatccacgagggaataagccatggaagaaggagcttcaccaccaagatgagccttggataa

SEQ ID NO: 97650 - DNA, 318 bp, Glycine max
  Peptide Sequence Number=SeqID_214428
atgataaatgatggaacatacgaatttggggatcccacggtcatgttgctccgcatgcccccggactctcgggtcatggtaacaaaaggtggggtggtcgacaaaagcagggcttttgctcctacgtatcctcaatttgtgatgaggaactcagacctacgtagttcttgctactgtgagactaaaaatagtctcggtgttttcttcactaaaatgcgaacatgctttagtaaagagacaaaacttctaactgatcagagcaacatatgctttttggatgaaaaacaatgtgtctatcggggaaggagagtatgctga

SEQ ID NO: 97651 - DNA, 357 bp, Glycine max
  Peptide Sequence Number=SeqID_214429
atggttatgagaagatttcatcagcatactctccttccccgagacaaattatggtcattctgcgtcttttgtcatccagaggcggtgggcccggtgacatgcggagacaaattatggttatttcgcacaccttttcgccattcagacacagtcgtgtctgatggcaggcagagacaaattgtggtcattctacgtcttttgtcatccagaggcggtgggcccggtgacatgtggagacaaattattgccattccgcacaccttttcgccattcagacacagtcgtgtccgatggcatgcagagacaaattatggtcattctgtgtcttttgtcatccagaggcagcgagcccaatga

SEQ ID NO: 97652 - DNA, 342 bp, Glycine max
  Peptide Sequence Number=SeqID_214430
atgacacgcggagataccttacggttatctgcacccttgtgtcatccagaggcggcggacccgatgatacgcgaagataccttacggttatccgcacccttttgtcatccagaggcggcgggcccgatgacaagtagagacaaaatttggtcattctgcacccttgtgtcatccagaggcggcgggcccgatgacacgcggagacaccttacgattatctgcacccttgtgtcatccagaggcggcgggcccgatgatacgcggaaatacccgagtggttatccgtataaaatttcgtttgctatctgtaagacagaacgcttgatagcatgcagagactga

SEQ ID NO: 97653 - DNA, 204 bp, Glycine max
  Peptide Sequence Number=SeqID_214431
atggatgtggccagtaaaggcagaaacttcaggaccatcgtaaagaagatggagaatgttgtcattgtcgaagaacagagaatgatttgctccatggttgaactcactgttcaacaggtggagaagctgagggaaatgagtccactttatgaatttgtcaaggaaggtatcaacatcaaggacattcaatgggcacagcactga

SEQ ID NO: 97654 - DNA, 2115 bp, Glycine max
  Peptide Sequence Number=SeqID_214432
atggctctagctaatagatctgaagggttgtctaatgaagttgtattaaattgttttttgagtaggttgaatgttgatattcgtagagatgtgattgctcagaggcctatgacattaattcgagtcgtgtccttatccaaattatatgaggaaaagtatcaaccagtaaactctaatcggacccacaattattctcatagatattcccttatttctgctcacactgctaatttcatttctactccttctaatgctgctgaaaatactacccaaacatctttgcccccattgttgcctactcctaatactcttcttcttagaaataattatgttaagaaaatttctcctgctgagatgcaattaaggcgtgaaaaagggttgtgctacttttgtgatgataagttcacatttaatcataagtgccctaacaggctgatgttaatgttacaacttgaggatgataaaggtgaagctgagatgagttttgatgttgtgtctagagataataatagtattgctgaaactgtgattgataatcctcaccatctttccttgaatgccttgaaaggaggtcttggtggtggcactattagatttgtagctcatatcaataccttacccgttaaggtactagttgataatggtagttcagacaattttctccaaccaagagtggccaaattttttaaactacctatagagccatcacccttgtttaaagttatggttgataatggtaattacatgactcctataggcatgataagagaacttagcattcaagctcaaggcaacaggtttcaattacctgtatttttgctgccaatttctggtgctgacttgatattaggagctatctggttgaaaacacttggttctcacatcgcggattatgattccttgcaaattaagttcttacatgatgggaaatttataaccctacagggcgatgatgatggtactcctactcaggctcatttacatcatattaggagaatgatttctactgactctattgctgaagttttcagtatgcagcttattgaaccttccaattttcagtttcctttatctgaattacctattaatttagaaccggagttggcacttctcttgcatacatatgaattcgtttttgagactcccacatccttaccacctcccaagtctcatgatcatgctatacccttgttggagggatcaaaaccggttaaagtcaagccttaccggcatttacatagtcaaaatgatgaaattgggaaattggtgcaaggaatgcttgaggaaggcatcatccagctgaatgcatttcctattccaatagttgatgaattgattctgtttggagctgaatttttctccaagttggacttaagtcctacatggaatggtcacctctctcatttggaatttgtgctaaaaaccttacaacaacataagctttatgctagactttctaagtgctattttggggttagacaaatcgattacttgggccatgttttgttcagtgcaagagtgactatggaaaccactaagctggaagctattactaattggccacaaccaactattataaaacaattgagaggatttctaggactcactgtactgagtcaatctcaacatcctattgattatttctctaagaatttgtcccctagaatgcagaagcaatctacttatactagggaattctatgctatcactgaatccatggccaaattcaagcattatttgttaggccataagttcattattagaattgatcagaaaagccttaaggagttgttggagcaaacattacagactccggaacaacaacaatggttaccagaattccttggttatgatttcaccatacagtataaatcaggtagggaaaatatccctgctgatgcattatctagaagcttgtttatagcttggtcagagcctactaatcattggttagcaaaagttgcagcagttactaaggaggaaaagttactaagtgaattgatcagtcgctatgctcatgggggaaccattgatcctaagtatgatgtaaaggatggattaatatttagaaaagggaaattgatgattcctgaagattcagctttgagaaactag

SEQ ID NO: 97655 - DNA, 457 bp, Glycine max
  Peptide Sequence Number=SeqID_214433
atggtgaatggtgatgcggaagaaatccctcagcatcaaaggtcgatagtatctgcaattagacaacgggcagttgcaactgttgctgaggaggttgaccgtgtggatcctccagctgacgagggttttccaagcaggcttgaagatacatcagtgatgacgaattatgtttatcatgtagctatcagagtttgggaagaacaagcatctcatgggaggaaggtagagaaatttggaaggcctacacctgagattgaaggcatagtggctgctacaggattaagttttctgattacatgtttgttggacactggttacaagggacttatatatgtttttgtggagaggcggcacaaggaaacttgtcaccctgtcgtgcagaggcaacttcctccccatggtgatcaacctaggtctcaaggaagttccaaaccaagtgacatgccctcaagttcaa

SEQ ID NO: 97656 - DNA, 471 bp, Glycine max
  Peptide Sequence Number=SeqID_214434
atgactcagatcattgtctgccagacccgtgggggtggagtgaccactgataaggtggatgtcacatatgttaactggaaacaggttcctgtaactcagaaggatttgatttgggaagacattcagtccaatttgaactccacatgggctcttgcaaaaggaaaggatgacaacgatgacaaagtctgtgagaagtatggtattggaaaggataagttgaaccaattttgtcaaagccatagagacccttcatgggaggatgtactgactactgccattaggcgactagaccaccttggccgtgtccgtactgttggagccgataatatcatggacgagctggaacaatcaatcattgaaaaagtgatgagacaactaatgtcgttcttcagccaaatgcagttccaaggaattgtacatccagttgagccagaggtagttcctgctggttgtccttgggagagtttatga

SEQ ID NO: 97657 - DNA, 321 bp, Glycine max
  Peptide Sequence Number=SeqID_214435
atgcagaagatccctgaaacagaggcagtggaaccaatagctaatgaagaaaccaatcttatagcagataccctaccatttggaggagttggtgaatttggatttggcaagtaccatggaaacttctcctttgatgtgttcagtcaccataaggctgtggctagaagttacttgactgatatttggttcaggttccctccatggactcttgataagcttctactacttgaggtgtcttgcaatttagactaccttggaatacttctagttctgctcggcttaaagaaatcaaaacggtcactatttcaggcttgtaattga

SEQ ID NO: 97658 - DNA, 255 bp, Glycine max
  Peptide Sequence Number=SeqID_214436
atggcttttaagctatcttgtgcagcctccactttcctagtttcgagacaaatctcattgctgaagcaatatagatccatgtcaattgtcactgatttctaccacatcttacttgaaaaactccctcaggactactgtggatctggagtattggcctccatgtgtaatgtgacattgagaaccctctgtaagaaattagtcatgctagtttctactccttctagctattcctcaaaagatgagtgccttcggtaa

SEQ ID NO: 97659 - DNA, 189 bp, Glycine max
  Peptide Sequence Number=SeqID_214437
atggatgaagatcaatggatgtatgacaacataatgtctaaagaagttgatatgaatgaagaaaatgaagaggaacctggtgtgaatgaagaaaatggagaggaacatgttgtgcatcaacatgttgattgttctgatgctttcaatacttctcatatgtttgctacccgtgattatgttttgcattga

SEQ ID NO: 97660 - DNA, 246 bp, Glycine max
  Peptide Sequence Number=SeqID_214438
atgtggccggaaaatggaattcatggttgcttggaaagaagaaggggcattgcagagcccaaagggcatcactcgaaattcaaaatgactgtgatgggtgcaaaaggtggtattgcaaatatcctcttcattcatgcgtatctggtggtacccctggaaaaggggtggagttgggttgtagatggatgtgatgatcagttggacgggaagggggcaaggattgcggttcttggaaaaggaggctag

SEQ ID NO: 97661 - DNA, 708 bp, Glycine max
  Peptide Sequence Number=SeqID_214439
atggtgcaattgtggatctgtaattctctttctcacagcatcaggaagagtgtgattttcatggaatttgcatacgatgtgtggaaggatttgcggcttaggtttttgcaaggggattttgttagaatggtgaagctccaacagcaattgtacacctgtcagcagaattccatgtctgaccctggagcatatcgtgaacaagattatgttatgagatttttaatgggactaaatgataactttgatggagttagatcacaaattttattaatggatcccttacctaatgttactcgagtattctctatggttatccaacatgcagttgcaccttcttctgagttacagtcattagtgaatcttgctgaggtagctggtctctctaatgaagaatgtaggaccctacttgcattgctgcagaaatctggttttcagaagggagattcacaacatgatcacagtgcaacagtccatatttgtaattcattgggagaatttgattcgttccatagaattactgctatatctgttagattaccaaatggcggtgtgttattggcagaaatttctagtgatgttaaggactatacactcaagaagattgattcgggtagtctcaagagaggtctttattacatggagaaggagaagaacttaaacagctttgtttgggcatgtatcttctacaagattgagaactttgtgtaa

SEQ ID NO: 97662 - DNA, 372 bp, Glycine max
  Peptide Sequence Number=SeqID_214440
atggtcgctaaggttgcagcacttgagactgatgtcgcagccctcaaaaccaccctgcaaactatgcagctcctagcagaagagaatcatgggaagttgattgaaatgttgtccaaaacaagtgggtcaaacagcggtgatgatactaagtcacccacaacttctcttggggctttagacaagttccgtgatataagaacatggtttagaggaccagtaacctcccaagaagaagagaagagaaggaaaactcagagtggaactcagcacaaagttcatccccgtcctcccaggatctatcgtcaggagacaacccatcccattgtaccaatacctcccattttggtgaagaggagcccaacaccagtttag

SEQ ID NO: 97663 - DNA, 570 bp, Glycine max
  Peptide Sequence Number=SeqID_214441
atggctcatgtgttatcgctacctgactttgcggttcctttcactgttgaaacaaatgcttcaggcattggcatgggagcggttttgtcgcaaaatgggcatcccagtgccttcttcaatgagcttaagaaacatcttctctgcaacccccagttcatccaacttcggcgagacattcgtgctcaaccagatgcgtactcggattattccattgcccagaacttgatcataaaggaggggcgtatatggttacctcaagggttccagttcatccctacgctattagctgagtatcactcgacaccctccaacggtcatatgggggttgccaaaacggtggcgcgattaatggaaaatttcacctggcaggggcttcaaagggatgtcgaggactttgtcaaggcatgtatagactgtcaacatgccaagtatgaaacaaaaaggggattcgctgttcctgagtcacttctagcaggagctatttcgcttgagtggtactcgcctgaggatgagctctgcatatcacccccaaagcgacggccagacttaagtattgaaccgtgtcattga

SEQ ID NO: 97664 - DNA, 111 bp, Glycine max
  Peptide Sequence Number=SeqID_214442
atggcctttggttgtggacacatgacttgtttagagtgtggatcaaaaattcgcaagtgtcatatatgccgaaggaagatcaccattcgtatcagattgtttcctgattaa

SEQ ID NO: 97665 - DNA, 547 bp, Glycine max
  Peptide Sequence Number=SeqID_214443
cgtccgcgagggcaccgacaccgcggtgtccgcgatgcgcgagaacgaccagcgcgcccggcagatgctcgacgaggccgaggccgccgaccacgccctgggcgagatcgccgagcacgccacgcggatcaacgagcgcaccctggtgatcgccagcgctgccgaggagcaggcccacgtcgcccgcgaggtcgatcgcaacctggcgagctagggcgtcgcgcggcgcagcaccaactgcccgccgtcgcccttctgcacccggtagtcgccctcgccctggcgaccgaggagcatcagggtcaggccgccgcgttcgagcagcgcgatcccggccggggtaggcctccaggcgcgcggctcgctgggcagccagcgcgtaaggcaggcggtatcgccgcccaggtcgtagccactggcttccgccacttcgctgtcgcgcagctccaggtggcagatcgcgggcgcctcgtcctgctgcagggtccattgcccggcgagatcggaagcgctgagaagaatcagactgctggccatactgatacct

SEQ ID NO: 97666 - DNA, 177 bp, Glycine max
  Peptide Sequence Number=SeqID_214444
atggagcagtatgaaattcttgaacacattggaagaggttcctttgcttcagctctacttgtcagacacaggcacgaaaacaaaaggtatgtccttaagaagatacgtcttgcccgtcagactgacagaactcatagatctgctcaccaggaggcaccgatgtatgaatatgtctag

SEQ ID NO: 97667 - DNA, 111 bp, Glycine max
  Peptide Sequence Number=SeqID_214445
atggagaagatcaccgctgattattacaagacagactgcccacgtgttagcaactacacagaagaagggcctactatatcaacctttacaacaatcttgcagattatgtaa

SEQ ID NO: 97668 - DNA, 423 bp, Glycine max
  Peptide Sequence Number=SeqID_214446
atggtggactggtttgctctggaaactattctgctggaaacaggtattcctaaacaatttgttaagtggattatgcttattgtcacttccgtcacctacaggtttaatatcaatggtaattataccaaatctatgaaagctaataggggcatacggcaaagggaccccttatccccggtgttgttcgttattatcatggaatatctcaatagactcctccacaagatgcaaaggaatcctgatttcaatcatcattccaaatgcgaaaagctaaatattactaatttggcctttgctgacgatgtcttgcttttcgctagaggagattgcagatcagtagagatgttgatgcagaccttgaataccttctctgaaacagctggtttagtggtggtgttgacaaaagtcgtaaaagtcctgtag

SEQ ID NO: 97669 - DNA, 531 bp, Glycine max
  Peptide Sequence Number=SeqID_214447
atggaagcaactatcacggaagaagataaggaatttccaggaacacaagggttgtttttctggctagagaacaagttgtcccataattccagtgaggccaatcattactccaaatggaaggaacatttgcagatcagtgatgaaataaataccctattttgtgaacaagatgagaacagtactagtgcacactgtgcttgctccttctgtggaagattaagcaacatagtcacgagatgctcacgctgcaaagctgctatatattgctcgaatgcttgccatgttaagcattggaggatttgccataaatatgaatgcgttgagaaagaagggtcacaagatcagcaggaatcaccgtttcatggaacccattgccttatcatggagcctgaaaatggtaagttctcattcagtgaagttattgagcagagatcatataagggagatgtttactatgtcgaaggaggagaaaacagtgctgagtgtgtggcaatccaagctctaaagtatgctcaaggtgcaaagccataa

SEQ ID NO: 97670 - DNA, 666 bp, Glycine max
  Peptide Sequence Number=SeqID_214448
atggtgatgaaggtgtcaacgagaagaggagcacgacagaaggtgttcgatgacggagggaggtgttcgcaatggtggccggtggttgagtggagacccgaagaacgaataagggtgattactgaatgcttttcaatagttttcgatacttcaaagtatgaccttggtcctcttcttgtagccataaaaaaagcaattgttgcagatattggcactgatctcttgttgcagctttgttcaccatcgagaatgaagtctgacgtgagtgtttttgtatgcggtgacgacagtgatgattgtggtcatgtcagtaactgcaacgacgatagagatatcagtaatggtcatagtgataataatagtggtagtgttggtagaggtaacattggtggtggtggcgatgcagatagtggtggtggtaacgatgttggtggtgacaaccaatggtgtgatgatggtagcaatgtcagtagtgttggttgtgatagtggtgacactaatgatgatagagtgatggtggtagcggtattggtagtgacaacaagtgggagcaatttttttaagtcgacaaaagcaaatatgtttatatacgtgataaactgcacaagaagtgctacaaaagaggggcatgacaggagggcagtcaataccccttcccatcgataa

SEQ ID NO: 97671 - DNA, 369 bp, Glycine max
  Peptide Sequence Number=SeqID_214449
atggttgagtcaatgaagtatcttccttaccaggtgtgtacacccactgatctgttgatatgtatgattttggaatactctcatcaagatggcaatattgaacttgaaaatcaggatccttccatgacaattctcagaaaattgctcaggaaggtagaaatcataaaaagctctagatctggtgaaccaaattttgagtctcatcacgtggaagcaaatgatttgcagtctgtggttgatcaatattttcaaattaggggaacttctaagccagcacgtcatatagagacacattttggggtcaataaagagcttactgaatcctcaacaaaagcatggcttgagaaaatgggaatcaagtatatatag

SEQ ID NO: 97672 - DNA, 150 bp, Glycine max
  Peptide Sequence Number=SeqID_214450
atggatattcgtgttgatgaagctgcacataccacggaaatgcacctagttgccatatcttgccaaatattgatgcaggcaccagctatgtatgggcagattcttgccaaatatgttgatcattcctataacttcttcgctatttcatag

SEQ ID NO: 97673 - DNA, 447 bp, Glycine max
  Peptide Sequence Number=SeqID_214451
atggcatcaattagtgcaagaagtgacagaacttggcaacttatatggacttctaaagcaaaaccaaagtgtaaaacttttgtgtggaggatggcttttgatattctccaagtcagagaaaagttgaggatcaagcacattgtggacaacccttcatgtccaataatgctatgtggcccaatagatatggtttgcttcgagtctgagcttgcagggtggagcatgaatcaaaaatttctcaaaggtgaatctattgatgtccacaacgttcttcaaagagaaaatgatgttatgccacgaaaaaggaatgaccaaaaccaaattgagaatcaccaagaagaaccccaaatctttaggtggaaggcaccagtaaaaggagtagtcaaggccaactttgatgtcttagttaaggagaatggtggatcgagccttagggtcattttttga

SEQ ID NO: 97674 - DNA, 240 bp, Glycine max
  Peptide Sequence Number=SeqID_214452
atggcttcagagttatcgactgacacaactaagacaagtaccagttctgattcatcatcagcaacaagcaagaagtgccctttttttaccaccgacaatgggcaccaaccagaataccctgagtttgtcaactttagatatgatggaacaatataccaaatcaggctaaggcagtatcggacaaaagtctactttgcggaagggctgaaagaattcagaaaagatttatcaattttttaa

SEQ ID NO: 97675 - DNA, 807 bp, Glycine max
  Peptide Sequence Number=SeqID_214453
atgcaaggaggatttcaatcatttttgtcacacgggaatgtcattagaaatgctgttctacaacgggtgcgcatggtgaaccccctgttacagccaattgtctcttcgcggtttgaatctgttacacctgctcgcattgaggagcatggttttgagagcaccacaatttcagacatcttgaatgataaaggcaagggtgctgatggctcctggctttggtgcaccacagatgataccgtttatgatgctgttaaatcgaatcaaaggaagagtgggaaaaactgcttgcttatgctctttcatctcttgctctctatccttgccatctatgatgccaaaattctatataatcttagggaaatagtttcggatgcagttaaatggtctaaatatctacagcactgtatgttgattatgtttgtccctgggtcattgatgttaactatttggtcatctttttatccagattacttaagaaagatcatcgtgcagggaagatcatccaagtctaccaaggttggagatattatgactgaagagaacaaacttatcacagtcacccctgataccaaagttctacaggctatgcaactgatgactgataaaagaatcagacacatccctgtcatagatgaaaagggaatggttggcatggtgtccattggagatgtggttcgtgctgtgatgagtgatgctgatgcatgtgtcatagttgcgagttttacggtggcaattgaaggtttaacaaaactcatcttttctttgggcttgggaactgattatgagggtttgagcagagttaaatga

SEQ ID NO: 97676 - DNA, 858 bp, Glycine max
  Peptide Sequence Number=SeqID_214454
atgtctttacaaaccgcaacaaggagcttggagccttgtgtttttcttatgagggctgtgtggttctgcattattaagatgaggttattgggtgaaggctttgtattggacgtggatgaaatcttaagaatgggaaagaaaattatcctgagggaagagttgaaaaaatgggaggcttatacatcaactgctattttgagttctttgttgttcaagggatatggcaaattaagcagtgaggagaaaattgaatggaataacagggggttctctacatttcacgctctttttgtatcatctgcatctttctacctcctcattttgtcagatgtcttcaatgtgaattcacaggacgacatagttatcaatagatcatcaaggttatcagatacagtgttgggggtttctattggttattttctaacagatctggcgatgattctttggaattttccagctttagggggtcttgaatatgttctacaccacggaatatccataggttctattacgctatgtctgctaagtggtcaagttcacatctacatacttatggttcttttctctgagagcactactccttttgtaaatcttagatggtacttggatgttgctggccttaagagctccaaactttacatttggaatggcattgcattgttcttcgggtggttgatgcagaaacttagtcctttgatgtacaataaaatatatgcaagggtgtcccacttagttgtgactttcgaatgtttcttggttcctgtggttgttatggaactacttttcttggtagttccaggttgcaaggattttcctgttcatgttccttttttaccacatagggacccgtttggatga

SEQ ID NO: 97677 - DNA, 313 bp, Glycine max
  Peptide Sequence Number=SeqID_214455
atggtagaggacgtgtgtttcctctacaaggtacttcctttctactttcttattgctcctttttaccgtcaaacgcgtatgagaaggtggaagaacacattaaagctgcgatttttatctcaaaaaatccaagagtacagtgtcatcgttttcctctgcaggaaagagattcatgaagccatcgaagggtgtctgtggctcagtggtatttcgcgttcaattgcttacaattggtctcgacccaacatgaaaatcggtgttaggatcattcacgcaacttcctcttaccggaacattcctgtttctcgcaaag

SEQ ID NO: 97678 - DNA, 1245 bp, Glycine max
  Peptide Sequence Number=SeqID_214456
atgtggagtagatggtggtgtggtggtggtgttggatcattgaggcaaagggtgtcttttgttttcaatggaagccatggttctgtgggaaaggttcatccttttgatcctttcaggggttttggaggggaatattgtggaggggtggggtttgtgttgaagcagatgaagaggagtgtgtgttcctcaactttactttcatcccctgctggtgttggtggcaactccaattcatgtgggagtgggagtgatgataatgataataataataataataatgggaatggaactgaagggtctatatcgttcggtgatgctaagaagtttatgagattggtgaatgtggaatcgctcaagatgaagcttggtagggatgggaaggagattattcccttctgtgagcttcttcaagagtgtaagagcatgggtgttgctaggagttctgaggaggctttggcattcgccaaggttcttgatgaggctggggttattctcctcttccgggacaaggtctatctgcatcctgataaggttaagcctattaccatgtatttaatgccaggagatgccattcattaccccttttcatggtcccctagcctttcggctatgtttggaagttttgaaaatgtttatgttgtgtggctacgcctacaaccctttttcagtaggaatagtcatgctggtgattcatggcttcctaccatccctttgttagtcctccgactccaagcatcagaatttggagaggagagccatgtggtggatctggttagaagagcagttccactagccctaacagctgaggatgatcctatgagggaggagttaaagaagctgcaagagaagaaggaagaaatcgatgttttggcacacaagcaggtgcggcgaatcctgtggtcaggattaggattcggtgttgtcactgttggactattcttcaggctaacattctgggaattctcatgggatgtaatggaacctataacatattttaccactgccactggcctagtggtaggctatgcctacttcttgttcacttcaagagaccccacttaccaagacttcatgaagaggctctttctctcaaggcagaggaagctgtacatgaggtacaattttgatgttgagagattcaaggagctccaatgcaagtgcaaaacacccttaaatgccaaaaccattttgaagaatcgcatggggttggaactggatttggatgatgccttacacagagattaa

SEQ ID NO: 97679 - DNA, 858 bp, Glycine max
  Peptide Sequence Number=SeqID_214457
atgctcgctgctgctgcttcagcttctcggcaccttcttcaacgcgatgccagcatcggtgcttgcagtggcagtggcaatcgagttcgctctcttttgactgcttctgccatcaccacaacctacccaattcgcattagaaaatgttacagtaacggttatggaattagtttcaataaccccaaacacagaacgtgcccaagtttgctttttgctgtaaaagggttcctctctgattcatcaaattctaattccccacatggcagagttaccagaccttacttaccacaccctgttaatagttcaaatgtggatgggcgagcgttgttctcaacttcaactaaaactgatgatggaagtcagagccaaaaggctgctgcttccaccattggtaaatcatcaccaccaccgccacctggtgggcaagctgctgatgtgaagatccttggcacgcttgccagttacttgtggatgaaagataatcttgaatttcgggttcggattgttgctgcattgggtttgcttgttggggctaagattttgaatgttcaggtgcctttcttgttcaagcttgccgttgattcgttgacagctggcacggggagtatgggtgctcttgcttcgaattcaagcgggttggttcttttcgcaacccctgttgcagtgttgattggttatgggattgcacgttcaggagcttctgctttcaatggttcggtgattcatgccatgtcggatgagcaagatatgcggaggatgggggggcttgcctcctcgttcccttttacctatgccactcacgcttattggattggacctatatttatagtgttaattgtagagaagaaattagactag

SEQ ID NO: 97680 - DNA, 2485 bp, Glycine max
  Peptide Sequence Number=SeqID_214458
ggagaagagaagagggttattagcacaacagcagcataagaagaatcgcgtttggatggaagcggtggcggaggggctatggggactcgccgagtaccacgagaagagaggggaaatagggaaagcagtgaagtgcctcgaagccatatgccaaagcgacgcgtcgtttttcccaatcgtcgaggtcaagactcgtcttcgcattgccacgcttctccttcaccattctcacaacgtcaaccacgccaagtcacacctcgaacgttctcaattgcttctgaagtctattccgtcttgcttcgaattgaagtgcagagcgtacagcttgctcagccagtgttaccatctcgtcggagctattccgccgcagaaacaggtcttgcacaagggactcgagctcgctgcatctgtaggatacgagatttcaatgaagttgtggtcttgcaactttaattcacagcttgcaaatgctttatcaattgaaggggactaccagggttcaatctctgccttagagtgtggatatgtctgtgctactgaagtatgcttcccggagttgcagatgttctttgccacttcaatattgcatgtccgcctcatgcaatgggatgatgataatttggttgagcaagctgttaatcgatgcaaccagatttgggaatcaattgctccagataaaaatgctgcacctcatgtagacaatctggatgctgccatgaagattgatatgcagcaaacacaacgtatacaagagctagtgaaggagctcaatactttagaccaaagtctctcccgatctgaccttcactacagggataggacagcattatctaaaaagcaaacaatgattcaggagcaactgcaaaacatgactggattgagttcaattgggcaggaatcactgcaaccagtatattttgggaatgtcagaaggataataggagataagcttcagttagcacctcctcctattgatggtgaatggcttcctaaaagtgctgtctatgcattagttgatctaatagtagttgtgtttgggcgcccaaaaggactttttaaggagtgtgcaaaacgcatacagtctgggatgaatataattcaagatgagttactgaagcttggaattactgatggtgttagagaagtggatttacaacactcttctatttggatggctggtgtgtacttaatgctactaattcagtttcttgaaaacaaagtggctatagagcttacacgagcagaatttgttgaagcacaagaggctttggtacagatgaaaaattggttcatgcggtttccaaccatattacaggcatgtgaatgcatctttgagatgcttagaggccaatatgctcattcagttggctgttatcacgaagctgcttttcattttattgaagcagtgaagcttacagacagcaaatcaatgcaagcaatgtgccaagtttatgcagctgtctcttacatctgcattggtgatgctgaatcttcttcacaggcacttgatttgattggtccagtttatggagtaatggattctttcgtaggagttagagagaaaacaggtgttctttttgcttatggtcttttattgatgaagcaacaggatctacaggaagcaaggaatcgtttggcaaggggattgcagctgacacatacgtatttggggaaccttcaatttgtttcacaatatttgacgatccttggtagtttggcccttgcattacatgacactgtacaagccagagagatattgagatcttctttgaccttagcaaagaaactttatgatattcctactcagatttgggtgctatctgttttgacagttcaccaattaaacgatttggacatcaagcgtgcaatggccgacccaactatgggagtcaatcttgatatccctgaatctattggtctgtcagcacccttatctgctccatcatcatcaaggctagttgatatagacaccagaagacgtccaagtgggttgaagagtttagcagatagggtttccacttaccagcaagggggagggggagtcaggatcgccatgctggaggatggggtcttccacaagatcctgcaagatctggttatgcatgatagcgtcaaggtaggcatagtggcccttgctaagagatcaacaagatctggtgggagcgaaaaggaaaaagcagaagagggagaggttgtagaggagggtggcggtggaggaaacaatgatagaaatcatgataacaacaaagataattataatcgtatgagttatgctaaaaatatcgttgtcatcaatgcattggatagtcgacgaggatgggaagggttggagtgtgtgaaggcgtctgtttcttccttcagacatgcaaccgaggtggtaatggtagtagtagtagcagctaacaatgcagatgctgctgctgctgctgagaacaaaatcagaatgaagaggatcatggactgtgctttgtcgacattgtgttga

SEQ ID NO: 97681 - DNA, 1485 bp, Glycine max
  Peptide Sequence Number=SeqID_214459
atggctccagccttggaagaaggaggagaaagagaaactagtgtggcacagaacaactccttgaacagtgttgtcaatgatgccacacacagatccaaagtcactgttattggaagtggcaactggggcagtgttgcagctaagctcattgcctccaataccctcaggcttagctccttccacgatgaagtgaggatgtgggtatatgaggagacactactaagtggtgagaagctcacagatgtcatcaatcgaaccaatgaaaatgtcaaatatctccctggaatcaagcttggcaaaaatgttgttgcagatccagaccttgaaagtgccgtgaaggattccaacatgttagtgtttgtgactccacatcaatttatggaaggaatatgcaaaaggcttgttgggaaaataagggaagatgctgaagctatttcccttgttaaagggatggaggtcaaaatggaaggcccatgcatgatctctagtctcatttctcagcaactgggaatcaactgttctgttttaatgggtgccaacatagcaaatgagatagctgtggagaagtttagtgaagcaactgttggatacaggctcaatagagaagttgctgagagatgggttcagttgttttatacacactatttcattgtgacagctgttcaggatgttgaaggagtcgaactgtgtggaactttgaaaaatgttgtggccatagcggcaggttttgtggatggcctggagatgggaaataatacaaaagctgcaatcatgagacttggtcttagagaaatgaaggcattttcaaagttgttgtttccatctgttaaggacagcaccttttttgagagctgtggtgtagctgaccttatcacaacatgcttgggtggaagaaataggaaagttgctgaggcttatgcaaggaatggagggaagaggtcttttgatgagcttgaagcagaaatgctacaaggccagaaattgcaggcacttataaaagcagaaaataggaagggtgtctcaactgcgagtgaggtttatgaggttctaagccatcgtgggtggctagagttgttccctctcttctcaacagtgcatgagataagcactggcctacttccaccatcggccatagttgaatacagtgagaagctacccagggtttgtcacaaggaaatttcttctagcaccccaaaaattacttcctacacctttctagaacgttgtctttaccttctggattggccaatccggaatgccaagtacatcatcaaaacccaaaaggaatgtccaaatgcccttttggttgagggaattttaagatgggctattgattcatgcacctcccaagttgcttctaacacctctgttttggcttttggaatggtcaattcaaaatgctgcaggaagcaacttggaggtgcaggaagtaacaaccatctagatgtggtccatgccctaatctatgagttggtagatggttaa

SEQ ID NO: 97682 - DNA, 200 bp, Glycine max
  Peptide Sequence Number=SeqID_214460
gcaaacgcccagaacttcaggagaaggccgttaactcgattcagaaactggttgctgaaaaagggagggaaggcctgaaggcctttagcgcatctcaagctgtagcagatgaggcgagagttatggagagtgctgaccaggtcttgagcaaagagatggccaccttgaagaaactatatgaggacttagtcatgcattag

SEQ ID NO: 97683 - DNA, 369 bp, Glycine max
  Peptide Sequence Number=SeqID_214461
atgaactcgaaaaggtctgactctaacttacggagaggcatctatagcagtagggagaatgttcaaaacaatcttgcttggaatattggtgatggaacttctgttgatttttggaaacacgaatgggttccttttagaggtaaattgcttggaattgcttcttgtcctatccctgtagatcgcgtttccaacaaggtctgtctatacacaaatcaaaatgcttatattagttcactagataataatgctttgtgcgatgatccattgtattctgccatctggaattggagaggtccagagagggtgcgcgttttactttggaaaattggagttaatgtgtttttgaaaaatgagaataggtgttcttga

SEQ ID NO: 97684 - DNA, 318 bp, Glycine max
  Peptide Sequence Number=SeqID_214462
atgtccttcctccatgacactgcattttatgacccgtcaccgccatctccttgtcacccaaggtcgtttggtgtctcctcgttcgcgagttggggttcatcgctactaccacgagattcaggctgtagccagaggactaaaagatccttcttttcgtgtgattcaaaaccactttgcaatttctggaaatctaggagaggtagcagcaaagattggagacctataaaatgtgctggcacatatcatatggcagtagaaacatggagagaaatcagacaattagtattaacaaatcccattgctagaactttccattaa

SEQ ID NO: 97685 - DNA, 174 bp, Glycine max
  Peptide Sequence Number=SeqID_214463
atgccatatccacattgtataattcttcttaatcccatcacccaacagatgctccgcatttcgcattggtctccaagtgcaccacatgaaatcggtgacattaattccccgataatcaagtatgcacccagagaacaactagaaatgcgttgtactgagatttcatcaaattaa

SEQ ID NO: 97686 - DNA, 531 bp, Glycine max
  Peptide Sequence Number=SeqID_214464
atggcagacgaagacatttcaaagacagcctttcggacacaccatggccactacgagtaccgggttatgccgttcggactctgcaacatgccgtcaacgttccaggcggccatgaacaacctgctccgccctttcctacgcaaattcacgatattacctcaagtgctcatagtgcctatttgggcaacgccagctcgattagttgggtcacgtcgtctccggaagtttgtgaagggatatgcagccatcatggcgcctctaactaagttactctgcaaggatgcctttcactgggtatcggagtctcaaactgccttcgagaaactgaaaacaaccatgactgccgcaccggtgctggctcttctcgatttcgtgattcctttcgccctggaaacaagtgcatctagcacagttatgggccctgtccttcatcaacagggacaccctatagcgtacttcagtaaacccttctgctttcatcttcaacaagcttctgcatatgttatggagttgcatgccattgtcgctgca

SEQ ID NO: 97687 - DNA, 150 bp, Glycine max
  Peptide Sequence Number=SeqID_214465
atggatgaacaagtgtcggaagaactttgtggtaatattggaaaaggggtccttaacaacaaggtcaccattccttccattaaacccataagcctcgttgatgtgaaggttgacgaggagtatgagattgtcatcaccaatccagcatag

SEQ ID NO: 97688 - DNA, 2538 bp, Glycine max
  Peptide Sequence Number=SeqID_214466
atgcacactttgctttcagaagcccttactcaccctccactcctctctcacccaccccgaactcgctcttcctccaaccgagcaagcctctcccttcttccctcaaacctaaaccctcacttgaccctcctttaccacgagccaccgagttccaccacctatgcttccattttggactcttgtgggtcccccattttgggaaaacagcttcacgcccactctataaaatcagggtttaatgcccacgagtttgttacaaccaagttgctccaaatgtatgctagaaactgctctttcgagaacgcatgtcacgtgttcgacacaatgcctcttcgaaacttacactcttggaccgcactcctgcgcgtttacattgaaatggggttctttgaggaagcgttttttcttttcgagcagttgttatacgaaggggtgcgggtaagattggattttttcgtattcccggtggtgctgaagatttgttgtgggctatgtgctgtggaactgggtaggcaaatgcatgggatggcgttgaaacatgagtttgtcaagaatgtttacgtgggcaatgctttgatagatatgtatggtaaatgtgggagcttagatgaggccaagaaagttctagaaggaatgccccaaaaggattgtgtctcttggaattctttgatcactgcttgtgttgctaatgggtctgtatacgaggcattgggtctcttgcaaaatatgtctgcgggtgagtgtggtttagcacccaatcttgtttcctggactgtggtgattggcggattcacacaaaacggttactatgttgagtcggttaaactgcttgcaagaatggtggtagaagcagggatgagaccgaatgctcaaacactggtgagtgttcttctggcttgtgcgagaatgcaatggctacaccttgggaaggaactgcatggctatgttgttagacaagagttcttctctaatgtttttgttgtgaatgggttagtggatatgtatagaaggagtggtgatatgaaaagtgccttcgaaatgttttccaggttttcaaggaaatctgcagcatcttacaatgcaatgatagctggttattgggaaaatggcaatttgtttaaggccaaggagttgtttgatcggatggagcaagaaggtgttcagaaggacagaatatcatggaattctatgatatcagggtatgtggacggttctctgtttgatgaagcttatagcttatttagagatttgctgaaggaaggaattgaacctgattcttttactcttggaagtgtccttgctggctgtgctgatatggcttctattcgacgtgggaaagaggcacattcccttgccattgtcagaggtctgcagtccaacagtattgtgggtggagctttggtagaaatgtattctaaatgccaggacatagtggctgctcaaatggcatttgatggagtaagtgaaagagatcttccaacttggaatgctttgatatcgggctatgcccgctgtaatcaagctgaaaagattagagaacttcaccagaaaatgagaagggatggttttgaaccaaatgtgtatacatggaatggtattatagctggctatgtggaaaataaacagtatgattcagcaatgcaattgttcactgaaatgcagattgcaaatttgaggcctgacatatacacagttggaataattttagccgcatgctctaggttggctacaattcaacgaggaaagcaggtccatgcatattccataagagctgggcacgactcagatgttcacattggagctgccctagtggacatgtatgcaaaatgtggggatgttaagcattgttatcgcgtgtataacatgatatcaaaccctaatttggtgtcccacaatgctatgctcactgcatatgccatgcatgggcatggggaagaaggaattgctcttttccgcagaatgttggccagcaaagtaagaccagaccatgtgacttttctagctgttctttcttcatgtgtacacgctggatcattggagattggtcatgaatgccttgctttgatggtagcttacaatgtgatgccctcattgaagcattatacatgtatggtcgacctcttaagtcgtgcaggccagctctacgaagcatatgaacttatcaagaaccttccaacggaagctgatgcagtgacctggaatgctctgcttggtggttgctttattcacaatgaagttgacttgggagaaatagcagcagaaaaactcattgaattggagccaaataatcctggaaactatgttatgctagcaaacttgtatgcttctgctgggaagtggcattatcttactcaaactagacaattaatgaaagatatgggaatgcagaagcgtccagggtgcagttggatagaagatagagatggaattcatgtgttcgttgctagtgacaagactcacaaaagaatagatgatatatattctattctgaacaatttaactaatttaattagaataaagcatatgaatcatttataa

SEQ ID NO: 97689 - DNA, 1065 bp, Glycine max
  Peptide Sequence Number=SeqID_214467
atgagattcctacttgaatttgagtccgaatctgatcacgataagaatgacgagccatatgtgccatcaaggagaagaaagacaactaataatcacaaaactcctaagaaagtaatgtcatcaactaagaggaaacgaaacggtggacgtagcagtacttctagaacaaacgtgtcatctcggaatggtgtgccagaaaggaatgaccaccaacaaaatgtttctaatctccctcaaaggggcgaccagaatgagctgcatgctgaggctgaggcagagccagataatcctgaaatggtaccttcctccgacaagaggcctgctgcatccccaagtggagaaagtggacaacacacaactacagcagcggatgcaagttcttctcctgaatttgctggtgaaaacattaatggtactcattcttcggctcttgtggaagaaaacaacagtactgctcaagaacctgcagcagctaaaaccacacgagccagtaatcaaaatctaagctttggggaacctttctatggcgaaaattcaacgccatgccttgccagtgatagacatgatcagaccaatgacaagggaaagaaagtgcatcaaacaatcccagcaatagtcttagaccaaagccccaatgctgaacttggctgttctgatgctcctgcctcaggttcaaggccatcttctttgcacttagaaggtgcaaacacctcttgttggtctaatccaaagaactctttgtcttctggtttggatttgaaccttgccccagatgagcaaggtggagatttacaatgcttaatgagtacaaatatgaaccaaccaccacagcatagtaatacagtactcccttttggttactctgacttgcaaaggggtgttggcttgctgaaccctatgggtccattccctatgcagcagccaaatttactctctgctgagttgttggtgccttctggaggcagatttattatggaggggaggaggatgagaaatctcgatcttaaccagccaccaccacaagaggcacaaaatgaagttgagaatcataatctaagagattaa

SEQ ID NO: 97690 - DNA, 408 bp, Glycine max
  Peptide Sequence Number=SeqID_214468
atgcgaaagataccaaaaaggaggggcaaaagggtctttttattgagttttcttgaccctggctctcccaggctagcctctggcttgcccgggacctcaaaagactcaagagtaagtctcaggtcgcctgtgcaagctgccttggtcccaaatgccttgttttctataaataggtgtcgaaacctcccttcggcgggagggcgacgcggggctcacgggtgcgtcttccatgggaggaaaatgcgcggagttgccacaaacgtttattcgaggaaaacgttggaaaaaaccggaaaggagagaaacattaaggtgttgaacattaacgatctcttggggcggtcgacaaaagcggggcttttgctcctacgtatcctcaattgcgatgaggaaatcagacctacatag

SEQ ID NO: 97691 - DNA, 963 bp, Glycine max
  Peptide Sequence Number=SeqID_214469
atggcttccagaaagagaaagagaattggttcaagacccacagtgcactatgacacaaggagattatcttcctttgaggcctggacccgatacacaaataatgttctaggaagacatatactgcctgagaggaaggtagaaatataccatactgagctggacgagtttaaggctgaattggagaggcgtaacttccataaaagcctcaccaatttagttgacaacaacatagatttagctttggtgaaggagttttatgctaacctttacagctccgaagggccttcaccaaaacaagtcaagatcataggccatttggtgaggattgatgcagacaacctcaacacctttctggagacacctgtggtactagctgagggtgaaaccttacccacatattccaaatactataggtcgtccactgatattagagaaattaaggcttccttatgtatcccaagtcgggggttcatcttgaactctgaaggccaccctgggaagattctcaggaaagatttaacaactcttgctcaggtgtggagtgttctctcgtactccaacctggctcctacatcccacactttggacctgacagtagatcgagctaggctgatctttggcctagtctctgagatggacatgaatgtgggagctctcatctctggtcagattacatctatggcccagtctaactcttctagacttgggttccccgctcttatcactgctttatgtaagtccagaggggttgcttctgacagcctgatcttcgaacgcctgagctcggtcattaacttggcctatatcagaaaaaattattggaaccctgatgatctgacagttactatcagaggggccaggaaagtgaggacaaggctagttgaggccccttccacatctacagctcctcctctagcacataccctaacagttccttttgtcacagcttttgcagattcttag

SEQ ID NO: 97692 - DNA, 460 bp, Glycine max
  Peptide Sequence Number=SeqID_214470
cgcagacacgaactccacaaacgcgaactcgacaatgtggttgcagtcacggaagcgcaacccagtttgcgacaaacacgaactcaggcagaaggagaaacaacaagaatgccctgggagtaccctttccgggactctttcctttcctacttttcttcgacctgcgaaagacgtacctcaatcgataagtggcaaagacgatctccacaatgtggttgcagtcatggaagcgcaggccagtttgacacaaagacgatctcaggcagaaggagaaagaagaagaacgatagggttcaagcgcgcgggttatgcaattttagaagtttatgttgctcaaaatcttgttaaggaggaaaaagatgaatccttaaaggttgtccctaatgctgctaatattttgaaagattcaagtgttagtggttctaaaggagatgacactcaaatggtggaaactgtgtag

SEQ ID NO: 97693 - DNA, 444 bp, Glycine max
  Peptide Sequence Number=SeqID_214471
atgaccatggaccggttatcacaaagcagttcggactcacccacacgaggagaccccaaagtgttatccatagagtgtctcaagggaagttccaaagcccacgagtggaccggagacatgcttcaaaccggagacatcgtcgaagagcttcgaatcggagcttctcctaacgcgcttatcagcttcagatcgccttttaaaaacggcaagagtggcgttaatagaatcctgcaagactcctacaagaagaaagacacctctatccttgttctggttcgccgaggaccccacgagttcgccgagctgcaggcgtgtattgtccccaacgattcctccgggaagaagcactatgtcctccgctccatcactgatcctaactacgtcgttgccttcctggatcgaactgaaaccgagtgcttccaactccaagaattaaccatctag

SEQ ID NO: 97694 - DNA, 146 bp, Glycine max
  Peptide Sequence Number=SeqID_214472
atgcaagggttacgtggctccagacagataaaaggacaacttagagtttccaacacaggaaaggatttgaacttgtcagcactttatcagaaggctatgtcagtgatgaaaaacaagtatcaagttctcaaaaagcttatgagaag

SEQ ID NO: 97695 - DNA, 1017 bp, Glycine max
  Peptide Sequence Number=SeqID_214473
atggtaaatgcactaactaggacgcggttacaagatggatatgtctcgtatccatgggagaggaggatgcaggagttgctatcagttcccaattctagcaattttctttcaatattacttcttcccaaagtttcagataggatagctgctcgctacaatgatgtggaggatacactagccagggcaaatacgtggctgaatgcagctcaagcttcaggtgtccctattgtctttatgaatgtccaaaccgagtccctacttactaagatctctggagagacagcttcttccactgtaaatgcaggatcattatccgacttatctaaccttgcaaatgcaagcctttatggctttgaggattaccatggagtagacattggtgttgttagagcagttcggctctggtatgctccaatcggaggagagatctcaattgagataaaactaaaagaggacgacgcaaagcttggctttgccattagtcgtacagaagagggttttattttcatccaaacagttattgaggataaccaagaaaatgtaccagccacacgttcaggactcagcaatctgtataaagcagcaaaagatacttcaaagttgttggtagtatctaggctttcaaatcagagagtcctcccatggatggtctcttcaacaggagccattaggtgttatgacactgtttcattgagccagaaactctccttgcatagacacaccaaagttcctattctccttcatgtcttcctttgggatagaacattggcttcaagtttagaaagtacaagattgagttcattatctccttcagtgttgccattaccattatcacaagaagttcaattggcaccccatccaaatgagaaccaaatacagccattgccccatgaagggtctgatgcaggtggtggtgtcagcagtgttggttctcagccaatgcagctcgagagagacacagctggggatctctcattcagattccacaacttctcagtgtccaactgctggttatga

SEQ ID NO: 97696 - DNA, 249 bp, Glycine max
  Peptide Sequence Number=SeqID_214474
atggccattaagaaagctctaatccttgtgatcttcattttccttgtttcattgccatttcttcaatcctctacttcaagtcgtatatatcaaacaaacatggcaggaaccgggtccatagcaacaaacaaagaggttgcaagatttgggaatgaagctgcttctgctggcatagtagaagactcggcaagagaagtccctacgggacctgacccccttcatcacaacaaccaccctataggccattga

SEQ ID NO: 97697 - DNA, 237 bp, Glycine max
  Peptide Sequence Number=SeqID_214475
atgtctgatctagcaggcaacctcctaaagaagttgagtggaactgatggaagtttgtggcggaatctggggtgccttagcataaagaagccaatgagaagggagaggaatggcaccaaaatcaaagctgtggctgtgagtgaagctgaaagcaaatcagtgaaagttaaagccgtaatcactgttcagccaaccgttgctaggtcaatcaattctcttggagcttgctcgcactga

SEQ ID NO: 97698 - DNA, 522 bp, Glycine max
  Peptide Sequence Number=SeqID_214476
atggaccccttcccaacctggatccagtgcgatcgcactcctgaacaatgctcagggtctggcctgcagacgaaattagagaaagaaactatcaaagattatgcccacagtacgcatcgatcagcacaagagattaaatacaaggctgaatttgaagtaccagatagctttggtgaggttggggccatttctgtggagaatgagcatcacagagaaatgttcatcaaggacattgtgcttgatggtttcctcttgcgtcctgttaaatttacctgcgaatcctggattcactccaagtatgataaccctgttaagagggtgtttttctccaacaagtcatatttgccgtctgaaacaccagaagaagtgaagaggttaagagaagagcagctagaacacttacgggacaaaggtcaaggtgaacgcaagaggttggagagaatctacgaatacgatgcgtacaatgatcttggagagagtaccacaacttcagtattaattagaaatgttttaattaattaa

SEQ ID NO: 97699 - DNA, 1770 bp, Glycine max
  Peptide Sequence Number=SeqID_214477
atggctgcaacaacagcaacttcagcacaggtttccaaagactacaaggatagcaacaatggcaaccctgaaattacgaggcaggaaattcaagccgccatagccaaagctgtggagctaagagctcttcatgcggctttaatgcgaggaaatagcccagccaatgctagattcccatccccttcccctgcttcgggccctgtttcacacttctctgctcaagattaccctgttttcacacctagctatgaagatgactctatggtggggtacactcaaaattccatgaaaagcttaacagtatcagaaagttgggatgggagtgtgctagaaggaggaaacagcgtagaaaacattgtagcatattacaagggaaaatcaagttcaagaaagggactatatgctggttttgctaaccttgaatctcacatatgccccactgaagatacgaaatctgtgactggctctagtgcaaatcaaattactgttcttcaaacatcgcctgcaaatgacgacttcttcaagtgtaggaggagaaacagtatggaggatttcaagtccgcatcgtcctgcaacaaatgtaaccctgccaccttaaccagtgaatttgagaatgcaagaaacagcaagagctccaacattgttgtccctgtcacggattcccactcgtctctccaatcccaacccaaaagcaagggagtgatttcttggttgtttcctaggttaaagaagaaacataagaatgagaattcccctaatagagcagaatctgaggatgtttctcaggttcttaaggacttgggtataatgtcaattgagacactaaagaaagagctggtggaagcaaacgagaaccgagatgtggccttaatggaagtttctgaaatgaggagttcattgggggagcttaaacagaagctggagtacttggagagttactgcgaagagctgaagaaagctttgaagcaagccatgcagacaagggattctcaaccttgtgaccaactaagtagtcttcctcagagagggaaatcatttgaagggaatggagaaaatttgatgcctgtgagtgaggaagtaatggtagaaggattcttgcagatagtgtcagagtccagattatcagtgaagcagttctgtaagacccttataaaccacattgaagaaactgatcattctttgacagaaaacttgaacttgcttctccaaccatataagttgtctctgaattccaagtactcaaaggcagttctataccattttgaagcttttataaaccagtttctctaccaagactttgagaattgtgttttccaaaagaacggttgctcaaaattcctagacccacagcaggatcgtcaagcacaattctcctcattcgttgccctcaggaatttgagctggagtgaggtactgagaaagggaacaaaatattacagtgaagagtttagcaagttctgtgatcagaaaatgagttgtatcaacactagtctaaaatggacaaggccttggcctgaacagctccttcaagctttctttgtggcagctaagtgcatgtggctgctacatttgcttgccttttctttcaatccaccattgggaattttaagggtcgaagagaataaaacctttgaccctcagtacatggaagatatgtgtccgaggtcacaaggtccaagcagagttaagatcatggtgatgccggggttttatgttcaggatagggtcttgaggtgtaaggttctttgcaggtacaagtctgcagcctaa

SEQ ID NO: 97700 - DNA, 177 bp, Glycine max
  Peptide Sequence Number=SeqID_214478
atgccttgcggaaggcttgacgttgaacttgatccatcagctgccctagccctcgcaagctggctaacattaccatggtgcccaatgcatgcaattaagaaggtgatgcggaccttccagcttcccgtgacaaagatgatgagacaaatgcgatgcatgagtgatgacatggcatga

SEQ ID NO: 97701 - DNA, 4476 bp, Glycine max
  Peptide Sequence Number=SeqID_214479
atggatgcaagtgaccttgaaaaggatttgttcagcaaagtagagacaaatgactactacaccactgttttaaagattaaagggctagaacatttgcctgttggattctattattttagtgaatatatggaagatcctagcacaatgggacatccagttgcaatgcagagattttattctgacactaatatattcttattatggtcctacggcaactctgttgatattaaggaaccgacagtcatggagcttgtaatcaagacaatagaagccattgggggagaggttgagcatgtcattcttcagcgtgctttatgtattttcctcatgttggcagccaagttggaatctgagcttcaaggttcaaggaatacttattatgtaggcggacttatggcatttgagctcacagagagaaattcatcttatgccatggctttgatctgcaagaactttgcatataggaatgattttccaatatttccttacaccaagaatttgtttcccttgcaagctttgtgccagaaaaagaatcgtagagaattaggtgaattgccagaagtgcaatttcctaatttgcctactttgaatagctacttaacgcactggggaactcatccaatcactcaaaacagggctctttatacttggattaatgaagaagggactccagtatgccaaaggacctatggagaactatattttaattcttcttgcattgctcataagctcctaacaagccaaaagccagttatcaagcccggtgacaaggttctcctgatctatgtccctggtttggattttattgatgccttctttggatgcctaagagctaaagtcataccagtccccattcttcctccagatcccatgcaaagaaatggacaagcactaattcgaattgaaaacgttgccaagtcatgtaacattgtggcaattttatcaactgtagcttatcactcagcagtccgtgcaggttcgttgaaaaatttaatctcattaactgaaaaaaatgggaaatcctcagctcggtggccgaatcttccatggttgcacactggtacatgggtcaagaactccaaaagtatgattctggaacatcttgacaaacaatgtgaacctcagccaggtgatatatgtttcttgcaatttacctcaggttcaactagtgatgccaaaggagtcatgattactcatggtgggctaattcacaatgtaaagttcatgcgaacaagatacaagagcacctcaaggacaacgctagtaagctggctccctcagtatcatgacatggggctgattgggggactttttacatctcttgttagtggtggatctgcagttttattttcaccgatgacatttatcaagaaaccactcttatggcttgaaactattagcaagtatcaagcaactcatagcgctggacccaactttgcctttgagttactgattcaaagattggagtctgacaaggataagcttcagaatttagacctctcatccttgacttttcttatggttgctgctgaaccagtgagacagaagaccatgaaaagatttattgagctaaccagtccttttggcttatctgaaaaggtgatggctcctggatatggcttagcagaaaattgtgtgtttgtcagctgtgcatttggagaaggtaagccaatcattgttgattggcagggaagaatttgttgtggatatgttaatcacaaggatgcggatgttgacattagaatagttgatccagagacttgtgaagagcttcaagaagatggaaaggagggagagatctggattagtagtccaagtgcaggcataggatactggggaagggaagaattgagtcaaaaaactttcaggaatgaacttcataatcatcctggacgtagctacacaagaactggagacttgggacgaataatagatcagaagttattcatcactggaaggatcaaggatcttatcattgttgctggaagaaatatttactcggcagatgttgaaaagacagttgagacttcatcagaatttcttcgtcctggttgctgtgctgtcattggagtccctgaggaaattttatcagcaaaggggatttccactccagatggctctgatcaggttggcttggttgtgattgcagaagtaagggatggaaagccagtcagcaaagatttgattgagaaaattaagactcgtgtggtagaagaacatggagtcaatgttgcttctgtcaagttgatcaagcctagaaccatcagcaaaacaacatcaggaaaaatcaagagatttgaatgtgtcaaacagttcacagatgaaacactgaacttggtaccacaaggttcaaaaactattttgacaaagaagtctttgttaaggccattcactacaggagcatggggagaagaaaaaagaccagggacacagcaagtaagaagtatacttgcacctaggaaaaggatcagtaagaatgaaattgtagagttcttgaaagggcttatttctgagcagacgggaatcccaatcaacgacatctcagtcacagacaacctgacatcctatggaattgactcaattggtgtggttaaagcaactcaaaaactgtcagatttcttaggaactccagttgcagctatagatgatctcctatcaaagtctcagcctcaactttcaagcaatctgcccaacattccagaagctgagagtgattctactgaattcattgtggaggcccaagaaatttcttctaaaattctggctatacacctcagaggaacagtgcttctaaattactggtttgagatgctgggtgcaaggattggatcctcagttttacttgatacagttgacatcactgacccatctatggtgtcaattggagatgaagttgtcatttctgaaggtgttttggttcaaagccacgaggtaaagaatggaattttaagtttccatcctattaggattggcaaatgttcttccattggaccttatgctgttatccaaaaaggaagtgttattggagaaggtgttgaggtacaggccctgcggaaggttggacaagaccaacatgtgttcaaacctgcaaagcttaataatgataacaagaaatgttatgtacaatcattgcctacttcttatatatttggttctccaagcaacctccatcaccccaacacttcacctttcgcctacttgcttcatggtttcatactcatcattctcaccactgcttttactcgtctcctcaaaacttgtcaaaagaaaacccaatttaaaacccagcttcaatgccaaatgataacttcctgccaccttagatgtgcaaaacttctctcaggaacagaagccttctgcatatatctacgccttttgggtgcaaaaattggcaagcattgttccattagagccatcaaccgagtttcaaatccagagttaatgtctattggtgatggtgtccatcttggagattttagctgtgtaattacaggctttcattcttcaagtggatatgttagtggagaagttgaggttcaggacaattcggttattggtagtcaaagtctaatcctccctggttctctagtccaaaagaatgtgattcttggtgcactttcagttgctccaatgaattctacacttcaagagggtggtgtctacattggatcacagtcccaagttgtcataaggaactcagtgaagaatgcttatgatgaagggatagaagagatggacatggtaagcaagaaaagagttggtaatttggctgcagcactgcacaaaaatgactcacagaaagtgaccttgaccagaacatggtatcagaccttctccgcactcttcactcagccactgctacaaacagtgttacctcatatggtgttaggtttagcagtttttgctcccttgaactgtgttgtttacctaaagagtgccaagaatcttccaatatactggttgcttcccttgttttggattcactcgggagccttagccgcattggcgtgtgtgatagcaaaatggattcttgcaggaaagaaaaaggcaggtgaagcagtgcctatatggagtcaaaggatcacattggacagcacatggcaggccattagaaccttagttggagactattttatggacatgacaagtggatcattttggtttgtgctgtggatgaagttgatgggtgcaaaagtggatatggaacatgcagtttatgtagatagcatgggggccttattgaaccctgaaatggtgaagattgagagagggggttgtgtggggagagaagccttgctctttggacatgtatatgaaggggaaggaggaatggtgaagtttggagagatcaaaattggagaatatgggtttgcagggagtagagctgtggcgatgccaggtgtgcaaatagagagtgagggcaatcttagtgctttgtcacttgccatgaaggaagaaatcattagatcaaggtga

SEQ ID NO: 97702 - DNA, 312 bp, Glycine max
  Peptide Sequence Number=SeqID_214480
atgtgttttctacggattctttttttgcaaaatttgcagaaaaatcctcagtataggccaaaaacatggacgcaattgcaccgcttccggctttggagcatcaagatacaagaggatgtaaagcttaattacactaatatctatttagcgtttgactactgggttttagcagtagctaagaaacatatatatttcaaagttagcaacccgaaactccacacccacctttttgcatgggcagaggttgatctaatggcgatgaaagatcggaatgtcgcagttaagagggatgtgatggagactcgttgttaa

SEQ ID NO: 97703 - DNA, 351 bp, Glycine max
  Peptide Sequence Number=SeqID_214481
atggtttatgcaaccacttacaacaggaaattatccagaaaccatgcagtctttgctgggaagtcgattaccaaacttcacaggagcaatccaagctacttattggatacttacagaattgactacttctatcgccatctttattatattctaattgcaatcaaggatggggtgaatgtacaaggatattttgcatggtcgcttatggacaactttgaatggagtgctggctacaccttgcgttttggaattaacttcgttgattacaaggataatttgaaaagacaccaaaaagctctctgcccatttggtttaggaattttcttcaaaaatactagactcattgtatga

SEQ ID NO: 97704 - DNA, 171 bp, Glycine max
  Peptide Sequence Number=SeqID_214482
atgaaacctgagggaaaacggcttcaatttagagaagaaacatcaagaataggcgcaacagcatgtgtgattgtaacggaggagcttataacaagagtgaagacaccaactaggagaaggagaatggcatcaacatctgtttgttgcaacttgcaagctagcattaaataa

SEQ ID NO: 97705 - DNA, 2214 bp, Glycine max
  Peptide Sequence Number=SeqID_214483
atgttccttgaaaccatccacctcgatggcttccctgagggtcctattcattttcattgtgcctcttgggttcactccaagttcgataatcccaccaatagggtcttcttctccaacaagtgttacttaccgcaagagacaccgggtggtttaagaagactaagagcaaaagaattgagtaatctgcgaggcaatggagaaggagaacgcaagagctttgaaagaatatacgattacgacatatacaatgacattggagatcctgataaaagccttgaacttcagagacctcctttaggaggtaacgagagaccttatcctagacgttgtcgaactggtcgtccacatagtgaagcagatccattgtcagagaaaagaagtagaaagttttacgttccaagggacgagtgcttctcagaggtgaagcagttgacgttctcaaccaagacattacactcggtgttacttatattgcttccatctctggggaaaattatcaaagaaaaggaccttgcattttcctacttcgacgacatagattcactcttcagccatggacttgacttgcctcctgaagaaaccgagaagggattcctaggaaaaatcatgcctaggctagtcaaatccatttctggtgacagggcacacgtgcttcgcttcgagaccccagagactatgagcagggacagatttttctggtttagggatgaggaatttgctagacagactgttgctggtctcaacccatatagcatacgattggtcacagaatggccattgaaaagtaaacttgacccagaaaaatatggtccaccagaatcagcaatcacctcagaaattatcaacaaagagattggaggcataatgtctgtagaaaaggcgattgaagaaaagaagctgttcatgttagactaccatgacgtacttttaccctacgtcaacaaagtacgcaaactcaaggggaaaacactgtatggttcacgaactttgttctttctaaacccagaggggacactgaggcctctagccattgagcttactcgaccaccatcattgtcaaataaaacaggccaatggaagcaagttttcacgccttcttggcactcaaccagtgtttggctctggaggttagccaaggctcatgttcttgcacatgactctggctatcaccaacttgttagtcattggttaagaactcactgtgcgacagagccgtatgttattgcaaccaacagacaacttagtgagatgcaccccataaacaaattgctacaccctcatttccgttacacaatggagattaacgctcttgcacgggaagcacttattaatgctgatggcacaattgagagctcatttgcaccaggaaagtatgccttagagattagctccgctgcttatgctctcgaatggcggtttgacaagcaggcactaccagcagatctaattagaaggggaattgctgttgaagatccattttctccacatggcttaaagcttaccattcaagactatccttttgccaatgatggactccttctgtgggatgctataaagctatgggtcactgactatgtcaaccactactaccctgaaccaagtcttgtagagtcagatgaagagctgcaggcatggtggacagagattagaacccttggtcatgctgacaaaaaagatgagccatggtggccacatcttaaaaccccaaaaaacctcattggaatcctcaacacaatcatatgggtaacttctggtcaccatgcagctgtgaactttgggcaatatgtttatgggggatatttcccaaataggcctacaattgccaggactaaaatgccctcagaggaccctacagaagaagagtggaaaaagttcattgaaaagcctgaaagagcacttctgaagtgctttccttcacaacttcaagcaactagagtcatggctgtcttggacatactctcaactcattcaccagatgaggaatacataggagaaaagatggaaccatcatggggtgaagatcctgtcataaaggcttcctttgaaagatttagagagagactgaagaaactagaaacactgattgatgagaggaatggaaacacaaagttgaagaacagaaatggagctggcattgtaccgtacgagcttttgaaacctttctcaaagccaggtgtgactggaatgggggttccctgtagtatatctatttaa

SEQ ID NO: 97706 - DNA, 538 bp, Glycine max
  Peptide Sequence Number=SeqID_214484
atggcctttttgcaacaggaggctcaaaatatctttaaaagtctcttccaatccatagaaagatgcacccctagtagcttggtccttcatgatatccctaaggtatctcaggattttcatgattctctacttaatcttgttaccagtgaggaagtttgttttgcaaccttttccatggcaccttacaaggctcctggagttaatggttttcagcctattttctatcaatcatattggcatattattagtgatggtgtttggaggttggtgaataaggcattctatacaggtagcattcctcctaaacttgatgagactctcattgtcccagtacttaaagttgataatcctacatcttttaggggctttaggtctattaatttgtgcaatgttattttcaacgttatttgtaaggttcttgtcaatagaatgagacctcaccttggcagtataattggccctcttcaaagtagcttcatccctaatggaggaacatttgataatgctatgattacccattatatgcacaagaagaaag

SEQ ID NO: 97707 - DNA, 237 bp, Glycine max
  Peptide Sequence Number=SeqID_214485
atgaccttttcatgtcatattgtgaaatttgagttgcagaatgaattggtgcatggaatggccccaaagaagcttttgtctaagaaggcaaggaaagatgccgttggagaaggttctagtgcagccccacaagtggacgtggagttcggcggacatagattcgaagtgaggaacaccagtgccgttttgaggcaattaagggttggtcattccttaaggaaagacgggtctagttaa

SEQ ID NO: 97708 - DNA, 303 bp, Glycine max
  Peptide Sequence Number=SeqID_214486
atgagaaaagaaacaagggcctacctgcgtggggaaacggaggcgacgacgtgcaacaatggatgcgtttggttcgcttgcgagaaatggcaaggagaagacgaagaagaattgttttcgtatttggctgcgtccaatcgcgcgcgtcttgttgtccaaccatgtccggtgacagtagaagcattggacaccgtgtcgcaccggagtcgtaccagcatgcgtgtccggtgcgcgtccgacgcgggacacgctgctgaagtgcctcgtccgtgcttcttaggatataacgtcccttattgttga

SEQ ID NO: 97709 - DNA, 138 bp, Glycine max
  Peptide Sequence Number=SeqID_214487
atgaatctggattttctggctcataggattgagatttcaaattcagaaggtggaggggaaagcaccggtcagtgggctgtgaggaaggctccttcgtctgatcttcactcattcttctcccaccctctcttcccttga

SEQ ID NO: 97710 - DNA, 489 bp, Glycine max
  Peptide Sequence Number=SeqID_214488
atggttgatgttcatgcattttgggagttaggattgtgtgcgagtttgaaacatacatgtttggctgaaggtttggctcagggctttggtgttgaagcttgtggtcccaaaagtggaggtctgtcatacatggcttttactaaggaggttaaccatggggattatttggtttgtgagcccattttaaagtatgttgaaggaggcataactttgttatcagagatagacattggcaaatggagcttttttgaatttgttgggtttctgaagcaggatgttaagattaagggagatttaaaattatggtgggagggggttgatgttggacttaaagagttgatgctggattgccatgttgttgagacgttgaatcatgggttggctgattttgcgaatgttgttgatgtggaggaaggtgttggtgttggaattgctaagcttgaaggtgttggtggggttgctgaaggtgttcttggtatgagatgctag

SEQ ID NO: 97711 - DNA, 399 bp, Glycine max
  Peptide Sequence Number=SeqID_214489
atggaagaacacaaagttccagcacaagctacctttctctcgacacaagcaaagacaccctcttttttcaccttctcaacactagcatttcactctcgtctgcacttggggatatataaattcaccaagctgaagctgaaagcgctaccacggatggcgacatcctccaagaggcaactcaccagcatggatgacaccttcctgagcctacgcctgagcacctgtaggtgctgcagcccacacttgaagcctgcaaagctgaagtcgctggtcaaaccagcgcttccattcagcctcccggacgcgccaatactaatggcgacaacactgtctgtgttgccagttgcagtggcgacatgccacgtgtcacctcctccccgaaggcgccaatggagatga

SEQ ID NO: 97712 - DNA, 324 bp, Glycine max
  Peptide Sequence Number=SeqID_214490
atggaaatgtcctcattccatcaatttctcgatgaatcacttagtgaggcactcaattgtttccacagactacttagaaagacacctacacatgggtacaatgatccttctagaactcacaacctaagatgcaacactggcctaaaacaagctattggcccgacagatagaggccttgacagagaccctcagcaagctccctcagcaactacaagcggtaagttaaagtccctctcactcttcaatcatgcaaataaggggatgccacatttgtggtggagcacacgagccagagtaatgcatagaccaagaagattcttctag

SEQ ID NO: 97713 - DNA, 348 bp, Glycine max
  Peptide Sequence Number=SeqID_214491
atgaaagaacaacaagaggtgcagaggaatcaagaagagagaggaccttcatcatccgaattatcttctccctcgcggctgattcaagggaatttattccatggcctaccgaatgaagatctgtacgcacacctggccacacacattgagatctgcaacatggtgaagataacaggagtgccagaagacgccatccgcctcaacttattttctttctccttgaccagtgaagcaaaaagatggcttcactcatttaagaggaatagcatgtggacatgggaagaggtggtggagaagttcctgaagaagtacttcccggagtccaagactgttgagggaaaggtgtaa

SEQ ID NO: 97714 - DNA, 204 bp, Glycine max
  Peptide Sequence Number=SeqID_214492
atgatagacccatgtggcgttaagattgtaccatcagggaaatggaggttgatagacctttcccgggctcactacaaccatttggttgttgagcaaggatgggaatggattttgtgggtgatgttggggaggtctttgtggttgattgggcattctctgttggaggggcgtcggccagggggagagccaatattggctaagtaa

SEQ ID NO: 97715 - DNA, 297 bp, Glycine max
  Peptide Sequence Number=SeqID_214493
atgggtaagcttaactcactcaaacataacaagtttagcatgctttcgtcaaatctcttcacaaataactatcacaaagcattacccaaccaaaactgcccatcatatctcccaaagcctcatatccacaaaaatcaaagatgcgcttcacgactctggaaatgccttcctttcgcgatttggagcagaaatggtgaccaaaggttggagctttgttgggcaacaatggtggatgagagaaaagaagaagaaggctgcgtgagagagagggagagagcttctgaaaattggggttga

SEQ ID NO: 97716 - DNA, 216 bp, Glycine max
  Peptide Sequence Number=SeqID_214494
atggttacgcgatccgtgaaattctgtaatgtggtggaaaccaaaaggaagtattgttacgcaatccgggtgcaaatagcaatcatgcccacttgggccttccagattcttcctccaaaagccggttgcttttggaggaaggaacctggctcggctaggcgagctgagctcgtctgggcgtgctgggtggcaagctcctcccctattttgctataa

SEQ ID NO: 97717 - DNA, 1335 bp, Glycine max
  Peptide Sequence Number=SeqID_214495
cgtaaccgctcggctcagcgagatagaggccatgctggcccaggcggccaaggcccgcatgggcgcggtcgtgacagccgtgtactggcgggtcagcgaccagaacgctgccgcccaggcccaggtgcattccgtggccgtgcgcacaccgcgtcccgtccagcccgtggccgtccccgcagtggctgcgatggaggccgtggcgccccagcgccgcaggcaggacacggcgccgttcgagcccatagacgaccaggaaatggccgcattcaagatggccgtggcggccatgcccgctgcagcccgtggtgcgggctctgcagctgcggcgcccgccggcgtgcgccgctcgggccccttgctcgggccgggcgcaggcgaacgcggcgcggactttcaccacagcacgctggaccatctggacctgggtgtcacccagtacggcgaactgcgctgaccgggcgccgccctgattcagtggccggcgaaatccaccagcgtgaacagcggcaggccgccatcgtgcagcagggtggagccgcccagttcgggcagatccacgatggccgcgccctcgatcaccgtggcgcccagcttttccagcaatctcttgccggccatcatggtgccgccggtggcgatcaggtcgtcgatcagcagtacgcgatcgccggtcttgacggcatctgtgtgcagctccaccgtggcgctgccgtattcgagcttataggtttcctccaccgtggtgaacggcagcttgcccttcttgcggatgggcacaaagccaacgcccagctcgtgggccaccacggcacccaggatgaagccgcgtgcatcgagccctgccaccacgtcggggcgcatgccgcgctgcatgtagcggtgcacgaaggcgtcggtcatcacgcgaaagacctggggatcctgcagcagcggcgtgatgtcgcggaactgcacgccgggcgccggccagtcgggcacggtgcgtatgtgcgatcgcaggtagtcgttgacgctgagggtggtttgcatggcgctggatcgggggctggaaagaacgggccagtggtcctgcgcctggcccgcgacaccctgggcatcgaggccgatgcccttcttgccatgtcgcagcgcctggatggcgtgttcggtgaagtggtgcagcgcatcctgagcctgtccggccgcgtcgtcgtgatgggcatgggcaagagtggccacgtcgggcgcaaggtggcgggccaccctggcatccacgggcactctcgccttcttcgtgcatccgggcgaggccagccatggcgacctgggcatggtgaccgtgcatcgatctgg

SEQ ID NO: 97718 - DNA, 204 bp, Glycine max
  Peptide Sequence Number=SeqID_214496
atgaagcttacctcgactccaacagtgacagtggcagtgagattggccacaagtggtagtgagaaagaagagtcacgatgtggagagtttgtgacagagaggaacatgagttgcggtgaagaggataatgcgggggacactagagttatggtagaggcgaagatacgcaatagatgtgagtcaattagggtgtggagccaataa

SEQ ID NO: 97719 - DNA, 354 bp, Glycine max
  Peptide Sequence Number=SeqID_214497
atggtcattatgtgtctcgtcgctcaggctcgatcgtgtccaacaaaatgcagagacaaattatggttccactggcagggaggttcactggccgagtggtgtttcgctcgaacgaaattagtgtcttatctttacttcccttttatctccaataaaagacaagtaaagaggggcaactgtcataccctaatttcgtctggggaccatccgttgttgggatgcgaccctcatttgaccacttcgaggtacttggcacccatcgttaggaaattcgtgaagtttcgtgacgtgccggaagtcaaaagaaagcattgtagcacaattagtgaagttccgcgacatgacggaaattaa

SEQ ID NO: 97720 - DNA, 501 bp, Glycine max
  Peptide Sequence Number=SeqID_214498
atggatatcattccagacaagtatcccttaagcgtgcaaaatatcaaatttggatctaaattgtatgtcaacactgatattacagagatacatgaattttgtcaaagtttatctgtgccattttattctggtgggatgatcaatgataaagatggttctcagtcccaatctagccagagtaatgtggtggaaaaatttctgcagaatgctcaagtggtcagtataggtcaaatcaacaatctcagacaggattgttactgcttaactgttggaacaattgacgaaatcattattgatgctccatggagttatgacaattgtcctaattgtacaacgacatttgatccatcaaaaggtggctcagcttgccgttcttgccataccagtgtggtcgatacagttccacgattagccatgataattttttgtactaattatttatttacacgctttgctgttttagcaaatttccttgaaatttctatggatgtcaaggtataa

SEQ ID NO: 97721 - DNA, 324 bp, Glycine max
  Peptide Sequence Number=SeqID_214499
atggttaagactagaggattaggtcgtgtcttaggtagggttgttggcaaaggtttggggagaggggatggtgatgattctgatggtgctcctcagtgccaaaggccaaccgcatcggcacgctggcgacgggtacctatcactgttgccgatgatgtgcctatagtacctgcggactcgcctgtggtacctgtcgcaacgtgcccttcgcgggcgagcgagggcgaggctcacgggtgcgctttccaaaggaggaaaggtcgaaaaaagcggggcttttgctcctacgtaccctcctttggagaggaaatcagacctacgtag

SEQ ID NO: 97722 - DNA, 828 bp, Glycine max
  Peptide Sequence Number=SeqID_214500
atgaagaacgaaagagcagcacctcgcggaagaatggaagaagaagaggcacttgaaggagggagaagcagcagctcgcgcagaagaagaatcaccaagaagaagaaaagcctcgctgaagaaggagaagaagaaaagcctcgcggaaaggaagaagaaatggctcgctggcaacaacctttttcaagcatggagaagttcctgaatcaaaattctgttcgggattcactaggggttgggaaaattcattttgtttcttgtagcactaaagtttctctggctatgtttgtggattggatgaggaatcttgaaattggtattcctccccttcttgaggatggaaccaatttgcttgtttatgccggggaatatgatctcatgggtaactggcttgtcggtaactcaagattggtccgtgccatggaatggtctggtcagaaagagtttgcaacctcacttaaagttccttttgttgttgatggatcagaagccgaattattgaagatctatggacctctaagtttccttaagctcaaagaaaactgggaaaggaaagagtcccagaaaggttcgtctttgtcgcaaattgggctgcacttccgtgactgcaaccacattgtggagttcgtctttgtggagttcgtctcttccacttatcgattgagctcgaagaaaactaggaaaggaaagagtcccggaaagggttggaatcgattttggaagtccattgtggttggctttaagactcccagggaagccatcaaagtcgctgtcaaggttcgttgttgcttctgttctgtgtgctggttagtgataagtgctgattag

SEQ ID NO: 97723 - DNA, 276 bp, Glycine max
  Peptide Sequence Number=SeqID_214501
atggcgactccgcgcatctttcctcctttggaaagcgcacccgtgagcctcgcctcgcttgcccgcaaaagggcacgttgcgacaaatccttcctccagaaggctgttgcttctggaggaagcaaccttgctcgcctgggcgagctgggtggcaagctcctcccctattttgctataaatagggggaggagtgaagaagaaaatggttcagccttcttggcacttctccctctctcgaaattgctaaggaaaattattttcgtgaagaaaatctaa

SEQ ID NO: 97724 - DNA, 207 bp, Glycine max
  Peptide Sequence Number=SeqID_214502
atgtcgcgggggtcaggagaccttggggacgacaggcgagctcctggcagtcaaccgataaaagaacaaagaccacaaagcaaggaggtttgtgtggtggctggccagctatggatcttgagtgatatttgggatatggcctctggtaatcgattaccaagggtgggtaatcgattacaaggcttaaaagtgaagacaggaagttaa

SEQ ID NO: 97725 - DNA, 453 bp, Glycine max
  Peptide Sequence Number=SeqID_214503
atggctaaatatgatccaaaaaaagtcatggagttctacgtcaatgcatggcccacggaggagggagttagggacaagcactcctgggacttcgcccgaagtgagatatggagacgggtgcagatcatgcgcactagcatgaccaccctgacacagatctggatgacattgcgtctcagcaacatcctccccaacaatcataattccgaccttcccttgccaaagtgccagccagtctatgccatcttgacccagggccttcatagaaaactaatgtatgccaaggcaggcacaacagtggggttaggcacagcagtagggggaggaccatcatcagccagccacagatgcaccaccactgcctcctcatcagcctccttccttagagtccatctctactcacctgcagaggatagagctccagatgcatgcatatatgcaacatgtgactga

SEQ ID NO: 97726 - DNA, 463 bp, Glycine max
  Peptide Sequence Number=SeqID_214504
atggaagatgaaggttttcacccgccccaaaacacagatctttatcgacacggatatgtcataggtggcactggtgctgggaagactacaacaattatttccttgataactgctataaagaaagcttacaataacacgataatcatgatttttgacccgcacggagacatggctgaagaggttgcttcatattttgcagatgacgaaaaactaatctacttccaccctgtagattcagggatttcaatcaacccattagcactgccaaacatcccacataaagaacaagccttgctactagggttcagcaatgttatggaaatattcgagaaactatttggacttaaggataccgcagtttacgtaaaatatatcattcaagtatcaatgcagctactttattctaaaactccagaacctacatttagagatctatacagaattatttacaaactgaggacag

SEQ ID NO: 97727 - DNA, 1152 bp, Glycine max
  Peptide Sequence Number=SeqID_214505
atggacgagccagtgcaattaaaatttttgaatcttgcatcaaataatttgtcaggagagatacctgattgctggatgaattggacatctcttgtgtatgtaaatttacaaagcaaccattttgttgggaacttaccccaatccatgggttccttggcagacctgcagtcgttacaaattcgtaacaacacactctcaggaatatttccaaccagtttgaagaagaataaccaattgatatccttggaccttggggaaaataatctttcaggaactattccaacatgggttggagaaaagctcttaaatgtgaaaatcctcctccttcgatcaaacagttttaccggccacattccaaatgaaatatgtcagttgagtcttcttcaggttttagaccttgcacaaaacaatttgtctggcaatataccgagctgtttcagtaacttgagtgccatgacactaaagaaccaaagtacagatcctcgtatctattctcaagcacaatttggtttgctttacacttcctggtatagcatagttagtgtgctactatggctgaaaggaagaggagatgagtacagaaactttctgggtttggtaacaatcattgatctgtcaagtaacaagttattaggggaaataccaagagaaatcacatatctaaatggattgaattttttaaacttgtcccacaaccaattgattggtcatattccacaaggtataggtaatatgagatcattacagtccattgatttttcgaggaatcaactttctggtgaaatccctccaaccattgcaaatttgagctttctgagcatgctagacttgtcttataatcatttgaagggaactattccaacaggaactcaattgcaaacctttgatgcctccagcttcatcggcaacaatctatgtgggccaccactgcccataaactgcagctccaatgggaaaactcatagttatgaaggaagtgatgggcatggagtgaattggttttttgtgagtatgacaattggatttattgtgggattctggatagtgattgctcctttgctgatttgtagatcatggcgagggagagtagctgaacgtaaagaggggaaggataggaggtgtggggaaatggaactaaggataaccaagtaa

SEQ ID NO: 97728 - DNA, 345 bp, Glycine max
  Peptide Sequence Number=SeqID_214506
atgggcgatcgtgtccggtggcatgcagagacaaattatggtcattctgtatctcgccacccaggctcgatcgtttccaacaaaacgcagagacaaattatggtcattctgcgtcttgtatcaaccgagaggaacaaattcgacagtatcaggatgatgtgtcgacaagtaaataggggcaactgtcataccctaatttcgttcggggaccatccgttgttgggatacgaccctcgtttgaccactttgaggtacttggcacccatcgttaggcaattcgtgaagttccatgacatgccagaagtcaaaagaaagcattgtagcacaatccgtgaagttccgtga

SEQ ID NO: 97729 - DNA, 291 bp, Glycine max
  Peptide Sequence Number=SeqID_214507
atgtccttgtggggtaggattgcatcatttgcgcatgaccccaaagtcctacattgcaaagtaaggctcatgagaaccctagggccttctcctgcatctctggcccaatcttcttggagtcttttatccaatgcctttggggtttgggattgcatcaagcctcatcatgacttggagttcaggttgactctagcgggtctgaggagattgaggagtacaaaaaaactattgtggcagttagagccttcaaccgagaaggagtatgacgatcttcctgaagacatgccttaa

SEQ ID NO: 97730 - DNA, 171 bp, Glycine max
  Peptide Sequence Number=SeqID_214508
atgagtaaaagtgagggcaatggtgaagttgtgaattctgatatgcctgtatctgttgagcaaagtggtgagactgagatgatggaggaagacaaaaataagagggaagacgcaaagccttccaaacacctctttgacacggctttagcacgagtcaagagaatgagctga

SEQ ID NO: 97731 - DNA, 198 bp, Glycine max
  Peptide Sequence Number=SeqID_214509
atgacgtctgaggcagtaaaggaaatcattgagaagatcgtaagattctttggaggagcaggcatcaagggatcattcgtcccccatggacgtcaggatgtcttgattgctgccattaggcgagcagagcaccctggccgtgtccgtgctgctggagtcggtatcaccataaagcaatactttggatcgactccatga

SEQ ID NO: 97732 - DNA, 413 bp, Glycine max
  Peptide Sequence Number=SeqID_214510
atgaacgaacgttcgttcatattcactcgatggcgccaggcgcccccttcaccgtttcgggagctgccgatgggaaaccgagaaaagattgtcgaggccgcgctgcacagctttacccataggggatttcaccagaccagcatgcgggatatcgcgcaggcggcgggcgtcagcgtcggcaacctctataaccactttaccggcaaggaagcgttgatcggcgagatcgcgctgctggaaaacggcgtattcgccgagtttgccgccgggctgcgggccgacagaacgcggccgaagcaggcgctgtcggcctttttcaccgcctatcacgcctttgtcgccgagccggccaatgtgcagctgtcggctgagatcgtggcggaggtggcgcgcaacccggcgttggccgagcc

SEQ ID NO: 97733 - DNA, 147 bp, Glycine max
  Peptide Sequence Number=SeqID_214511
atggaaccttgcgtttggactaacgagcgtgaacaagagagacctttgagcgacgcaaagacgaaccgaaggagagctcacgatagggggtgcattaaccttgttggatgtcctcggtggggaaatagagtggttaaagagttttaa

SEQ ID NO: 97734 - DNA, 480 bp, Glycine max
  Peptide Sequence Number=SeqID_214512
atggtgtttgtatccccttccactagtgaatggcaatatttccagcctgggtctgccttatttttcctcgttgcacttgcagtagcagcatcggatgatggtctgacccgcgtcttcttcttcgtgacttcgtcttcttccttcgcgcgtcttcttcgtcttgttcgtgcgttgccggggcttgtcgtcggagctcatcgctgccgttcgtgcgttgttagggctcatcgcgatgcgtgcgcgtgcaaactgcgggaaggggtggtgtcgcagcggcggatgggtgcggcgggtgcgggagttacgcaggcagaggaggttctgaagggttgggtcgggtcggcccaactcctaccgcggacaaaaaccaaacaaattccgccatttccgccatttccgccaccccgccacgaccgccatgactatggcggccgccatcccaaacccgcaacgccaccgctattcggtggcgttttttga

SEQ ID NO: 97735 - DNA, 401 bp, Glycine max
  Peptide Sequence Number=SeqID_214513
atggatgaaccatcatccgatgctgctactgcaagtgcaacgaggaaaaataaggcagacccaggctggaaatattgccattcactagtggaaggggatacaaacaccattgtttgtaatttctgtggaaaaatcactaagggaggaataacccgagccaaacaacacctgattgggaagtcgggcgacgttgcagcttgcaagaaaactcccccaaatgtagtcgaagagttgaaggaatatatggctacaaaaaaaagtgggaccacttacagtacttctggcagtggtaatatggcaaatataagagactttgaatttggtgaaccgattggatgtgatggaagtgaagaagatgagtttgcagactcttttaatgctgctgcaagtgcaaagacaaa

SEQ ID NO: 97736 - DNA, 694 bp, Glycine max
  Peptide Sequence Number=SeqID_214514
atggaaactgcacaacttcgttacagttatggtataaagaattttgacactgccagacaaggcggtacttattggatagcaattgagatgataagggatattataagagggaactggaagacagagagtgcaaaaaattttctggagtggggtgtaccaactgcggcgtcgataatggaagtgagatattcagttccagattcctttctagtgggtagcggaggtattaggagtgggttagatgcagctaaggctatagccttaggtgctgatatcgctggtatggcattaccagtgttaaaaagtgctatagaaggtaaggaaagtttagaacaattctttagaaagataatatttgaattgaaggctgccatgatgcttactggttctaaagacgttaatgctttaaagaagaccagtattgttatcttagctgggggcaaaagacttagacccttaattctggtttcatcgtcagacttaattggcggggacaggcaaagggcatataaggcagcagctgccgtggagattcttcacaactttactctagttcatgacgacataatggatagggattacctaagacgaggattaccaactgttcatgtaaagtggggtgaaccaatggcaatacttgcaggggattactttcacgctaaggcttttgaagccttaaatgaggctctaaaag

SEQ ID NO: 97737 - DNA, 162 bp, Glycine max
  Peptide Sequence Number=SeqID_214515
atggctcaacaccgcattggccacaatggtgtttgggtggttcatggtgggtggcaagaggtggagacggggaaggaaggacatatttgtccgttatgttttctatggggtgcaggaaggaaacaaataggtgctggaacttacctcgttctaacagattaa

SEQ ID NO: 97738 - DNA, 667 bp, Glycine max
  Peptide Sequence Number=SeqID_214516
atgaattatgttttcgttcatgtgtcctccatcttcgagtttggagctttgcgtagtgattgcttagtgcaattctccattctcaaactttttcggagccccatgaattgcgttttcgttcatgtgtcctccaccttcgagtttggagctttgcgtagtgattgcttagtgcaattctccattctcaacctttttcggagccccatgaattgcattttcgttcatgtgtcctccaccttcgagtttggagctttgcgtagtgattgcttagtgcaattctccattctcaaacttttttggagccccatgaattgcgttttcgttcatgtgtcctccaccttcgagtttggagctttgcgtagtgattgcttagtgcaattctccattctcaacctttttcggagccccatgaattgcgttttcgttcatgtgtcccccaccttcgagtttggagttatgcgaatggattgcttagggcaattccccattctcaacctttttcggagccccatgaattgcgttttcgttcaggggtcccccaccttcaagtttggagctatgcgtagtgattgcttagtgcaattctccattctcaaccttttttggagccccatgaattgcgttttcgttcatgtgtcccccaccttcaagtttggagctttgcgta

SEQ ID NO: 97739 - DNA, 480 bp, Glycine max
  Peptide Sequence Number=SeqID_214517
atgccgatctccccctgcggaagtattagttggtttgtgccatcccgacataggggtcgcgcccacaagacacctagtggacccagagaagtccaacagggccctgaggtttccagctctggttacgggcctctatcagtcctacagggtgcccgtacccccccggcaaggtcatgccatcgcgacatagggatcgcgcccgcaggacacccagtggatccaaagaagtccaacagggtcttggggtttccagctctgattatgggcctctgtcagttctacggagtgcccgtcacccccagcaaggtcatcaggcctcctactaaccaagctttcatcaagaagtattgcgcccccgggcaggcagagggcgagacaccacaacagcctggggatggccagcaacatgtaacaaatgcaccgccgccacctccagagcccctcatctcatccacaaaaatgttagagtattgcctatga

SEQ ID NO: 97740 - DNA, 420 bp, Glycine max
  Peptide Sequence Number=SeqID_214518
atggcttatgggggtggagggtttgcaattggttaccctttagctgtggcattggagagaatgcaagacaactgccttcagaggtacctgcattgtttggctcaaatgataggatctaggcttgtatggcagagcttggtgtccctctcactaaggagattggttttcaccaggccagacaactacctcaaaggcataattaacaagtcagtgttttttttcaatacatttgcttcagcattaggttggaaaatcaaaattttaattgtacaacaagcatcaatgtttgtattcaacagtgctttgaaaggacttgatggtactcaacaaagtaaatccaagcctgctgctaggtggattgttgttaaatgtaatagacaaaaaggaagcactgagtgtggatattacgtcatgcactag

SEQ ID NO: 97741 - DNA, 231 bp, Glycine max
  Peptide Sequence Number=SeqID_214519
atggagaacgcgaaaaatgtggcgtgtgtgttacctcaacgcgttgtggacaagaaagaaaaaatcatttgggagcctcatcaaggctatggaaccatagaaaagagtacatcaaactatgatgaaggccaaattgatgtctcaaagttcaaggtcgagaatctacgtgggaagaggttgggagttagaatatctcgcatagtctcggagacaatgaggctagggatgtag

SEQ ID NO: 97742 - DNA, 585 bp, Glycine max
  Peptide Sequence Number=SeqID_214520
atgggtgactcagacaaatacgggttgtacattgaagaaaatcctccccgcctggttgccctaggaagactttatgagggatctacaaccgttcacaacatttcttttatgcatgatcaagtcaaggttggtgttgaggaggttagagatgcaaatactctcattcatgtacccactgaagagggagctgtggaacccatgaaacttgcagataggccggatcatgatctcgatgatcccctatatctgatgacattgaccatcccacaactttttctaaagctattgcaggttatgtgggatgctaccatgtttggggtgtttaatgacaacttccccttgtacataaagcatgaagatctgtctgaaatagcatacggtggtcaatgtctcagcatctctattatacagttgtggattcttgcacattggcaaatggttgtcattttgcctaaggaaaatgttgtgatctggttttgttcgttgcataataggtcagacaactatctgaaaggaataattaacagtgttttgaaaggatttgacgatactccacaaagtaaatccaaggttgttgctaggtga

SEQ ID NO: 97743 - DNA, 249 bp, Glycine max
  Peptide Sequence Number=SeqID_214521
gaacttttcaaaattgaacatggagtgtgcacaaattgccaattcgactgtcataagctcgttgaggatataagacctttgtcattggaaaggcggcgtgagtacatagagaaagtagcaccgaaagttgctaaacggaagaaaatgtttgagaagcttgtcaatgaaccaactgaaggcaatgcatggcatgctgaccatattgttccagtatatgacggaggaggtagaattcattttaaagtttaa

SEQ ID NO: 97744 - DNA, 438 bp, Glycine max
  Peptide Sequence Number=SeqID_214522
atggaggttgaaggtatttcttatttagactcatctttgaacagtgataattgtgaagagcaatctgcacgcagagatgcagtaggtgaaacacaattggataagcaaccttctgcagaaaattcaaatgaatccgaagcaaatcgagatgataaatctgatgagacttttcttaataactcaattcagagttctaatattatggctgaaaatatttcctgccaagatttaggcaaggcttcagtactggatggaacttgtgatgttgatgtttttgatggcatggagagatgtcctgaaaagagttttgaagatggagatcaagaaatacgggatttgaaaaaaatttcaacaacagaagcagatgacaaccagtctgttaatctggttgaagtcaatggacattgttctaatcaagttgattttcttcgatttgag

SEQ ID NO: 97745 - DNA, 1153 bp, Glycine max
  Peptide Sequence Number=SeqID_214523
ccctcaccttcagaggactacacgccctcgccttcagagggctacacgccctcgccttcagagcagtacgcatcctccccttgagagggctaaacgcccttgccatcgtaggacttcacgcccttaccttcaaaggagtacacgtcctcaccttcagaggactacacatcgttgccatcagagggctacaagtcatcgccttcagtgggttacacgtcctacccttcaaaggactacaggccctcaccttcagaggactacacatcctcgcattcagagggctacacgccctcgccttcagaggactacacgtcctcgccttcagagggctgcacatcatcgccttaagaggactgcacgtcctcaccttcagtgggctacacgctctcgccttcatagggctacacgccctcaccttcagaggactactcgtccccaccttcagaggaatacacgtgctcacctttagagaactacgcgtcctcaacttcattgcactacaagccctcgccttcagaggactacacgccctcgcctttagaggactacatgtcctccaagtcagaggactacacgtcctcccctttagaggaccacacgtccccgccttcagagagctacacaccctcaccttcagaggactacacgccctcgccatcagagaactacacgtcctcaccttcagaccactatatgccctcgccttaatagaactgcatgttctcaccttcaaaggactacacgtcctcgccttcagagggatacacgtcctcgccttcagaggagtacacatcctccccttgagagcgctacacgccctcgccttcgtagggctacacgcccttaccttcaaaggagtacaagtcctcaccttcagacgactatacgtcgtcgccatcagagggctacatgtcctccacttcagaggactacacgccctaaccttcagaggactacatgtcttcgtcttcagagggcttcacgtcctcgccttcagaggacaacatgtcctcccctttagaggactacacgccttcgccgtcgtagggcttcacgccctcaccttcagaggactacaaaatctcgccttcagaggactacacgccctcgccttcgtagggctacacgccctcaccttcagaggactacacat

SEQ ID NO: 97746 - DNA, 1086 bp, Glycine max
  Peptide Sequence Number=SeqID_214524
atgaagacgctgactccattcttctttaagacaaaggctgtcgtattggcaactggaggaatggggatgctgtataggcatacaaccaatagttacattaacactggtgatggcttcggaattgcattaagagcgggagctgcgttaaaagatccagaatttgtgcaatttcatcccacagcattatacccatcagacgttcttattagtgaagccgctagaggagaaggtgggatactgaaaaatgttaaaggagaaagatttatgacgaaatatgctcccaaaaagctagatctagcgcctagggatatagtttcaagagcaatcatcaccgagataagggaaggaagagggttccctggtggatatgttggcttagatttgactcatttaggtgaagaatatattaaagaaaggttagctttagctgtagaagctgcaaaaagttttgcaagtgttgatgcgtttactgagcctattccagtcaggcccgctcagcattattatatgggaggaatagatgtggatatagatgggaggaatccggatattgcgggattattctctgcaggtgaagcagcttgtgtatcagtacatggggctaatagattaggctcaaattcacttctggacactttagtatttggccaagttacaggtagaactgttgtacaatttcttaagtctaatccaggtaaccccacatcaaattatgagaaagaggctgagaaagttgttgatgacgcttacaagttcgtaaagagcgagagtggtgtgcattttggccaaatattagaaaagctaagagatacaatgtgggactatgttggaatatatagagatgagggtggtctactaaatgcaatgtccgagataaataaattaagagatttagcattaactataaccaagtcagctttagagaggaaagagtcaagaggggctcattataggacggattatccagatagagatgataataattggttgaaacacacgattgcgtatttaaggggtaatacggttgaagtcacatttaaaccagttaaaataaccagatggaagccagaacctagggtgtattaa

SEQ ID NO: 97747 - DNA, 321 bp, Glycine max
  Peptide Sequence Number=SeqID_214525
atgattcatgaaattttgatgattttgaagaagcttcacgcgttaagtgtgccatctcacgctcatggccgtcttcacttctatcagcccttcttcttcctcctcttcctagcaggagcatctagtccagatgttgcagagcctccatcatggtcattgcctcgtcatctagaacctgcaccaactatccattcacctttctatggagcctccactgatgacgccagaggcttttctacaaggggtgacacttctggcatgggtgacaatggagcttgtgatgattatattgcagacatcactactgctcaggaagcttaa

SEQ ID NO: 97748 - DNA, 735 bp, Glycine max
  Peptide Sequence Number=SeqID_214526
atgtgggaaggagatgaaattcgagacaaccaagatgacagagacagcaaagcagaagtaggccaaagcaactcaaaaagaagaagtcgaactgctgccattcataaccagtctgagcggaaaagaagagatagaattaatcagaagatgaaagccttgcagaggttggtgcctaatgcaaataagacagataaagcttcaatgttagatgaggtgataaactacttaaagcaactgcaagcacagatccaaatgatgaacatgacaagcatgccccaaatgatggtgcctttggccatgcaacagcagcttcagatgtcaatgctagcaagaatgggtgttgctgggcttggcatgggaatgggcatgaacatggcagcagcagcccaaacagcaggtggcccaattaggtcactcccccaattcattcaaccaacaacaactacagtttgtgctccaccacctgccactgcccctgtgtttgttgccccttccttcatgatgccaccttccatgatccaagcacctccaaagccccaacaattacctgcatcctcagcctccattgcctcaattcatttgcctcatccatatagtgctgctggtctcacccaaccaattaacatggatatcctcagcaacatggcagcactttatcaacaacagataagtcaaaacaatcatcaggccctgagcagcagcatgccccaaccacaccatgagcaaggccgttga

SEQ ID NO: 97749 - DNA, 156 bp, Glycine max
  Peptide Sequence Number=SeqID_214527
atgggaaaaaaagaaaaactaaggatattgaacattgtggcaatattagggttaggtgtttttgttctcacaaaaaccctacccttcgccggagacgggacggagcacaggttgggaaatgtccacgacgagcttgtggaggtcagggcagggtga

SEQ ID NO: 97750 - DNA, 486 bp, Glycine max
  Peptide Sequence Number=SeqID_214528
atggataatttgctatgtgatgaggtgtggctttcaaagtctgcaaatacttttgaagaagttattagtgaccctgttgcactaaagagttatgaaaatgaagagtttgaagaggtttttgcagtgtgtctagagaaggaggtcttgtgcttgcccgaacctgactatacaaagtacttacactacaacaatttcatttttcctagctgtagagttattcaatggtttatcaaggattgggaatactggatgcttgaattgctttctattgcatgcttatcaattgccataaagttgaatgagatatcaggactttcgttgcatgaaattcagtggatcaccgttaatagctttgtggcatcacgtgagctaatggatattgcactgaacatgaatttgtttcatgacttagtcatgtctgttctcattttattaacaactagtggagtgcccgtgcgatgtacgggtcggtattttactagttga

SEQ ID NO: 97751 - DNA, 681 bp, Glycine max
  Peptide Sequence Number=SeqID_214529
atggcgcgtacaaagcaagcaacccgtaagtcgaccgaggaaaaggctcctcggaagcagcttgcaactaaggtcgctcacaagtctgctccattgactggcggagtgaagaagccacacaagttcaggtcaagaatcgtggccctgagggagatcagacttcataatggaaatttggaaaatctttccttcttcatggcatgtttcatatcatctttgtaccctgttttgcaaaaagatgagcttgcttgtggagcttctatggaggttggatctttgaacttcaatgaggaagaaggagcttcaccaccaagaatttccttggataagaagcttgaagaggatgctttaatggaggaaaagaaagagagaaggggggagcacgaaattgaaggaataaaggagggaaagaagtggaactttgaagtgtatctcataagactttcattcatcaaagttacaacaagggttacacatgcttctatttatagactagaaatctaccctgggattcatgagaaccccaaggccttctttagcagctctagcccaatcctcttggagtcttctatccaatacccttgcggggtaggattgcatcatcaagctctagtggtggaagctaaacttcttgagcatgaaaaggatggaagtaaagatttggtcatgcctggagctggg

SEQ ID NO: 97752 - DNA, 303 bp, Glycine max
  Peptide Sequence Number=SeqID_214530
atggcgaaattgttagagagagagacaacgaagatagataaatatagagataacgtgcactggtcttctggctacggtggcattggtcctagaagcgactatcgaatcttgaatattgtcctcgttgctgctagagatgttaagcatctcgattttagaattgatgttgacgacagcgactctggctttgccgccgtagttgacatcttattgccactctgggagagctcatcttcgtcctcatcactatcgcttgtggaaggagaagatggaaggacatattttgtgttagggcacaaataa

SEQ ID NO: 97753 - DNA, 234 bp, Glycine max
  Peptide Sequence Number=SeqID_214531
atggaaagcagaaaagggaagaagcaaaaagagacaggatggacgaacataaacaaagagaacgaacataaacaaagagacaacacgcgtgcactgaagtggcaacacacaggaatgaggaaagaagaagcattaaacacgacaatgagcaaaagaaggcctacaactggacaggtgtcaataggacagagaatgggacagtggacaggtgtcaacagaatagagaaaaagtag

SEQ ID NO: 97754 - DNA, 336 bp, Glycine max
  Peptide Sequence Number=SeqID_214532
atgaaggaagaaaacccatcagagaacaggtccaaagcttcaaaattttcagaccaaaaccaagccccaaagcctcaaaacaccaaaggagccaacctcaacaacaacaacaaaacaaggttgtggggtgctcacattgtgaaaggcttctccgctgacaaaaaaaccaagtcatttgccagcaaaaaactaacatcttcaacaacaacaacagcaatatccgagaatgttgttacaaaccagaacaacagcaataaaccttttgtgccttcttctcattctcgagtgaaaaggtccctcataggtgacttatcatgttcaataaaccctgctcag

SEQ ID NO: 97755 - DNA, 786 bp, Glycine max
  Peptide Sequence Number=SeqID_214533
atgaagtgcgcgagggatagggaggggagaatggcattttctgttgtagcagagagtgagcacgaacaatctcacgcgcgcacgtgcttggtcgatttgctgggttggggcgacacgctgttgcgtgcggtgagagttgacaatgttcatgacatgaagaaatgtttgggggaaggggttagtgtgaacgggagggaccagaacaggtggacctcattgcattgggcaacgttcaagggtcgaataaagagcgtgaaggtgttgcttgaacacagtgccgaggttgaaaccgttgatgatgctggctacactctgttgcattgtgatgctgagattcctagaaagattggagtttccattccaatgaaggctaccttatttatgacatacataatggttgatggatgggctggaattgctggtgagattctcagattaaagccattggttatataccatctcagaaacatgttcttatcaattatagaaaagtgtgttagtatcaatacatgtggtgtacacaaggtagagtatcaacttccaaatcttattgttggggctattacaaaagaaagcttgtatagtgcttttgaaaatggcattacagtagagcagggatttcactgtactgtatcattgaatgagggccctccaccaccttataacatgctaagaaatgtgctagacatgaatgctcatgttggtggttttaattctgcaatgttgcaagctggaaattccatatgggtaatgaatgtggtccctctgagtggactcaataattaa

SEQ ID NO: 97756 - DNA, 423 bp, Glycine max
  Peptide Sequence Number=SeqID_214534
atgagcatccggaagtcatgggctcacatagtacaggcttccatagctgatggtgttttgtcaggtaatactgaccccaagaaaaatattgagttgctacaagatgctattgcttctattactctcttaggaagcataatcacgtccatccctttatcgaggaactattcatataatttccaatacttttggcactatttacgaaaaagtaatagtttagggaccaaattgatgaaccgatgtagaaagtatttcagaatatacaattcaacatcggtttatcggaaaaatcaatattgcaagcatgttcatagcttagctcatgcaacttctggatatcacaaagttcttgaagaaaatagcaaactatacaatcaagttcatgatcttaagggtaaatttctgattggttggttgctataa

SEQ ID NO: 97757 - DNA, 1191 bp, Glycine max
  misc_feature (729)..(729): n is a, c, g, or t
  Peptide Sequence Number=SeqID_214535
atggcgagccaagagaagtggggcccgtttgcagatattttagccttgctgatttttggggttgtcctcttcccaaacgtcgacggtttggtagacttagccgccattgatgcattcctcgcatatcaccatagcaaggaaagtccggtggtgtctatcttggcagatttgtttgacacctttgatcggaggtgtgagaaaaacagcgcgcggattgtctgttgtttacccgctctctgtgtatggttgatttcacacctattccgacaagacacgagacacccgtgtccgcttcaaagctatcgctcatgcgccgaaaaaggaagagtcgattgggaccaacatttggctgggatagggggcagcgcgatcaattggtttcctcgttggaaggaaggcaaggaaggagttcttttctcgtgtggggacaaccctaatgttccactgatagggactaggtgttgtattaattataatcccacactcgccataagacagctagggtaccccatgaggggagcgccaaccgaagaaagtctcacgccttgccttgtgaggaatctaggcgcgcaaggtctcaaggttatacaaagaatccacaaggcgtggaggtatccgttgaagaaagacaaggagcttaggggcatccgaaatggcgtcattggaggttatcatggatggctaagaattcatgcgcgagggttagattggctctccaaattgaaagtnatcgatgaggagaatttcgaagctctggaggaagatgaagaagtccgagctctaaagttagagttagggaaggcaagactcgccaaggagaagttcaagtcagctgctacacacatccggaaggagtgcaccgagttacaagaggaaaacgcagccactgcaaaagcccttgaacaagaaaccaaaagggcccgcaaggaggaatatggccgagagaaattccgaggagcattgcggggtagtaacaatgagctcaagctccgaagagaggagagagatcggtcacgggtgcatggcatgatattaaaagaagagttagttgcttgcgcgaggtccaaaaggagtttggctcaacacttggaagccatggagcaaagcatgctagctatcatagggcaatacaaggaagaattgaaccagtccatggcccatgaacaaaagctagtggaggattttgcataa

SEQ ID NO: 97758 - DNA, 1596 bp, Glycine max
  Peptide Sequence Number=SeqID_214536
agtgacgttgttgccaaaattaaagccgaggcatcattgctgaggctcacgaatgaagacctgtgcaaacaagtagaaggtttgcagataagcagattgaatgaggttgaggagcttgcctacttgaggtgggtgaattcatgtttaagaaacgagttgaagaacacatgctcagcgttggattcggataagccatctagtcctcattcagttgtgagcagtagtgatgattgtgttagttctttctctgatcaaaccaataggtattcaaattgtggaagtgcaaataggttcaatatggtgaagaagccaaaaaagtggcctataactagtgatgatttatcacaagtagagtgccaaggtagtctcattgagaagaataggattgaatcagatgtagggggaagccctagaagaagacactctatcagtggatcaaactactcagaggaagaggtttctttgagtaagagaagacagtcagattgttttgtgtgttcaaaagaaatggaaaaggaatcagtggcattgtctgttcaacaatctggtttggagattgtccaaagaccacaatattttagcaattgccaagaagctaacaagcttttggtttcttcagatgtcgagaaaagagccctacgcattcctaatccacctccaaggccttcatgttctatatctatcaagacaaaacaagaaacttcagctcaagttccactgcctccacctccacctcctcccccacctcctatgaattttgcatcaagaagtaacatggcatcggtgaaacgagcgccacaagtggtggaattgtaccattcacttatgaagagagactcaagaaaggattcttcaaatggaggactctctgatgcaccagatgtttctgatgttcgtagcagcatgattggagaaattgagaaccgttcatcgcatttgcttgctataaaggcagatattgaaactcagggagaattcgtgaattcattgataagagaggtgaacgatgcagtttatcagaacatagaagatgtagtggcatttgtgaagtggctggatgatgaactttgcttccttgtggatgagagggctgtccttaagcattttgattggccagaaaagaaagctgacacattaagagaagcagcatttggctatcaagatttgaaaaaattagaatctgaagtttcctcttacaaggatgatcccaggctacctggtgacattgctctaaagaaaatggttgcattgtcagaaaagatggagcgtacagtttataaccttcttcgcacaagagattcattaatgcgtcatagcaaggagtttaaaattccaatagaatggatgcttgacaatggaattattggcaagataaagctaagctcggttaaattggctaaaaagtatatgaaaagggtagctatggaacttcaagtaaagtcagcattagaaaaagatcctgcaatggattacatgcttctccaaggagtgagatttgcttttagaatccatcagtttgcaggagggtttgatgcagaaacaatgcatgcattcgaggagcttcgcaatctggcctctcttcttaacaaaacatga

SEQ ID NO: 97759 - DNA, 171 bp, Glycine max
  Peptide Sequence Number=SeqID_214537
atggaggaagggaataaggatatgtggcttcaagatgaaggacgaagggagcagccttcgcaggagggagacatcgcgggaggcacccctcgcgagtgggttgaagaaggtggtgccaattcattaagggcaatagggagtgtaagattcaattccccatcaatggactaa

SEQ ID NO: 97760 - DNA, 800 bp, Glycine max
  Peptide Sequence Number=SeqID_214538
gaggagttggtaataacgtggatcccccacaagagaatcaaactcagccaccaaataaccaagatgtgaggtcactttgtccttggcccccaccaccagagccattctcttgcagttgctgtgaagttcttagacaaataaattacaccaatggtgttaggtttgacaagcttgagattcatggaacagtcggggtgattaaccacgcaatatgccacgttgaggataagacatcgaatcgtcctccaagggacacttatcaaataatcgatttctgcaataaaaacacagaagaaataaggaatttcctaaatgtttactgtaaagagaggattgaagcagggttcattcccatagaagatccgtcgatgtctgccttttatgatgccctctgcactggaatggattggactgaagtttccaatgacgtagacgatgatttggcaaatggcacggagcaagagtcggagtctgaacctgaggctgggaatggaagaagggcttcaacttctaggcctagacgacgtgatatggcagttcagaggcagagagtaccaaggatgacattgagtgatttgagcggtgtcttccatttgactattagtgctgcagcggttaaactggacgtgcaaagccttgccaagaaggtcagagtactcgttagagcattgaattcgcctgatccaggggtgaagcgaagaactcaagatgaaattcgaagacttcagaaagaaataattgagaattgtggtggaattaccccaaccggaataccgatgctccaattcgatgaagaatga

SEQ ID NO: 97761 - DNA, 210 bp, Glycine max
  Peptide Sequence Number=SeqID_214539
atggaagacaagcttgacctcatcattggaaattacactgatggaaacttggcttcgatgcgcttgagattcacggacacaatgtgcgtgaggttcagggacacaatgtgtgtgaggatgagggagagaatggttgaggaacaacgaaggatgcttgagacaatggctgagggacacaatgtacaggcgacgtcgtttaggtcgttttaa

SEQ ID NO: 97762 - DNA, 500 bp, Glycine max
  Peptide Sequence Number=SeqID_214540
gcggtgtggaattcattgacggcgagtctgaagtgcaaggtaatgaggaccgttggctgcgcgaagggggttttgtcgccgctgagtccgtgcaggtcgtcagtgctgcgggcggatctatcgatggcgtgttaggcattcacggcagaggaggagtacgttgccggagggaaggaggagaaggggaaggggaaggaacgagtgccggtgtttgtgatgatgcctttggacagcgtgacgacgaggaatgcggtgaactgaaaaaaggtgatgaacgcggggatggctgcactgaagagcgcaggggtagagggggtgatgatggacgtgtggtggggtttggtggagagagaaaagcctggggtttggtggacacggtgaactcatggaaatggcgaagaagcatggcctcaaggtgtaggctgttatgtcatttcaccaatgtggcggtaacatcggagactcttgcacattctagattaattggttttaacaattag

SEQ ID NO: 97763 - DNA, 612 bp, Glycine max
  Peptide Sequence Number=SeqID_214541
atggaagagttacgaggcgatgaaatagtagttgaaatatcagcagttaagacagagttagaaaaggagtttattctaatttttctaactatttgtgctacatgggtttttaaaacggctctttttgagagcatgagtttccttaacttattcaaaaaaccaagtcagcaagcagtaaagaaggataaaactaaatactacaagctggaagggatcccgttcttccttctagcgccagaagatagagatatgaaaatgaaggaattaagtgctcttttaagtcaagctgaaaagggctatatttacatcagtcgtaagccagatacctacgagtttgaggggactaagttccctattattacgtcttctttcaatttgataacagagaaagaactagacttagagacagccgaacctccgcagaggcctaagattgttaaagaatatgcaaaatatttacaaactacagagggttacgctagagttctggttagttatgcatactcgactaaaatttacgaaggtgcgcttggcagaatagacttcaaatctttacgccctgagctctttgagttagttgttcagttccagaaaatttcaccactttcgtaa

SEQ ID NO: 97764 - DNA, 213 bp, Glycine max
  Peptide Sequence Number=SeqID_214542
atgtcttctgccataatagttgcctcaaaggtagacaacactggctcctccaagttggttgggattgaagaagatgattcagaggatagaatccttctgtcgccttggttgcctcaatctctaaatccagaggagccaagtcctccgctgaagttttacctcgtatacaagaagcaaactactacagagcagttaaccaggacaaaggattaa

SEQ ID NO: 97765 - DNA, 183 bp, Glycine max
  Peptide Sequence Number=SeqID_214543
atgtttggaaacccaacgtgggaaggccaaaaagaggctcggggggctagtatacctgataaagtacagagtcaggctaaagggacacctggaacacccaaatcgaacaatatgcctcggccttcagcatgcacgagcaacaagcatcattcgattgcaattatcaccactaaatctgcttaa

SEQ ID NO: 97766 - DNA, 429 bp, Glycine max
  Peptide Sequence Number=SeqID_214544
atggttagtagcgggatgaagccagatgtgaaagcatatcgggtttttgtcgtcaatgagtattgcaagattagaaaaccaagtgaagcagtgttgcttttgtgggaaatgatggtgaggggtgttaagccaagtatgtcaagctttaatgcagtgtttagagttcttgtggatgaggggaagcttgataaaggagttcttcttttgaagcagatgcctaagatgggatgcccgcccaacttcttgttttattgcatagtgatatgtggtctttgtaaagtgaagggtaggatgcaacaagttgaagagctcattttgaatatgcttcagaatgggcataacctggatgccactatgtataattgcttacttgcgggatattgtgaagacggggatgaagaaatgacaccaaagacagttatgacataa

SEQ ID NO: 97767 - DNA, 630 bp, Glycine max
  Peptide Sequence Number=SeqID_214545
atggtttctgagacactccaaagccaaaccaagaacgtgtgtgtggttggagcaggaccatcagggctagtggctgcaagagagttgagaaaagagggtcatagtgtggctttgttggagcagaatcatgatgttggaggacagtggctatatgaattaaatgttgaaggagaggaccctttaggaaaaaagccgtttctaaaggttcatagcagcatctatgaatctttgaggctcacatctccacgtgagatcatgggattcactgattttccctttttggtcaagaagggtagagacatgaggaggttccctagccacactgagcttcttatgtacttgaaggacttttgtgatcattttggcttgagagagatgataagattcaacacaagggtggattatgtgggaatgttggattatggtgtttgtagtaatgatttgaagtgggttgttagaagtgttgataagaagagtgagaaggtggtggaagaggtgtttgatgcagttgttgttgccactggtcattactctcaaccaagattgccctccattcaaggaatggatacatggaaaaggaaacagatgcatagtcacatttacaggaccccagaaccattccgcaatgag

SEQ ID NO: 97768 - DNA, 417 bp, Glycine max
  Peptide Sequence Number=SeqID_214546
atgatcgtagaaaattactacatacatcgtggcaatttaagtgagagatccaccaatcaactgaaatctcgatggccaaaaatccactatgccattcaaaagttcaatggttgttccaagcaagttgttgctttgaagaaaaaacgaagaggtctttcatctttgcagaaatgcattgcagcaattcgaatattggcatacgaattacctgtcaatagtgttgatgagtatctcaaaatcggtggaagcactgtagttaaatgcttagaagcttttgtgaagggtgtgaacaagatatttggagatgagtatctgagaaggcttaacaacaacaacatcaattgcctactacaaattagagaggcacatgggtttccaggtatgttaggttctattgattgcatgcattgggaatga

SEQ ID NO: 97769 - DNA, 1168 bp, Glycine max
  Peptide Sequence Number=SeqID_214547
atggcattaatgggcatgagtgcaaacaggcaatgcaatagctatttcccaggatatcattccccaaggtatcttgtttttggtgccgaaggaagcacatgtacctcatctaatggtaacagtgaacgtgagaatgactgttaccaacttggttccttgccattgtcatctgcctgtcatcttttaggatacaacaaggaacttctgaaacaaacaatactccagcatgaagcgatatttagggaccaaattcaagagcttcaccgcatttaccagaaacaaaaggaattaatggatgaaattaaaaggattgaactccataaacgtagtttaaggttggagacatcattgtcaagttcctctttgtattactcacaaaacatgccttggttgactagtcaatcatctgttttaaatgccgagctcatccaattaccattggcttctatgcaagaaaagagcagggaattatgtcctactcctcttgctgttcctgctccaactgcaatcaaagaatctttagaagatactaaactatcagggttgacttgcagaaaagttggtaagaaaatactggatcttcaacttccagctgatgagtacattgatagtgaaggtgaatcttgtgagaatgaaagggttatcaaacagcccccactgtcaacttatacttcaaatggaatttctaaggttgtgtataacactgttgagaaaccatatagaatcaattctaatggttttgctgacttaaatttaccatttaagcttcaaaaagagacaggtgtggagtctgatgattttggggcctcaatccctcacagaaaccatacatttcatggtatgcttgggagaatgacatcgggttctcataattttcccaatgatgtcatcccgaatttgaaaagaagacaggatcatgaagcttacccagatctcccactaccaaatcaagggcagaaacatggatggctgccctcagggcaaaatggcagtaacttgggttttcttgctaaatttaatgatatggaaagccaatctgtttcaattgatttcataagtaagaagctgaaacaagttaacaattgtccatgttttcattcgacatctcaaattgtcccaggatctagaaccaagagccctgcaggaactcatgatcccaccagtggtg

SEQ ID NO: 97770 - DNA, 822 bp, Glycine max
  Peptide Sequence Number=SeqID_214548
atgtctcacaaaattgaatgttgggacttagtgacactttctacctctgatgttttcaagttttcctctttcgtgcaaaaccgagaagttgtaggttgctttagcattgattattcatggaagaacatgatttatccctgtcttcaaatacatgttctatctctggttcgaccccaccagaaacttccacacttattctatcatttggaagcgccagcacatcatgctagagagtacctcgtggctactgtcgatggctttggcattgtggtggagacaatcaatgttattctatttctcatatatgctccaaaagggataaggggtagaactctcattttggctgtgattttggatgtggcaatttcgatagtagcagtagttactactcaattagcattgcaaagagaagctcgtggtggtgttgttcgtgttatgggagcagggttaaacattgttatgtatttctcacctctctctgccatggagacaataaggttgccacttcttttttctatctatcccaccttgactgattttggtaacggatccaaaagctttgagattaggattttatgtgaatttgatagctattgcattgccatcatcatgggaattggctttcttggtggctctatctatcttggaagtgtgcttggagcagccatagcggttattggtttttatgctattatttgggggaaaagccaagaacaagcaaaggaagagtgtgaagtctatgatgactcagaatcatactcgatgttgtccctcttttggagaacaagagaatggaggaatagaatcatagcaatcatttaa

SEQ ID NO: 97771 - DNA, 486 bp, Glycine max
  Peptide Sequence Number=SeqID_214549
atggcaagcagagaccaagtttggtcattctgcacacatgatacgcggagataccttacggttatctgcacccctttgctaggcagacacagttgtgtccgatggcacgcagagaccaagtttggtctttctgcacccaagatacgcggagataccttacggttatctgcacccttttgtcatccagaggcaggtgggcccgatgacaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcacccctttgctag

SEQ ID NO: 97772 - DNA, 1074 bp, Glycine max
  Peptide Sequence Number=SeqID_214550
atggactgtgaaacctttctcaaaaagattggatcgttcgtcccccatggacgtcaggatgttctagccgctgctattggacgtctagagcaccctggacgtgtccgtgctgctggagccggtgtcaccatcaagcaatactttggatcggctccacggacgtcccgcagcgcttcctccctgcctcctgacgaattacatcagctgacccagcagatcaggcaccagctagaggagtccatcacagagaaaatgcaatctcagggacttgcagtgcctcctgagcctctggttggtcctggtccctccggccctcgagtgagcacaaaggggagttgtgttgatccctcaggaaacgatcctgagacgggtgactctgacaggtgcggcttgtacatagaagcagatcctgcccgcctggttgccatggggagagtttatgagggatccactcttgttcataacactcctttgttgcctggcaaattaaaggtgagtgtggatgaggttaaagatgcagatgctccagttcctgtacccactgatgaggtttccttagtggggcagacacttcacaccttccttgcttggccgacacatctggtcaagtctttatcacaccaggtagttgtgtctccgccaaaaccacctccgaagcccgatccggaggtcgatgatccgctttatctgatgacattgaccatcccagagcttttcttgaggccttatcaagttagatgggatgccaccgtgttcggggtcgttaatccatatttccccctgtacataaagcacgaagacctctccgaaatcgcacacgatgcggggaattctgatatctatggattcctcgagcctcagtccattcagagcggacactggcagatggtggtcatcttgcccaaggaacacttagttggtcttaatgatgctccacatcctaaatcaaaggctcctgctaggtggattgtcatcaagtattttaacgatcctagaccattggagcctgagagattaaaagcattgcggatccagttgacacagttttatctccgagttagagatcaagcctag

SEQ ID NO: 97773 - DNA, 1077 bp, Glycine max
  Peptide Sequence Number=SeqID_214551
atggctggaagcagtgggaagcaagaaaatacaatgccagtgaagtttgcaatccagagggagttagaatataggaaaattgtagcagcatttcatttgcgtccgaattctaaattcactaaagaggttaaatcatcaaatgatgcttcctgtccaaagctattgccaggtccaagttcaatgaaattttcaagcctttcaggaactaagcggaaggaatcaccaacaagaagtactcatcatccgcgtctaaaacatcaacaaccatttcatggaagtctcaatcatgaagttcagacaggagcctgtgatgtaaggcttaatgttaaaccgtcaaatgatgcttccctcccaaagccactgccaggtccaagttcaataaaatttccaagcctttcaggaactaagcgaaaggaatcaccaacaagaagtactgattatctgtgtcttcaacatcaacagccatttcatggaagtcgaaatcacgaaatgaagacaggagccagggatttcagtcttaatgttaaatcatcaaatgatgcttccctcccaaagtcattgccaggtccatgtacaagtaaattctcaagtcttttaggcactaaagggaaggaatcaccaagttctgatcatctgcgtctacaacatcatcatccatttcatggaactctcaaccatgaaggtgagctggatgatatatactgcaaaatttgtcaaatatcttgctcaagtccatccaatctcaagcaacacttgagaggtcggaagcacaagcaaatgttgcaaaagggtggaagcaatagtcagatgcaatggtgtgaagtgtgttgcattccgtgtatgaatgaagatttgctcaaaatgcactttcaaggccaaaagcacaaggctaaattgcagatgctggaaatcagcaagcaaggtgtggaggctccaaataagccaaaatggtgtgcactatgcaaattatggtgcagtgatgagtttgctttcagactgcaccttggagtcatatctcagcaacaagttaaactaggcaatgccttaattgatctagtagctcagaaaagatggtga

SEQ ID NO: 97774 - DNA, 3279 bp, Glycine max
  Peptide Sequence Number=SeqID_214552
atgtcagagcaggaaaccgattcatggggcttcctgtttgtctgtttgttgatccttttctcaggtaaactagttgttggggattcattggaaactgacgcacgagttttgctgaagctgaaatcatatttgcaaacacaaactcttgcaaataaaggagggtacacaagctggaacaagaacagttcaaatccttgtgattggtcaggaatcaagtgcagcagcatcttgaatggaacaacaaggagggttgtgaaagttgatatctcttacagtgacatatatggtaacatattcgaaaatttctctcaactcactgaactcacgcaccttgatatttcttggaactctctctctgggggaattcctgaggatttgaggaggagccacaaacttgtgtatcttaatctctctcataatactcttaagggggagttgaatttgaagggtttgacaaagttgcaaacagtggacttgtcagttaatagatttgttgggggacttgggttgagtttccctgccatttgtgatagtttggtgactttgaatgtttcagacaatcacttgaatggtggaattgatggcttctttgatcaatgcttgaagttgcagcacttggatttgagcaccaaccatctgaatgggaccctatggactggattttccaggctgagagagttttccatctcagagaattttctcacaggggttgttccttccaaggcttttccaatcaattgtagccttgaaaaacttgacctttctgttaatgaatttgacggtaagcccccaaaggaggttgctaactgcaagaatttgttggttctcaacctttctggtaacaattttactggagatattcccagtgaaattggttccatttctggtcttgatgcattgttcttggggaacaacactttctcgagggatatcccagagacccttttgaacttgacccatttgttcatcttggatttaagcaggaataaatttggtggggaggtgcaggagatttttgggaaattcaagcaactgaagtttcttgtgctgcactcaaattcctacactggagggttgaacacatcaggcatttttacattgacaaaccttagccgtttggacataagcttcaacaacttttcaggtccattacctgttgaaatctcacaaatgtctggacttaccttcttaaccttaacctacaaccagttctctgggcctattccatctgaattgggaaagttgactcgccttatggcacttgatcttgccttcaacaatttcagtggaccaatcccaccaagccttggaaacttgagtactctcctatggctaaccctttcagataatttgttatcaggagaaatcccgccagagttgggaaactgctcaagcatgttatggctgaaccttgcaaacaacaaactctcgggaaaatttccttccgaactaacgagaatcggaaggaatgcaagggccacatttgaagcaaacaatagaaaccttgggggagttgttgctggcaatagtgagtgcttagcaatgaggagatggatacctgctgattaccctccattcagctttgtgtataacatcttaacaaggaagaattgtagggccctttgggataggttgctcaaaggacataatatttttcccatgtgttcatctgtgccctcttctaaaccttcacacatagcagggtatgttcagctaagtgggaaccaaatgagtggtgaaatcccttcagaaattgggaacatggtgaacttcagcatgttgcattttggggataacaagttcactgggaaattccctccagagatggtaggtttgccacttgtagtcttgaacatgaccagaaacaatttttctggtgaacttccaagtgatattggcaacatgaagtgtctacaggatctggatttgtcttgtaacaatttctccggggcatttcccgtaactttggcacgcttggatgagcttagcatgttcaacatctcatataatcctctcatatctggtgcagtcccaccagctggacacttactcacttttgacaaggattcatatttgggtgacccccttttgaacctgttctttaacatcactgatgatagaaataggactttacccaaagtcttgaaaaatcccacaaaatggtctttggttttggctctagcacttgctatcatggtctttggacttcttttcctggtgatatgtttcttggtgaaaagtccaaaggtggaaccaggatacctcatgaagaataatacaaagaagcaagcacatgattcaggcagcaccggatcctcagcagggtattccgatactgtcaagatattccacctaaacaagacagttttcacacatgctgacatcttaaaagcaacctccaacttcacagaggagagaatcataggaaagggtggctatggaacagtctatagagggatgtttccagatgggagagaagtggcagtgaagaagcttcaaagggaaggaactgagggcgaaaaagaattcagagccgaaatgaaggttctgagtggtcttggatttaactggcctcatccaaaccttgtcacactctatggttggtgcctctatggttcacagaagatactagtctatgagtacataggaggtggaagcttggaggaacttgtgactgatacaaaaaggatggcatggaagaggcgcctagaagtggcaatcgatgtggctagagcactagtctatttacaccatgagtgctacccttctattgtgcatagagatgtgaaggctagtaatgtgttgctagacaaagatggcaaggccaaggtcacagattttggacttgctagaattgttaatgttggagatagtcatgtgagcactatagtggctggcacagttgggtatgttgcaccagaatatggacaaacatggcaagccactacaaaaggggatgtgtatagttttggagtgttggtcatggagctagcaacagcaagaagagcagtggatggaggtgaagagtgcttggtggaatggactcggcgcgttatgatgatgagttctggaagacaagggttggatcaatatgtgccagttttgttgaagggatgtggagtagtggaaggggcaaaggagatgagtgaattgctccaagttggagtgaagtgcacacatgatgcaccacaggctaggcctaacatgaaggaggttctagctatgctcattaggatatacaatcccactggggactcaaatggtggacacattgtgtag

SEQ ID NO: 97775 - DNA, 159 bp, Glycine max
  Peptide Sequence Number=SeqID_214553
atggctagggaatctttgaagactttgatcttctcccataagatgtggtccaagaccaataaccagttgctttttataagtgaatttgtcactgtcattatcccttttcaaagaggttcacataccaaggacaaatttgctcactctatccaagagtaa

SEQ ID NO: 97776 - DNA, 832 bp, Glycine max
  Peptide Sequence Number=SeqID_214554
ggtcctgaggatgattttgttagctacctctgcctgtccgttagtttgaggatgttcgacagagtgacaacggtgtatggaaggtcgtacatgtatatgaggtgtttccaggtgaatttttccaccttgttggccgtaatttcccataatggtctcacttctatccatttggtgaacgaagggacaaggggagctcagactgtgaagattgtcaagaggagtgtgtggcacatctgcaaactcttggcatcatctgcatttcctggtaaagtcgagggcatcttccctaagtgttggccacgtcttttgtatgatagtcttgaggtgcctaaccttattggtgctggccagcttggagagcagcactatttccttggtctggtatgtgttgacaacctatccctggacaagctgcgagctctaaatttttatgatccctgccctgcttccttttatgttggatgcaccgccaacgtaaagggtgcaccagtctggggtggttgtgtcatttccatcgaattctaccagaaaataggtacctccaagttgaaagcttcctccataattgtggtgcaattaggtgttagggcttgtccatgctaccttaacttgctagggcataaggcgaagagcatggaatgcaacgctacctcgaggcggtcgaggtcatgcggtgagactgctggtggcgtactgcacactgaatcattcgacgagggtgtcgaagctgtttatggacctaggtttgcatgtgtcaagaaggcatccagatgctcatctagatctattgtcccatcatgccactcaaggttgagtggtttccaccccaagg

SEQ ID NO: 97777 - DNA, 216 bp, Glycine max
  Peptide Sequence Number=SeqID_214555
gtgaaccatgagcctttcaacctaacaacctcgtatggcgagtccgaggtgaagccagaaaaaaatcctcaagcgggaaagtttggcctcaactgggaagacccattcagggtcacaactaacctcgacaacggagcatacagactacaagaactagatggcaaggcaatcccaaaagcgtggaacgccacccacttgaagttctactttagttga

SEQ ID NO: 97778 - DNA, 255 bp, Glycine max
  Peptide Sequence Number=SeqID_214556
atgtcactcgccatatgtgacatacattggagcgatagtagtgtgctcttgcgcacatgtcactcgtcgtgggtggcacgtgctggaggtttagcgtgggtggtacgtgctagagacacagtgatatgctcttgcatatgtgcctcttacaaagtggcacctactggagactgcatggtagaagaggggctcaccaagggcggaccttgggttttaagagcctcagagctacgactatggatgttcttgtcttga

SEQ ID NO: 97779 - DNA, 918 bp, Glycine max
  Peptide Sequence Number=SeqID_214557
atgacggtgaaaacctcggacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggcttgtccatgctaccttaacttgctagggcataaggcgaagagcatggaatgcaacgctacctcgaggcggtcgaggtcatgcggtgagactgctggtggcgtactgcacactgaatcattcgacgagggtgtcgaagctgtttatggacctaggtttgcatgtgtcaagaaggcatccagatgctcatctagatctattgtcccatcatgccactcaaggttgagtggtttccaccccaagggtatgtttgcctccataattcgatcgacaaagggatgtcgatggacagttcgccctgctggacggtgcatgcgggagagacttaagtcatctacaatgttgattatgcgtcgggggtgtgattccccttgggtgcgatcaggtaaagtttggacggagtgttcgtcaccttggggatgtctgacacgagcctttagctggtcatgtgcctgtgtttgtcatagctgtcaggtgaagataggagtcttcgagaggagtctcacgtttgaggccagactgagtgctaaccatggatcttcacagtgggcgccaaatgttcttaccaaaatacaaaactgtgacatgtcagggttgaggtggctaatgtggggtctcaaaccttacactaagcaagatatgcatgtgagagcaaatatgcttaagctcgaagggtga

SEQ ID NO: 97780 - DNA, 1101 bp, Glycine max
  Peptide Sequence Number=SeqID_214558
atgaaaatcaccctccctgaagagttgattcaagttattctattgaggttgccgctgagaaatctgttgcacttgaaacgtgtgtgtaagtcatggctttccctcatttccgatcctcagttcgctaaatcccattttgacttagccgctgaatccacccacaaacttcttgtcaggatcaacaatgatcccggttcggacgttaattttgtcaacatagaggatggttctgcggaaccagtctatagccttccaaatccaaaacctaatcaaattcagaaacatgaatgcattcccagggtaaatgttgttggttcatgcagaggatttctactcttaaccaccgcatcctatcccttcctttatttcctcatatggaatccatcaaccggtctgcagaaacggttcaaaaaagtgtggttgaagttttcatatatatgcggcattggatatgactcatcaactgatgactacgtggttgtgatgataacattgccgagatcccaaacctcatgcactacagaggcctattgtttctcctcgaggaccaattcatggaactgcactatgatcaccgttccatctactactaattacacatttgtgcaagatcagtttaaacatggattattcttgaatggggctcttcattggttggcttgctccgactacaatgattgcaaaattattgcatttgatttgattgaaaaaagcttatctgatattccgctgccacctgaattggaaagaagcacctattatttgagggcaatgggaggatgtctgtgtctctgtgttaaggcttttgagaccgccctgcctactgaaatgtggatgatgaaccaatacaaagtgcactcatcttggactaagacgtttgttttttcttcccatgaatttctcccaatatgtttcacaaaaaatggtgacattgtgggacaagaccgtacagctgtaatgagacttggagacaccggtactgacgaaggcgagctgcctgagcatcgcacatttaagctgggtggtggtgggtggcctacaaggttataccttggatacattgtccctgatactgacttagtcagaagctttcttgtataa

SEQ ID NO: 97781 - DNA, 573 bp, Glycine max
  Peptide Sequence Number=SeqID_214559
atgtcggacgaagaacaccatttcgaatccaaggccgatgctggagcctccaagacctatcctcaacaagccggaaccatccgcaaaaacggttacatcgtcatcaagggtcgtccctgcaaggttgttgaagtttctacttccaagactggtaagcacggtcatgccaagtgtcactttgttgggattgatattttcactgccaagaagcttgaagatattgtgccctcttctcacaactgtgatgttccccatgtgaatcgtactgattaccagttgattgacattgctgaggatggatttcttagcttgcttactgaaaatgggaacaccaaggatgacctgaagcttcctactgatgagagtttgcttactcagcctctttgcatatgcaagggtaaggctgcgtacaacatccctcccccataccttcgcatagcgaagagcttctgggcaatggggtacgaaataaaggatgggtttgctgagggtaaggaccttgttgtgtcagttatgtctgcaatgggtgaggagcagatttgtgccctgaaggatattgggccaaagaactag

SEQ ID NO: 97782 - DNA, 204 bp, Glycine max
  Peptide Sequence Number=SeqID_214560
atgggagtaggcggatttcgtaaattctggggaacaaaaataaaagaagctaaggatgcagatggagcaattatggaaggcttagttgattttcttcttgcatcggtgagtctgaatactcgtcaggcatgcatggctgaatctgaagatcgtgtagaatatcaagaaggtgttctaggcagaagaaaaatagtaaaatactaa

SEQ ID NO: 97783 - DNA, 174 bp, Glycine max
  Peptide Sequence Number=SeqID_214561
atggctgatgagccaagacaagtgaccctggaagattactcaagtacttatgtgccgcaattcttcacaagcattgtgcagccaaagaataatttgtttcatggcctgcccaatgaagacccgtatgcacgtctagctacctatattgagatatgcaatacctgtccagaataa

SEQ ID NO: 97784 - DNA, 468 bp, Glycine max
  Peptide Sequence Number=SeqID_214562
ggtcggcggtgctgggttatggccccgtgctaagtttcggattggttggccccctcctcccccccgtgatcagttttgttgccaggattttgccaactttggcttgcgccccggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctaacccggattctgacttagaggcgttcagtcataatccaacgcacggaagcttcgcgccactggcttttcaaccaagcgcgatgaccaattgtgcgaatcaacg

SEQ ID NO: 97785 - DNA, 210 bp, Glycine max
  Peptide Sequence Number=SeqID_214563
atggagaattttcatcaacctttacgattacaagttgaggagttgaatacaatggcaaaagagcatgaaaaaaatccaatgataatgccaggaaggggattaaaaggttgtatttcaaaagacctactgtgtgagcacaaggaggatagtggggtgacccattttgcacttggattatgtgaagcatgctataagggtcttaaaacctag

SEQ ID NO: 97786 - DNA, 354 bp, Glycine max
  Peptide Sequence Number=SeqID_214564
atgggtattggactcaggttgttcttatcatatgtgtccacacagaagctggttcgtaacaatgcttcttgcaagttaataggtataggctctatacaaatcaaaatgcatgatggtatttgtcgcaacctacccttcggcgggagggcaacgccagggctcacgggtgcgtcttccaagaaaggaaaacgcgcggagtcgccaccaacatttattcgaggaaaacgtcggaaaaaccggaaaaggcgtggtctacgaactttaagtgtgaaaggttcaggagttgtatttacgcacggggaaggggtgacaaagctatgtgttgattttaggcttttaaaaaatccacgttaa

SEQ ID NO: 97787 - DNA, 417 bp, Glycine max
  Peptide Sequence Number=SeqID_214565
atggaggtcaatacgactacagttgttgccgcaagtaccaccactgaggtggacccgactcacccatctggcctcaatcaattaagtcgtctagtcccagacatggtaggtcaatggggcaaagtattgggaagtatgggcggccctcattttgcacaagtccagagcaagcatccgttcccaccgtatggcctgcctcccaactatgcaccacccaatattgtacatgtgctctatgagaacatcgaccactccgctcctataccccttgagagccaacaacctcagtttgggcatgcacatggctctcaacccatgggggagacacatgaagtaccccgagaccacactctggccgactttgagccttaccccggatatgccatcgaggggcaaacatttggtggaataccctag

SEQ ID NO: 97788 - DNA, 694 bp, Glycine max
  Peptide Sequence Number=SeqID_214566
atctttcgaacggccccggcagctacgccgaataccacgtggccgccgaaagcatcgtgggcaggaagcccgcctcgctgagccatctggaagcggccacctgacgctggtcggcggcaccgcgtgggaagcgctggtcgtgcgcgccggcttgcgtgtgggagagagcatcctggtgcacggcggcgccggcggcgtcggccacgtcgccatccagctcgcgaaagccgtcggcgccagggtgttcacgaccgtgcgcgacagcaatgtcgacttcgcgcgcagcctgggcgcggacgtcgccatcgactacgagaaggaagattatgtcgaggccatcctgcgcgagaccggcgggcgcggcgtcgacgtggtgttcgacaccatcggcggcaacacgctggcgcgcagccccgacgcgctggcgcaattgggccgcgtggtgagcatcgtggatatcgcgcagccgcagaacctgatccaggcgtggggcaagaacgccagctaccacttcgttttcacgcggcagaaccgcgggaagctggacgagttgagcgcgttggtggcgcgtgggcaactacggccgcacgtgggcgcggtgtatccgcttgccgatattccggcggcgcatgcgcggttggagagtgcgaacaacgggctgcggggaaagatcgcgatcgcggtggccgattga

SEQ ID NO: 97789 - DNA, 423 bp, Glycine max
  Peptide Sequence Number=SeqID_214567
atgtttcagaggcaaactgaaataattagattagcagccacaagggttgctaagtatcaggaggcaaatcctactgtgtatactgtagttacctttccatttctttttgctgtaatgtttggtgattgggggcatggaatatgtttactactggcggctctatatttcataatcagggagaagaaactttctagtcagcctatgctagtcatcaagacacttgaatgcaccttactcccctataattacgtaataagcttaagacaactggccaagtcaatactacctgagattaatgtgctgaagttaaggttgaatcgtttgggtactacccaagtgcaatccttggcagaaacaattcttgctcaggctttacttacctctcggctaaattttggattagttagggtctctttcccctga

SEQ ID NO: 97790 - DNA, 609 bp, Glycine max
  Peptide Sequence Number=SeqID_214568
atggagactgagaaaaatgtttttgtggtcttctatgctggtgaaaaagcaaaagccaagattctgaaaatatgtgaagcctttggtgctaatcgttacccttttgctgaggaacttggaaagcaagctcaaatgattacagagagtggacaggagaggattggctcaatttctaagtttttcttagatgtctcctgtaaccataagacattgagtgagtgcatgcacaatagccaaaaggtttctggaagacttttagaattgaagaccactttagatgctggactactgcatcggaataacttgctaaatactattggggctcaatttgagcaatgggatgttttggtgaggaaggagaaatctattcatcataccctgaacatgctgagccttgatgtgacaaaaaaatgtcttgtggctgaggggtggagtcctgtttttgcaactaagcagatccaggaagcattacagcgggcagcattggactctaattctcaagtcaatgccattttccaagttttgcaaactagggagttgccacctacctatttccgcacaaacaaatttacttcttcttttcaaggaattattgactcatatgggtga

SEQ ID NO: 97791 - DNA, 1205 bp, Glycine max
  Peptide Sequence Number=SeqID_214569
taccaaggaaaggtttggaagcaaaggcgagaaccttggcaagtcaagacgaatgggctctgttcatggacgtcctgacgctcttgatcttcgaagtggtcctctttccaaacgtagatgggttggtggacttggcagcaattgatgtttttcttgcctttcacgaccgcaaggaaagcctggttgttgctatcttagctgatctatatgacacatttgaccaaagatgtgagaagaacagtgcaaggatcgtttgctgtacaccggtcctctatgtatggttggtttcacaccttttctgccaagaggtgagacacatttgtccactagaaggccaccgctcatgcaccgagaagaaggaggcaaactgggatcgactcttagcaagcaaagaaggaccgtctgtcagttggttcccccgatggaaagaaggaagaaccaggattcttatttcgtgcggaggatttccaaatgttcccttaatggggacgaggggttgcattaattacaatctcgtcatcgccataagacaacttggctaccctatgaggggggcaccattagaggaagacctcacaccttttattgcgcgaggtttcaatagctccaacgcgggggtgcttcagagggtctgcaaggcatggggaatggtgcaaaagaaggatgaagaacttatgggaagtagcaacgggcccattggcggttaccataagtggttgaaagcctacgcacaaggtctggattggctcccgaatttgagagccattaaagaggtggaggttgaagctccggaagaagacgaagaggtacaagccctcagaacagagcttgagaaagccagagcaatcaaagaaaagttcaagtcaacagccgttaggatccgaaaagagaacgccgaactgagagacgtcaacataaccaccaccatggttgttaaactcgcgattctacgtagaatcgtggaggttcctccagcactgcagcacgacagctatgacgacaaccacgacgacgcgagtagctcaacgagagtcactttgggggggttgttgtacgacgccgtttcgggttttcataaactcatggactcggagcagactcgcgagtctacccaaactcgtccgagtctacgtaaaatcggacgagtctactccggtttcgattctacttccgatttaactcgccaacccttagtagaatcgtaa

SEQ ID NO: 97792 - DNA, 1794 bp, Glycine max
  Peptide Sequence Number=SeqID_214570
atggtatcactgaagggaatggttataagaagcagctcaatcattccagagatcagggaagctatatttaggtgtcttgtgtgtggattctgctctgagccagttcctgtggagagagggcgaataaccgaacccactatatgtttgaaggaagagtgccaatccagaaactccatgacacttgttcacaaccgatgcaggtttgctgataagcaaattgtgagggtccaggagacacctgatgagattccggaaggaggaacacctcacacagttagcttgctgatgcatgacaagttggtggatactgcaaagccaggtgacagagttgaggtgactggtatttatagggctatgagtgtcaggattggaccaacacagagaactgttaagtcattgttcaagacatatattgattgtcttcacataaagaagaccgataagtccaggatgttggtagaggatgctatggatgttgatggccaagacaaaaatgcagaagttctctttgatgaagaaaaggtggctcaactgaaggagctctcaaaacggccagatatatatgaaatactgacaaagtcaatggccccaaacatctgggagctagatgatgtgaaaaaaggtcttctttgtcagctttttggtggcaatgctttgaagttagcttctggtgctaactttcgtggcgatataaatattcttctcgttggcgatcctgggacaagcaagtcccagctacttcaatacatacacaaactatctccacgtggcatttacaccagtggaaggggaagttcagctgttggattgactgcttacgtaaccaaggaccccgaaacaggagaaacagttttagagagtggtgcccttgttttgagtgaccgaggtatatgttgtattgacgaatttgacaaaatgtctgacaatgcaaggagcatgttacatgaggtgatggaacaacaaaccgtttcaatagcaaaggcaggtattattgcttccctcaatgctaggacttcagtgttggcttgtgcaaatccaagtgggtcaagatataatcctcgcttgtctgtcattgacaacatacaccttcctcccactcttttgtccagatttgatttaatctacttgatgcttgacaaggctgatgaacagactgacaggcgccttgctaaacatattgtgtccctacactttgagaatcccgagaacgtggaacaggacgtgttggacatttctacattaaccgattatgttagctatgcccgaaagcacatacacccacagctttctgatgaagccgctgaagaattgactagaggttacgtagaaataagaaaaagaggaaattttcctgggagtagcaaaaaggtgataacagcaacaccaaggcagattgagagtctgatacgcctaagtgaagcattggctcggatgcgcttctcagaatgggttgaaaagcatgatgtaatggaggcatttcggcttttggaagttgcaatgcagcagtctgcaacggatcattctactggaactattgacatggatcttattactactggagtttcggcaagtgaaagaatgaggcgagaaagtctgcaacaagcaactcgtaacataatcatggagaaaatgcagattgggggaccatctatgcgcttattggagttattggaagaattgaagaaacaggatactggtagcgaagttcatcttaatgatctaaggaatgcaattgctactctggctacagaaggatttgttaccatgcacggtgacattgtaaaaagatcttga

SEQ ID NO: 97793 - DNA, 3582 bp, Glycine max
  Peptide Sequence Number=SeqID_214571
atgctgaccaagttcgagaccaaaagtaatagagtgaagggactgagtttccacagcaagagaccctggatcctcgcgagtcttcacagtggcgtgatccaactatgggattaccgaatgggtactctcattgacagattcgatgagcatgatggtcctgtcagaggtgtccatttccataattcccagcccctgtttgtctctggaggggatgattacaagattaaggtttggaactataagatgcataggtgcttgttcactcttctaggacaccttgattatatccgtaccgtgcaatttcatcatgaggacccttggattgtgagtgccagtgatgatcagaccattcgcatttggaactggcagtcaccctccctggatcaaactgttcgtgtttgggatattggttctctcaaaaggaaggccgggcctgctgcagatgacatcctacgattgagtcaaatgaacacagatctttttggaggtgttgatgcagttgttaagtatgtattggaaggtcatgaccggggtgtcaactgggctgcttttcatcctacactgcctctgattgtctcaggagctgatgaccgacaagtgaaactttggaggatgaatgacaccaaggcatgggaagtggatactctgagaggacacatgaataatgtttcatgtgttatgttccatgccaaacaggacatcattgtgtcaaattctgaggataaaagtattcgagtatgggatgccacaaagcggactggaattcaaactttccgcagagagcatgatcggttttggattcttgctacacatcctgaaatgaatttgttggcagctggtcatgacagtggcatgatagtctttaagctggagagagaaagacccgcttttgcagttagtggtgattctttattctacacaaaagaccgattcttgcgtttcttcgaattttcaactcagagagagactcaagtacttacaattcgacgacctggatcttcaagtctgaatcaaagtccaaagactctttcctacagccctactgaaaatgcaattctactctgttcagacgtggatggcggatcttatgagttgtattgcatatccaaagatggtacaaaggacagttttggtaggggtgatacacaagatccaaagaaaggtcttggaggatctgcagtctttgtggctcggaataggtttgctgtgcttgacaaaggcagcaaccaagtctgtgtaaaaaatctgaagaatgagcttgtcaaaaagagtgccctccctattgctgcagatgctatattctatgctggaacaggcaacttgctatgtaggtcagaggatagggtttttatatttgatctacagcagaggattgttctcggtgatcttcagaccccttttataaagtatgtagtctggtctaatgacatggaaagtgttgctcttctcagtaaacatgcgattgtcattgctagcaagaagcttgtgcaccaatgcaccctccacgagactatccgagtaaaaagtggagcctgggatgacaatggcatttttatttacacaacattaaatcatataaaatactgtctccccaatggagatagtgggataattaaaacactggatgtcccaatttatattacaaaggttgttggaaacaccatcttctgcctgggtcgggatgggaaaaacaaggctataactgttgatgcaacagaatatatctttaagctttccttgttgaagaaaaaatatgaccatgtaatgagcatgataaggaattcacagctctgtgggcaggcaatgattgcttatctacaacagaaagggtttcctgaagttgccctccattttgtgaaagatgagagaatccgattcaatttggctttggagagtggcaacattcaaattgcagttgcatcagcaacagcaattgatgaaaaagatcactggtatcgactaggggttgaagctctccgtcaaggtaactctggtatagtagagtatgcataccaaaggactaaaaattttgagagactgtcattcctttatctcattactggtaatgtggagaaactttcaaaaatgttgaaaattgctgaagtgaagaatgatgtgatgggccagtttcacaatgctctatatatgggtgacatcagagagcgtgttaagatcttggagaatgcaggacatttgcctcttgcttacatcactgcatcagtccatgggctacatgatgttgctgaaaggcttgcagctgaattgggggataatgctccatctgtgcctgagggaaaagtacaatctctcttgatgccaccactacctgtattgtgtggtggtgattggccccttcttagggtcatgcgaggaatatttgaaggtgattttaacaatacagatcgagatgctgatgatgaagagtatgaggctgctgatggtgattgggtcgaggagcttgacatggttgatgtagatgggttagaaaatggagatgttgctgcaattttggatggtgtagaagtggcagaagatgatgacgaagaaggtggatgggagctggaagatttagagctgccccctgaagctgacacaccaaaagtttctgtcagttcacgatcttcagtttttgtggccccaacacctgggatggcagttagccagatatggattcagagatcatctcttgcagctgatcatgtagctgctggcaattttgatactgcaataagattactgaacaggcaactcgggatacggaactttgcccccttgaaatccatgttcctagatctacatactggcagtcattcctatctgcgtgccttttcatccgctccagttgtatcaattgctgttgaaagaggttggactgagtcatctagtccaaatgtgagaggcccaccagcacttcctttcagattgtctcaattagatgaaaaactcaaagctggttacaagtcaacaactgctgggaaatttactgatgctcttcgcacttttgtcaatattcttcataccattcctttgattgttgttgagtcaaggagggaggtcgatgaagtgaaagaattgattatcatagtgaaagagtatgtcttgggtctgcagatggagctcaaaagaagggaaattaaggacaatccagcacgccagcaagagcttgcagcttatttcacccactgcaatcttcaaacacctcacttgaggctagctttgctgaatgccatgactgtctgctacaaggcaaagaacctttccacggctgcaaactttgccaggaggctacttgagaccaatcctactgttgaaaaccaagctaagacagcaaggcaagtgcttgcagctgcagaaaagaatatgacggatgccttacaattgaactatgatttccgaaacccatttgtaatttgtggagcaacctatgtgcccatttatcgtggacagaaggatgtcgcttgcccctattgtacttcccgtttcgtgccaagccaggcgggccagctatgtgctgtgtgtgagctttcggtggtaggggcggatgcttctgggttgctctgctctccttcccagattcgttga

SEQ ID NO: 97794 - DNA, 474 bp, Glycine max
  Peptide Sequence Number=SeqID_214572
atggcttccgactcttctcccccgaatttcaacaacggaccttcatcccccgatgactccctttccagccccatcggcaataccttctcgtcaccggccagtagacgccgccgccgctcctccaccccctccgcattcgccactccgtcggagcgccgctcccgattcgcctcctccgatgccacccctaccgcgccgcgctcccgccagagaagcggcggcgggcgcgttcccgccacttccacctccaccaccgacgacgttccggcctcttcagacggcggagacggcttcgacatggacgatgccaggcccaccttcgtgtggggcaccaacataagcgtggaagacgtgaacgacgccatcaaaaggtttctgaggaacttcagagacgcgtcttcgtcgcagggtggtgacaacgatgacgggttgcacttgcacacagaagggaagtatgagaaactgatcagacag

SEQ ID NO: 97795 - DNA, 648 bp, Glycine max
  Peptide Sequence Number=SeqID_214573
atggaagcccaagtagtaaagggatcaaagtgtgaagactgtgggaaccaagcgaagaaggattgtgaatactcaaggtgcagaacttgctgcaagaacaaagcctttaagtgccaaacccatatccgaagcacttggattcctgtagatagaaggcgccaccagaaactggagcaccaacctctcactactaatcttaaggcagatactattcctaaaaggcacaagcacaacccatattcaagtttagaggagttcaaatttccagctgttatgagttccatggcgttattcagctgcgttcaggtgcgttccatggatgacacggttaatgaaattgcgtatcaaacatctgtgaacattggaggacatgtatttagtggtcttctttatgatcaaggtcctcaacaacaaagcttcaatgtttctaagggtgacaataatagctccatagacccttttgttcaacaacacagtctcaatcttaggagtagtgcttcaattcacactcgtaatggtgcaagtgcaaatatgcctccactatcagccactgcatcagctcaggaaccattttttcctccgccacatccatttcccttagcttccttcagacctgatatgagatacttgtcacaccctaaaccttaa

SEQ ID NO: 97796 - DNA, 222 bp, Glycine max
  Peptide Sequence Number=SeqID_214574
atgaagggttccttgctgaagttaatgcacagctacgacaaagttaagactcaacagtatcttgcccataatgagcaggcaaaggaagatggtgataaaccggggcttgaggctatgatgcaaaaggtgttgcagctttatgcttccatagttctgtcaaaacgtagttatgccatgaaagggaaggaagttttgaaggatgagcaattccttgaaccataa

SEQ ID NO: 97797 - DNA, 867 bp, Glycine max
  Peptide Sequence Number=SeqID_214575
atgaagatccagtgtgatgtgtgtcacaatgaagttgcttcctttttctgcccctctgatgaagcctctctctgccatgcttgtgatcgcaccatccaccatgccaacaagctcgcagacaaacacaaacgcttctcccttcaccaccccacttccaaagactcccctctttgtgatatctgtcatgagaggcgtgcatatcttttttgcaaagaggacagagcaatactatgtagagaatgtgatctttctattcatggggtcaacgaacataccaagaaacacaacaggtttcttctcactggcgtaaagatcggtgctgatgcttcagacccaacatcactttcctcaaatgacactgccattgaagaaagaacaacctctagttctaaaataaacagaccaataagttctttgtcaaatgagaatatcagttcttctcccacggttggagacaacatggcttgtgacacgggttcggtttcaactagcagcatttctgagtacttgattcagaccattcccggttactgcatggaagatcttttagatgcttcatttgcatctaatggtttatctaaggattatgagcaccaatcagcgtttcagaaccaagatgttcaagtcagcatgtgttcgtttccactgcaaagttgggtaccacaatctcaagctggatcccctcaactaattagcactacctcgaatcttcatccccagattaattctttagttggagtaatggaaatgcctaaagccaaagctagtgaaggatactccaattgcatatataattatgactactcagcttacaaagttccttcaatttgtcctccattgatcaaaaaatgtaaacgctctcgttaa

SEQ ID NO: 97798 - DNA, 1137 bp, Glycine max
  Peptide Sequence Number=SeqID_214576
atgagtgtgagagcaggtgaaagactctatcttgggttggactttggcacatccggtgccaggtttgccatcattgacaaagatgggataattcaagctgaggctaagagagagtaccctctctacttggctgaggtttctgtttgtcttgtcttagaaagagtggagagtcacatgattggtgactcgggagaaccgttgtggagacctttactttacaatgagagttgccctgatgctttggcaacggtgaaatctattgctcctccaaatcatacggttggctatgatcctgaggtggactcatatccttcatggctagtctctcaaccatattatcatcttttaccttcagttgttgctcctggaactccaattgcttgtttgaaggaggaaattggaaataaatatggttttcaaaaggattgtgttgtatgcagtggaaccactgacagtatagctgcatttcttgcagctcgtgctacacaacccgggaaagctgtcacttcattgggttcaacactagctattaaactactcagcaacacaagaattgaagattctcggtttggggtgtacagccatcgccttgatgataaatggcttgttggtggtgcttcaaacactggtggagccattcttagacagcttttcaccgatgatcaattagacaaattgagtgaacagatcaatccctcacaaccctctcttctggattactatcctctaccaaaagcaggtgaaagattcccagtagcagatccaaatttggctccaaggctacttccacgtccagaaaatgatgttgagttcttgcatggaattttagaatccattgcacgtatagagttttgcaaaaacaagtggatcttcacgcatccactagagcctaatgcgaaaaactcttcaatgttattttttttatcggcaaatgcaaaggcatatgggttgttaaaggagctaggagcaacccaggtagacgaagttttcacagccggtggaggagctaaaaatgagaagtggataaagatacgagagagggtgattggtttgcctgtgagtcgtgcaaatcaaacagaagctgcatacggagctgcattattggcaatgaagggcgatcaacaaaatattttgtga

SEQ ID NO: 97799 - DNA, 2487 bp, Glycine max
  Peptide Sequence Number=SeqID_214577
atggttctaagcaagcttggtatccatgctgatcatgccaaatctgacaagtgcttagcaaacctgaagccatattcttctcagtatcaagatggcaaaaccaaaggaactgataaggtgaagaaaatgatgaagtcaaggtcatttcagctttcggatttcgagcctcctcaatcactgccttcagttaggagcttatcccaaccaagaaagctatcacctcttcatgttccaactgctgaggcatccccacaacagcagaaggctttggtcagaaggtcacccaattacatgaagcctaccagcagttcatatgcaaaaaaggagcttttgccggttagtcatcggaatacccaatctagttcagatggcaagagtttaccacaaaaatgcatgagaaattcaaaagctagctttgtttcttgcaaagaaccagcaaaaacattgtcaagatcatctagtttgaattcaatgagaacattaacgaagactcctagttttaagccttgtaaagcttgttcaagagaattcacatcagcagttctgtttgaagatgtgaatgcacccgagagagctacctgctcttcaactttgaaagactgtaaattccccgagtacctcatgcttcaccctgggggaactgagtctaagggagtttcactcatgaaggtttgcccatatacatattgttctcttaatggccatggccatggtcatggtcatgctcctttgcctccattgaagagcttcatgtcagcaaggaagcatcttttggagactcagaagaaaatcaagccggaagctgcaagccctcaaagatggaaggtgcccccctgtgacacaaaaaaagactcttatagtgagcaaatggtctttcatggaaaacctgcatgtgatgaagctgatacaggtaatccaacaatcactcccttggcacaagaaattgctatggatttcttttttgaaatctatgctaaggaaagggaaggagctgacgaaatgggaaaattcaactctttcaaagaccttgagaaacaagaagatatcaagtttacaaatgaggagaatggctttgcaacagaagacgatggagtcaagcaagttactccaggtgtgactcatgatctgtcgaagtctcagatcaatttcgaggaggatttcaaaaactactttgctgatgctgctgcaattgaagcagatatcaaggggagcttttatctaggacaaaatgctgaagatggggatgaaaaccacccacctaactggtttcatgaagaaacctgtacaggaagctactgcaatgaggctagctatgacggggaacacatggataatagtgaattggacgagtccaattcccaatatagtgatatggactgggaggaggaggaacacttctgtgaattcaaccatgaggacgatactgattcttccatctactcaatggaggagactaactcaaaacttgagtccttattagagagttcacatgatatatctgaaatgcggttacacaacatttttagcagtcaatatgcatacattctggttgaagaagcactccaagaagctgaagaagagaaaatgaccagttttagcagccaatatgcagacattctggttaaagcactccaagaagccaaagaagagaaaaggaccagttttgatgcacaaccttgttgcactaattctgtcctggaagacacaagtgaaagcatcaagtttgtgactcaagaaacagattatttgtccaatggtacaagtttcgagtatgaacaatctactttgacagaggaagtatttcaatatttggcaaatgcagaacataacagcagagaaaatgaaaaacatgtggattatgaggcatgttgtgtctcaatggtacttgatgaagagacagttgagaatagtgaaggccacaagactagtgaaagttgcaagattgatgagagctgtgaagacagaaatgcaaggctagagaatgatgacgacgatggaattagccaagagaaccaaattcactcatctgaagtgcctgaggaaaacaccattattgttcaggagcagaaattattggaggaaaatcaagttaagggtagtaagttcctgagtacagatggtggtgaagagcagcacacaagcaagaattggcaatggggaactaagcggaagagaactgtggaagaggatgaggaaatgagaaagatcagcccacaaaatccaaatttcctgcccttggttgctgagccagaacctgagaaagttgagctgaagcaccaaatgatagatgaaagaaaagatgcagaggaatggatgcttgattttgcactcagacaggctgtcacaaaacttgctccagcagggaaaaggaaggtgtcattgctggttgaagcttttgaaacagtaatgtcaatgcccaaatgtgaagcctgtataataaatgattcaccctttgctcatgcaaggcctattcaagcgtgtagatga

SEQ ID NO: 97800 - DNA, 735 bp, Glycine max
  Peptide Sequence Number=SeqID_214578
atgtatggaaggaaggagaaggaggcgttaatggtgtctggtgttgcggccagcaaggggggaaaggaggcatcaatggcgtggggaggggtgatggaaggtaggcttgctgaagaactttatgctgaaagtttgcaactgtcaaaattagaactgacatccaccagtgctgatgatcaagaaaacaaggcgaacgattgtgatgatgatgatttgagtttgtgggatgattctgatgacaagttggagagcttgtcggatttggacagggagtggcagaggaggcatgaccaatttcatacgatcgggtatcgagatggtcttatagcggcgaaggaggcttctgcacaggaagggttcaatatcggttttaaacaatcggtccttgatggttacagttggggtgttgtaagaggtgttaccagtgctttttctcatcttccacgtcaattaaaagcaaggttgattgaaacacaagaaaaaaggaatgaattccaaggcctgtatgaatccgtgcattctttgtcaacaacagatgccctcagattgtttagtaaagaaatcaaagcacaagaagctttggaacagagtgaacactcagaagttagccatcacacagctggtttacaagagcagccttcccatggctctcaattgagaagttatcgtggacaacttgaatctctgctttgtgattttcctgccattgatattcatttacctgaaccaaaataa

SEQ ID NO: 97801 - DNA, 567 bp, Glycine max
  Peptide Sequence Number=SeqID_214579
atgaacaatccaactcttataatcttcttccttgttattttctccgtcttcttcgcggcgtcggcggacggcggcgacgatgagccgctgatcatgcaggtggtggagggcagcggcgtccggttgggagcagagcaccactttttggacttcaagcgcaggttcgggaaggcgtacgcttcccaggaggagcacaattacaggttcgaggtgttcaaggctaacatgcgccgcgctcgccgccatcagagcctggacccttcggcggcacacggcgttacgcggttctctgatctcacggcgtcggagttccggaataaggttttgggtctgagaggtgtgaggttgccttccaacgcaaacaaggctccaattctccccaccgataatcttcccagtgattttgattggagagatcacggagcagttacccctgtcaagaatcagggttcgtgcggttcgtgttggagcttcagcaccacgggggctcttgaaggtgctcactttctgtccacaggggaactcgtcagtcttagcgagcagcagcttgttgattgtgatcacgag

SEQ ID NO: 97802 - DNA, 576 bp, Glycine max
  Peptide Sequence Number=SeqID_214580
atgtttcctatatacttatcctgtctaagttggaccctttcctatgtgcagtgtgatccagaagaagcaggttcttgcgactccgggtgcaatggtggattgatgaacagtgcttttgagtacatccttaaatctggtggggtcatgcgcgaggaagactatccttattctggtactgatcgcgggaactgcaaattcgacaaagcaaagattgcagcatcagtggcaaacttcagtgtcatctcactagatgaagaccagattgctgccaatctggtgaaaaatggccctcttgcagtggccatcaatgcagcatatatgcagacatatatcggtggagtgtcatgcccatacatatgttcaagaaggcttgatcatggggtgttattggtgggatatggttctggtgcctatgcacccattcggatgaaggagaagccattttggatcattaaaaattcctggggagagaactggggagaaaatggatactacaagatttgccggggacgaaatatctgtggggtggactccatggtttcaactgtggctgctgttcatacaactactcagtag

SEQ ID NO: 97803 - DNA, 495 bp, Glycine max
  Peptide Sequence Number=SeqID_214581
atgtcctcgccttcagaggactacgcgcccacgctttcgtggggctacacgcccttcccttcagaggactacacgtcctcgccttcagagggctacagactcttgccttcagaggagtacacgttgtcgccttcagaggactacatgtcctcaccttcagaggattacacgtgctcaccttcagagaactacacattctcgccttcagagggctacacaccgtcaccttcagcggactacacattatcacctctagagggctacacgccctcacctttagaggactacacgtccttgccttcagagggctacacgtccttgccttcagatggctacacgcactcaccttcaaaggactacacctcctcgccttcagaaggctacacgtccttgccttcagagggctacacgtcctcaccttcgatggacttcccgtgctcgccttcagaggactacacggcctcaccttcagagggctacacgccctcaccttaa

SEQ ID NO: 97804 - DNA, 249 bp, Glycine max
  Peptide Sequence Number=SeqID_214582
atggcccgcacgaagaaaactggccagatgacgtctgaggtagcaaagcgaattgctgacaagattgattcgttggaggagcaggcgtcacagggttcctttgtcgcccatggatccggtgtgacaatcaagaaatactttggaccggctccaaggacctcccacacttcttcctccatggctcccgaagaccaagagcagttgactcaacaaataagggaccagctggaggagtcaatcacagaaaaa

SEQ ID NO: 97805 - DNA, 666 bp, Glycine max
  Peptide Sequence Number=SeqID_214583
aattttatcaactatgtgtctcatgaatttaaaacaccattagccgctatctcgggcaatcttgaggtttttgctcaaaaggaccggacgcctgaagaataccgtaaagtggtgaaagaatcattggataatgtatatgaaattgaaagtatccttaataacctgctgttgatgtcaggtcttaccaagcttgaaaattctcaccagcaggtaagaattgacgagctgatctggaagatatatgaaaagctaaatcctaaagcccaggaaaataactcttctattaaaatcaatcttctggtaaacactcctgatttactggaatttcctggtaatgaaactttgctttatctggcattgtacaatattgttgaaaatgctattaaatattccgggcatcattctgtagagattgtgttgtctgaagaacaggatagacatttattgattgaagttaaggaccagggcagaggtatttcggaggatgatcttcaaaagatcacggaaactttttatcgcggaaaaaatgtagataatataaaaggaagtggcattggcctatccttatctaaaagcatattcgatcatcatcatattcaaatgaaaattaattctgttgtgggctcaggaacccaggtatcgctcatatttccggttacaaagtag

SEQ ID NO: 97806 - DNA, 429 bp, Glycine max
  Peptide Sequence Number=SeqID_214584
atgatgatttggaaacaacgtgaaaaattagtcatggccacagccaggtgggcactcaagcatcccgtttatggcattgtgatactacagttgggaatttacacaaacagacccaacgtttccaaattatgttctttcaccagttcaatgaattcatccattcttatctcggttattcaagaaaataaactcttagcgtcagtcccttgtttccagaagatatgtttgctctctacgaatgatttatgcttcctaaccataacatgccgaccttcgaggacgacgttcctaaatgaaaaactgtacacggttccggaatttcaacaaacactattgacaacaacgaagatgaaacataaaaagaacatgaatctggggatcccacggtcatatggctccgcatgccaccggtctcttgggtcacggtaa

SEQ ID NO: 97807 - DNA, 165 bp, Glycine max
  Peptide Sequence Number=SeqID_214585
atgaagaataagaaggttgttgtggctggagtctcgctaagcgaggctttgagtcgtttgtcttctctcgcgctaagcgcacccagctcgctcaatggaaatcatttacttgcgcttagcacgaaaatggtgctaagtgagccttcgaggatagaaagcccttaa

SEQ ID NO: 97808 - DNA, 414 bp, Glycine max
  Peptide Sequence Number=SeqID_214586
atgctctcacttgaagtatctgaaaagactgagatgaaagtttatggcgcgggtgacagtagttggagaaaccttaaagacctggagaaggagacttgcagatcactgtttcttctcgacgatttttgcttttttgatacaaatattggagtttttagagactcgatgtgcgtttggcaagatagcaacacccatcttggcttgtggcagatgaggaagtttggagatgacaagtcttggattcaattaataaattttagttatttacatcttaatattcgtccttatgaagaaaaatcaatgattttaccattctgcatgtctaacaatggagacttcttcatgctgaaattcactagaaatgctgatgatgaataccaaacaattttgtataaccagagggatgatgtttaa

SEQ ID NO: 97809 - DNA, 303 bp, Glycine max
  Peptide Sequence Number=SeqID_214587
atgtcggcgagctatctcctcctgaaaatctgtgaactcatcgcccctgagctggacgcgtctctctctgtggaacgatcatcctttgatggcctcgaagcgctgttggtgtacggcgctcctgaaacggaggctatcaaactcgggagcggcactgaaaccttccccctcccccattttaaccctcttcgtgcaggggttgctcgcccagcggcactttccgtttgtccagcgctgggcaagggacgacgatctatcggtcgtgaccctagcctctacttgcgtccgtccctaagtacctga

SEQ ID NO: 97810 - DNA, 468 bp, Glycine max
  Peptide Sequence Number=SeqID_214588
atgcagagtgggtcccaatctgaatcgtttgatgtagaaatgggagatcgcttagaggatataatttatgatcttggacaagagtcttttcagcaagcacatgcccgtatgtatgatacattgaaagctaattcaaagaaacctttgtatatgggttgcaacaattcgttgacgttgttgtcaacgaatctacaccgtctagaagcatctattgtggaaaggtacattccagaagaagctattgaattttgttcagagtacattgaaagggcaaaacctgttgggcttcccgagtctcgccatgaggaaagagtgagaggtttagtgaaggaaagtaatccaaaaatgtcgaagagtagggtgttgaaagagcataacaagactttcctaaattggtttaaagatacaatctttggtgacgataatgcttctaaaacattaagaaagctagcagatgggcctgaatga

SEQ ID NO: 97811 - DNA, 390 bp, Glycine max
  Peptide Sequence Number=SeqID_214589
atgtcccatactaatggattcgggtccacaacgatgggttcaaatgtaagatcggttcaggatcatgggatccttttctatcagataggaagggctgtttcacaaaatgtacttctaagtaattgctccatagatcctatatctatctatatgaagaagaaatcatgtgacgggggggattcttatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctg

SEQ ID NO: 97812 - DNA, 1126 bp, Glycine max
  Peptide Sequence Number=SeqID_214590
acatgactggtcaaggccgcgtaaagctgctccaccaccagttagcaatgttcttagacacgatgttcatgcgaaaattgttagcgtgcacgatccgccttggcaagcggatttcggcaagggaatgaaccttacgggccgccgcggcgttgcaaccctgccgaaacggtcaggagtgccccgtcaaatgcttcatcgcctgtgtcttctggtaaccaccctcgcactgatttctgcctctgaaccgccggcgcaggtaccggtgccgcagccgaaaccgggtgaggggcagtcctccaccccctcggaaaagccatccgacaagacgccgcaaaggccggcggaagcacccaaacccgttcccaagccgcagcccgaggagcagccggtcgcgaaacccgatgcttccggaaaccagcaatccgatggtgaaaagacacccgcagacaagggttccgatgacgccaagaaggaaggcgaggacaaggatggcgtggagcagaagaaaccgactgtcgaaacggcgaaacctgatgagaagccaccggagccggtgaagccggaggacccggccgcactccaggcatgccttgcctcgttgaaggggatcggtgcagagttcaagcagcttgagccgatccgcgatacggaacaggggtgcggcatcgacgcgcctatcgagctttccgtggttctgcctggcatcaagcttgagccatctggaaccatgcgctgtgaaaccgcgcttgcgctttcacgctggaccaaggagatgatggtgccggcggccgctctggctttgccggagaaaaaggtgacggccatcgccaatgcctcgacctatatttgccgaaaccgcaacagcgcggaaaacggcaagatttccgaacatgccaagggcaatgccgtggatatttccaccatttccttcgataagggcgagccgctggtgatgaagccgcgcggtgaggaccggacgccggagggtgcttttcagcgcacgattaccgctgccgcctgcctgtttttccgcacggtcctttcgcccggcagcgacgcaacccatcaggatcacctgcatctcgacgtgctggagcgaaaaggcggctatctctattgccgctga

SEQ ID NO: 97813 - DNA, 192 bp, Glycine max
  Peptide Sequence Number=SeqID_214591
ttctacggagtgcctgtcgcccccagcaaggtcatcaggctccctactaatcgagctttcatcaagaagtactgcgtccccatgcaagcgcagggcaaaacaccacaacagcctgggggtggccggcagcgggcaacaggcgcaccgccatcaactctagagttcacctcagctcatccaaaaaaaggttag

SEQ ID NO: 97814 - DNA, 213 bp, Glycine max
  Peptide Sequence Number=SeqID_214592
atgagggtggaaatagcaaccaggcccacttgggccctccagaaggcggttgcttctggaggaagtcacctggctcgcctggtaattcgttcagccctcctaaaatccgagccgaggtgcttccgtaacgtttccgtggggattttcgcgaagattttcagccgttcttcgacgttcttcattcgttcttcatcattcttcggtcttcaaccg

SEQ ID NO: 97815 - DNA, 170 bp, Glycine max
  Peptide Sequence Number=SeqID_214593
atggcgaaaagggcgcagaatgaccataatttgtcgctgcgtgccatcggacacgactgtctccgaatggcgaaaagacacgattgtctccgaatggcgaaaagggcacagaatgaccataatttgtctctgcgtgccatcggacacgattgtgtctggatggcaaaaag

SEQ ID NO: 97816 - DNA, 201 bp, Glycine max
  Peptide Sequence Number=SeqID_214594
atgtcgcggaacttcacggattgcctaacgaggggtgtcaagtacctcgaagtggtcaagcgaaggtgcataatgaccataatttgtctctgcatgccatcaaacacgatcgtatctggatggcaaaaggtgcggaatgaccaaaatttgtctctgcgtgccatcggacacaatcgtatctggatggcaaaaggtgcgtaa

SEQ ID NO: 97817 - DNA, 279 bp, Glycine max
  Peptide Sequence Number=SeqID_214595
atgactaaagcacatcaaaagggggtacgaaaaggaaaagtgggagaagcttgccacctagctcgcccaagcgagctaggttgcttcctccagaaggcaccgccttctggaggaatatcctggaaggcccaaaacttcacggatcgtgcaacaaggctctcttttgacttcaggcacgttatggaacttcacgtattgtgcaacaatgggtgccaagtatctcgaagcggtcaagcaaaggttgcatgccatcaaacaatggtccccggacgaaattag

SEQ ID NO: 97818 - DNA, 903 bp, Glycine max
  Peptide Sequence Number=SeqID_214596
atgggaattatatttgccgatcaacaaggcaatactttacataccagaaagccaactccggaaaaccggtatgataaccctgaaatcaacagaaatcagctaagaaagatcctgctggaaagcttagctccaaataccgttatctggaacagaaagctgaccaacctcacagaacataatggcaagtggttgctacaattcgaaaaccagcccgatgcaacagctgatctagtgattgttgccaacggaggaatgtcaaaagttagaaactatgtcaccgatgccgaaatcgaagaaaccggtagctttattatccagggtgatgttccgcagcctgagatcaattctcctcaaatgtacgggctgtgtgatggaagcaggctcatgacttcaaaccaaggaagcttattcgttgccaatccttataacaatggttcgctcacttatggtttaattatacaaaaacctcaagaatgggatcagggccatgctttggactttcaggataaagaaattgtaattcagtttctttccgaaagattaccggattggggcaaaccttatcaggaagtatttcaggcaacttccttcttcgttggattaccaacccgaaaattaccattaaaacagtggaaagatagcagatcgcttcccataactttgatcggtgatgcagcccatctgatgcctccttttgccggacagggtgtaaacattggcctagtagatgcccttacattatctgaaaatcttactgaaggtagttttgaaactgtagaagcagctataaaagattatgaactgaaaatgataaagtatgcagctgaagcccaacaggaatccgccgttaacgaggcagaaatgcgcgatcccgatttttcttttctacagctttttgaataa

SEQ ID NO: 97819 - DNA, 252 bp, Glycine max
  Peptide Sequence Number=SeqID_214597
atggcttttgtctgtagagcgtctgctgaagatgccattcagaggatgcaagggaaggtaataggtcagcaagtgatccaaatttcttggggcagtaccttgacagctagacagtggtttggctgtttggtcgttgaaagatgtttggaagataagtctagactctacttgacaatcatgagattgatgcctatgaaggttatcacaattgcatatgcaaactgggtttggagccacttccccttcccctaa

SEQ ID NO: 97820 - DNA, 208 bp, Glycine max
  Peptide Sequence Number=SeqID_214598
atgtattggacaatatggattttaaaatatcagaaatcaagtgagctggtaaagaaatttggagatatgatgcctaaaaccaagaatagcactgggattaaagtaatgttgaaacgtcataagcctaacgatagttcaaagaagcctagagatgtaacagcaaggaccatgaacacccaaagcaaatttgtggcacattcatgcaaag

SEQ ID NO: 97821 - DNA, 261 bp, Glycine max
  Peptide Sequence Number=SeqID_214599
atgttgagctggctaaagtttctgggatgtccaaggattattatcatgctctctttgacctttaatcccatcttacattcttacaggatgcattcactgacaagaaagtttgagggaaaaagggtcactgccatgttattcactgggtcagattggccaggggcagtagtgagtgagtattggaccttagcagagagcaaaagggatgtggggacacttgaccccaaacatagggtacaaagacttttggtcaatccataa

SEQ ID NO: 97822 - DNA, 294 bp, Glycine max
  Peptide Sequence Number=SeqID_214600
atggagataaagcctgaagaatacagcaggagacaactaaaggaatcaaagttcaaaaaagggatagtagaggaagtgagcagggatgacaaaggaaaagacaggtttcaagtagaatatagggacctgaaaaccaatggtggcacccagcttttgaaagaagaaattgatgcacggcttattaggccctgccctcctgaagtttcatttgctggccctttcaaacagttccaagaagttgatgcatggtataaaatgacgggtggtgggaagccgttgctcatgaagtactaa

SEQ ID NO: 97823 - DNA, 417 bp, Glycine max
  Peptide Sequence Number=SeqID_214601
atgcaaaaattcctctatgtgccatccatgtccaattgtgcactcagtgccgtgtgctttgataagtgtactaaaatacccatagttacttcttcttcttccttttgccttcttcactcattcattatgttgctttcttcgcattcattcattctcgtgagaggagaggtccttcattgtcgtgcctactttggtctaggtgcaagtgttacggtggttcgtcagcaagtgatggttggtgtgtctattaacgacaaaagtaagatggaggaagatcagtggatgcatgacaatgtaatgtttgaagaagttgatgtgaatgaagcaaacggagaggaacctggtgtacatcaacatgttgatagtttcgatgccttcaatatttttcaggtgaaactagtggtgggaggcgaatga

SEQ ID NO: 97824 - DNA, 204 bp, Glycine max
  Peptide Sequence Number=SeqID_214602
atgatgatttatggggtggatctgatagctggtggtggtgttagaggcgagtgttcgtggaagagcatcagagagcaaaggcaccgcaaattacgagcttgtggaagccaagatgagacaaagaagcacaatgtgggagaagaacaaatgaaggagagcggtgtaggggaagaacaagtgagggagaaagggaaagaaaaatag

SEQ ID NO: 97825 - DNA, 465 bp, Glycine max
  Peptide Sequence Number=SeqID_214603
atggaggcaaagtcactgctcaagggttcatcacttaaaccttcttatcccatccataagctttcaaaaaccacgatgatgacacccaactgcgttagattcagtttcaactacaactcatgcctcatattcgcaaatgggtacccttcttcttcacttccactttctcttcagaataagcccagaaaatcggcatcagtggttgtgagtgcccgaaggaaagacaagaaagaagatacccatagctctgttcccaaacccgacgaggtcactggtttcttccccgaagctgtgctccttaaaaagagaacagttgaggaagaagggaagcttctcccggagtttgaagatgctgatgaaagagaactctttgaagcgctgatgcttgagctggatagtgatatggatgttgatatatatagcaataatgtgatgaatcattcccttcgaagatttgttctttag

SEQ ID NO: 97826 - DNA, 2310 bp, Glycine max
  Peptide Sequence Number=SeqID_214604
atggctcggaagggtaatcagcagaagaatggagtggaccgtcatggattgaataacaaaaaaggggtttctggtggcatgcttccgggaatgaaagaccttggtaaaggagggccggtgaaggttttcctgagagaggaactcgcagaaaccaattgtatcggtgtttcgcagactgcatgtgatgctagttcttcaggtgatgagtgtaacaatgagcaaaggtctgtcaaggtttctagaaaagagaagcaagggatggccggaaagcatgacctggaggagtcctcattctttgagggtaattctggggatggcagtttgaattctgaagccgaagcttcaatacaagaagaaaatgggactttacctagaagtaatcaaggtcaacagagtataaagagtagattgagctgtatactggatagtttgcacctgaaaagtgtggtggaaaaagtagagcttgccgataatgtgataattcggagattaagattgttagtgttttccatctttacagcagtttcagagtggctaaccaggcagactccattgtttgtatctcttagaaccatcgtgtttgaagcctgccataatgtcagaacaaaatttgtgctggcatatcctattgttttgaagtgcctcatgcattttggaaacataatgctcctattatcagtgttttggttggactgtgcccttcggggtgttgattcatttatacgtatgggtacaacgtccttcttctctgttatttggtgtagcatattctcggtgattagtatgatagggatgctcaagtttcttgctgtcctgggcctggctgccttgattggatgttttcttgggcttatgcttgcaattttggtagttgcaatcattggggttattaccttgtggttttatggtagcttttggacaacagcatttttcatcattcttggaggattgacatttatgttaagtcatgaacgggtggcactacttatcaccacagtgtattcagtctattgtgcaagactgtacgctggctggcttggtttgctattggcttttaatttagcttttatctctagtgatgttctgatatacttcctgaagaaaaatatagaacaacagagtagatccaatccttttgagcaaagagctggaatgcatggtcaaccaggatttagtgatgaaccaacacatgcgtcttcctcggaaaatggacagggaccatctgcagatcgcaatgctggcatcccttcaactagtggggttgattctgatttaacttctgaagatgaagttgtccgtttgttgaactgctctgatcattatgcagcactgggattcacgcggtatcaaaatatagatgtttcaatactaaagcgggaatataggaaaaaggcaatgttggtacatcctgataaaaatatgggtaatgagaaggctgcagaagcctttaagaaacttcaaaatgcatatgagattctaatggattcgttgaagcgaaaagcttatgatgatgagctaaggagagaggagattttgagtgtatttcgtagatttcatgatgcttctcgtaagggaactatgctttttgggtcaaacacattgtggtcaggaataatattcatcagtattggggataataaccatgaagagaatggtaggcatggattctttccttcaggatttgcacgatctgatgcagatggcaaggatccatttggtgattcaaggcgaatagcctgcaaaagatgtgctggctttcatgtctggatacacaccaagaaacaaaagtctcgggcaagatggtgccaggattgccaagactttcatcaagctaaggatggtgatggatgggttgaacaatcttcccaaccatttctttttggcttattgcagaaggttgatgctccttcagcatatgtgtgtgctggtagcaggatatatgatgccactgaatggtatatctgtcagggcatgagatgtccagcgaatactcataagccaagttttcatgtgaacacaaatttaatgtccaagcataattctggcaaaggaactagttcaggtcaaagaggtgggcatatgccaacacctaatatcgaagaaaccatgactgaggaagaattatttgagtggttacagaatgcagtacatgcgggtgcatttgacaattttagtggcactgcaacagagagcccatctcccaaatctggaaatggaatgaaaagtcctggcagtagtagcgccggtgccagtgctggtgctggtggtagtagcagcaagagaaagaaaaagggaaaaaagcaatggtga

SEQ ID NO: 97827 - DNA, 942 bp, Glycine max
  Peptide Sequence Number=SeqID_214605
atggcacctcaaatttcaagaggcagagtctctattgttgttttgctagcctctcttgtcctcccactactttttccggaatgttattattcttctgtgttcattgcaagtgcagcagccccagaatcagatgttgatctgttagaatttcccttaaacttagaatacttggaggctgaatttttcttgtttgggtctttgggttatggattggatgtggttgctccaaatttaactgagggaggaccccctcccattggtgccagattggccagacttgacagccttgtcagggatatcatcttgcagtttggtttccaggaagttggacacttgagggccataaagagcacagtgagagggtttcctaggccattgctggatctaagcacagcatcttttgccaaagtaatgaatagtgcatttgggcgacctctggttcctccctttgatccctatgctaattcgatcaactatctgcttgcatcttatgtgattccctatgttggcctcactggttatgttggtgctaatccactgttgcaaaatgctacttccaagaggcttgttgcagggcttctgggagtagagtccgggcaagatgcagttattcgagcattattgtatgaatatcgaacgttatcggtacaaccatacaatgtgactgtggcagagttcacaaatcgcatatcaatgcttaggaacaacctaggaggttcaggtttgaaagatgagggtcttgtggtgcctagagagcaaggtgctgagggtagagtcaccggcaacattcttgttggcgacaaagattcactgtcatatcccaggactccaagggaaatattaaggataatatatggaggaggtgatgaacatgttcccggtggcttctatcccaaaggagcaagtggtagaatagctaaatattacttgaaaactacctaa

SEQ ID NO: 97828 - DNA, 549 bp, Glycine max
  Peptide Sequence Number=SeqID_214606
atgttaggtagtcctgtctctatgctccatagaactgacggtgactttttgagggagaagaaaggtcaggtttggagattgaatgattggggtatgagaaggctagcttacaaaataaaaaaagctaacaatgcccactacatgttgataaactttgagttggatgccaaatatatcaacgatttcaagactctgttggaccaagatgaaagagttattcggcatctggtgataaagagggatgaggcaatcactgaagattgccctcctcctccggattttcatacactgcgtggaaatgcagatgatgatgaggacgaagaatttgatgaagattatgatggtgactgggatggtgaagatgaggaggatggcgatgaaggcgaggatgatattatttttgtagatggtgatgaagatgatatagattctagaaaacagacatcagcaaatgttagacaaccagatataagaaaattgagggctgagaacgttttgtcagcggaaggtattgaacctgcgatttttccctcttacctcacatcttaa

SEQ ID NO: 97829 - DNA, 321 bp, Glycine max
  Peptide Sequence Number=SeqID_214607
atggaatttgactctccaacctctcgtcctatccgaagtgacgtcgttttggaccctccaccaccgtttccgaccatttacacttttctgccgccgccaccctccacggtgctgcttccgttacctatcaacccatcacttttctttacaatggacaatcaaaggtccatttctctgtttcagtttatggctgatgaaggacttgttccatggctagaagattacttgtacggacttggcataaatatctatgcagtaataatatccacttctcttaattctaatgtcaattttgggaacctcactcacaatcatatatga

SEQ ID NO: 97830 - DNA, 432 bp, Glycine max
  Peptide Sequence Number=SeqID_214608
atggctgtacattctgattcggcttcatccgagaagaaatcaagcaatggagtgaatgagttgctgacttttaatgctgagaacatgcaaagcaacatgaaaattatctattacagccgaacatttttatctataattggtggagttgttgctggtattttgggatttacaggcttgaaaggatttgtgttttacttacttctcatggcatttacttcacttgggctcgtggccaaagcaaagttttccacccacacatactttgactcctggaatcgagtgctacttgatggctttctgggtggcctaatggatgtcccggagttggtggtacacgtcaagtttccggtggccggtgttggacttgtcgtatttgaacccgggttggaacgtagagagtgttattcagtggaacttgtcgctggtggatga

SEQ ID NO: 97831 - DNA, 570 bp, Glycine max
  Peptide Sequence Number=SeqID_214609
atgaggaggatcccaaccagtgtgtcttcttttgcaattcacattcttcttcttctagcttctatttctattcccttcacactatgccaaccctctttcccatggaaagatgggaacggcgatttggtagatcaagtgtgcaaaaagacacccttttatgatctttgcagctcgatccttcactcaaaccctctaagtccaaaacctgatctcaaaggggtggctctattaatggtgaacaacattcttgcaaatgcaactgacacactgagttacattgaggggctgatcaagcagaccccagaccgtgagttggagcaatccttggctttttgtgctgagtcttatatcccaattgtcaagtacattctcccacaagctgctgatgccataagccagggtcgttttggctttgccagttactgcatttctgatgctctcaaagaagtgagtagctgtgacaagaaattctctggtgctacacaagcacccttaggtgacagaaacgacattgtgcagaagcttgtgaatgtagcttcggccatagtcaaactacttctaaagggctga

SEQ ID NO: 97832 - DNA, 848 bp, Glycine max
  Peptide Sequence Number=SeqID_214610
tttctggagagagtctggaggaaattctacagaataataacaaccaagaagttggattaggattttgtgaatttgggatggatcatagaagtgcaatggatagggctactgaatttgatcttgaaagtggattgccactaattggagatgattcaaagaaagtctctgctcctagcacggctagcagtgcaaaacaaggaaaggcattatttgctaaggtttctggtgggtttgctggaggttctgttaaaggtgatgatgggccaagtttatgctgcaatgaaccaagtttaagtgaagtatatgcggatgtgatgagagtaacaaacaaaccaatgatggggagagattcggcaaaccgtgcacaacaaaccccagtgagggagaaacggaaaaaggccagtaataaaaaggctcccaaacctccaagacccccaaaggctccatcattggatgcagctgaccataagctaatcagggagatatctgaacttgccatgttgaagcgcgcgaggatggagcgtatgaaaaccttgaagaagatgaaaattgctaaatcatcagcaccatcatcttccaatgccagcagccttttggctatgattttcactgttgtcttctttgttgtgataatactccaaggcatgtcatctggtaaaacctcagtggcaagtttccagggatctcctgtatcagcaggtgaatcagaggatggtttaatttcagttcattaccaactcaatccttctgcaattgactcaaatgctcctggttcagagtctcacacttttgtacagcaggtagcgggttcagatttgcctgaaaagctgaggagagattcaggttaa

SEQ ID NO: 97833 - DNA, 261 bp, Glycine max
  Peptide Sequence Number=SeqID_214611
atggttgatgtgatcaaagccataccaaatgaaacattaaacaaaatcaacgaacttctgaaggaaggtgatgtacaacaaactactcaagctttgaaacttggagacccaagtttgcaaaagatggaacaagtgattaatctattgaggctacttcttgtgagaagagcttcagtgggaaatcatggctcaccaaggagaacaattatgcatagtgatgtggcaaatgtgactagagctattgttagactattgctctag

SEQ ID NO: 97834 - DNA, 636 bp, Glycine max
  Peptide Sequence Number=SeqID_214612
atgactagaaaagtacacaatgagatgatcagcacgaggccgaaagagtacgatgaattgccaggctctgatattcctaccgatgaggaacgcgcagaaagcatcaaccgtcgcataagcaacttgatcgttgctgagatattcagcataccacgcgctcacgcttatgtctctccgctgcggcactcggtaaccgaggcacttcgctacgatcgcttccaccgaatcccgcgtgaggctctcgaagcagagcctcagatccagaggatccatcgccatctccaactcgtgctccgaacacgcgagcttaaggcgatcggagtggttccagaatccgacgaaggtgtgcgaaggatcgttcaggaacgtgcggaggctctccggcacgtagtcggcgtgcgcgagctggaagatgaggcagcggcggccgacgcagagctgaagcgtgtccggcggaggatcgtggccgccgcgagtccactgcacgccgaggccgacaacgaggcgctcctggtcgacgaagtagcggttgaagtagagcgtggaggagagccaccgcttgaccacggaggcgctggcggtgacggtgacggtgatgtagttttcggcgagacagacggtgtagatgtcgtggtt

SEQ ID NO: 97835 - DNA, 462 bp, Glycine max
  Peptide Sequence Number=SeqID_214613
atgagaaaaaaatttgttgtgaaaagggttgatcctttggctaaagctctaacttcagtatatgacgagtctcaaatagaacgtcaaggaaagatatcggggggagtagtggaagcaaattcatgtaatgttgattctactatgaacatggagttcactgatggatctgaaactatcatgagtgatgtggatatgacacgaaccggtgatatggcaaatgttgcaagtattcttggccggttgtggccaactctaataaaacccctcaatgaggagtctatgttgttggaattcccttcataccaaagaaggcaaactctttgggaggagcttatcaactttgtagatgatgttgatggtcctttggcgtttgttggtgattacaatgttgtgttgcatgtgagcatgaatgaagtaggagccgttctagatatttgctcaaagcatggaagcctttcgtaa

SEQ ID NO: 97836 - DNA, 846 bp, Glycine max
  Peptide Sequence Number=SeqID_214614
atggagaactccgaagattttctcactctctctccgccaggtaataatagtgatgccaagagtgcgagactctttcttacaataaaccctcccccaacaatgcaaaagcatctttcactcattagtccattgttggaaccatataaaccctcgtatcaaaacacagataatattgttgctggtgacatgcatctaaatgctccttcaaccgctttatcactcagtattagtcccatgttgtcaccatatacagcttccaaccccaacaaagataatgctagtgatctgcatccaaatgttcctgtacctggtttctcaagttctcctcgtacccgttctcgtcggggaaagagtaaaaccatcactccaccttttccctgggcaacgaatcggagagccacagtgcacagctacaaatacctcttgcaaaacaagattgttacgatcacgggaaaggttaagtgcaaacggtgcgatgagaggttcgagatggagcttgatctgaagagcaaattgggtgaattgttgaaattcattcagaagaagaagtgtatcatgcatgatagggcacctaatgtttgggtggtgccagtgttgccaaaatgtgagcattgtggacgagaaaatagtgtggagccattccttggggacaccaagagaagggccattaattggttgttcttgttgctggctcaaatgctgggtttctgcaaccttaaacagctccaatatttctgcaagcacaacaataaccatcgaaccggcgccaaagatcgcattgtttattccacctatatgggcctctgcaaacagcttcttcctgaattgtttgattctcgatcatag

SEQ ID NO: 97837 - DNA, 1098 bp, Glycine max
  Peptide Sequence Number=SeqID_214615
atgtgcatacttcctcgcttaaagattattcattttaacccatctagaactttgttgaaagaattgatgttcactttcatgatgaatctttcttcaaattctagtaaagaaaatggcaagaggaaagaaaaaggctatcattgctcatattgtgaaaaggcatttgaaaattctcaaggtcttggagatcatcaaaggttgtatgaagttgagattaagcaacacaacaatcaaatgattcattttcaaaattcaaaggatgttaccaagtctaatcctggacatggggatgccttaatgaaagctttgtctagaggtacaacaaacaatccttatgtaacgaaaggaaattattatggaggctatagccgagaagaccacaattcattgttcatgcctccaaattattcttctgcccgaaccgacaatgcatccttggtaacgtcaattcaatataaagagaccattcctttttctcaatctgtagactatccaatttatatgagttcttttagtaatcatataggtggtgcaagttcttctataaaccatcaatttgatgctagcaatccacaattttttattgatagtttttccaaaccttttaaaagcaatttttggaaaaacgaacataatgatcccaatctcacatatccggtcttggttagaaattcatctttacccggttatcacatggctgattttagtttatggaattttaacaccaacaaatttcctagcccaattgagcctaatgttgttgatacccaaataaattttgttggctcaaacaatagttatagttataatgtggaccagatttatgagaaggtaaaaaaccataatagagatgaagttcaagaaaaaattccaatgatgaatccaccaaaaatgcccaatatcaactttggtccacttgtcaatcatggaatagagatgctgcaaaaaaaggaagcatggttttctacaaaagagacaaagcttaaagctgtagaagcaattttcggcaaggatgaagggaagaatgcttcgacttcaaagagtgcaaattttataaaagaacaagaggttgacttggatctttcccttcatttatag

SEQ ID NO: 97838 - DNA, 369 bp, Glycine max
  Peptide Sequence Number=SeqID_214616
atggggagaaatggccctagaatttctcatctcatatttgttgatgaccttctcctttgtggtcaagcagactatgagcagatgcaatgtctcaaagagctccttcaattgtttagagatattgatcagttggtgagtggggaaaagacattatcaaacccctatttattttttggtttcatggaagtttcttctctaggatcctatctaggaattcctctcctgggcaagactcctagacaaagagactttcaagacttgatggacaaagtgtcgaataaattagctaatactctgaacagttgtcaatggctgaccacatcactcttgctagctctatcattcaagccctacctacttactctatga

SEQ ID NO: 97839 - DNA, 633 bp, Glycine max
  Peptide Sequence Number=SeqID_214617
atgaaggtggagaaaaccaagatattcttctcagaaaacatcaactggcatataaaggaggatcttactgcaaagattggtttccaatgtactttggggaaatatcttggtgtgccgatattccataaaaaggtgaagaaagaatcctttgagttccttctagataaagttaatcacatattaagtggttggaaaagtaaaatgttatccatggcgggtagattaagtcttgcaaagtatgtgatcaaagcttttccctcatatgtgatgcaaattgtgaaaattccggcctacatttgtggtgaaatttataaaaatgtagagcatttttatttgggggatgatgagaataggaggagagtgcatattgtggcttggagtgaattatgtatgcccaaaaacgctggtggcttgggcttgagatcatcaacggatatgaataaaagcctcgtttatgaaggttatagtcaagtcattgatgagggtgacccgtatttcaagcgcatttgggattggaagggtcctaaaagaattcgaatttattatggaagaggagaagcaagtcgtccattgccgatgcaagaaaatccctatataagaaagaaacttcagaagcagaatgagaggtcttga

SEQ ID NO: 97840 - DNA, 240 bp, Glycine max
  Peptide Sequence Number=SeqID_214618
atggtggagtctaacgatgaagttggagctcattgggtttggtatctaagatcgttaaggaagactaagatcattactcgcgttcctggctgggaaactcattgcttcagcgatgccgtgacagagctctacctcacccgcagcgtcgtcgcacttctcctaagtcgttacgcctgggagcttcatggaagagactctcggagcaatgaaggagacgatgatgaaaaattccaccgatga

SEQ ID NO: 97841 - DNA, 1026 bp, Glycine max
  Peptide Sequence Number=SeqID_214619
atgaccaattcctacacctccaatgaccttaacttttggttggacctcaattcaccatgtcttctctcctctccttctccttcttccatcaatccaccattctattttccttccaattatcataatagtaataactacacaagtgccatatcttctaatactcatcatcagttccaaccctctcctcctcaaagaaaagcccttcccctccttcatccaagacatgaagaagaagaagatcttgaatcttcattcagtgtcatggaagtggacaagaaaaagaaagagctgagttcatcatctagtttcttggatgaagaagatgctgcagtgactgtggccttacacttagggcttccaagcacgagtattgcatcttctgctgatttagcttcttcaagcctatactcaacagaggcttcttcagacaaagaagaagaagaagaaaaagtagtactcactgatgcttcggggcttcttctgtcaaatagaattaacagaggacaatattggatccctacttcttctcagattctgattggtccaacacagttcccatgccccctttgtttcaagacgttcaacagatacaacaacatgcagatgcatatgtgggggcatggatctcaatataggaagggaccagagtctctaaggggaacacaacccacggctatgctaagacttccttgctattgctgtgcaccggggtgcaagaacaacatcgaccatccaagagcaaaaccactcaaagacttcagaacccttcaaactcactacaagagaaagcatgggacaaagcctttcgtgtgcagaaaatgttgcaaagcatttgctgtgaggggtgattggagaactcacgaaaagaactgtggaaaacgctggtattgctcttgtgggtctgattttaagcacaaaagatctcttaaggatcatatcaaggcatttgggtatggacacacggcttgtggaaatgactgcaacctagatcaagatgatgatcaagtgggctctgaaattgaataa

SEQ ID NO: 97842 - DNA, 288 bp, Glycine max
  Peptide Sequence Number=SeqID_214620
atgtacaatgtttggtttgtccgcttcttcgaagtccattatctcctctctctagtgccactggtcgtcgccgcgagtggaagagaggatagtgacattggagggggagtacgatgtgggggaacggatcgagatgacaccaaattgggagttgcaagtgacgttcacgaagccaaagttgttggtggcgtgactggtgatttgaaggagcgtgatgataagcttgtcgaaggggtggggagggtgcgaaggtcggaccaggagaggaattggaggaggacgtggtag

SEQ ID NO: 97843 - DNA, 135 bp, Glycine max
  Peptide Sequence Number=SeqID_214621
atggaagtgctgaaaccacccacggatgaaagtgcaacacccagcaagacctgcgaatccatcacgataatgaatgaagataacgtctcggtggagggaaagccaaatgagagggagagggagtttgagtattaa

SEQ ID NO: 97844 - DNA, 1140 bp, Glycine max
  Peptide Sequence Number=SeqID_214622
atggcatgctatttgctcaaccgatcatcacgagcatcattggatgagaaagttgcaaaggaagatccagtttccaacaagatggtgatcaacagacatgcaatgtttgatgaacaatccatgttgccagaaatagttgagacaattgtgccagtgtctgatggagcttcccttggctccatggaggttcaggccacacccacatatgggccaggatcaatgagtccaagtggactgcatcaagagtacaatcttatcaaagacagagattgtcgcaacattaatcctgttgtccaatatcagtttgaagaattagctaaatcgactgcttttgcacttcttactagtgctacatatccttttacctttcaagaggctatgaacaaccaagagaaaaaaaaaaggatatgtactaaggaaacttctatatcagaaaaagaagaggaaaagtttaaggctctcccaatagaaaaggggagaaaatttacatggagtagccaaaatggttcaataaaggtagaccaggtcaactgtcttgatgatgactattttatttttctgctattgtatgttgaagatatgttgattgctagtagccttttgcatgatgtgaatgagttgaaatcattattgaacaaggagtttgacaagaaagacttgggtcctgccaagaaaattcttgggttcaacacgagtaataccaagcctatgagtactccattagaaaaacactttaagctttatgtagatcaatgtccgaagacaaatgttgaggtgaagtacatgtcaaaggttccctatgctagtgcagttggttgcttgatggaagcgacattgagaaacagtgaagtggatattgagggtgatccttcagttgtgaaatatgtggattctgactatgctagtgatttggatgatagaaggtctacaacaggatatgtctttagttttggagcggagtacatggcgttagtagaggctagcaaggaagttgtgtttttcatagagctaatgaataagctgggcaaagttggagtggagtataagggccacttgttgttgggttacaaagcgggaaatatcaatgaagctattgtgaaagctatgaacttgaaaatggagagcaatttgaagaaatga

SEQ ID NO: 97845 - DNA, 633 bp, Glycine max
  Peptide Sequence Number=SeqID_214623
atgacatacttgaaacaggagtcttgtcccaggcatgacgatcctagcgattacagaggaacgtctcagaacatgctgctattattagcccgttttggttacacattttggcaacaatggcgcataactggggccaaatctggagtggggaagttggatggaattgagaattttggattgtggcataggcgagttaaggacttgttgacacaacaaggtcttctaaaggtcgactcaaagcttgagaaaatggaggatttggattgggaggagttgcaagagagggttgcagcaaccatacgcttgtatttagtagacgaggtcctctatcacgtgacgaagttggcgtctctgggggcgagacagaatgcaatgggtagttcgaaaggcgatggtctgcatttgaaagggaaacatgaatgtggaaggacacaagacaaggattatggtggtaggcagaggaagagtctaagtctagagaatgcaaatggtttcagttatagaactgatgaagatcaggatacctttagagtatgtaagggggcgagatatgtatgggtgttgactgtgatgaaagcacatggggctataggaaatatttttgggctactggagagcatagttgtaggatga

SEQ ID NO: 97846 - DNA, 228 bp, Glycine max
  Peptide Sequence Number=SeqID_214624
atggtgatgggtaataatgcgtcatgcatgataactggtactgggatagtccaaattaagatgtttgatggagttattcgtacacttggtgatgttatgcatgttcttgatgtgaaaaaaagtcttatctctttgtgtactcttgattcaaaaggtacaagtacactagtgaaggtggagtcttggagattagcaaagggagattctatgttatacatggttctatag

SEQ ID NO: 97847 - DNA, 643 bp, Glycine max
  Peptide Sequence Number=SeqID_214625
ggcgatcggtgcgggcctcttcgctattacgccagctggcgaaagggggatgtgctgcaaggcgattaagttgggtaacgccagggttttcccagtcaagacgttgctaaaagcgaagaagaagaagaagaagaagaaccaaaagaagcaaagagaaccaagattcgcgttcatgacaaagagcgaggttgatcacctagacgatggttataagtggcgcaagtacggccaaaaagctgtgaaaaacagcccttatccaaggagctactaccgttgcaccagcgcgggttgcggcgttaagaagcgcgtggagcggtcctccgaagacccttccatggtggtgacaacctacgagggtcagcacacgcacccgtgccctgcttcggctcggtctagccttggcttcgtgacccaacctgctgcgttcggtccctcacactttatgctgccacatcaagcacaagcttcggctttgagtgttgttagctccagtagtaactacatcaatacgacatcgtttggtgggtttgttcaggatcactcgacccgtcgtggttttggacatgaggctttgttgagggacaatgggctgcttcaggacattattgtcccaactcaggtgaccaaggaggagatggattga

SEQ ID NO: 97848 - DNA, 1194 bp, Glycine max
  Peptide Sequence Number=SeqID_214626
atggagatggaagataatgaaactattggtgtcttgatagagaatagcgataacaccacttctctagaagctaggagtggaaaggacatccaaggtataacttggaaaacagaaacatcggattataaaagtcgtgatgaatttagacgatttaggttagaacgtctctggatcgtggaacctcgacccttaatagtggaacaagccaagcagggatgccagccaacactgaaaggagggatctattatgactattttaaatacaataactgtttgatgccatttaaacaagattactccccggattatggtggcatgctttggtgtacgtcaaggcatgatttatatttttgttcacgttacaaaattggtcatttgaatgcactaacttccaggactactgaagtgttggatgtgaaagggcatgtagttccatctaaggaacatcctggaaaccacatgcatggatttacgaagacatgtattgaggcaatggctgtagggcataagttgttgattattggaggcaattatggagaactaatttgcaaacacttaaatcgtccaggagttagtttttgtttccaattagagaatgaagcaaagataaattctattgagatttttaagcgtcccactgccaccaggtctttgtttactttttccttgattattgaagttgctgctaagcatgcttcatcgagcccagatggaagacaacttgtagtggttggagatgacccagaaggaagattagtggattctgaatcaggatcgaccatccaatcttttcgaggacactttggctgttcatgttcatcggcatggcatcctgatgggaacatgtttgctactggaaacacagacagaacatgtcgaatatgggatgttcggaatttgttacaacctgttgctgctcttgagggcaatgctacagccatttcttcaataagtttcacatctgatggaaggtttatggcaatgtgtgaagacgttgattttgtgcatgtctatgatgtgcaggacgcgtttaggagagagcaggagatcgatttgtttggacatgtgtcaggtttatcttttagtcctgacaccgaatatctttttatcagtgtctccattgatactgttccaacccttttatcgtaccagcggcgacacaggatctaccactacctggattctatgaattga

SEQ ID NO: 97849 - DNA, 168 bp, Glycine max
  Peptide Sequence Number=SeqID_214627
atgagagtgcagagaagggttaagttcattgcacatgctcttcacgtgcgtgacgtagggcagtgtcgtggactcttagctggaggagaaggaaagcggcaacggtggtctaactacatgggaatgaacaacccacataaaatcccaaggtcgtgtttggtggtttga

SEQ ID NO: 97850 - DNA, 546 bp, Glycine max
  Peptide Sequence Number=SeqID_214628
atgaagcttcttgctcagcaaagggatcttcaggcaaagataccagatattgaaaagtgcttagacgttgttgctacattgaaagctaagaagggtactggtgaggaacttattgctgattttgaggtatcagaaggcatctattcacgagcacgcatagaagaaaccaattccgtgtgtttatggctgggagctaatgttatgctggaatattcattagaagaggtacttgtatccgagaaaaattcaagtcctacattggcaagaaataaggccaatatagagtatataagtggagggcaaccctcaccctatgagttagcttttggggttgagttaggcccagactcacattttattatggctactggtcttctacagaagaacctggataatgctagagccagtttggaagttcttattgctgatttacagtttttgagggaccaggtgacaattactcaggttacaattgctcgtgtgtataattgggatgttcatcaacggagagttcaacaagctgttgctacaactgctcaagactag

SEQ ID NO: 97851 - DNA, 462 bp, Glycine max
  Peptide Sequence Number=SeqID_214629
atggcggaggagaaaagacaagagcaagtagcgaaccccaacaactcatcatccaccaccatgccattttccgatcagattcccaacaacaacaactccatcatgatgactttccctttccaacaaccatccaccatcttcgacctcatgatgatgccttcttcttcttccttcatggacctgctcgccgtgcaggactacaacgtgccgttattcgattggctccccgccggtgtcgcacaccatccttcgccgtctccggccagctccaacgtccccgactcctccgaggtgctcaacacgccggcgtcgcctaatttttcgtcgatttcctcgtcgtcgaatgaggctacggtcaataacaactccgaacaacagagtgggaaagaattacaagaagaagaaggtggtaatggaggcagaggagataaccaagatcaagacaagactaagaaacagtga

SEQ ID NO: 97852 - DNA, 111 bp, Glycine max
  Peptide Sequence Number=SeqID_214630
atggcctttcacacacctcgtttaagtagtcttaaagtgcttgttttgggtggatctgaaactggagtgaaacctctaactagtagcatttgtcctcgaggaaaggcatag

SEQ ID NO: 97853 - DNA, 1438 bp, Glycine max
  Peptide Sequence Number=SeqID_214631
atggaggcgttagtgtttgcgcttgtggccattctgttgtgtggttgtgatgctgctaaagaatgcacaaacattcctacacaatctcatacattcaggtatgagctattgatgtccactaatgcaacgtggaaagcagaggtgatggatcactaccatttgacgccaacggatgaaacggcttgggcggatttgctgccgaggaagttattgtcagaacagaaccaacatgactggggggtgatgtataggaagattaagaacatgggtgtgttcaagtcaggtgaaggatttctcaaagaagtgcctcttcaggatgtgaggttgcataaggattccatccatggtagagcacagcaaacaaatttggagtatctgttgatgttggatgtggacagcttgatttggagcttcaggaagacagctgctctatccacacctgggactccttatggagggtgggaaggtccagaagttgagctcagaggtcattttgttgggcattacttgagcgcatcagctctaatgtgggccagcacacagaatgataccctgaagcagaaaatgtcatctcttgttgctggtctgtctgcctgtcaggagaaaattggaaccggatatctatctgcatttccatctgagttttttgatcgatttgaagctgttcaacctgtttgggctccctattataccattcacaagatcttggctggcctcttggatcaacatacttttgctggaaaccctcaagctctaaaaatggtaacatggatggttgattacttctacaacagagtgcagaatgtaataacaaagtacactgtaaatagacactatcaatcaatgaatgaagaaactggaggaatgaatgatgtcctttatagattatacagcataacgggagattctaagcacctagtgttggctcacctttttgacaagccatgctttttagggttgcttgcagtgcaggctaatgacatagctgatttacatgctaatacacatatcccaattgttgttggatctcaaatgcggtatgaaatcacaggcgatccactttataagcaaattgggacattctttatggacctcgtaaactcttctcacagctacgcaactggagggacatcagtcagagagttctggagtgatccaaagagaatagcagacaacttaagaacgacagagaatgaagaatcatgcacaacttataatatgttgaaggtttcgcgtcacctgtttagatggaccaaagaagtctcttatgcagactattatgagcgtgccttaaccaatggtgtgctcagcattcaaagaggaacagatcctggagtgatgatttatatgcttccactaggttttgcggtttcaaaggctagaactggacatagttggggaacacagtttgactctttctggtgctgctatggaacag

SEQ ID NO: 97854 - DNA, 2118 bp, Glycine max
  Peptide Sequence Number=SeqID_214632
atgggtagacatgggttcgttcaaaaactggtgggcgagctttgtttcctcgattcttcacccttcgccaagttattggactcttgcgttcggtcgaagtctggaattgacgcgcgacgtattcatgctcggatcattaagacacagttttcatctgaaatctttattcagaacaggctcgtagatgcttatgggaaatgcggttattttgaggacgcacgcaaggtgtttgatcgtatgccgcagaggaacactttcagttataacgctgttttgagcgttttgacaaagtttggtaagcttgatgaggctttcaacgtttttaagtcgatgcctgagcccgaccaatgctcgtggaatgctatggtgtcgggttttgcgcaacatgatcgctttgaggaggctttgaggttctttgttgacatgcatagtgaggattttgtgcttaatgagtattcgtttgggagtgctcttagtgcttgtgcagggttgacagatttgaatatggggatacaaatccatgctttgatatcgaagtctcgttacttgttagatgtttacatgggttctgctcttgttgatatgtactccaagtgtggcgtggtagcttgtgctcaaagggcttttgatggcatggctgtgaggaatatagtttcctggaacagtttgattacgtgctatgagcaaaatggtcctgcgggaaaagctctggaggtttttgttatgatgatggataatggggttgagcctgatgaaattactctggccagtgtggtcagtgcttgtgcaagctggtctgctattagggaaggtttgcaaattcatgctcgtgttgtgaaacgggataagtaccggaatgaccttgtgttaggcaatgcattggttgatatgtatgcaaaatgcagaagagttaatgaagctcgattggtttttgataggatgccacttaggaatgtggtgtctgaaacctccatggtttgtggatatgccagggcagccagtgtgaaagcagcgaggttgatgttttcaaatatgatggagaagaatgtggtgtcctggaatgcacttattgcaggttacacacagaatggagagaatgaagaggcagttagacttttcctcctcctaaagagggaatctatctggccaacccattacacctttgggaatctacttaatgcatgtgcaaatctcgctgatctgaagcttggtagacaggctcacactcaaattttgaagcatggattttggttccagtctggagaagaatctgatatttttgtggggaattctctcattgacatgtacatgaaatgtggaatggttgaagatggatgcctggtttttgagcgcatggtagaaagggatgtcgtttcatggaatgccatgatagtggggtatgcacagaatggttatggtacaaatgccctggaaattttcaggaaaatgttggtatcaggacaaaagccagatcatgttactatgataggagttttatctgcatgtagtcatgcggggcttgttgaagaaggacgtcgttacttccactcaatgaggaccgagcttggtttagcaccaatgaaggaccattttacatgcatggttgatttactgggtcgggctggttgcctagatgaagcaaatgatttgatacagacaatgccaatgcagccggataatgttgtctggggatctttacttgctgcttgtaaggttcatggaaacattgaattagggaagtatgtggcagaaaagctcatggagattgatcccttgaactctggtccttatgttcttctttcaaatatgtatgctgagcttggtagatggaaagatgtggtgagagtccggaaacagatgaggcaaaggggagtaattaagcaacctggttgcagctggattgaaattcaaagtcgtgtgcatgttttcatggtgaaagataaaaggcaccctcttaagaaggacatccatttagttctgaaatttctcacagaacagatgaagtgggctggctatgtgccagaagctgatgatgatgagatttgtgaagaggaaagtgactctgaacttgtcttgcattttgaaatggaaacggaggctgatactgcagttgcttaa

SEQ ID NO: 97855 - DNA, 201 bp, Glycine max
  Peptide Sequence Number=SeqID_214633
atgtttaaacgattccaaaaggctgcaacaatagcaatggaaaacaaacactcagaaccattggaaggtacggtgactatactggcgaaacacaattccgatacaaaggactctggcagccgaactgctggcaagcatgctatgaaaccccagaaggcagcagcaagactgagaatgatgaaaatgttgacgagtctttga

SEQ ID NO: 97856 - DNA, 1068 bp, Glycine max
  Peptide Sequence Number=SeqID_214634
atgggtggtgctagtgtaaatttctcaatggcactagtagtaatgaccctagttggtctaacacccttatcagttacctcatgcccttcctccgaatgggcagcactaatgtccttcaaagaagccctaaaagagccctaccgtgggtttttccattcatggagaggcaccaattgctgctaccgctggcacggcatcacgtgcgaccccaccacgcgccgcgtagcggatatcaccctccgtggcggtgacatgatgaccggccacatctccccctccatatgcaacctcacgcagctctccagcatcacaatctccgactggaagggcatttcgggaaacatccctccctgcatcacaaaactccctctcctccaaatccttgacctctccggcaacctcatccacggccaaatcccctccgacatagggcgcctcacgcaactcaccatgctcaacctcgcagacaatcacatctcgggaaaaatcccgaactccctcgtgcacctctccaacctcatgcaattggaccttcgcaacaacgccatccaaggcccaattccaatggacttggggcggctcaaaaaactcaaccgggccttattaagtcataatctcataacgggccgaattccacggtcaatttcagaaatctacgggctggcggatctggacctctcgctgaaccggttgtccggttcgattccggcttggttgggccgaatggcggttctggactcgctgaacctgaagtacaacaacttaacggggaatattccgtggacggtgttggggtcgagaatgagccacgtggatctgagtcgaaacgcgttgagtgggcgcataccgaactcgttcggagaggactcgtatttcataagccttgatttgtcgtataacaatttgaggggttcggttcctaagtctatggcgttggtcaattacattggctacttggatttgagtcataataactgtctctgtgggcgcatgccacgtggcgtggccttcaaccaccttcaaccgctaaaaccatgctctcgtgcctctggtcgcatgcatgcgtga

SEQ ID NO: 97857 - DNA, 384 bp, Glycine max
  Peptide Sequence Number=SeqID_214635
atgtttgactttgatgcttccttgtttgtacctgcactgctttggtttaaggaggagaatggaggtttttttgtgtttgtgacccttgtgttgtgcggttgtgctgctggtaaggagtgcacaaacattcctacacgatcacacatgctaagatttgcagccgaggaagttcttgacggaacaacaccaacacgattgggcagttatgatttctcaaagaagtgcctcttcaaggatgtgaggttgcataaggattccatccttggtggagcacagcagacaaatttggagtatctgttgatttggagctttaggaagacggttggtctatccactcctgggactccttatggagggtgggaagttgttggagtacaagtgtga

SEQ ID NO: 97858 - DNA, 611 bp, Glycine max
  Peptide Sequence Number=SeqID_214636
atggctacctcaccaaaagagacttcatctcttggttcaccttctgtaccatcatctccatcatccaccaaagcaccatcaaaccaggaacaacctgaattccatatccaacccatacaaatgattcctggtcaagcccctgttcctgaaaaactgattcccaaacgacaacagggagtgaagacttctgaaaaccctagccttgcagcaagtcctagggaagtagacacggagatggacaagaagatccgcagtattgtgagtagcattttgaaaaatgcttctgtccctgaagctgatgaagatgtcccaacatcttccaccccaaatgtttctgtgctagatgctgataaagatgttccaacatcttccaccccgaatgtttctgtccctgatgctgacaaagatgttccaacatcttccactccaaatgctgaagccctcccttcacccagtgaagaggaatcaacagaagaagaagatcaagccacagaagagacccctgcaccaagggcaccagaacctgctccaggtgacctcattgacctagaagaagtagaatctgatgaggaacccattgccaacaagttggcacctggcattgccgaaag

SEQ ID NO: 97859 - DNA, 1215 bp, Glycine max
  Peptide Sequence Number=SeqID_214637
atggtagatgataaaatgcacgctcgttctattggtccttactcattgattactcagcagccgttaggaggtaaagctcagttcggaggtcagagattcggagagatggaggtttgggctcttgaagcattcggagcatccaatatccttagagagatccttactgtgaagtcggatgacgtgattggtagagcaaaaacttatgaagctattgcaaaaggtgagtctatgcctgaaccagcttctcccgaatccattcttcaggattcaagaggggaggttctaaaaccggaaactattaactacagaacgcataagcctgaaagagatggtttgttctgtgaaaaaatcttcggtcctattaaagattacgaatgtgcttgtggtaaatacaagagaattcgttacaaagggatcgtttgtgaccgttgtggggttgaagttacggagaagaaagtaagaagagagagaattggacacattaatcttgtagttcctatcgctcacatctggtatttccgttctttaccaaacaaaatcggttaccttttaggtattccttccaagaaattggatatgattatctattatgaaagatatgttgtaatccagcagggtattgctaaaaaattggacggttctgactttgataaaatggaattcttaacagaagaggaataccttgatatcatggatacccttcctgttgagaaccaatatcttgatgattccgatcctaacaaattcatcgccaaaatgggtgctgaagctgttgaggaattattaaaaagaatcgatcttgatgcattatctttcgatctgagacacaaagctcacaatgaaggttctaagcaaagaagaactgaggctctgaaaagattaaatgttgtagaagcattgagaggtgctaatacaagaatgatcaacagacctgagtggatgatcatgcgtgtacttccggtaatcccaccagagttaagacctttggttccattggatggtggacgtttcgctacttccgatttgaatgacctttatagaagagttattatcagaaataaccgtttaaagagacttttagagatcaaagctccggaagtaatcttaagaaacgagaagcgtatgcttcaggaatcagtagattcattattcgataatacaagaaaatcttctgcggtaaatctgatcaaacagaccattaaaatcactttctga

SEQ ID NO: 97860 - DNA, 402 bp, Glycine max
  Peptide Sequence Number=SeqID_214638
atggataaccatgagcatgcaaatcatcgtgatacggcacaagccaggataaagaataaaggtatcaggcagcacaaagttaatgatcaggctcaaaatattgatttcaatattcgtgattcatcagaggatgacagttctaaatcaacacaagtttcttcacctgagaaccaaaattatatgtcctcagctaatgagcccgcaattaatagagaaggatattttgatcttggtgatcaactcatgcagtgtagtcactgtaatgcaaatatgtggtatgatgaaagagtctcaaaagataaaagaactacaaatccaagattcagtttatgttgtggaaatggcaaggttgaacttccattgttacagaatccacctaaatttctctaccaacttttgtaa

SEQ ID NO: 97861 - DNA, 289 bp, Glycine max
  Peptide Sequence Number=SeqID_214639
atggcaagagtttggctcacggcgccgctaacggcgctgttactgttcgcattctcctccgccgttagttcgtgtccgccgtcggacctggcggcgctgctggccttcaaatccgctgtccgggagtccaacggcggaatattcaactcgtggaccggcaccgactgctgccgcaactggtacggcgtctcctgcgaccgcaactctcgccgcgtcgccgagatcagcctccgcgccggtcccgtctacagcaccttcgagaagcccttccgtccgggctacatgtccg

SEQ ID NO: 97862 - DNA, 300 bp, Glycine max
  Peptide Sequence Number=SeqID_214640
atgcctacatgcatgaccctccagttagctgaccgctctattacaaggccatatggagtcgttgaagatgttctggtgaaggttaaacaccttatattcctagctgattttgttgtcatagacatagaagaggatgctgacattcctctcattcttggctgcccattcatgtctactgcaagttgcatggaggacaaagatcaacctagccaaaatgtctgttttaaagtgcatgtgatggaggaaaagagacctgagaagaaggtccttgaagtagaaactctcttggatcttggatag

SEQ ID NO: 97863 - DNA, 333 bp, Glycine max
  Peptide Sequence Number=SeqID_214641
atggcaaccacctctgtttttggatgtgccaccgctcaccgttgccgaaggtgtatgcctctggcttccagatccgccgctctcataatcgggatccaaatctatcatccgacggtgagggaggctggtgccgtagaacatgcaggggccaaagacacgattgggaacggtggcaaatgtattaaagaacactatgaaagggaacttggtggagcagagtgcagacgagtcccgccccatccttacatatctgacaacagaataccatatcctttgagtttgtggagcaagcagatcaggattcatgatttgattaaattcacgagtaagtga

SEQ ID NO: 97864 - DNA, 210 bp, Glycine max
  Peptide Sequence Number=SeqID_214642
atggaaattttgatgaggccatatctattcttgaagtttttaaactttatacaagaatcctgctctgataccacttgttggaccttgttgatgcaatcctaccccgtaagggcattggctagaagactccaagtagattgggctagagatccaaggaaaggccctagggttctcatgagccttagggtagatttcgagcccatgggctaa

SEQ ID NO: 97865 - DNA, 537 bp, Glycine max
  Peptide Sequence Number=SeqID_214643
atgtatgcctctatagcaggaggatttaccaataaatctttaggagaaaaattattcttaaaactccccggtaaattaggacaaaaaattagaaacagttgggatgatgaccaaattgacctagtcatgaacaatctaaccgtcataatccaacacataatgaaagtgatggaagatacattgatatgtaaacagatttacactcctcaacaataccataaagaaattaggagaaaaaggcctcagtacaaacctcccaataaacaaccctctaggaaaaagaatccaacttgtaggtattctattagagcctctaattctagaaaacctactcttaacaaagaaagatatgttagaaaactcagagataacaaaacatacacaaagcaactagagtgctatgcttgtcaccaaccaggacattactccaaagattgtccaagcaaaaccaatctacttacacgagaagcaaaattaataaaaagttgtaggatgaatctcattctcatatatgagacaatgtctattgactcataa

SEQ ID NO: 97866 - DNA, 1219 bp, Glycine max
  Peptide Sequence Number=SeqID_214644
atgacttattcagcaccactgatccacactattcaacaagaggttgagccaattttccaagctgaaaatgttgtagccttcgacaagatggaagaactccaagaaagatttgatggtatgcaaagagaagtcgaagccctccgaggaagagatctgttcgggaaggacgcctgtgaattatgcttggtcccaaatgttactatccctcacaagttcaaggtgccagacttcgagaagtataaagggaactcttgtccccgcagccacttggtgatgtacgcgcggaaaatgtccatgtatactgacaatcataagctgcttattcatttctttcaggacagcctgactggggccgctctaaagtggtatatgaatttggacagtgcgagcattcgtactttcaatgacctaggtgaagcgttcatccggcagtataagtacaatctggacatggccccggatcgtgatcaactccgtgcgatgacacaaaaagagaagcaaacgttcaaggagtatgcccagcgttggagggaagtggctgcccagattatcccgccgttggaagaaagggaaatgaccaaaatatttctgaagaccctgagccagttttattacgagaaaatggttgcaagtgcaccaacagacttcaccgaaatggtcaacatgggggtgcgattagaggaaggtgtccgagagggacgtttgactggggaaagtacccctgccgcaagtaatgccaagaagtttggaggccactttgcgaagaagaaagatcaagaggtgggaatggtagctcatggtaagcctcagcagaatttcaccccatatcgtcaggttgcgaatgtcgcatccactatcccaaacccatcatatcaccaacaaaggccacattacccctaccaataccctccacaacaataccctccacaacaataccctccacaacaatatcatccacaacaatatcctccacagcaataccatcagccacaataccctcaaaaacaacaaaatcgcccgcaaaccccccaacaaccatatcactcacaaaaccgccagaaaacaacctttgatccaatcccaatgaaatatgttgacttactccccgccctgctcgccaaaaaccttgtccaggtcagaacaccccctcgcacaccagatgttttacctccctggtttcgtcatgatttaacctgcgctttccaccaaggggccccag

SEQ ID NO: 97867 - DNA, 159 bp, Glycine max
  Peptide Sequence Number=SeqID_214645
atggataagcattgcttcaagattaatacaaggttgcttcaacaaacaaagccttgcttcaagattaactcaagatcaagtcttgccttaaaacaaagtgtttccaagacatccaaggctacgatgtttgtaattgattaccagcaacagaactcttga

SEQ ID NO: 97868 - DNA, 153 bp, Glycine max
  Peptide Sequence Number=SeqID_214646
atgtttgtattgaacaatgctttgaaaggaattgacgatactccacaaagtaaaaccaaggctgtgttgctaggtggattgttgttaaatgtaatagacaaaaaggaagaattgagtgcgggtattacgtcatgcactggatgtcaactataa

SEQ ID NO: 97869 - DNA, 456 bp, Glycine max
  Peptide Sequence Number=SeqID_214647
atgagtaggagggcacgacggtcgctgcaaaacccagggcgcgagcccgggcggaacggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaggggaatccgactgtttaa

SEQ ID NO: 97870 - DNA, 1075 bp, Glycine max
  misc_feature (1073)..(1073): n is a, c, g, or t
  Peptide Sequence Number=SeqID_214648
atgaatgcggatgtggtcggtttgatggagatccagaacaatggcgcaacagcagcgcaaaacctagtcgatggcctgaatgcagcattaggcacccatacctatgcggtgattgctgacccggtgacaggcaccggtacggatgcgatcaaggtggccatgatctacaaaccagccaagctgacaccggccgctgccgctttgtcagataacgacagtatcaataatcgcccaaccttggcgcaaacgtttgtcgctgctaatggcgagaagttctctgtcctggttaaccacttcaagtccaagagctgttctgattcggctggggccaatcaggatcagggcgacgggcaaggttgctataaccctcagcgtattgcccaggctaaccgcttattgcagttcatcaataccgttcaaacgcagtcaggtgacagcgatgtcgtggtgatcggtgacctgaatgcctatggtaaagaggatcctatcctggcattgacagccggtggattgcaagatcaggtggcccgtttcaacggtgataccgattactcgtatgtgttcgatggcgaatccggttacatcgaccatgccctggccagcaacagtatggctgcacaaattacgggtaccctgcactggcatatcaatgcggatgaaccctttgtgattgattacaacaccgagttcaagccgcaagacctttacaccgacagtccttaccgttcttctgaccacgatcctgtcattgttggcgttcaactggtgaaggccatcaccggcagcagccagcgcgacacgctggtgggtaccgcaggagatgatgttatcaccggtggtgtaggtgcagacaccatcactggtggggcaggacgtgacacctttgtctatcaaagtatgcgcgatgcgactgacaccatcactgactttacaccaggtgaagatcaattggacatcgctgaattgctgcaaagcatcggttataccagcagccagccatttgccgatggcgtagcccgctgggtcaatgtggcaggtggcgtgcagttgccaattgacaccgatggcaccgntg

SEQ ID NO: 97871 - DNA, 213 bp, Glycine max
  Peptide Sequence Number=SeqID_214649
atgtttatacggataaccactcgggtatttccgcccgtcagcgtgactcaaatgcttttcgtcttacagacagcaaaaaagaatgtttatacggataaccactcgggtatttccgcccgtcagcgtgactcaaatgtgagtatgacagatcttgtgagcgcggaagatgacgtaaatctccgcgtgtcaacggggcttgtcggccgcgattaa

SEQ ID NO: 97872 - DNA, 345 bp, Glycine max
  Peptide Sequence Number=SeqID_214650
atgggtccagaactgaccggctcgcacgtgattggtctcgagcgtggctcatccaccattttatcacggcgaagtcgagccatgaaccccagatttcaaccaaccacgaggcgggtgctcgcgggaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 97873 - DNA, 396 bp, Glycine max
  Peptide Sequence Number=SeqID_214651
atgaaagaaaaagcagcgttatactccaaactaaaagaacaaaatctagttcctctgtggcttgtcgagcaagatgtattaccgctacggcctaatccggctgcaatcccctggctttggaaatgggatcaactttatgaactggcagcaacttccggaaagctcgtaaatcttgaagaaggaggggaccgacgtgctttaggattaagcaatccagggcttaatggaaaaccttatgccactgaaactttatggatggcattacaatggttaaatggtaaagagatcgctcctccacaccgccatatttcacaggcctcaagattcattatccgaagcgagggttcttatagtacagttgaaggaaatagaatctttttggaaagaggagattat

SEQ ID NO: 97874 - DNA, 703 bp, Glycine max
  misc_feature (49)..(49): n is a, c, g, or t
  misc_feature (73)..(73): n is a, c, g, or t
  Peptide Sequence Number=SeqID_214652
gccctcaccttgggtacagttaccctcaccgttgagaggactacacgtnctcgccttgagaggactacacgtnctcaccaccagagggctgcacgccctcacctccagaggactacacgtcctcgccttgagaggactacacgtcctcaccatcagagggctgcacgccctcacctccagaggactacatgtcctcgccttgagagggctacacgccctcaccttggtgagaggactacacgtcctcgccatcagagggttgcacgccctcaccttcagaggactacacgtcctcgccttgagagggctacacgccctcaccttggggctgcacgccctcaccttgagaggactacacgtcctcaccatcagagggctgcacgccctcacctctagaggactacatgtcctcgccttgagaggactacacgccctcaccatcagagggctgcacgccctcacctccagaggactacatgtcctcgccttgagagggctacacgccctcaccttgggactacacgtcctcaccaccagagggctgcacgccctcacctccagaggactacacgtcctcgccttgagaggactacacgtcctcaccatcagacggctgcacgccctcacctccagaggactacatgtcctcgccttgagagggctacacgccctcaccttgggtactagttaccctcaccgttga

SEQ ID NO: 97875 - DNA, 1243 bp, Glycine max
  Peptide Sequence Number=SeqID_214653
atggcagacgtggatacgatgatggtgcatacccgcatatcggaaaatgacatcttgcaggtgaagacggggcagccgctgtggttttacgtcgccgccgatccccgccgccgctatgagggagcgatgggcgcgatacagcaggcgccggcggaggcgctggaaaccgacccgctgggcaggaattcaagccagcaaacggcggcggtgtattacaacggcgtgtttgccgtcgccaacggcgagcgtcgattgcgcacctcgatgacggcgcaggtattcatcatgaccgaacgcgcacagggggtggtgcgggtaccgatggctgcgctgggcgcggcattggatgaaggaagctatcaggtcaaggtgctggaaggcgggcaaacggtggtgcgccgcgtgcgtatcggtacccgcgatcgccgctatgccgaagtgttggaagggctgaacgcaggagagcaggtgctgctggagcaacagcctgatgtggaggagggcgctgatgcgggggagcagaaaattgcggtcctcaagcgcgtttccctgagcattcaacggggggaaatggttgctatcgtcggcgcctccggttccggaaaatcgacgttgatgaacatcatcggctgtctggacaaaccttctcagggcgacgtgcacatcaacggggtggctattgggcaagccgacgccgatcgcctggcgcagcttcgcagccggcatatcggctttatcttccagcgctatcacctgatgccctatctgaccgccggtgagaatgtggcgatcccggcgttgtataccgccatgccggccgccgaacgccgcctgcgggcagcgcatttgctggcccggctcgggttggcgcagcgcggcggtcatcgtccggcgcagctctccggtgcgctggatagcgccagcggtcaggcgttaatgaccattttgcacgagctgaacgctatcgggcataccgtcgtcatcgtgacacacgatcggcggatcgccgaacaggcgcggcggatcattgagatcggcgacggcgagatcgtggcggatcgtcgccatgaagcctcccgacatctttctacgttcgaacgaccgctggcggcgccgctgaaacgcatggcgccgggcgcggcgttgaaagaggccgtcggcatggcctggcgggccattgctggggcaccgggtccgggcattgctatcgatgctcggcatcattatcggcattgcggcggtg

SEQ ID NO: 97876 - DNA, 900 bp, Glycine max
  Peptide Sequence Number=SeqID_214654
atggctggccgtcgcctcggagttggatcggcgcaataccgcgttgaccttgatcggtgctaccgcgcgcgggcgctggcgatcgcgcgtgaaactttgcggctggtggcggcacgtcacaccgccggcgacgttggccgattcgagctgttgcaggcggagcaaagcttgttggcgcgagagaatcagctgcatgagctggagcgacagcgggaagatgcgcgtaactcgttggcactgttgttcgggcgatcgccgctgctgcgctatagcgaacggcgttcgttgccgcttgacgaggtggctgtcgcgcagcgtcagccggcgtgggtgattgcgcgccggccggatgttcaggcagcagaacgccgtctgagagcggcgctggccggtgccgaggcggcaagattgagtttttatccggcgctgagcctggaggccgggttggatgccggcagcggacttttccgccagtggttcagtgaaccttcgcgctcgctgggcgccacgttgacgctgccgtttatcgaatggcgcaagatgcgcttgtccagcgacaaagcggcgttgcaggcgcagcgggcggagattcaatttcgcgatgcggtctaccgtgcgctggccgatgtggacaacgccatgcgacaacgcctggaagcacagcggcaaatcggcaatcagcggtggcatctggcgatgagtcgacaagccgtggcgttggcgcgacatcaatatcaggctggttccgttgcgctgcaaacgctgctggatgcgcaagaggcggtgttggccagcgagaattcgctgtcggcactgcaattccgctatctgaacgccacgatgcaactctggctggcgctgggcggcaacgaggctttcgcatccgggcaaggagaataa

SEQ ID NO: 97877 - DNA, 880 bp, Glycine max
  Peptide Sequence Number=SeqID_214655
cccacgtgtcatcttcacgcttcaccacgtgcgcccgggcggcgctgtttcggctttcgcgcccaatgtacaattgtccgtcacgccggagttcctcgaagaggccgtacaggcggcgctcgaatcgggtctcgttcccgttcacctgcacgatcttccggcactgcttgccggcagcggagaagaccggtcgttttgtgccttcacgcttgatgatggctatcgcaacaacgcagactacgccgcgccgatctttcgcaaatataacgttccctacacgatcttcatcacgcccggttttgtcgagcgtacacgcggcttgtggtgggagaccgccgccgccttgacgcagaaggcggcgtccttcgatttcgatttcggggcagggccggagcacgtgacatgcggaacgcccctgcaaaaagcggatgcattcgcgcggctggaaaattttgtccaaagtgccgccgaagatgaagcggtggagaggatcgatcgcgccgctcgacagtgtggaatcgatccggttgccatcgtggacgagctcatcatggatgcggcagaactcagggcgctgtcggaggatcctctggtgcatctcggcgcccataccatgacccatgtgaatatgcgcaagatcgacgctgagcgcctggcttacgagattgcggaatcgaagcgccgggcggtgggcgagcgcgaggcgaaggcggtatcggacgcagggttttccgcggcagtcaccacacaggcgggggttctcggcctcggcagtctcgaaaagcccacactcttgccgcgtgtgtcactgaacggccgctttcagaaaaagcgcttcgtcaaagcccttatctccggtctgcctttccgcttcgtttag

SEQ ID NO: 97878 - DNA, 141 bp, Glycine max
  Peptide Sequence Number=SeqID_214656
atgaagtttcactgtcatcaagcaagtcagagacttagcatgaccacagattcacctccacttcctatgttcccatggactcggttttttggggtcgataagagtggggctcttactcctacgtatcctcaattgcgatga

SEQ ID NO: 97879 - DNA, 429 bp, Glycine max
  Peptide Sequence Number=SeqID_214657
atgcctcactcccataggatagaaaaggaaagaaagcctcaagtggctaacattaacctctcatacttccatgggaaggagaatgtagaggcttacttggattgggaaataaaggtagagcaacaaattaaaaggaagtctacttccaaatgttatggccttcactcttttccaaagaaagaccaaggtcaaggcatcttaggggcggcaccttctaagcccaaacatgataaggggaagacaatagaaaagcaactccataaggctaaggaaacattacttctaaatgcccccaccaagaaaaccatgattatgaggagccatgacatttatagtagccaatatgaggctactacttcaccttcctctagtgaaagtgaagcagcaaaaggggaagaatctacccttaagaagaaggacaacctttaa

SEQ ID NO: 97880 - DNA, 1581 bp, Glycine max
  Peptide Sequence Number=SeqID_214658
caattgggcgtagccccacagcgcgccgaaaccggtttccgccagcgtggaagccaccaggccgaagatgccgagcggcgcacagcggatcaccgcgcgcaccaccagcgtgaccgcatgggacatgtcgttgatcagccccttggtggtttcggaagcgtggcgcagcgccagccccagcccgacggcccacgccagaataccgatgtagttggcgttaatcagcgcatggaacgggttggccaccacgctcatcaacaggcccttcatcacctccacaatgccgcccggcggggtaatgtccgtcgcgccggtgctcagcgccagcgtggaagggaagataaagctgacgacgaccgccaccagcgccgcggcgaaggtgcccaacaggccatcaccagcaccagcaccagcaccggcgccaccgccttcagcgcgccgacgaacagggaaccgagcaggccaacggcggaggccgccgccggcgaaaccagcgccaacagaatgccggccaccaggccgaccatgatttgtttgaccaggctaccctgcgcgatcgttgcgacggttgacccaggcgttaatcagcaaggtgagcgtcaggatgcccgccaccacgcccagcgatacgccgatcgggatgtggaagaagtcgataatcagcatcttgatgccgataaacaccaggatcaccgacaggccgtatttcagcatcgagaaacgctccgccacgttggccagcaggaagtacatggcgcgcaggcccatgatggcgaacaggttggaggtcaggacgatgaacgggtcagtggtcacggcgaagatcgccggaatgctgtccaccgcgaagatcacgtcgctcagctctaccaggatcagcaccagcaccagcggggtggcgaacaggatgccgttgcggcgcacgaagaagcgctcgccttccaggttgtcggtcatgcgcaggtggctgcgcagccatttcaccagcggcttgtcgccgatcgccgagtcatcttccttcgccagcgccattttgataccggtgaacagcaggaaggcgccgaacaggtacagcagccactggaactggctgaccagccagctgccggcgaagatcatgatggtacgcaggacgatcgcgcccagcacgccgtagatcagcacccgccgctgcaggttggccggcacggcgaagtagctgaacagcatcagccagacgaacacaaaccgaaattgaacagcagggagaggctgacccacaccagcgaccagctggcggcctgcttcagggtcatggtgtgcacgcctttacggccctgcaacaggaggtcgattgcgagcatcacgactatgacggcggcgaagctgccccataaccacggtgtgccaacggaattcatcatcagaggtatccttcaaaaacaaaaacggccaacgtcggaagacgccagccgctctgtgaacgctgcaagcaacctcgccttccggcaaggtctcacttacaacgttgatgaaggtggttacacctttgacatcaggttgcccggtaaccggatgcttgcgcatcgtaatgacgattga

SEQ ID NO: 97881 - DNA, 150 bp, Glycine max
  Peptide Sequence Number=SeqID_214659
atgttaggccgagttattaagattgtgacaggtgttcattatgtttggtgggttggagctcttgctcatgttggtttggttgccccaattgatgttgtcgttcctcttggcaacacagggcttgatccctctcagacctctttcttctag

SEQ ID NO: 97882 - DNA, 252 bp, Glycine max
  Peptide Sequence Number=SeqID_214660
atggataacagtgtgattggaggaggagtgatcaccactgcgttgctgaaggaggagcagtctccgccacaccactgccaaaggagaggtttggttgtgcgatttggtcacaaagggtgttcctcaccaacgagatttgggcttcgatcaaaattgaatgtagtgaaaccagatctggaggttaggtcaccaacgttaatgtcaccgaagaggatgtccctggcattgaacatctcagtgtggttctattga

SEQ ID NO: 97883 - DNA, 528 bp, Glycine max
  Peptide Sequence Number=SeqID_214661
atgtggaatgctaccttgtttggcctgtttaatgaaaactttcccttgtacataaagcatgaagatttgtctgaaattgcacacggtgttcaatgtctcagcatatctgttatacagttgtggattctgcatatgactgagacaagtatgcgagctgggaatatcgatgtgtatggattcctcgagccacaatctatccagagatctggccaatcacaatttgaatcagaaaattacattaagaactggatgcaaaattcaaaatgggatgtgtacctaggagcctacctgaatggtgcacattggcaaatggttgtcattttgcctaaggaaaatgttgtcatttggttttgttcgttgcataataagccagacaactacctcaaagacataattaataggtcagtgttgtttttcaatacatttgcattagcattggtcagtgctttgaaagggcttgacgatactcaacaaagtaaatccaagcctccagctaggtggattgttgttaaatactgtgtaaactaa

SEQ ID NO: 97884 - DNA, 252 bp, Glycine max
  Peptide Sequence Number=SeqID_214662
actcatcttctacttgaagtggcgtctccattcatctttctccttctccattctgctgcaatcagacctcaagaagcaaaggaatccattgatgaagaagatccaaggcctacaagcttcacatggagctacatcagacactcacttaaagatgcatgcaataacatggctttcgtctctttaattgaacctaaaaacataaatgaagccataattgacgaacattggattatttctatcaagaagaattaa

SEQ ID NO: 97885 - DNA, 537 bp, Glycine max
  Peptide Sequence Number=SeqID_214663
cacgaccggcaacccaccctggtcggccaccgcccgttagtgcgcgatcaggccggcctgggtcgcccgcacgtacggcggggtgaccaccagcgcgtggctggcgccgagcgcggcggcacgacgggtctgttcgatggtcttgccggtgcccgaaaggccggttccggccatgaccgggatgcgaccgccgatgcgctcgaccgcgctggccagcagcagctcgtactcggcatcggtgagggttgccgcttcaccggtcgagccggctacgacaacgccatggacgccaccttccagttgcaggtgcagcaggcgctgccaaccgtcgggatcgagggcgccgtcggcccggaacggggtcgccagcgcggtgatgaggccggaaagggacaaggacgtgctgctcttggctgggaagggaaaacgcccgccatgaaaggccgggggcgacttgaatgttacttgcggcgcgaaagcacgggcaagtatgctggacaccggtggatccccgcctctggcgggcattcagactaa

SEQ ID NO: 97886 - DNA, 1002 bp, Glycine max
  Peptide Sequence Number=SeqID_214664
atgcggctgtcgggggaaatcaggaaggtgctgcgttcgatgccacgtacctgcttgccgtacatgttcttcatcttgatcacgtcgaagtgcgctgcacagcgcttcgtcgccatcgctgaccagcggaaagttgaagccctgcttggcacagaagttgtcgtgcgacttcaccgagtcgcgcgagacaccgagtaccaccgcgcctgccttcctgaacttcggcagcagcgcgttgaagtcgatgccttcggtggtgcagccgggggtgctgtccttgggatagaagtacagcaccagccagtggccggcgtagtcgccgagagtggcctgttcgccaccggacagcgccagcggcagggagagggtggtgctgtccagggtatcgccgttgttcatgaggtccttctgtcgagcctgggttctttctacgacaattgcatgaaacgccacgcgcccgttcaggtggtcgcagaactcgaggaaatcgtcgcgcagcgcggcgatgtgcatgttggccggcacgccgatggtgacctgcgcgctgaacatttccgcaccggtctgcatggcgcggtagcgcgtgctctgcaggttctcgatggtgatgccctggcggtcgaagaaatcggccagctggaacaggatgcccggcttgtcggcggcgatcacctcgacgatgtacggcagcaggttggactgcgcctgcttggcggcggtgcggtaccagaccagcttcaggccttcctcgcgctcgagccgggtcagcatcgcttccagcttggccaccgagtcccacgagccggtggccagagcggtgaccgagacatcgcggacgaccgtggccaggcgtgcgtccaccatattgcagccgctgtcggcgatgcggcgggtgacggacagcaggggggactccggatgcgtcgtataggcgttgatcaggaggtggttttcgctcggcgcggggcgcggggtggtgtcggtcaaggcgattccgggtaa

SEQ ID NO: 97887 - DNA, 207 bp, Glycine max
  Peptide Sequence Number=SeqID_214665
atgaaaaggggtgaacttagtaattggggtgcgcttagaaatcttcctcaagaagcccctgggcggcaagcacctccctttttccttataaataggagaggggggctgtttcaaaatgtccctaaccccgttgaaaatccaagccgaggtgcttccgtaacgcttccgagacgtttccgtgagcaatttcatgaagattttccgtag

SEQ ID NO: 97888 - DNA, 153 bp, Glycine max
  Peptide Sequence Number=SeqID_214666
atgacgttggtgtttatggtaatgttgatagagaatgatgttgttattgatgataatattgatatgagattattgaccaagttggatatccctggtgggggaaataaagtggttaaagagttcaatcatctctggagtgaagggacggcttag

SEQ ID NO: 97889 - DNA, 222 bp, Glycine max
  Peptide Sequence Number=SeqID_214667
atgatggcatccaagaaaaggaagaggactgcttctaggccacaggctcagtatgataccaggagattccaatccttggaagcctggaaccgatatatagataacattctggactggaggatccttctagaaaggaatgctaagatttatcatactgaattcgatgagtttaagacagagttggagaggcgtaacctgcacaagcgcctcgccaacctttag

SEQ ID NO: 97890 - DNA, 168 bp, Glycine max
  Peptide Sequence Number=SeqID_214668
atgtctttctcatcaaacaggacatcatccttcacatccttgaagggatcgaagagacctaagtcaaggttaattagacaagctttgaaaagtgttgtttttcaccttctcgctaagccaatctgctggcttagcgagcgtccgctaagcataacactcatgggctaa

SEQ ID NO: 97891 - DNA, 141 bp, Glycine max
  Peptide Sequence Number=SeqID_214669
atggaagacgcacctgtgaaccctcgcatcgccgtcccgctgaaggggcattctcatatagaacctgttgaagacccaatcttggctgaagagcaaagaagagtaatcctggaggattattcaagttctactgtgccataa

SEQ ID NO: 97892 - DNA, 990 bp, Glycine max
  Peptide Sequence Number=SeqID_214670
atggttatgctactagaagaaggagaattagctcttggtagaaacttggtggttgcgttcatgccttggaaaggatataacttcgaggatgcgatcgtaatcaatgaaaaagttgttcgtgaagactggtttacatcaatccacgtagacgaatactctcttgaagttcgtgataccaaattaggtatggaagaattaacagcagatattccaaacgtttcagaagaagcgactaaggatcttgatgaaaacggtatgatcagaattggtgctgaagtgaagcctggtgatattatgattggtaaaatcacacctaaaggtgaatctgacccaactcctgaagaaaaacttcttagagcgatttttggtgacaaagccggtgatgtaaaagatgcttcattaaaagcagattcttcattaagaggtgttgtgatcaacaaaaaattgttctcaagaaatattaaagataaaaagaagagaactgaagaaaaacttaaacttgaagaaattgaaaacacttacaaggctaagtttgatgaattgagaaatactttaattgaaaaattaaatactcttgtaagcggtaaaacttctcaaggggttcataatgaccttgacgaagagattatcggaaaaggagtgaagtttactcataaattattgacttcagttgaagactatgtaaacgttagcggagcagattggactgttgataacgataaaaatgaattgatcaagcaattgattcataattataaaatcaagttcaatgatatccaaggggttaaaaaccgtgagaaatttgcaatttctatcggagatgagcttcctgcaggagataaaatggcaggacgtcacggtaataaagggattgtatccagaattgttcgtgaagaagatatgccattccttgaagacggaacaccggtagatatcgtattgaatccacttgggggtaccttcccgtatgaacatcggacagatttatga

SEQ ID NO: 97893 - DNA, 509 bp, Glycine max
  Peptide Sequence Number=SeqID_214671
atgatcagtcaatggaacaatagagctgagtttagggttgaggtttatcctcggcaggagggcctattgagttttaactccgattacatgggtgaagttccggagacattacagtatatggtgtcaccacaagggaggaacacatggacagttgatgatctcgtgccttatgtggagaagataacgattttatctgaaaagcaagagaggatcactgagcatacgaaaggaggtcatgacactgatatgtctacaagcgaacattcgtttggtggtgttgtggaaacacatcctcatttttcatggccgactatgaccccttcgcagcaacatgatgccccaatggcaacacctagcgccccattagctccgcaatggaatgtacccggagcaatacctgatatgggtgacttattaggtgttgatttgcgtcacgagttttgtgctgaggctgagcaagaagggcagagacagcgcgcaagaagaaatcctgatcgtcaagcccgaag

SEQ ID NO: 97894 - DNA, 422 bp, Glycine max
  Peptide Sequence Number=SeqID_214672
gatcccacacaggggatggtggggtttatgcgcgcattgtggatgtggaaaacttgttgtgcaccatcgcccgaccgccacctagtaccacatgtgatggagtggtacctggagatatgtcgcgggggtctggagaccttggggacgtcaggcgagctcctggcagtcaacagataaaaggaacaaagaccacaaagcaaggaggcttgtggcttaaaaatgaagacaggaggctaagatggtctctggtaatcgattaccacggggtgcttaaaaaagggaactgggagatggtggaagcctctggtaatcgattaccagcctgtgtaatcgattacacagaggaatgggtcactggtaatcgattaccaggcatgtgtaaatcgattacacagtgcatttttgcctatttcatgttctga

SEQ ID NO: 97895 - DNA, 186 bp, Glycine max
  Peptide Sequence Number=SeqID_214673
atgttgagtcagagtatagccacaacctgggcagccactggcaaactatgtaccaggtggagaaactcttgccaggatcattttcgaataacatcagaagctatccagagcttgctggaccttagagctaggctagaggatacaagtcattatcagctcataaagcaagctttgcaactgttgtag

SEQ ID NO: 97896 - DNA, 585 bp, Glycine max
  Peptide Sequence Number=SeqID_214674
atggataaggctctactcaagtcaggaatgacaagtgaggcctgtgagtcccctgaactaaccgaaaatgcccttagttggaagaccaattgctacaagggcaagaagttgctgattgaagatgatgaagatgctcccccaaccaaatatgttaaagctcgtctttgtcctttttttaaacatgagcatgaagctctaaagcaaaagactgagctcactaatctggattggtacgtcatgaagaggttttacacactgaaggaacattactctagtctagaacgtattgagaagccacatgcggatgcaattcaccatgaaaatggggagttctatgatgtgtctgatcgtacctttttgtttatggtgttcctgcctttctccaaattcttcttcatgcagcacgtggatcctatcattaaaaaagttgaatctgatgttgaagttgcaactgcttctaattccatggtctttcaagatcgtgctcatgctaaaaagcagggtcacaaatggttcatgacttgggactatttctataagaagattattggttggaaaccgcctcatcctcctatggccccccaa

SEQ ID NO: 97897 - DNA, 231 bp, Glycine max
  Peptide Sequence Number=SeqID_214675
atggagatagagggaagtgatatgtgggtccatttgttgggttcaagtgatagtgagggtggcataatgatgttagcggtggttcaaggtttaaattcatccagttgcgaggagagagaagaaaggaaaggagtagagaagggaaagaaaaaaaaactcattactagaattcaccttcgacgacggtgtacagtggtctgccacagttatttgacgagatatattgcttga

SEQ ID NO: 97898 - DNA, 219 bp, Glycine max
  Peptide Sequence Number=SeqID_214676
atgcacgaaacacaatgtggaccactacgggtacatagaatgaatcgaaaagcttggttcgagcaaaataggggaggtggttgccgcccagctcgcccaggcgagctcagctcgcccaggcgagccaggttgcttcctccagaagcaaccgccttctggaggaatattctggagggcccaagtgggcctgggtgctatatgcacccccatttttactaa

SEQ ID NO: 97899 - DNA, 1239 bp, Glycine max
  Peptide Sequence Number=SeqID_214677
atggagagtgcaagaatcagccaatggttaaatcttcttgtttgtgtactgctattgctcaaggcagaaggatctttagttccattgattttggtcgagaatgcagaatcaaaaggagctgtttgtttggatggaagtcccccagcttaccactttgataagggatttggggaaggtattaatagctggattgttcacattgagggaggaggatggtgcaacaatatcgagagttgccttgaccgtaaggacactcgcttaggttcatctaagcaaatggaggatatttacttttctggaattttaagcaatgagcaacagtttaatccagatttctacaattggaatagagtcaaggttaggtactgtgatggttcatcgtttactggtgatgtggaagaagttgatccagctattctctctggctgttcagctggaggattgacaactatattacactgtgatagctttaaaacttttttgccctctagagctaatgtgaaatgtgttccagatgctggttattttgtcaatgtagaggatatctcgggagcacatttcattcaacagtactacagtgaagttgtttcaacacatggttctgcaaagaatttgcccacatcctgcacttcaaaactcagcccaacactactttgcaacttctttggtgttactgatgcttctgaattgttgtgtagtgcttttttccacaatatgtggcatcacatatcagtaccccaatcttcgttgttaattcagcctatgactcgtggcagaaactatgagaaggtatgggagaggttcattgtacgtagccttacctgtgcatatgcaatgaggctgtttccagattcgaaaattcgatacatctttgtacctggctctgctgatcccagtgatagttggaatagctgcaaggttaatatgagcaactgctcgcctgatcaactaagtaaattgcaaggcttcaagagtgaattcgaaagggcattgagtgaggtaggagattctccatctaaaggaatgtttattgactcttgctatgcccactgccaaacagaaccacaggagacatggtttaagactgactctccaaagcttgccaatacaactattgccaaggcagtggcagactggttttatggtcgaagttctttccgccatgtggattgcaattatccttgcaacccttcttgccagaaccgtgtttttgatctaaaagacctccctggaatatag

SEQ ID NO: 97900 - DNA, 429 bp, Glycine max
  Peptide Sequence Number=SeqID_214678
atggaactccaatgtcttaatcaaaatgaagaaaccgacaaaaagaaaagaagtatagcacttaaagcctcttcatcaatacaagaagaaaatgaagaagacttctcactctttgtgaagaagtttcaaaaatttgtcaagaagagaagaatcgagaagcgtcagaatttcaacaatggaagaagatctcaagaagactctcaaattcttagatgctacaaatgcaaccaacttggtcacattaaagcaaattgtccctcaaatgaggaatggcctgagaaaagtgataagaaaaggtatgaagaaagaaggaccaagaaggcctacattgcatgggatgacaatgactcatccaatggttcagagaaggagatcaaccttctaaccaagaattatgagagcaatgagaacatttctcaagaagattaa

SEQ ID NO: 97901 - DNA, 219 bp, Glycine max
  Peptide Sequence Number=SeqID_214679
atggaaatgacaaatgttgatgaagatttcattatggtggttagttttgataatagaagtgaaagtgatcttgatgtagactgtgtcgatactaaattaccattagagccctatgaaggaatgaatttctcatcaattgaagatgcaatgaaatactgcacaagagttcacagtttcttcgagtacataggaaggaaactaaagtgcaaaaacaattga

SEQ ID NO: 97902 - DNA, 246 bp, Glycine max
  Peptide Sequence Number=SeqID_214680
atgtctgcggtacctacggactcgcctgcggactctcctgcggtacctgcggctgagcctcttatagctggtgatgaggcgatgattgatgctaacgcacaggacaccagtgcagaggctgacgcacacgataccggtgcaaacagtgctgtagatgaggctgaggggtttcttggtggacccaggaacccatcagtgcttacgggctatgctgatcatgttgcaacgagcgtatggtcaggagag

SEQ ID NO: 97903 - DNA, 846 bp, Glycine max
  Peptide Sequence Number=SeqID_214681
atgagagcggggaaagggagtcaggaagaggatgagtacgaggaagaagagtttggttcttccaagaaacagggcacttcctctgcccctaacaccaataaagatggaaaagccatcgataaggctagtgcgataagatcgaaacattctgtgactgagcagcggagaaggagcaagataaatgagagagagcttgaaattttagtgcattcagttggagttttgatgattggtaaccctttctccagattccagatattgagggatctcatacctcatagtgatcaaaagagggacacggcatcatttttattagaggtgatagagtatgttcagtacttacaggagaaggtacaaaagtatgaaggttcatatcaaggttggggtcaagaaccctcgaagttgatgccatggagaaatagtcattggcgtgtccagagctttgccggtcaacccacggctgtaaagaatggtttgggtccagtatcaccttttcctggaaagtttgatgaaagcaatgttagtatctctccaactatgcttaatggctcccagaatacaatagatcctgatcagagcagggatattgtcaacaaaacggctgagaggcaacctgatttagtaagcaagggaatacctcttccccttgctatgcatgcaaacatgtctgttcctgtcagaagtgatggcgtacttgcacatcctcttcagggaactgtttctaatgcacaatcaactgaatgcccaacaactagtgaaccacagaatcaacaggatgaactctcggttgaaggagggacaattagcatctcaagtgcatactcccaagggtgggtaattgcttaa

SEQ ID NO: 97904 - DNA, 162 bp, Glycine max
  Peptide Sequence Number=SeqID_214682
atgctggtgaacctagcaacacccaaattttgggaagctttcttgatatttggaaacttggcattgacagagttaaacatcacagggaatgcagtagctgatgagaacttcaggtgctacagggctagtatagattacgcttacgctaatagaagtgggtaa

SEQ ID NO: 97905 - DNA, 1152 bp, Glycine max
  Peptide Sequence Number=SeqID_214683
atgcgagctggaatatgtgacatggttaccattgcaagatatttaaatgttacactaatagttcctgagctggataatacctccttttggaatgatcacagccaattcaaagatatattcgatgtggattatttcatcaattcaatgagagatgaggttcggatcctgaaagagtttcctccccaacaaaagaaggtggaaacagagtccatctattccatgccacccattagttggtcaaatatgacatattactatgatgtgattcttccccggataaaatcatatgggatagtacacttcactaaatcggatgcaagacttgcaaataatggaattcctgaggaagttcagagacttagatgccgagtgaactaccatgctttgagatttgttcctccaattgaacaattggccaagaagattgttaagattcttaaggagagagggcctttcttgtcacttcatctgagatatgaaatggacatgatagctttcactggttgcaatgaaggatgcaacaaggaagagattgatcagttaacaaaaatgagatatgcttatccatggtggaaagagaaagagatagattctgagaagaaaagaaaagatggtagttgccctctgactcctgaggaaactgctctaacactacgtgcattggacattgatcgtaatattcaagtttatattgctgctggggacatatacaaaccagagaaaagaatggcaagtctcagagaagccttcccaaatctggttaagaaggagacattattggaaccctcagagcttgatcctttccggaatcattcaaaccaaatggcagcattggattattacgtgtcaatagaaagtgatatctttgttccctcatacaaagggaacatggcaaaactggttgagggccacagaaggtacttgggattcaagaagacaattcttttaaacagaaaaattctggtgaaactcatagaccagtacaaaaatgggaccataaattggaaccagttctccacttcagtgaaggtagctcattcagaccgtgtagggaacccaagtacaagatcagtggtgcctggaaaacccaaggaagaggattatttctactcaaacccacaagagtgcttgtcaccagttgatggaccttaa

SEQ ID NO: 97906 - DNA, 1467 bp, Glycine max
  Peptide Sequence Number=SeqID_214684
atgagtccaattcctgaatgggaaacatcactacacgaccacccagttgcaactgatgccgaagaagtgaaaacattttacttcaaacaggttctggatcacttcaactacaggccagaaagctacacaacgtttcaacaaagatatctcgtcaatttcaagtactggggtggtgccaattctagtgcccccatatttgcatactttggtgctgaatcaccaattgataactcacctaacggcattggatttttaactgataacgctgcttctttcaatgcccttttggtatacatagagcaccggtattatgggaaatcagtgccatttggatccagggaagaagcattgaagaatgcaagcactattgggtatttcaactcagctcaagccttggcagattatgcagcaatactcgaacatataaagaagacattacatgcccaaaattccccggtgattgtaattggaggatcatatggtggaatgcttgcttcatggtttaggctcaaatatccccacctgaccgttggtgccttggcctcagcagctccaatcctatactttgataaaattacaccacaaaatggttactactctgttgtcacaagggattatcgagatgccagtgagacatgctatgaaactatacttaagtcttggtctgaaatccacagagtagcttcacaaccaaatggtctagtcactctcagccacagattcaacacttgccacacagtaaaccaatcttatgaattaatcgactacctaaggtcgacgtatgtttatgcggctcaatataatcaaccaccaagatacccagttagtgagatttgtggtggcattgatggagcatctcttggaagtgatatcctaagtaagatatatgctggtgttgtggctctatggggaaacaacacatgcaaagttaatggcccaactaatgtatctgagacaagtgtgggatggagatggcaggcacgtaattgcatttacaaaacatgcagtgaaatggctatacccatcagcataggaaacaatacaatgtttgaacaacctatcccttttaacctaacaaggtatgccgaagggtgcaagaaacaatatggtgtctcacctcgccctcattgggtcactacttactatggaggccataatattaaattagtccttcgaagatttggaagcaacattattttctccaatgggctaagggacccatatagtattggcggggttctggattacacatcagacagcattgttgccgttaatacagttaatggtatgcctcctaggaagatctcattgcctggatcttctgcgggcaagatggttggtggaacaacaaagaaagagattaggataatcaaaagttggatcactcagtactatgctgctgatcttgatgcactcaaagacaagccaaaaattccagagcaaatgataggggaaaaagcaagttga

SEQ ID NO: 97907 - DNA, 915 bp, Glycine max
  Peptide Sequence Number=SeqID_214685
atggaggacctgtggaagcgcgcgaagaccttcgccgaagaggccgcgaagaaatcccaatccctcaccccttcctcctcccggatcgccgatctcgtctccgaaaccgccaagaaatcgaaggagctcgccgccgaagcctccaagaaggccgacatcctcaaatccgccgcgctccgccaggccgaccagatcaagtccttctccgacaccatcgccattcctccccaattcgccgccattgcctccgccgccaccaccgctgccactgccgccaccgccaccgccccgccctctgcgacgccgcaggagctcgagaagttcggcgtcaccgacgacctcagatctttcgtcaagggcctcacttccaccaccttccagaactttcctctcagttccgtgagttcggttggaaatgtagatgaatcggaggtttctgatgtgactactgtgggatccaatgttcggaaggatctaaacgagtttcaggaaaagcatgccactctcgttttaactactgttaaggaaatttcaagattgagatatgaactatgtccacgtgctatgaaagaaagacacttttggaagatatatttcacacttgtcaacactcatgttgctccatatgtcttgactaagcatgatgtggccccttatcaagctccattgctgcttctgagttcagagcttcaaggactgtgtaccatggcactcggatataactcagtcaaacctgatgtgcccccctatcaggctccattgcctctcttgagtgaacagcttggggctttgcatcatctggatatagaatccaagatatactcaacctcaacccatcccgttgcacattcacttctctacccctccagcctgataaatgtttctgccctattaacaaagcaaattgacctctaa

SEQ ID NO: 97908 - DNA, 1068 bp, Glycine max
  Peptide Sequence Number=SeqID_214686
atgtcggagtgcgctgtcatctcagcttcacgagcacacgagacctacgttttggtcttaaaagtgaaggctccactgccaccacctccttcgcggagtagtgcggcaccgtcccagcgcgcgccaatagatctggtgacggtgctagacgtaggtggaaacatgatcggcaggaagtttcacatgctgaagcgcgtgatgcgtttggttatctcatcgcttggcatcgcggacaggctctccatccgcgtggctcatcgcattgttgaccggctagtgataggtcaaggctctagcgaaggggatgcattgaggaaagccaccagagtgtttgaagatcgaaaagaaagaaacccggtggccagcgtcatgctcttatcaaatggtcaagaagaaaagcatccgcaactcttccaatttgccatgctcacagagactccttggaattcgaccgaagaaccagttgttgaaaacgttgggcaagtttgcaacactcgacagcaactcgctagtgaagtgatcctcatagaggttaagactctcgagaggcaaacgacacaactaatcaagaatggtcccactcaaatggttcatggaaacatcaataagcctcagcgaagtgaggttggacatttccttggtgaggcgagtgagcgaactcgggatgggaccgtagaggttgttgatggagaagtccaagacgaggttcctgagggagtccaggatggggcccacaaggttgctgagggagtgagggatgagggaagggagaaaagggttgaaggagaggttaagcgttttgagagtagtgatgttgaagagggaaggaagaacgacgtcgtcgaggaggttgaagacgagggagagttttctaaggttagggaaggtggagaaaaagggaggaatggggccaaagaagttgttgctggtggagaaaaagggtgtaaagagagatttagagagagagagggtttggttgatggagttgttgaagaggatgatggaagtcaggctggggaggtggtagaaaagggagggggagaatgggcccaccacgttgaagtttga

SEQ ID NO: 97909 - DNA, 2226 bp, Glycine max
  Peptide Sequence Number=SeqID_214687
atggcattattccgcgcacttgctcactccaaaaacaccacactcaccctcaccaggtcatgccgcaccatcatcacattcacaccctcttcctccttctcttccgcgtgccggcggcggaatccctctccggcaccgccgcaagctccgccgtcaccgaagaaggtgccgttcacggtgtcggttcacgggaagaagtggcaggacccctatcactggatgtccaacaccgacgacccgaatctgttggaccatctcaaccgcgaaaacagctacgccgatgcttttatggctgacaccgtcgaactccgttccgttctgtcgtctgagatgaaagcgcgattgccacccactgtgttaactccccctgagcgttggggaccctggctgtattaccagtatattccagagggaaaggaatatcctgtactgtgtaggaggctggaaacaaagagaaccggttggatgaagaatgtttttcttcactatggaatgacaagatcaaaaagggaggagattttacttgactggaatgaactcgcagagaaatatgggtatgtcaatgttggaacatgcagagtatcacctgaccacaactaccttgcatacacacttgatatttccggtggtgaacgattcactctccagataaaagaccttagaagtggattaatagacccaaaattggaagtttatggtgctgttagcttggcatgggctcaagacgcaagttatctgttttatactctatcagatgaaaatcagcgaccttacaggcaaaatctcacgattggattttctttttgtcacttttcgggaagacttggatatgatcatgaggatgatctcgcagtatttactgaaaacaattccagtttttgtgtggacataacaagcacaaaagacggcaaattcataaccgtttatgttatagattcggtcaatccatcaaatggtttacagaaaatatgtaatcgtacttctggtgtacagtactttgtggaacatcactctggtttattttatattcttaccaatgctcctattcctgatgctgaatggtctggtcaaggttattacctggttagatcccgaattgaggatgtagagtcagctaaatttcagagtatcatccttcctgataaagatacaagcctatgtgatatggacatttttaatggatatctggttcttttcttcactaagaaaggtcttcctctgctatgctcattgaacttacctatgcaaattgatttcaagatgccggatgtaattgttgactatgacatgtcaagacatacatattcaattgtgcatcaagaggaagtgaactgtgattctgttggtcagtcatgcatcccaacttttgtgctaaataaaaacaagagtaaaattcaagaggcacacggtgataacaaagagtgtgccactaactttaattcacaaagatggaaagacttttctcatgtatactgttgtcagagggaggaagttatttccgatgacggtgtaagggttccactaaccattgtgtactctagagaatcctggaagaagggtcaatccccaggactcttggtaagctacggggcatatggagaagatctggataagagctggtgttcagatcaccttagtttactggaccgtggttgggtagtggcattcgctgatgttagaggtggtggtggtggaggtccttcatggcataaatctgggagtggattaaacaaactcaattcaatatttgattttgtatcctgtggcaactacctggttaatgagggttatgttcagagtgatctgcttagtgctattggatggagtgcaggctgccttcttgttggtgcagctatgaatatgcatccgcagctctttcgtgctgtcatattaaaaagattgaagctcttaagagtgaagtctgaaagtgcaagtactgccggcaagagttacccagtaattagcagtgaccacttgaagtcatggactggtgcagaagccagaaacccggcttctggtgtcacaaagttctatgaacatgagtttggtaacaatgaaaagtctattatgtccgtacctaaaatgttgacatgtgacacttttcctggccacgtgtattgctctccagttgtcttcggtcatgttggtgtggacgtaatggcggttgcactctgcagcacgcttgctttctctggtctccatcgagatgtcccgtcgagaaacccc

SEQ ID NO: 97910 - DNA, 699 bp, Glycine max
  Peptide Sequence Number=SeqID_214688
atcatggttagaacacgaggtttaggtcgtgacttaggaactggtagaggcagagacttgagtcaggatgcgcatgagcctgaagttcgtcggcgtcattggcctactgcttcagtacattggcaacaggttcatgtgactgaggacgttactcagaaacctaaggatgtgcctcagttgaatgaggatgttcctcatgtgtctgacgctactccggagatgacaagcgccgttgatgttgcggacgcagagggagtggctagtgatggtagcttgggttcacctgctgttgatgagggattccctggtgggccacgcgacccatcagttttgactggttttgctgagcatgtcgcacacagcatctggagtggagaggaacgacccaatctgaagttggtctcccatggtagaaaagtagataaatttgggagactagcgcctgagatagaagacatgattgcagccaccagattgagtccactgatcaggtgttctataatcaccactgatcctggacttatatccgccttcgtcatgaggtggcatagggagaccagtaccttccacctgccaccgctggttacttttgatgcggtggggcttttgacggagctgcttgaggtcacccctgaggaggctatagctgagacccgtcaggctggtgggcctcatgttcggttgtcctggcttcaggac

SEQ ID NO: 97911 - DNA, 639 bp, Glycine max
  Peptide Sequence Number=SeqID_214689
atgtcgatgctgctcaggaaggtgtgggaaagggtgttatggagatctgattcttcaacgtcagcatcagcatcagcatcatcttcatcatcatcatcaccaccagaagtggcatgttctgacatgggcgagttggagctgctacccagtgacatcttgatgcacattctgagacttttgggtccaaaagaggctgcaaagttgagtgtggtttgcaaggctttgagatcccttgtgtctgataacagactttggattcactttcttcagacccatcaggctgagccctctggggattctgtcttctttgctgagaccaccttgagctatggctaccctcttcctgaatttggtggattgcggttgaaaatttgtgttttgatgggtggtgctagtttttgctgtgatggggcatgctcatggattgattgttgcttgccctttgctggccattggccccaactatcattcaagcatatttatggccagagagcactggttcctggttctattatcatcgatggtggttctggctattgcaaatttggttggagcaaatacgcatatccatcagggcgttcagcaacatttttggtaatgattttgattgggactagcactagggctgtgtttaattag

SEQ ID NO: 97912 - DNA, 1125 bp, Glycine max
  Peptide Sequence Number=SeqID_214690
atggcattgaaatatcataattttttttcccttttgcttttgcttgtgaatctgagctttcatggaaatattgctgctcagaatgctaagttagcagcttctttcatctttggggactcattggttgatgcaggaaacaacaactatctttcaactttttccaaggcagacgttccccccaatggaattgatttcaaggcctctggaggaaatcccacaggacgtttcaccaatggaagaaccattagtgatattgttggagaggaattaggacaaccaagttatgctgtcccatatttggcaccaaacacaactgggaaaaccatactcaatggagtgaattatgcttcaggaggaggagggattctcaatgcaacaggaagcttatttgtgaataggctcggaatggatattcaaataaattacttcaacataacaagaaaacagattgacaagttgctaggcaaatcggaggcgagagattacataatgaagaaatccttgttctccatcattgttgggtccaatgatttcttaaacaattatcttcttccttttgtttcctctggagtgagagtttctcaaaatccggatgctttcgtcgatgacatgatcaatcatttcaggatccaactatacagactttaccaactggaagctcggaagtttgtgatcagcaacgttggcccattaggctgcataccttaccagaggattataaatgagctgaacgatgaagattgtgtggatttggctaacgagcttgcaacccaatacaattcccgattgaaagatttggttgctgagctaaatgaaaacctccctggagccacctttgtcctcgcaaatgtgtatgatttagtgtcggagctgatcgtaaattatcataaatatggattcacaacagcaagcagaggttgctgtggaattggaagtggaggtcaggttgcagggataatcccatgtgtgccaacatctagcttgtgctcagataggcacaagcacgtgttctgggatcaataccacccaagtgaggcagccaacataatacttgccaagcagcttattaatggagacaagagatacatatctccaatgaatcttagacaactcattgatctttga

SEQ ID NO: 97913 - DNA, 2502 bp, Glycine max
  Peptide Sequence Number=SeqID_214691
ttcattttcacattcagcaagaagcaaagtaacatagcactccattcattattcattatcgctgtttctgtttgtgcgttgggtaagatttacgtatgcaacaattacatgaacaaagcatgtttttgtgtagcagagggtcatgctctatctctgctccaaaaatgcagcaccgtgacctcactgcgagaggcgcgtcaactccacgccctcatattaaccactaccaccgccttcacctcccaatctccgtttgtgtacaacaacatcctctctatgtatgcacggtgtggttcactcacggactctcacctcgtgttcgacaaaatgcctcgcagaaccattgtttcttacaatgcactccttgcagcctattctcgagcatcaccaaaccatgccatttctgctcttgaattgtatacccaaatggttactaatggtcttagaccctccagcacgactttcactagcttgttgcaagcatcttccttgctagagcattggtggtttggatcgtcacttcacgccaagggcttcaagttgggtttgaatgatatttgtctccaaacttctttgcttaatatgtactcgaattgcggggatttgagttctgctgaattggttttttgggatatggttgatagagatcatgttgcttggaattctctcattatgggatatctaaagaataataagatcgaggagggtatttggctatttatcaaaatgatgagtgttggttttgccccaacccagttcacctattgtatggttttgaattcctgtagccgtctgaaggattatcgttctgggagattgattcatgcccatgtgattgttaggaacgtgtcacttgatttacatctgcaaaatgctctggttgacatgtactgcaacgctggtaatatgcaaacagcatacaggatttttagtagaatggaaaacccggatttagtttcttggaattcaatgattgctgggtattctgagaacgaggatggagagaaggccatgaatttgtttgtccaattgcaggaaatgtgctttcctaaaccagatgactatacttatgctggcattatatctgcaactggtgtattcccatcttccagttatggaaaatctcttcatgctgaagttattaaaactggatttgagagaagtgtgtttgtaggaagcactttagtgtctatgtatttcaaaaatcatgaaagtgatgctgcttggagagtattttgttcaatatcggtgaaggatgttgttctctggactgaaatgatcactggctactctaaaatgactgatggaatttgtgcaattagatgcttttttcaaatggttcatgaaggccatgaggtcgatgactatgttctcagtggagttgtgaatgcatgtgctaaccttgcagttttaagacaaggtgaaataattcattgctatgctgttaaattgggttatgatgttgaaatgtctgtttctgggagtctaattgatatgtatgcaaaaaatggtagccttgaagctgcgtatttggtgttttcgcaagtttcagaaccagatttgaagtgttggaactcaatgcttggaggatatagtcaccatggaatggtagaggaggcattgcaagtttttgaggagattctcaaacaaggtcttattccagatcaagtgacattcttgtctctattgtcagcttgcagccacagtaggttggttgagcaaggaaagttcctctggaattatatgaacagcattggtttaattcctgggcttaagcactactcttgcatggtaactttgttcagtcgggcagcattactggaagaggcagaagaaattatcaataaatcaccttatattgaagataatctagaactatggagaactttgttaagtgcctgtgttataaataaaaattttaaagtgggaattcatgcagcagaggaagttttgagattgaaagcagaagatggtccaacgcttgttttgctttctaatctttatgctgctgcaaggaaatgggataaagttgcagaaataagaagaaatatgaggggattgatgctggacaaatatccagggttaagttggattgaggccaagaatgacattcatgtgttttcttccggagatcaatcacatcccaaggctgatgaaggagttgatacaggaccaggtacaggtgttgtagagccaaaaagtgaggtttgcggtcctggagcaggagttggtgttgcaaacagagatgacaacatagaagatgatggagcagaagatggtgtgctaaaaagagataatccacttcctgatgacaaagatgaagttgatgcagctgtaaatgcaatgttggatgaactctttttgaggcagcttcttgtcttgcagtttctcgccgatctgcctccaaaaatggatcattcacctccccccggtgacgctgatcagctaggtatgctgatttcattgattcaatgtactgatgaatgctctccacctgaatag

SEQ ID NO: 97914 - DNA, 930 bp, Glycine max
  Peptide Sequence Number=SeqID_214692
atgtcattttcgttgttcgccactccgcagcaacagcaaccgcagcagcagtctccttttcagccacagcaaactagtttgttccttccgcagcagcagcaacaatttcaacaacagcaacaacaacaacaacagcaacaacaacaacaacagcaacaatttcaacaacagcaacagcagcagcagccgcaacagcagttgtttttgtttactaacgatagaacccccgctagttatagtaccaattgggcggatcttcatcctgattcccagaagattctccttcagatcgagtatgctctaattatcccgagagagtgtagtgttcttctgtgggagcggatattggagtttagggatgaaagccagagactagatcagtgtagtcgtctttatgattcttcagtttccaacgatggatttgagcttgatgcaggtcatatagttcaggaacttggtggaattaacactgctatggaacgacagaaaacattgctacatgaactgatgtccactgttaaggatatgttacgcaacacagaggttgctgttcgttcctttatgatgctacgccctaggttccttcatccgagtgggggtacatcaagtgccactgccccatcacagactcctggtgcaactatagcacctagttcgagtagccaaccaacaactgcttctatagtgcctgtttttgatttctacagtggtcttccaaggaaaccgtctccgtttttacagcagacagttttaagatttgagaagtatcttggtgagtgccatcagtggattgaagagttggagcagctgcttctcttggagtctgagagaaatgcatccagtaatggttcctcattattgcaatctcttcccaaggtcatgacaaatgtgcatgacttttttgttcatgtggctgcgaaggtagaatga

SEQ ID NO: 97915 - DNA, 1146 bp, Glycine max
  Peptide Sequence Number=SeqID_214693
atggctgacaaacatggtccaattttcacaataaaacttggttcatacaaagttctggtgttgagtagcttggagatggccaaagagtgtttcactgtccatgacaaagctttctccaccaggccttgtgttacagcctcaaagctaatgacctacaattctgcaatgtttggctttgctcctcatgggccgtattggcgtgagatgaggaaatttgccactattgagcttctctctaaccaaaggcttgaacttctcaaggacacaagaacatctgagttagagactgcaacaaggaaggtttacaagttatggtcaagagaaggttgtccaaaaggaggggttttggtgacgccagaaggtataagaaaactgagggaatttatgagattgtttggggtggtggctggggaacacaaaagaaaaagagctatgagtacaaatggaaaggaagaacaggatgtcatggatgttatgctgaatgttctgcaggatcttaaggtttctgattatgattcagacaccatcatcaaggctacttgcctgaatcggattttggcagcaggagacagcatcatggtggctctaacatgggcggtatctctgctactaaacaatgaaatggaactaaaaaaagctcaagatgaattggatactcatgttgggaaggataggaaggtggaaaaatctgacataaagaaattagtgtacctccaagccattgtgagggaaactatgcggctatatccaccaagtcctattatcacccttcgtgcagccatggaagagtgcacattttcatgcggctatcacattcctgccggcacgcatttaatcgtgaatacttggaagatccaaagagatggttgtgtttggcctgatcctcatgatttcaagcctgaaaggttcttagcaagccacaaagatgttgatgcgaagggtcagaactatgagctcatcccttttggttcctcactggctctgcgtgttgtgcacttggctagactcttacatcttacactctttcaatgttgcttctccttcaaatcaagctgtggacatgacagagtgcattggactcacaaatttaaaagctactccacttcaagttctcctaactccacgtttagatacaaagctttatga

SEQ ID NO: 97916 - DNA, 141 bp, Glycine max
  Peptide Sequence Number=SeqID_214694
atgggcagggccaaaaggggttgtcattgtgggatgctaaatgtcagcttcggagaaattgaagggaagggtccgcagttgctcttgccactcaagcagataagaatgcatacatgtgtgtgtatcactcaagagaaatag

SEQ ID NO: 97917 - DNA, 207 bp, Glycine max
  Peptide Sequence Number=SeqID_214695
atgtctgaacccatgcacttaagaccagccgttggagctacacaaatatataatgataaaaagaacaaagatgagacaggaaaagggatcaatgataagagaagaaccaccctgatggaaattcttggtgttaggcataccactgatatttgcaagtatcttggatataggcctctaacgggaagagggaagaaagttgacttctag

SEQ ID NO: 97918 - DNA, 1008 bp, Glycine max
  Peptide Sequence Number=SeqID_214696
atgttgggtggtgctagtgctagccacataccaggagaaagaaaaatctccattaataacggaggaggaggaagagcacttctactaacaccacccacatcatcatcttctccttcttgcacaacaagcataactacttccaccgccaccgccaccgcgacctcatcgaattcagagaaccaaaatttgaggtgccctcgttgtgattcatcaaacacaaagttctgttactacaacaactacaacctcactcagcctcgtcacttctgcaagacgtgtcgccgctactggaccaaaggcggcgctctcaggaatgttcccatcggtggtggctgccggaaaagcaaaagctccggtggcatgtccaactcggtggcgaagcaaaccgccacaaagatgaaagcggtggcatcagagcttggaaggtcgccacaaggactcttcgaccaagagcttccacaaaccccaatcctgtggggttctccacaaaattctcaactgatggctttactaagagctacccaaaaccaaaaccctaaccctaaccctagtcccatgtcaatttctgtcaagggagaagggaacttaatgggatctcactcccacatggtgagtactgagtcattgctcgcgaatgggttgttgaatcctagaactagtctaggctttgatgatggccgtgtgggagaagcacttccttcactgggtctatgcagctctttttggaggaacaatcaagatcagactcagcaacaaaacaacggttttgtagttggagaacatcaaagtagtggagttcaagaactttaccacaagctcaggtcatcgtcatcagttaattattggggaagtgataactcaccagtgtttctaagcaacatggcttcttcatcctcttctttgtccaacattttggagtcatcttcagtttctgggagtgaattcgggtgctggaatccaaccctttcctggtctgaccttcccactaccaatggagcatatccttga

SEQ ID NO: 97919 - DNA, 1593 bp, Glycine max
  Peptide Sequence Number=SeqID_214697
atgaagaaaatgcagctactacacacgttagcgagtgaaaaaccaccacaagaaaagagagagggagtaaggaagagagaaagcggcacagacccaagtgggtgtaagtcagtcttgggagtgagtcactcttcttgcataacccagatctgcagacaatatgcgaagaactggcttgttacatttgttatgccttgtcattgctttagttattcttatcaatggaacggtattaaacaaaggaagaattcatggcaagatggagttttgggaaccaactgtcccattcctccaaactcaaattacacatacaagtttcaggccaaggatcagattggtacatatacatactttccatcaactcaactgcataaagcagctggagggtttggagcactgaatgtttatcatagatctgtcatcccaatcccttatccaaaccctgatggagattttactttactcgttggtgattggtacaaaaccaaccacaagacgctaaggcaaactttagaatctggaaaacctcttgcatttcctgatggcctccttattaatggtcaggctcattcaaccttcactggtaacccggggaaaacctatatgttcagaatctcaaatgtaggcttttcaacctcaattaacttcagaattcagggtcacaccctaaaattagttgaggttgaaggatcacacactgttcagaacctttacgattcacttgatgtccatgttggccaatcggttgctgtgttagtaaccttaaaccagcctccaaaggactactatattgttgcctcaacaagatttacagagacacctctcactacaactgctgtactacactatgcaaactctttttcctctgcattgggacccgtgcctgctccccctgttgataaatatgactttgactggtccatgaagcaagctagaacctacagatggaatctgacagcaaatgctgctaggcctaacccacaagggtcattccattatgggaagattactcctacaaaagtaattaagttggccaattcagcacctttgatcaatggaaagctccgttatgctgttaacagtgtctcctatgttaaccctgacacccctctcaagcttgctgattacttcaacattcccggaatcttcagtgtgaatttactccaaaactctccctcaaatggtccaggatacataggcacctcagtgttgcaaacttctctccatgattttattgaggttattttccagaacaacgaaaacaccatgcaatcttggcatcttgatggttatgatttttgggtcattggtcatggtttcggccagtggacagatgccagcaggaaaacatataatctagtggatgccctgactagacacactacacaggtgtatccaaaatcctggactactatattggtgtctttggataaccaaggcatgtggaacttgaggtctgcaatatgggaaaggcaatatcttgggcaacagttctatctcagagtgtgggatgcacagaaaagccttgctaatgaatatgacattcccaacaatgttctgctttgcggcaaagctgttgggcatcacccttag

SEQ ID NO: 97920 - DNA, 1526 bp, Glycine max
  Peptide Sequence Number=SeqID_214698
atgttgacaatggtatagtgaaggatgtagtcctatggagaagaaagaaaataaatataagcgttcttgttgcggcaacagcggcatgggtgttgatggaagtgtttgaattcaacttcctcactctcatatcatgggtggccatactcggtcttgcttcaatattcctctatgccaatatgcttagacttttgggcaaggaaccaccgaacttgttggggttggaagtgagtgaaaaaacaacaacgagaatagcacacacagttcgagcatggattgaagaaggaataaggtggttgttccttgtgggcgcagagaaagagtggcccgtgtttgtgggggctgtggctggattgttatcactatcttatttaggaagttgcatggacctcctaacactagtttatatgggtacgttagtgggaatggcagttccattaacttatgtgaagaacgaggacaagattaagaggtttgtggagtggttgagggagaaacacaagagatattatcagattattgacgagaagaccattcagaagattaaaagcagaatcgtaaaggagaagaaaacagagacaaggacaagtctggggataggagtgaacacattgactatacttgagccatgcatggcctacacaaaagcacaagtcaatcttgtggtcattcgcaaggtttgcgagttcaaagccacccacgaaagaagcagagaaaccttcaagtctctgagtccagaatgcaaggttgaggccaatgcggttgatctgacgagacacacgactacgattgagcctgttcacattaggcgcaacatcatggagatccagtccgacatcagaatcatgaaggagaaggagaatgcatgcggagcaatcgaagaaccagagtgcattggaatggatcaacatttgaagcagttgaaaattgacctgctcaaggatggtgtgtcggtccttgtcttgacaggtttgggtgaatccggcaaaaccacactcgctaagaagatctgttggaaccctcaaattaaacgcaagttcggggcaaacatcttctttgtcaccgtctctgaaacgcccaacttgaagagcattgtagggacagtgtttgaaggctgtggacctccggtgccggagtttcaaagcgatgacgatgcaacaagccgattgagagctctgctgcggaaagcccttgttgagaaggttaaaatagacatacctgattataagatcttggtaacttcaaggattgaatatccaagatttggcaccaagatcttgttgggtcaacttgatcacaatcaagcagtagcccttttcactcattatgctaaactaaatgaaaacagcttatacaggcctgaagaagatcttttacacgtggatgaactccccaccaacggaaaggtgtgcttcatggatctagggcttttccctcaagaccaaaggatccatgttcctgcactcattgatatgtggccagaactgcataaccttaatagtgatggtagcaacgcaatggccatc

SEQ ID NO: 97921 - DNA, 625 bp, Glycine max
  Peptide Sequence Number=SeqID_214699
atggcagatctgttcagtggaggtgccgtgggggcagtgatgggggagttgctgaaaggggcaattgcgaccataaacaaaggtcgagacttcggacccaccctcgagagcaacatagaaaccttaaactctctggctcctcaagtggaggagatgaagcgttacaacaagatgttggatcgccccatagaggagatagcgaggttggagtctcaaatgcaagctggcgaagagctggttcgcaagtgctccaaattcggtcgctggagaatgctctctttcccttattaccagagcaagcttaagagcaacgacgcgaatttgaagaggcacttttcggtcaacgttccggcggagaacaagagggacttgatggaggtggtggccagtgtgagacagattctggaaattctatccaagaaggaggatttcaggcactcgttccatttaaggggtctaagtggggctccccaagaacctgagtgcgtgggaatggatgtgcctttgagcaagttgaggattgacttgctcaaggatggtgtttctgttcttgtcttgactggtttggggggatcggggaaaagcacgcttgctaagaagatctgttgggaccctcaagtcaaag

SEQ ID NO: 97922 - DNA, 2006 bp, Glycine max
  Peptide Sequence Number=SeqID_214700
gaaagtttgagggaaacatcttctttgtcaccgtctcaaaaacaccaaacttgaagtacattgtagagacactgtttgaacactgtggttgtccggtgcctaagtttcaaagtgacgaagatgcaatcaaccgactgggagttctgctgaggcttgttgggaaaaatccaatattgttggtcttggatgatgtttggcctagctcagaagcccttgttgagaagtttaaaatagacatacctgattacaagatcttggtgacttcaagggtttcatttccaagatttggcacaccatgccaattggataaacttgatcatgatcatgcggtcgcccttttctgtcactttgcacagctgaatggcaagagctcatacatgcctgatgaaaaacttgtcgacgagattgtgagaggttgcaagggttcaccgttggcgcttaaggtcactgcaggatcactctgtcagcagccttatgaggtgtggcaaaatatgaaggatcgtttgcaaagtcaatccattctgctggagtctagtagttctgatttgctttttcgtcttcaacaaagtttggatatattggaggataagttcaaaatcaacgaaaaggtgtgcttcatggatctgggactatttcctgaagaccaaaggattcctgttgctgcccttattgatatgtgggcagaactgcataaccttgatgaaaatggtaggaatgcaatgaccatcatccatgatttaaccatcaggaatttgattaatgtcatagtcacaaggaaagtagcaaaggatgcagacatgtactacaataaccactttgttatgctgcatgatctccttagagagctatcaatctgtcaaagcaaagagaaaccatttgaacagagggaaagactgattattgacttaaatggagataatcgtcctgaatggtggataggacaggatgagcaaggagtcattggccggatgtcctcattcttcctcagaatgttgtatagacagaaacagctaagagttgctgcacgcatattgtctatttcaactggtgacacatactttggggggggaatcgcaactgttttgaaaatgtatggactaataagaaatactcctgcgatgtgccatacttcatcttccattattgatgtcaaatacgttgcttctgcagatgaaacatttacttcagattggtgtgacatgctacctgatgaagctgaggttctggttttaaatctcaactctagccagtactcattaccagagttcacagaaaagatgagtaaacttagagttctgttagtcacaaattatggtttccatcgttcagaattaaacaagtttgagctacttggttctttatttaacttgaaaagaattagattggaaaaggtttcagtcccttccttgtgcatattgaagaatctgcaaaaattgtcccttcatatgtgtaatacaaggcaggcttttgaaaactgttctatccaaatctcagatgcaatgccaaatcttgtggagatgagcattgactattgtaatgatctggttaaattgcctgatgggatgagtaacatcaccccgttgaagaagcttagtatcactaactgtcacaggctatctacactgccacaagatattgcaaagctcgagaatttggaagttctaaggttatgttcttgctctggtttggtagagatgccagattctgttaaagggctttacaagctaagttgtcttgacatctcagattgtgtaagtctgtccagattaccagacgacattggtgagttgaagaagcttgagaagctctacttgaagggttgctcaaaactgagtgaatttccgtactctgtcgttaattttggaaatttagagcatgaaatatatgtgatctgtgacgaagaaatagctgccttgtgggaaaacttccccaccatgcccaagttgaagatagagatatctacaatggagattaacttgaattggcttccaggagttcattcctga

SEQ ID NO: 97923 - DNA, 1149 bp, Glycine max
  Peptide Sequence Number=SeqID_214701
atggtctccgaatccgaactcatcggccgcctccgcgagttcctccggagctccgacctcaacaccaccaccaccgccaccgtccgccgccagttggaggccgatttcggaatcgacttatccgaccgcaaggcattcattagggaacaggtcgacttgttcctccagactgagcacaaccaatcacaacaagaagaagaagaaaaggaagaaaaacaccaaaacgaccacgtagaggaacaagaagaggatgcgcctaataatcccgaacaaagccaaccctccgattccaaggaagtaaccgatgaagacgaagaagaagaagacgaagaagaggaagaagataaacctaaacacgccaaaaaggccaagaagaataaaggacgcctcacaggcacatggttttccgttatttttaacaattggggtccactctcagactttgctgcgttgctctctataaaaatttgtgtgtttttcaagttattgacgagatcgaacacgttaggtgatgaggtagtaaagaaaagaggtggtggtttttgcaaattatgtagcctgtctccacaacttcaggaattcatgggagctccagaaatggccagaactgaggttgttaagcaattatgggcctatattagggagaaaaatttgcaagacccgaacaacagacggaatataatttgcgatgagcgattgcgttccctttttaatgtcaattccatcaacatgttccaaatgaataaagcattgtcaaagcatatctggccattggattcagatgatgttgttcaggtgaagtccacaccaaaggaaaagcagaagaagcaagagagagatgatgattcagatgaaccaaaaaaaaaggaaaaacggcagaagggaggagggaaatcaggttttcttgctcctcttcagctatccgatgcccttgtaaacttccttggtactggagagagcgagttagcgagaactgatgtcataaaaagaatgtgggattacattaaaggaaacaaccttcaggatccttctgacaagaggaaaataatatgtgacgagaagctgaaagaactctttgatgtcgacaccttcactggcttcactgttacaaaactgctggctcctcattttataaagacagagcagtga

SEQ ID NO: 97924 - DNA, 1278 bp, Glycine max
  Peptide Sequence Number=SeqID_214702
atggatcggccggcgaccggacctggcgtggacatgccgatcatgcacgatagcgaccgctacgatttcgttcgcgatatcggctccgggaatttcggcgtcgcaaggcttatgagggataagcagacgcaagagcttgttgctgttaagtatattgaacgcggagataagattgatgaaaatgttaaaagagaaatcattaatcacaggtctctaagacatcctaacattatcaggtttaaggaggtcattttaacacctactcatctggccattgtaatggaatatgcatctggtggagagctatttgagaaaatctgcaatgcagggcattttaatgaggatgaggaagtgtgtcaccgggacctgaagttggaaaacactttgttggatggaagcccggcacttcatttgaagatatgtgattttggatactccaagtttgtgcttgatccattcattagaattgggcctatcccaagtctaagtgatagagtgctagaccagaatgtaagcttgaattctgaaacactcaggatttggaaagtgtatgtttataagaagagaaaaactagtgagaagaggattaggagaatgataagttcattaagttggctgagaaaatctcttaatctcttgggagttgatgctctgcaagctgtaaatggctcagactccatttgtggaaggctgactgatgcccccaaagatgcaatgacttcttcaaagatgttggatccatactcgtatgatgaacaaggtagtggaagcaataggggtgttggtgtgacccttggtagtggaggaggaacttcgtttctggtggtggagacttatttcaaagttcaaattacgttggatgacgttgaagttaagttggctaagctaagcatggatggtgctaccatctacttgtttaatttgttgaaggagaccaaagaagatgccttgtgctgcattcacgaggaaggggaattcttgtcttcggtgcttcattcacaacctaagtcaactgtgggaactccagcatatattgctccagaagtattgctgaagcaagagtatgatggcaagattgcagatgtctggtcatgtggagtaaccttgtttgtgatgctagtgggatcatatccttttgaagatcctaatgatccaaaggatttccggaagacaattcagagggttctcagtgtccagtattccattccagacaatgttcaagtttctcctgagtgtcgccaccttatctcaaggatctttgtttttgaccctgcagag

SEQ ID NO: 97925 - DNA, 916 bp, Glycine max
  Peptide Sequence Number=SeqID_214703
acttatcaaggtaatccttgtggcgtctacccagacttatcttccttcaccggaagtggcgtctacccagacttatcttccttcattggaagtggcgtctacccagacttatcttccttcaccggaagtggcgtctacccagacttatcttccttcattggaagtggcgtctaccctgacttatcttccttaaccggaagtggcgtcatccaaaccttcgtaacctgtatcaagcgatccaccccatatggttcacatcatctggtatcagagctttggctcttgatacagacttatcaaggtaatccttgtggcgtctacccagacttatcttccttcattggaagtggcgtctacccagacttatcttccttaaccggaagtggcgtctacccagacttatcttccttaaccggaagtggcgtctacccagacttatcttccttcactggaagtggcgtctaccatgacttatcttccttcaccggaagtggcgtcatccaaatcttcgtaacctgtatcaagcgatccgctcctactcaggccaaatacagtctaaaggcccaagtggagaaggacgaaggcccaagtggagaaggacaaagcccccgagtggagaaggatgaaggcccaagtaatccttgtggcgtctacccagacttatcttccttcattggaagtggcgtctacccagacttatcttccttaaccggaagtggcgtctacccagacttatcttccttcactggaagtggcgtctaccctgacttatcttccttcactggaagtggcgtctaccctgacttatcttccttcaccggaagtggcgtcatccaaaccttcgtagcctgtatcaaacgatccgctcccgtaagattcacatcatctggtatcagagcttcggctcttgatacaa

SEQ ID NO: 97926 - DNA, 228 bp, Glycine max
  Peptide Sequence Number=SeqID_214704
atggcaagagatgaaatgcaaagattggacctcctgttaattaggaaaattggcaaaagtgttgttttcaccttctcgctaagccaatctactggcttagtcatcaagcgcacagcttcagctcatctgctaagtgaaacaagcgcactaagccaaaatccacttaggcgcgctaagcagtccatacgtgcgctaagcgcacgagcacgaacaaggcctcctacttaa

SEQ ID NO: 97927 - DNA, 351 bp, Glycine max
  Peptide Sequence Number=SeqID_214705
atgaatagactgaatctcatgatcgggcacacacatgcggatcacttggtcactaccaaacctccacaacaaatgctcatcaaggaagttatccctaataggaagggaatcaacgggtccctcaatcctgctcaaatgatcagccacaacattttctgcaccactcttgtctctgatctcaatatcaaactcctgaagaagaagcatccacctgatcaatttgggtttagcattaggtttcttcaacaagtatctcaaggctgcatgggcaatcttgctaaaatcttggatgaatctcctgtaaaaatctgcatgtcccagaaaagagcgtacttctcgcacagactataa

SEQ ID NO: 97928 - DNA, 1392 bp, Glycine max
  Peptide Sequence Number=SeqID_214706
atgtcgccggcggcgcctgatgctgccgagtactctttcgccgtcgagtacgacggcccgccgctcacctgcgacctccctcgggcggtgccgatcagcgtcgacaacattccggtcgccgccgtcgtttcccaggttcctctctccgactccttatctctaccggtcgtgcagccgctcctgccgccgcaacaacaccaccaacccctccgaaccgaagctagggtttccaagttagcgtccgaaacaacggtctctcccacctcggtgatcgccttcgagcaccgagcttcgcagagcaacgtcggcgaactctccggcgagctgagcagctccggcgcgtttgagttttccaccgggaacgacggctccggcgacctgtccgatttggggggaagctcgagagtgctggaagaaactagaagctctagtaccattgagtttagggacaaatcagggagaagttccggcgcgttaagggttctggaagacggaaaagagagtttggatttcaacgagttgaatcagcaagattgggcatccactgagtcagtgctgagtttggagtatccatcaactcgggtttcttctctcaaggctgaggatatcgatgctaaacgtccccctattgttactttcgatgtggactctgatgatgcgttggttgaggagtttgacgtggaggacactgtgagcagcaataaacctgttaaaagggcacctctcacgaagggaaagaaagggtcttgttataggtgcttcaaggggaataggtttaccgagaaagaggtttgtctcgtttgtgatgcgaagtattgtggtaattgtgtgcttagagctatggggtctatgcctgaggggagaaaatgtgtgacttgcattggattcccgattgatgaggccaaaagagggactttggggaagtgctctcggatgctcaagcgtttgcttaacgagttggaggttcggcagataatgaaggctgagaggttttgtgaagcgaatctgcttccacctgagtatgtttgtgtgaatggacacccactttcttatgaggaattggtaactttgcagaattgccccaaccctcccaagaagctgaagccagggacctattggtatgataaagtatctggtctttgggggaaggagggacagaagccttcacaaattataagtccgcatctgaatgttggaggccccatccaacaggatgccagcaatggaaacactcaggttttcattaatggtcgggaaataacaaaagtggagcttcgaatgttgcagttggcaggagttcagtgtgccggcaacccacatttttgggtcaatgatgatggttcctaccaagaggaggggcagaggaatacaaggggttatatatggggaaag

SEQ ID NO: 97929 - DNA, 240 bp, Glycine max
  Peptide Sequence Number=SeqID_214707
atgaggaaactgctaatgattccttgtcgtgccaaaccgccgaacgtcgttggagggagcgttgagaggtttggccacgttttctatgtgtgcgactacgtgggtcaattttcatgccaaactaatggaaaccttggattgggaaaacaggttgtaactaagatagatgatgagagagaattatcaggtgatgatatccaaactgctaatctgaggaaatgtgcgattttagatgtgtag

SEQ ID NO: 97930 - DNA, 1377 bp, Glycine max
  Peptide Sequence Number=SeqID_214708
atgacagggtcatctcgaaaaggacgcggatacttggatgaaggaagtgtgaatggaagaatgtacggaaagttaaagaaagacgagttcgacggttacaactccgataaccatcaaagaaaaaacaaccccatcacaatggacgcgcctcatttggatcctcaaatggaagctgacaacgctccctacgacgcttccctctctcccttatccaaatccccatggtcctctcacatgaacgaagacgcttttgccggctccaacgaaaacgacgctctcgtgggctcccttgtccgcgaagagggtcacatttattccctcgctgcaaccaaggacctgttgtacacgggttctgatagcaagaacattcgcgtgtggaagaaccaggaggagttcgcgggcttcaaatccaatagcggtttggtcaaagccattgtgatcgccggagagaaaatcctcacgggacaccaagacggaaggatcagggtttggaaagtgtcggggaaaaacgaccaacaacacaagcgcgtcgccacgcttccaacgttgagaaactacatcaaatgttccatgaaaccgagcaactacgtggaagtgagacgacgccgtaatttaatatggatcaaacactacgacgctatttcgtgtctgagtttaacggaggatcattctctcatatactccgcctcgtgggataagacctttaaggtgtggcgaacgtcgaatttcaagtgtttggagtccgtcacggcgcatgacgacgccgttaacgcgcttgttgtggggttggatgggatggtcttcacgggctccgctgacggcaccgttaagatttggcggcgcgaggttcaagggaaagggacgaagcatttgttttcgcagacgctgttgaagcaggagtgtgcggtgacggcgttagcgataaacgaagaggggaatgtgctatacgcgggttcctctgacgggttggtgaattattgggttcgggaaacgaatttggagcataaaggggttttgaggggccacaagctggcggtgctgtgcttagctacggcggggagtttggtgttcagcgggtctgctgacatggcgatatgcgtgtggaagaggtcgctgaacgacgaccacacgtgcgtgaatattctgtcggggcacactgggcctgttaagtgtctcgcggcggagagggatcctgaagcgatgtgtaatgagaggaggtggattctgtatagtgggagtttggataagtcggtgaaggtgtggaaggtgtcagagaatgctgcgagtgcgcataacaaccaccagccacccaggcccagtcttgatcagttccccagagtttcgtccttaaggaaaatggggtcaaagagatactag

SEQ ID NO: 97931 - DNA, 267 bp, Glycine max
  Peptide Sequence Number=SeqID_214709
atgcagagttcgtcaagaccacccggttgtgcacgtaactgcccccccataggtgatcaacctagggcccaaaggagttccctaccagcaagtgccaaagaccatggaccaattaaagcgcctaagcatcccctcagaaaatgcttagattctttaaccacgcttgtcccccacgaatgggccatccgacaaggtcagtgcacttcgccccccacgaacatacacaacatccaacgtatcgaacatgggcaccatcaagtgcaatga

SEQ ID NO: 97932 - DNA, 678 bp, Glycine max
  Peptide Sequence Number=SeqID_214710
atgcctgactaccttgagcatgggatagttcagaagcttctcttagttggtggcagtggatctggaacgagcactatttttaagcaggccaagattctgtacaaaagtgtcccattctcagaagatgagcatgaaaatataaagctgaccattcagagtaatgtttatgcctaccttggcatgctgcttgagggacgaactagtccaaaactggatgagaagactgtatattccattggtccaagattgaaagcattctctgattggttactgaaaactatggtgtcgggcaaacttgatgccatctttccagctgctactcgtgaatatgcaccattgattgaggaattatggaatgatgctgccattaaggctacatacgaaaggagaagcgaattagaaatgctgcctagtgttgccagttatttcttagagcgggctgttaaaatattaaggacagattatgaaccctcagatttagacatcctttatgctgagggagttacttcatctaatggggtggcttgtgtggagttttcatttccccaatcagcttctgacgaaactgttgacactactgatctacatgattctttggtcagattaatagcacccgtgaaactgccaagggttgtaaatgcaagcacatcagaactacaaaataccaaaagaaactaa

SEQ ID NO: 97933 - DNA, 1504 bp, Glycine max
  Peptide Sequence Number=SeqID_214711
ggcacctcaagcagcaggtgcatggcctatcattggccatttgcacctcttcaatgctcatcaactcacacacaaaacacttggcaaaatggctgagaaacatggtccaattttcacaataaagcttggttcatacaaagttctagtattgagtagctgggagatggccaaggagtgtttcactgcccatgacaaagcattctccaccagaccctgtgttgcagcctcaaagctaatgggctacaactatgccatgtttggtttcactccttatggctcgtactggcgccaggtgcgaaaattaaccaccatagagcttctttctaacaaccgtcttgagccactcaaggacacaagaacggttgagttagatgctgcaataagggagctttataaggtttggacaagagaaggttgtccaaagggaggggttttggtggatatgaagcagtggtttggtgatttgactcataatattgctctgagaatggtgggagggaagtcatatagtggggttggtgatgatgatcatgcagaaggtgaggcaagaaggtataggagagttatgagagactgggtgtgtttgtttggggtgtttgtgttgtctgattcatttccatttctggggtggttggatatcaatggatatgaaaaggatatgaagagaaccgccagtgaattggatgctctggttgaagggtggcttgaggaacacaaaaggaaaaggaaaaggaaaagaggtttgagtgtgaatggaaaggaagaacaggatgatttcatggatgtcatgctgaatgttctgcagggtacagagatttctggttatgattcagataccatcatcaaggctacttgcctgaatttgattttagcaggaactgaccccaccatggtcacgctaacatgggcactatctctgctacttaaccatcaaatggaacttaaaagagcccgacatgaactggacactcttattgggaaggacaggaaggtggaagaatctgacataaagaagttagtgtacctccaagctgttgtgaaggaaactctgcgcctgtatccaccaagtcccattatcacccttcgtgccgccatggaagactgcaccttttcatgtggctatcacattcctgctggcacacaattaatggtgaatgcttggaagatccacagggatggtcgtgtttggagtgaacctaatgatttcaagcctgagaggttcttgacaatccacaaagatgttgatgtaaagggtcagaactatgagctcgtcccttttagttctggaaggcgagcatgccctggggcctcgctcgctctgcgtgtggtgcacttgaccttggctagactcttacattctttcgatgttgcttctccttcaaatcaagttgttgacatgacagagagctttggactcacaaatttaaaagcaaccccgcttgaagttctcctaactccacgtctagacaccaaattttatgaggactatattatattaagctag

SEQ ID NO: 97934 - DNA, 390 bp, Glycine max
  Peptide Sequence Number=SeqID_214712
atggcagcttgcccaggcaagctgatgcttattcctgaagtaactggctcgcccaggcgagctggttacttcaccctgaagtcttttgggggcccaggcgagccagaggctaacctgggtgatctagggttcttgaaaagacccttttgcccctctttttttggtattttttgcattcctgatcgaaacactgaatggttccttgctttgcactgtaactggtgttcaacactgggaagtaaagataaggacactaatttcgttcgagtgatcttgctattcgaccgggcaacagcatacaaactgaggacgatgagtcctaagaagcacaaagacaaggacattgagtcctataaaagacagaagacgttgaagtcttataaagtgtaa

SEQ ID NO: 97935 - DNA, 120 bp, Glycine max
  Peptide Sequence Number=SeqID_214713
atggagcctcctacggggttttctgcttcattgttgagtttcatccggtttcttccttttttcattgggcttctgcttctaggcaccaccaaagtggtggggacttcgggtggagcctga

SEQ ID NO: 97936 - DNA, 465 bp, Glycine max
  Peptide Sequence Number=SeqID_214714
atgaagttcaacagtagaaattgggttacactaatagcctcagtgtggatgagcttcacagtgagtgtaatggaaggtgtgcgtcctttacctaatccattaatagaggcacatgggcacgttaagcatgcaacggcaaaaagatgggtcgttcttgttgctggtttaagtggttatgataattataggcaccaagcagatgtttgccatgcctaccaaatactaaagaatggtggccttaaagatgaaaacatcattgttttcatgtatgatgacattgcccaccataatctaaacccaaggcttggcactaaaatcaataaaccaaacgatccacatgtttataaaggagttcccaagttccttccaaacaacatcttcgggattggtatgtcgccattggataagtacatcagtgatagctcggtttcccttcttcttcattctcctatccaagaccgctag

SEQ ID NO: 97937 - DNA, 912 bp, Glycine max
  Peptide Sequence Number=SeqID_214715
gattatactggaaatgccaccacttcagaaaacttttatgctgtaattagtggtaaccgaagtgctctctctggaggtagtggcaaggttgtggacagtggtccgaatgacaccattttcatttattatgcggaccatggtgctaccggtgtcattggcatgccagttggggattttgtgatggccaacgatttcgtagatgtgttgaagaagaaacatgcagctaaatcttacaaaaagatggtgatatacatggaagcatgtgaatctgggagcatgtttgaaggtattcttccgaataacatagacgtatatgcgaccaccgctgccaacacagatgaggatagttatggtttttattgtcctgatctctaccctactccaccgcctgagtacactacttgtttgggagatgagtacagcatttcgtggttagaagacagtgacaaaaatgatatggtaaatgaaactctgcaacaacagtatgaaacagttcgtcgaagaacgttagttagtcatattaatgccacttcccatgtgatgcaatatggagataaagagttgaacaatgattctctagctatctacattggtgcactagcccccagtctaagtcttaatgaaaatgcacattcctttgaacaatctactactcaaactaaacttattagccaacgagatacccgtttactccatctcaggctcgagttgcaaaaggctcaagatggttctgagaagttgaaagctcagaaagagttagctgatgaaattgcacataggaaacatgtagataatgttgtccatctcataggggatctcttgtttggagaagagaatagctctgctatgatgttccatgttcgtccagctggcaagcctcttgttgatgattgggattgttttaagaccctt

SEQ ID NO: 97938 - DNA, 546 bp, Glycine max
  Peptide Sequence Number=SeqID_214716
atgtcaccgtccattcaattgcaacaacccttaccatcatccagcctacaaccacattcgctgccatcctctggttacatcgcaactacttggttctcccgcactatcaccaatggaagtgtttcaaggtcgtcacacatggctttcgcaaaggtggagatgaatcccttggttctctctccatatcactctacttatttctcgttcacaacgaccttgtttcattattgtgcttctattgcatttagtcatactttgtctccaaacatctcaccatcgcttgattcccacccaattttccatacttcatctagaccatttgttaccattaatctagaaaaccctcaatatcattcattaacacaactaacattagatcacatcactgagaatctcaaccgtccatgtgtccaacctttcttctttgcacaatctctgattttccccagcaaaaatcctaatactatgcgattactacccatttcaactccccataaaacacctcgctctcattctcccttgcttacttgcatcaccaacccttaa

SEQ ID NO: 97939 - DNA, 318 bp, Glycine max
  Peptide Sequence Number=SeqID_214717
atgttgaaggccattgtggtggcgagaatggttgttgcggcgacgggtgatggttttggggagaggaataccaccaagggggttgttgatggtgagaacctgttatgtatgacgatgattatggtggcagggacaacggcaacgacgaatgttgtggttgcggaggtggtggcagaaggtcaaaatgatagatcacattttcgtggacaagctaggcatatccagatatgtttgtggaatttgttggataattataatgggtgttatgggtggtggttgatgaaatggaagggcagtaaaaatgctcacatacagtga

SEQ ID NO: 97940 - DNA, 258 bp, Glycine max
  Peptide Sequence Number=SeqID_214718
atggcggcgacactagcgtctagcggtagcgatgctagtagttatggtgctaatgatgaaggttgtagaagtggtggtgacaatgaaacaattcttgaacctaatgaaaagttgccgccatatggagggcaacatgaagtggggtgtcactatgaggactctgaatcatacctattcaccattgaaactcctttcaacagagtcttcccttggaagagagattttgttgctgagtttgattgcaacttctctttcatg

SEQ ID NO: 97941 - DNA, 693 bp, Glycine max
  Peptide Sequence Number=SeqID_214719
atgcctcacttgtcttccatgtgttccgaactcattggcttttcccgttctcttaagtcttgctttttagcaacacaagggcataacttaatattttattcgtggttttcttcgtccttatgcacgctttctagtattatatatctgccccaactacttcaactcctcttactacactttcagttcttccaagaaaaggagattcagaaagcaattaagatgattaagttgaggtcaatgaggtttagccgaagcagctccaagcttggaaatggtgggcacaaagcaacaacacccactgaaaaggattgcagaagcattggtgaaatccaatgggaacttaggcctggtggcatgcttgttcagaaaagggagagcaaccaaagcgcaggggagggaatgatcacaattatagtgtcaactgtttcacaatcgcatgaaatttctatcgaggccacatcaacttttggagaattgaaaatgattctgtcactggcaacaagttttgagccccgagagcaaaggcttctcttcaagggtaaagagagagaggatgatgaatatctacatatggttggggttagagacaaggacaaggttcttctgtttgaggatccagctataaaggagaagaaactgcttggcttaagaaaccaacccattaacaatcctagtcgtaccatcagtgtatga

SEQ ID NO: 97942 - DNA, 252 bp, Glycine max
  Peptide Sequence Number=SeqID_214720
atggttgttggtaaccttacaactgtgatcaaggtatatattagaggctacttaaaggggattcacaagaaaggagggaggaaatttggggttcttaaccagtcagttttgggttgtattccattggtcaaggcaccagtaaatggatctgaaggttcctgcgtggaagaagcttcagcactagccaaactacataacagtgtgctttctgtggaacttgagaagttaaagaaacacctaaaaggatattaa

SEQ ID NO: 97943 - DNA, 324 bp, Glycine max
  Peptide Sequence Number=SeqID_214721
atgatgagagtagttgtggttgcatgggacgggttggggagtggtggtgttgttgggaatgcatggaatgttcctgaaaattgtggggctaacaagactaatgtgaaggaagaaatgggttggaagttggggcagagagaggcaagtttgcagagatacaaggagaagaggcaaagcaggctcttctataagaaaatccgttatgaagttcgcaagctgaatgctgagaaacggcccaggatgaaggatgttaacatacacatgaataggtggaggttagaaatccctgtgtgtgtatgtattggctacaaattcttgatgtag

SEQ ID NO: 97944 - DNA, 513 bp, Glycine max
  Peptide Sequence Number=SeqID_214722
atgccgaagccgtgcagccgctgcgtgtttaccaccatcggcaccgaaagcggtcgcaagcatccgcagggcgaaccgctcgccacgctgcagcgctttcgcagcgcgcaggacggcagcggtgatatcgatttcggcctgaatctgattgcgcttaacagcggtatcgtgcgcgtcggcgatacggttgaagtgctggaacggcagacgccgcgcgcttacggtgccggtgaggtggtggaaacgctgcaggccgccagcagcgcgccggccgccgtgaccattggctatcagggtcagcagtttgccggcgataatcagcaggtattactggaacagctggagatgcagggctttcgcattccctattcgtgtcgggccggaatctgcggcagctgcaaaataacgctggtgtcgggtgacgtgaaggcgctgaagcagagcgcggtgcgcggtgatggcaccattctcagctgcagctgtattccgaacggagatatcgaactggcgtaa

SEQ ID NO: 97945 - DNA, 363 bp, Glycine max
  Peptide Sequence Number=SeqID_214723
atgtctcctccacctcttggacctcacaatcgctcacaaactcatctcaagctctcaggacagcttcctcttccagctctggtctctacagatcttcacacaacaaattctctcaaactctctggaacttggacctttctctctctagaactttcaagacatgcagaagcttcaagaaaaggccaaactccccttcaaaatctgattttaggcttaaataggtgctttgtttgtgctcgtgcgcttagcgcaattatgaaccgcttagtgcacattagtgaatttcgacttagcacggaaggtgaaaatcaacacttcaaaacttgcctaattatcctgaaattgagagaaaatgattattaa

SEQ ID NO: 97946 - DNA, 286 bp, Glycine max
  Peptide Sequence Number=SeqID_214724
gatgggagagctagagataatgccaaccagaatgactctgcagttagttgatttctccatcactagactgtatggagtcatagaagatgttttggtccgagtaaagcatttcactttccctaccgactttgtggtcatggacattgaggaagatgctaatattccattgatcttgggacgtccgttcatgctgaatgcaagctgtgtggtggatatgggaagaagaaatccactcgctaagcacacatcccgtgctaagcgaattttccttcctgcgttgagctag

SEQ ID NO: 97947 - DNA, 244 bp, Glycine max
  Peptide Sequence Number=SeqID_214725
tttcatcaagaagtactgcatccccaggcaggcgcagggcgaaacaccacagcagcctggggatggccagcagcgggcaatagacgcaccgccatcacctctagagttcacctcagctcatccacaaaaaggacatcccctttatccccgaaccgctggccaaaccctgacatatatcatgaccagccgttctacaagccttgagccaaaatcccaacttatcataaaccttgacccagggtga

SEQ ID NO: 97948 - DNA, 669 bp, Glycine max
  Peptide Sequence Number=SeqID_214726
atgaagacaatctctcttcctccgactcttccacacagcgccgcggcggaacatttggagaaagctgggtgtctcgttggagataatttcataaaagctgttaagtgtgacaacattgcaatagctggtggttatactcagggtgaagggatagttgtgtgctgcaacgagatggaatctcaagatgatgttgaccagctgttaaagcatgagctaattcatgtatttgatgactgtcgtgctggaaacttggattggacaaaatgtgctcaccatgcttgtagcgagataagagctggtcatctaagtggtgattgccatttcaaacgggaacttcttaaattagcttctctgaaaattcgagggcatgaacaaggatcgactgcaactaggaaaacgtattcaaaagagtccttagtctcaacttttagaagagttgttgaggctatagggattcaggtagaagtgaaggctggtgtgcaccacaaccatgaagagattggcattgatggagtaacagacagcagccacattgctggaaaaccaaatgacagcgtgacaggccatggtagctcatggatgctctggtggcaacatgactgggtgggttttgacaaccagaagctgttgaagattatagtatggtcagctggtggagttgatgcatag

SEQ ID NO: 97949 - DNA, 249 bp, Glycine max
  Peptide Sequence Number=SeqID_214727
atgaaggtggtggtggggtttcttagagtgattctttgcttaatcttgctcagtcagtatcaaacattttctgttagacagctccaccattcagcaaaaacatttgagtggcttgcaggttcaaaaggactgcatgagcatgatcagcagcaacacatgaaagggaaaaaccatgttcctggatggtggcatgtggattattctctgcctcacagacgaaggcctgtgcataataagttggagccctaa

SEQ ID NO: 97950 - DNA, 216 bp, Glycine max
  Peptide Sequence Number=SeqID_214728
atgtgggtattcgaggaaaaattaccaagtggggagaagctcacagatgttatcagcaagaccaatgaaaatgtcaagtatctccctggaatcaagcttggtaaaaatgtagttgctgttccagaccttgaaaatgcaggcatgtacaattacaaagcatgctttagatgcatttacaaggatagaatgtctgcaatactcagaaagttctcttag

SEQ ID NO: 97951 - DNA, 162 bp, Glycine max
  Peptide Sequence Number=SeqID_214729
atggaaggaggcaagcctggaggtggtggaagcaataagctttgccgctaccaagaacgatatataagctgcacctcaaaaactgagacaggcgatgtggaacttcctaacaggttcatgtgtttgatcaacctccgccaggcgtacagattgctttgttag

SEQ ID NO: 97952 - DNA, 1299 bp, Glycine max
  Peptide Sequence Number=SeqID_214730
atggcggcgaagttcgcgttcttcccgccgaatccgccgtcgtacaaggtggtgacggacgacatgacggggctgctgctcctgacgccgttcccgcacagggagaacgtggaaatccagaagctgccgacgcggcggggcacggagattgtggcgctgtacatacggcacccgatggcgacgtccaccgtgctctactcccacggcaacgcagctgatctcggccagatgtacgagctcttcatccagctcagcatccacctccgcgttaacctcatggggtatgactattctgggtacggacagtcatcagggaagccaagtgagcagaatacatattcagatattgaggcagcatacaagtgtctagaagaaagttatggtgccaagcaggaagacataatcctttatgggcaatctgttggcagtggcccaactttggatcttgcagctaggttgcctcaattaagagctgttgttctgcacagtcccatactttctggcttaagggtcatgtatccagtaaagcgtacatactggtttgacatatataagaatattgacaagattccgcaagttaattgtccagttctcataattcataatgtgaaaggacaaaatgctctaataaaagcagttatagtttacttctatttctgtatggataatgcacttaattatttggtgattgatattttaccatttcataattccgaatgtaaaggaagaataccttcatacttttcaccttcagaccatttcatatttgtcatatgcttgtctgctatgttcttcaacctaaatgaattagctgagggtacttcagatgaagttgtagattgctcccatggcaagcaactctgggaactgtgtaaagagaagtacgaaccactgtggctcaaaggaggaaaccattgtgatttggagctctttcctgagtacatcaggcatctgaagaagttcataacaacagttgagaagtctccatcgcaacgatacagtttccggcggagcacagaccagtttgagcagcctcgaaagagtacagatatttttgaagtaagtagaaagagcactgatcgtagagaaaagccaaggaagagcacagacaagccagaaaagctgaaaaacttgtctaataattctgatatgttagagaaattgagaatgacttttgatcacaaggaaaggtctaggagaagtgtggattgtcatgagaagtcccggaaaagcattgaccatcaattagaaaaagcaaggaagagtgttgacaggctggacagaataaggagtggataa

SEQ ID NO: 97953 - DNA, 297 bp, Glycine max
  Peptide Sequence Number=SeqID_214731
atggcgcattcaggttcatttttagcaatgcaaaccgtcactgctgttgctggttgccatcagttttttgacccactcaccatgatgtttgcttgctactttccagcagactgcgaaatgcttctggcagacattgtttcacatgttctcactctcttcatggaattcatgtaccatctcagtcagtgctcgagaagtgctgctgtcagacactgtttcacatgtcctctctctccctgtttcggcatctggggcaccctagttcttgataaaggggacaacatctcctgggactga

SEQ ID NO: 97954 - DNA, 450 bp, Glycine max
  Peptide Sequence Number=SeqID_214732
atccaaacactggttaattctctcacggctgttggagagaccgtaacgtccactgagcatcttgatcttgtgcttgatggacttcctcttgagtacgactcatcgatttcactgattagtagatgtgttgccaattttacgattgatgaggttgagaccatgctcttggagcatgaatctcgtattgacatggccaaaaagcgttccctagtttctgttaatctaactgaaggaaattttagggctaatgattcctttcaaccttcaaattctaatttgcaaggcacaatcttggtggtcggagctttggacgcggtggtggtggtcgagatcattttgttgatgtccaatgccaagtgtgtcacaaatgatgagaactatgttgctactattcctatggcttctactacttctgctgcttcctctgcggtttcgactgtggcttctcct

SEQ ID NO: 97955 - DNA, 324 bp, Glycine max
  Peptide Sequence Number=SeqID_214733
atggatgccatggaactcagtgcatcatccttcattgatagccaagaaaatcgtcaagttgaaggatacgattacatttttctacatggggggggaggggatgaccctgaatgggtaagaaggtttttgaaggaagtccacaaggctgcaacgactacaggaatgaacttaaggatgctatatgttgggaaaaacaacaaaaaggaacaagtgcaaaaaatcattgataccatacagggtgaggagctcaaaattaaatactggaagattccgtctttagagcatgctcttttccaagcttcaactcaagcaaatcgacgatga

SEQ ID NO: 97956 - DNA, 1302 bp, Glycine max
  Peptide Sequence Number=SeqID_214734
atggatgctgaagcttaccaaatgctacgagaattgttttcaaaacctcacactgacaacatgaaggttctcaaggctctgatttatgcgcaggatgatattctacctctatatgatggagttaccaagaaaagggttagccttgagccactgagaaggaagaatgttctgcttctattttcaggcatggagatctccaccgacgagcttctgattcttgaacaaatctacaacgaatcaaaggctcatgcaccgagaatggagagtagatatgagttggtttggattccaattgtggaccctaactctgaatggatagaaccaaagcaaaagcagtttgagattctgcaagaaagcatgtcatggtactcagtgtatcatccttctttgataggcaagccagtcatctggttcatccagagagaatggaaatacaagaataagccaattcttgtggttttggacccacaaggaagggtttcttgccccaatgctattcacatgatgtggatttggggaagtgctgcctatcctttcacaagttctagagaagaagctctatggaaggaagagacctggagacttgaattgctagtagatggcattgaccaagaaatattgaactgggttaaggatggaaaatacattttcttgttcggaggggatgatcctgaatgggtaagaagatttgtgaaggaagcccgcagagttgcaacggctacacaaatacccctagagatggtatatgttgggaaaagcaacaaaagggagcaagtgcagaaaatcattgacaccataattcgtgataagctcaacactcaatactggtcagagcagagcatgatatggttcttctggacccgtcttcagagcatgctcttctccaagcttcaactcaagcaaacagacgacgatgaccacgtgatgcaggaaatcaagaagcttctgagctatgacaaacagggtggatggattgttctggcaagagggtctcacattgtggtcaatggacatgccacaaccgggttgcaaaccttggtggagtatgatgctgtgtggaaagaacttgctgacagagatgggtttgaaccagcatttaagaatcactacgacaaggttcattcaattgttagtccttgctgcaggtttgagttctctcattcaatggggagaatcccagagaggctcacgtgccccgagtgtcgccgcaacatgcacgtgctcaccaccttccagtgctgccacgatgaaaaaattgatgaggacttttttgtcagcactgttactcctcctaccatttga

SEQ ID NO: 97957 - DNA, 767 bp, Glycine max
  Peptide Sequence Number=SeqID_214735
atgaatagcattggcaagctgggtgctatgcaaaaactgataaaaggtggaagagccatgcctgcagctgcaatatctgatgacagcgttttggtgaagaaaatagtggcagagcatagccctgaggggatagaatatgatgtcaggccacttctccatatagttgaggatgttcttatatattccaccttgagttctgatagtgctacaacggctgcccttacacgtgctgatcatgtcgaagacagaagccaccgtcctggccacacaaacatgctggaggctctatctgctaagattgataggatttcctgtgagatttcctacaagactctcaacggtgtagatgcacactccacaacaattgcaatatttgacatgctcacaatctataagtgggatgtgaagatagtgctggccttagccgcttttgctctgacatatggtgaattttggctccttgcacaaattcatgacactaaccagcttgctaaatcaatggcaattctgaagctactacctagtatcatggagcatggaagctcgctgaaaccacggtttgatacccttaatgatctagttaacaacatcttggaggtgaccaagtgtgtcatagagttccatgatcttccagctcaatacattacacaagacatctcagcctacaccactgcctataactatataccagttgcttcctactgggccactagaagtattgtggcttgtgcagcgcagattacaagcctcactacccttggctatga

SEQ ID NO: 97958 - DNA, 257 bp, Glycine max
  Peptide Sequence Number=SeqID_214736
aaaactgacttgactccttcatgcatgctccactcggctcggggggatatagctcagttggtagagctccgctcttgcaattgggtcgttgcgattacggaggaccgaaacatgccactgaagactctactgagacaaagacgggctgtcaagaacgtagaggagggtttcctcatttgggatcctggggaagaggatcaagctggcccttgcgaacagcttgatgcactatctcccttcaaccctttgagcgaaat

SEQ ID NO: 97959 - DNA, 210 bp, Glycine max
  Peptide Sequence Number=SeqID_214737
atgaagtcaagcctagaagaaaagttgatgaagaggatgtcagtggttcacaggaaagctgaagagtggagagcagaagctagacaacaacatttggagcaaatccacaaggccactgaacaagctcaaaagatgattcataaacataactcacaattttcaaggcccagttcatgtggttgcttcccttgcaataacaaccatcattaa

SEQ ID NO: 97960 - DNA, 276 bp, Glycine max
  Peptide Sequence Number=SeqID_214738
atggtgccgatggatagaccagatgccacgcccatcaccattgatcactgttggtactactacattccttggggatttatgtctcaccaacaactggagtggtttgaagacatcaatttttatctaggtatggaagtgcctcatgatgctcaagaatttgaagtgacgccagtcattgaggatcggggagatcacactgacatgatgcccaaggaggaggaagtgtatcgtgagtttctacaaaatttagagccttcatctaaggaggaggattga

SEQ ID NO: 97961 - DNA, 647 bp, Glycine max
  Peptide Sequence Number=SeqID_214739
tctctcagatggacatgaatgtgggagcccttatctctggccagataacatctatagcccagtctaactcttctagacttgggttccctgctctgatcatcgccctgtgtaaggccagaggggttaattctgacagcttggtttttgagcacctaagctcggtcatcaacttggcctatattaggaaaaactgttggaatcctgatgatctaacagtttctattagaggggccaggcgggcaaggacgaggctagctgagcctccttccacatctacagctcctgttccagcacgatctattccttcaatggagcagttcgctgagttggtagcatggcccgggactcagtcttctcttcgcaaggaagatgaaggtcccacagcccaggcagaggagacacaggaagctgcggccacacttgagagatctcttgaggcagcttctgagctcccagcacaaggggaggacataccctcacctcagcttgcagcagacccttccactcctgtcttggaattatcagaggatcaaactgctctagtcctgacaatgaacacttctcctccaactactccagtattgcatctgacagatgaggaggatgttcagatacaggacacccaggaccagtcacaggaattttga

SEQ ID NO: 97962 - DNA, 156 bp, Glycine max
  Peptide Sequence Number=SeqID_214740
atggtcctaccaaagagaggaatgttcggtcaccgacatcctaagacaacaacgagtatgccaatcggaaggttgcttactcattcttatcataaatatcagcacggacacctcttgttcgaagagtcgctgtatcgcacacgtttccgacactga

SEQ ID NO: 97963 - DNA, 453 bp, Glycine max
  Peptide Sequence Number=SeqID_214741
atggtgaccgaatatgccaatgatctatctggaacactagggtatatggaagaacaacttgagttgcttcttgatactataatgttcaagtgcagttttcttcctagaccttcaagaaaacaaattaggtcccaagtagtagatgagataggcttgcaacctaaaaccataggagatgagataggcttggcttctttcatgctggctttcgataattgggcatgctttcccactgataagagatctacttctgggtattgtatttttattggtgatatctttatctcatggaagagcaagaaacatgtggtaaaatcaagtgcagatgctgagcatagagctatggcttcttccacttgtgaatttatttggcttaaagaattgatgtttggagacattacaaatacctttgtaaattcaaatgatcaattggcagatgtctttaccacataa

SEQ ID NO: 97964 - DNA, 792 bp, Glycine max
  Peptide Sequence Number=SeqID_214742
atgtctccaattatgcaaaccaatctgcaaccaatctcagcacctcataccagaacttcaattaaaattgttagcacattaaataaaagctaccacaccaatcaaccgcccttggaaggcaaaataaaacgccttgttctcacccaagaaggtagaacaaagctcaacatttacccagatagagagttctatgcatttccacgctttgtgaaacatgtagatgatggcttcatttctacactgaccaatctttacagagagagattgagacctgacatggaaattcttgacctcatgagctcttggattagccatctaccaagtgatgtcaagtacaaaaaagtggtggggcatgggttgaatgcacaagagcttgcaaagaatcctaggttggatttctttgttgtgaaggatctcaacaaggatcaagagtttgaatttgagagtttcagttttgatgcagtgctatgcatagttagtgtgcagtatctccaacagccagagaaggttagaggttttccgggtactataaagtcaggaggggtattcattgtgagttttagtaacagaatgttttatgagaaagccataagtgcatggagtgaagggactgcttatagtagggtacaacttgtggttcagtacttccaatctgtggaaggtttcacagagcctcaagagaatatgtcaccaattggttggatcatgaggctttttggattgatttcagagttagatcccttttatgctgtgattgcctacaggagttttaagcacatacatgatgcctga

SEQ ID NO: 97965 - DNA, 1155 bp, Glycine max
  Peptide Sequence Number=SeqID_214743
atggcccaaaagcgaccgggctttatgcgcctcggtccgacgagcctatcgttgaagacgatgagtgaaaagatggccagatgcgttgctacgcaccaagaacaagggcataccccaaggaggcagaaaatatatatatttattaataagagaagctacagtaccaggggtactgatgataaccatacaaaggcagctgtgctgccagcctcccaaacagaaaaccaaaacccttcacaaagcccaactacaagtcttttggggctattgggatgtcagagtagtggatggattccgaagaaggttgcagacaagctggtgaaggtgcagaggaggtttctgtggtgtgggggggagttgatgcagagcagaagaagattgcctggattagctggggatcagcttgcctatcaaaggagaaagggggtctgggaattagggagttgtccaaatagaggaacctggataagaatagaaggaacgtggcaaaatctgtatggtggtggcaagatggagtgtggggtgtgggtcaaaggtgaggttttgggaggatgggtggaaggaagacggtgttccgttgatggacaaataccccctagactttatcttatctcgaaccaacaaaacaaacttatccagcaaatggggaccttatcagatgcagcatgggagtggaacttgcagaggaggaggattttgcaggatctccccatcgatcctaatcatcaagacaagtgggtttggaaaggtgatgcatcagggagatatactgtaggttctgcatataagttgcttgactcaaactcaagagatgaaaatcaagatggggcatttagagaactgtggaaattaaaaatctcagccaaagcttctttctttgcatggagattattaagggacagattgcctactaagaacaacttgtgcaggaggaacataaggaagaagaggcagctcacttgttttcagctgtcatttgatcctgccgttatggtggaaatcgatgtcttgggtaaaaatggagggagctttcccacagaacccacgacagcacttcctctagcattccttctgcaggaattcggaaattcgtctgcagcgatggcagatttggtggatctccctaacttggtgcacatggtatcacagaaatag

SEQ ID NO: 97966 - DNA, 237 bp, Glycine max
  Peptide Sequence Number=SeqID_214744
atggatttggtgaggcctttattcgcatgggaggaagatctcttaagggatttgatgagcaagttacatggtgttgagttgctcgctgaactgctgaagttctggactcgtgggactgaaaagtttatcattccaacatatggaacatatttggggagcgaggatgaaaaggatggagcacttcttttggcatgtcacatgttggtgtctttggaatatgagaaacaatatatataa

SEQ ID NO: 97967 - DNA, 585 bp, Glycine max
  Peptide Sequence Number=SeqID_214745
atggttagcaacccctccagagctcagaagaaggacaagtcctcgaagaggaagcaaggagagtgttctcaggctactctcaataggcttgatacatggttcacaaacgagaataagaataacgacttcaagatgatatacgcaatgaagaatcaagggtttaatttccctaatctgctcgaagcacagggtctgtccaagcttgtgcagatgaaaggaactttctacacggaactgaaatggttattggtgctaaagtttgaagaatctactgatgattataacaagatccagacttatagaggtggtttaactgctgaagacagaatgttcgtgtaccacataacctatattctcaaccaaggtccaacgaccacacacaggtattcaaatgaattgggtactcttgatcgaagacatcatgttgaagagccatcgataaccaaaaggcgtctcaagaagcttgtgaagaggttttttgaacacgaatggaacatggatggagagccaccagcaacagcaaacatagaccagatggaaaaagaagcgaaagacgaagctcagcaagagctagcacaccaatga

SEQ ID NO: 97968 - DNA, 1026 bp, Glycine max
  Peptide Sequence Number=SeqID_214746
atggttgagcttttggcagtcatatgtactctcttctcagcccttgcctttgtttatcttctcaaatatcgtaacaaaaacaaacaagattccccacacaaattgccacctggaagcatggggtggcccttttctggggaaactcttggcttcctcaagcctcatagatcaaactccttgggaagcttcttacaagaacgctgttctaggtatggcaaagttttcaagtcgcatttgtttggttctcccaccatagtttcatgtgactttgagttcaacatgtatattcttcagaatgaagggacattattccctgttgattaccccaaggttatgcataacatactggggaagttttctcttcttcttgtcaaaggagaccttcacagaaagctaagaagcaccattattagttttgtcagtgcaacaaagcacgaatccaatttccttcactgtgtggaaatgcttgcactctcaaggattaactcatggattccaatctctaaacaagttgctttctacgaagaagctaaaaggtttacgattaatgttatgatgaagcacctattgaacattaatccagatgatccactagccttcaagattttagggaactttgagaactacatcaaaggctttatttcattgccaatacgtatacccgggacggcatatttcaaagctttgcaggctagaataagactctcagccattatcaaagatatcataatagagaggcgtaaatgtaataatgtgaggcctatgcaaggaggggacctcttgaatgtgattttgtcaaagaaaaacctaagtgatgaagagatggtgagcattgtgttggacctattgtttggaggttatgagacaactgcaaaacttctgtctttgattgtctatttccttggtggagcctctaatgctttagaaagtttaaaggaagaacaccaagagataagaaaaagaaaaaaggagggagaactacttaactgggaagattataagcaaatgaacttcactcaaatgtaa

SEQ ID NO: 97969 - DNA, 695 bp, Glycine max
  Peptide Sequence Number=SeqID_214747
atgacacgttcgaccggggatgtgaaaagagcgacgcaagaattttttgttgtgcactggctctctatgtgtggctggtttcacacccttttctccaagaaggtaggcccgtctatccgctacaaggtcaccgctcgaaggaagaatcaggattctatcttcatgcgaaggatgtccaaatgttcccttgatggaacaaggggttgtattaattataatcccgtcctcgccataagacagcttggctaccccatgagaggagtgccatcagacgaaagcatcacgcctttcatcgcacggggtttcggtgaccacaacgcgagggacagagagcttaggggaagcagtaatgggatcatcggcggctatcataagtggctgaaaggattggattggctcccaaatctaaagactgtgagagaggatgaggttaaagcttcggaagaaagtgatgaggtacaagccctaaaggcagagcttggaagagcccgggtagtcgaagagaagttcaagtccatagccatcaaagaatcatcacgggtcaaaggcatgatctccgaagaggtgaaaggattcatcacgggtcaaaggcatgatcttgaaggacgagctaaagggaatatgtgggccatcatcgataagtgcaaagagaagctaaatctagcggcgactcacgagcaaaggctagaggatga

SEQ ID NO: 97970 - DNA, 234 bp, Glycine max
  Peptide Sequence Number=SeqID_214748
atgaagagtgaaagagaaggagatggacattcaagcttcacgagaataagaaaatggtcttcaataaaggaagaggttgagaaaactcacctagacctccaagaacttaagccctcaacaatggaggaagagaagaagaagaagaagaaaaagaaaagaactccctctccctccccttggagaaccaacacacaaccagggggattgcttctcttctatagagggaagggttag

SEQ ID NO: 97971 - DNA, 201 bp, Glycine max
  Peptide Sequence Number=SeqID_214749
ggtgggatgatgaaagggaaaggaggtcaagaagctggttcaggtttagaagggttcccattaggagaagtgatgaaaagattcaaggaaggtcaagttcattttggtgacctttttgctgggaactacttgttcatgcatgtcaaccctacctcactcaagtgccttgaaagggatttgtccctctcaaaaattgcatag

SEQ ID NO: 97972 - DNA, 558 bp, Glycine max
  Peptide Sequence Number=SeqID_214750
atgggtttgaaagcaattcactcttctgatcaagtgcacctaatccagttactgatgacagaaaatataacattccccattttgttgtctcggcagaaaactcctaagatagagaaaggtgcgtgctacatattgtttaaaatttttagaagcccagtaatttatcatgagaaggatgcaggtcttgaaattctaagcaaagctgttcaggagttacaagagcaacctgatggtgattctaagtcacttaacctagtgagatgtacgtcattgaagcaagatgggatcattaaggatgaatgtagtttttctccgcttcagaatttacttctatattacccagaaaagttgactggcaaatttcctgagaatgagccagataaatcaagtctctgtcctttatctttccttttcagatattacatcttagagtatgcttttgcatggaattcagtagggaatgtatacattacgctgcttaaccaaaattctagctgttcgatagatttcccctcgtactggcatttgaacttggtacctcaggaaagtgtctcctaa

SEQ ID NO: 97973 - DNA, 285 bp, Glycine max
  Peptide Sequence Number=SeqID_214751
tttgtgaatttcacagagattatgtcaaagaacatccctccttcacgaaaagaggcatcatttgcacttgctgcattgatggaaattccttctcagtataaggcagcaatagagcttaatctactgggtactcggcaagtgaatgctcttcaaaggcatgccctcccacctcccacatataatcctcatgcagcaaggtttgagccaagtattcctcctcaacatggcaacagccacctagttgccacagctccttctgccccaagttccacttatgacaatcaa

SEQ ID NO: 97974 - DNA, 165 bp, Glycine max
  Peptide Sequence Number=SeqID_214752
atggtgcgtggagtaacactggcggagaatcttgaatggctttgtgggagtgttgaagaagcaagagcatggaagtttcgcgtttcgtatcggaactcgaacttagaacggtcatgttctgcgcttactgttacttgcggtgggtttggcaccgaacttacctga

SEQ ID NO: 97975 - DNA, 941 bp, Glycine max
  Peptide Sequence Number=SeqID_214753
ggaagaaggaagggaacaacttgctagggttgccgaatttcacagaattaggaaacgggcgtttcaagtgcttagaaacagggcacgaggtcctctcgaaggacatagcgtcctactcgcacagcaaaaaatgccgtttgggtctcatcgatttcgccttgtccaataacaaaccccctctcaacatgttcaaacaacaccctctctgccgttcaaagttgatatgtaagctgactggagacaatgtcaataagtcagaggaacatatctggaagcatatgagtgggaaaaggtttctcaataaattagagcaagaggaagaagaaaagttgttgtgtcatggattggaaggtgaagagagcttacatgagtcaaaaagtgcagatggtggaaaaaaggatagaatgaagaagaagaagaagaaaaagaatagggtcaaggaaattgatgaggagaaattgcaggtgtcaaaaagtgcagatggtgcaaaaaaagatagaatgaagaaggaaaataataaggacaagggaattgaggaggttatatctgaagttaggaagtcttccaatgagaacagtgacactgaagacgaagacttctggatgcctcctgctggtgatcgttgggacaatgatgatggtggcgatagatggggttcagagtcagagcagggaactgaagagggagatgtaattgatggtgatgctgctgaggattgcaaggagtcagacgagttgtcatcaaggacgaaaagaatgtcgatagaaattggaccaagcagctttgctacaagaaaaaagaaaaacatagccggtgaaattgacgaagatagaggagacaagatcgatactgaacggatggggccagaaggattgactgaagaaatagggaacagagcggaggaagacgaacttttatttcagaataattatcaagcatga

SEQ ID NO: 97976 - DNA, 258 bp, Glycine max
  Peptide Sequence Number=SeqID_214754
atgatcgaaccacttcaagaaacattgtcagaatcagaaggtggtcttttagcatcatggagtagtggaacttctaatgcagacttcacagtggcacaagatggttcagatgtatcaggggatgggttttgggcgagagatatgacatttgagaacagagcagggccaagagggcaccaagcagtggcattaagggtcagttcagatctatcagtcttctataaatgtagcttcaaaggcagaaatattaaagaatga

SEQ ID NO: 97977 - DNA, 348 bp, Glycine max
  Peptide Sequence Number=SeqID_214755
atgaaggcccaagtggagaaagatgaaggcctagaggcagaggcacaatcaagacaattaatgttgctgaaggcccaaactaatttgaaggcccaaacttatcaaggtaatccttgtggcgtctacccagacttatcttccttcattggaagtggcgtctacccagacttatcttccttaaccggaagtggcgtctacccagacttatcttccttcactggaagtggcgtctaccctgacttatcttccttcaccggaagtggcgtcatccaaatcttcgtagcctgtatcaaacgatccgctcctactcaggttcacatcatttggtatcagagcttcggctcttga

SEQ ID NO: 97978 - DNA, 258 bp, Glycine max
  Peptide Sequence Number=SeqID_214756
atggaaaagatagttaagcctgcatatgattttgactcttctaaggattcaatcacgagctacttaggcaggccttggaaacaatactcaaggactctatttctaaagacaaatttagatgggttgattgacccaaatggatggggtgaatggataaaagactttgcactttcaactttgtactatggagagtatatgaacacaaggagtggtgcctctacccaaaatagagtgacatggtctggtttccatgtttga

SEQ ID NO: 97979 - DNA, 243 bp, Glycine max
  Peptide Sequence Number=SeqID_214757
atggaagttgtgctcccttttaaggtagagattccttctttgagaattctagcagaatcagggttgggagaagcagaatgggccagacataaagatcttcaagggaaatgggccccaaactatgaaggaccttttttggtgaagaaggctttctcgggtggagcactgatactggaaaacatggatggtgaagaactgcctttgcctgtgaattctgatgtcgtcaaacgatactatgcatga

SEQ ID NO: 97980 - DNA, 213 bp, Glycine max
  Peptide Sequence Number=SeqID_214758
atggtcatggacatggctgacacattgggagaaggattttggaaatgggcttctttatacgaggaccctatacagctgcaatgtgacatcttgaaggaaatgggcttgtcttataaggaagaagatagcaaggttaaggggctactgctggatatggagaataaagatgatttgatggcaacagaaaagggaattaaatctcagcaattatga

SEQ ID NO: 97981 - DNA, 285 bp, Glycine max
  Peptide Sequence Number=SeqID_214759
atgcaatcacatggactcgcactgcctccagagcctaaggttggtcctccagctgctcgtgtcagcacaaagttgagttatgttgatcccttaaggaacaatctagacatgggtgactcagacaaatatgagttatacatcgatgaaaatcctccccgcttggttgccctaggaagaatttatgagggatccacaatcattcacaactttccttcactggagttgtgggacccgcgaaacctgcagataggccggatcatgatgtcgatgatcccctatatctga

SEQ ID NO: 97982 - DNA, 381 bp, Glycine max
  Peptide Sequence Number=SeqID_214760
atgaaacgaaggggaaggggttttatagggaagagggaagtgcctgggggcccaccactagtggacgcgcctgacaggctaccactagtggtcgcgccaggcaggccaccactactggtagcgcctggcaggccaccactactggtagcgcctgcccatgggcccgaaaactaccctaaggctcatgagaaccctgaggccttctcttgcatctctgggataatcttcttggagtcttctatccaatgcccttggggggtaggattgcatcatatattgaaccattatatgacaagacatgatttacaagaggcttatttacctgctacacttttatttgtggttgccaaatattatgatatagatttaaatactttgtaa

SEQ ID NO: 97983 - DNA, 589 bp, Glycine max
  Peptide Sequence Number=SeqID_214761
atggaatcaagcaatgtgaagaacaagtcaagtggaaaaagaaagatgtctagtgaggacacaagaagttacttcgcatggaacttggaaatggagcgtgtgctagctgatgtgcttagagatcaaagaaatttgggcaataaaggtggtggaaattggaaagcagtagcatatagtactgcaactcaaattttgtccaagcgttttggagttcacctcatggcagataatgttaagaatcgttttaagctttggagaacatggtatggaattgtgagtgtcattcttagtcaaagtggatttgactgggatagcataaagtacatgattaccgttgaaaatgaaattgcatggagtgaatatgttaagtcacatgaagaggccaaacaatttcgattcaaagtcattcctaattgggatgatattgttgacctatgtgcaaaggatagagctattggactcggagcagaaaatgcattagatgcagatgatatcatgagcaaagaaacaaatgaagaggaagcaattcatagtgtgagttttgacttagagggatcaagttctgccacgagaaaaaacattcgtccaa

SEQ ID NO: 97984 - DNA, 315 bp, Glycine max
  Peptide Sequence Number=SeqID_214762
atgcatcctccacccaaagagtttggagctatgcttcatgattgcctaagtgtggaccctctagtgcaatcctccattctcccctttttttcggagccccatgaatgtcattgcctagcgttgtccatgcttcctccacccaaagagtttggagctatgcttcatgattgcctaagtgtggaccctctagtgcaatcctccattctccccttttttcggagccccacgaatgtcattgccaagcgctgttcatgcatcctccacccaaagagtttggagctatgcttcatgattgccaaagtgtggaccctctag

SEQ ID NO: 97985 - DNA, 513 bp, Glycine max
  Peptide Sequence Number=SeqID_214763
atgggaaggatccctttgtctgttaaaaataattatgctaggaacaatcacctgaaaccagatgatgggaatgttcaagttgctatccccagacccaaccctcttaaattaggcatttatggatggggtctttttgctcgtagagatatacaagaaggagagatggaggcagccactgacttgactacattgttaattgagttattcaatagtgatcacatcctccaaaagagttctttcttcattgtggcagagtcttatggtggcaaatttgctattcataaaggaaaattaaagcttaaacttggaggtgtggtgttaggagacagctggatctctcctgaagattttgtgttttcatgggggcccttgcttgaatacctctcaagacttgacgacaaggagatgcaaatatcaaacgagtatttcaattttccaccttacataaacacattgatgaaaagcactgaaacaatttcaaaaatggatgagagagagatgcacacttcttaa

SEQ ID NO: 97986 - DNA, 441 bp, Glycine max
  Peptide Sequence Number=SeqID_214764
atgaagccttggatagaatactacaacggcccggtcccctatgaacatttatcagcaaggcataaaacacttgtgaaaatgaactacatgctgatcacatctgaagtgctgtcgcgtctctctgacctcttcatactgagagcgttaatagttatgattgtgtggacgtgctcctacagggacgtgtggagctactacgagtcagacgtggtggtaaggtggttcctaggcgagtacaagtctaagtcggagatccataggagggcaaagaaatttaggggagaggtagtgtctaatctccctggggaagttgagaaaggaacaatacttgtcagcagcgtcaagaagcctcttggctcgggctggagaaaagggttggacaagttggctgagggacaatatagccttccttccctcctccacgttcctggaggactttag

SEQ ID NO: 97987 - DNA, 171 bp, Glycine max
  Peptide Sequence Number=SeqID_214765
atggcgccgcctcttaccttttctcctttgtcttccgctgcatctccatgggctagaagatctgaggccccatctgcatcagctgcccctactccccctacatcagctccatctacttctgctcttccttcaccatcagcagctccagttcatccaggtccctccacttag

SEQ ID NO: 97988 - DNA, 261 bp, Glycine max
  Peptide Sequence Number=SeqID_214766
atgtttgaatccttaaagacaaacactaactggatgaagaatgaagaacgaatgaagaacgatgtagaagtcgactacggtcgcaagccagaggctagcctggacgagccaggggttaataaggcgagatggtatagtgctgattttcaccctctcgctaagaaaaccttttggcttagcaagccatccgctgagcgcgaggaagaatctggaagaaggatgagctgtgcatgttcgctgagcgaagggccatcccgctaa

SEQ ID NO: 97989 - DNA, 1042 bp, Glycine max
  Peptide Sequence Number=SeqID_214767
gtcctcaccttcagaggactacacgtcctcgccttcagaggactacacgtcctcgccttcagaggactacacgtcctcgccttcagaggactacacgtccttgccttcagagggttgcacgccctcacctttagaggaatacacgtcctcgccttcagagggctgcacgccctcaccttcagaggattacacgtcctcaccattagagggctgcacgccctcacctttagaggattacacgtcctcgcctttagaggcctgcacaccctcaccttcagaggactacatgtcctcaacttcagaaggatgcatgccctcaccttcagaggactacatgtcatcgccttcagaaggttgcacgccctcaccttcaggggactacacgtcctcgccttcagagggctacacttcctcgccttcagaggactacacgtcctcgccatcagagggctgcacgccctcaccttcagaggacaacatgtcctcgccttcagagggctgcacaccctcacctttagaggactacacgtcctacttttcggaggactacgtgtcctcacctttagaggactacacgtcctcaacttcagaggactacataggactacgtgtcctcaccatccgaggactacaggccctcgccttcagaggactacatgtcctcaccttctgaagactaaacgttctcgccttcagagcactacatgtcctcaccttcagaggactacatgccctcgccttcagagggctacacgtcctcgccttcagaggactacatgtcctcgccttcagaggactacacgtcctcgccttcaaaaggcttcacgccctcaccttcagaggactatacgtcctcaccttccgagggctgaatgccctcaccttcagaggactacacgtccttgccatcacagggctgcacgccctcaccatcagaggactacacgtcctcgccttcagaggcctgcacaccctcaccttcagaggactacatgtcctcgccttcatagggatgcatgccctcaccttcagaggactacac

SEQ ID NO: 97990 - DNA, 546 bp, Glycine max
  Peptide Sequence Number=SeqID_214768
atgagtgatgagaataatgaagaaccttgcgaaaaccgtccggttccccgtttaaatgaaaggattctttcatctttgtctaggagatcagttgctgctcacccttggcatgatcttgaaattggacctggagcgcctatgattttcaattgtgttgtggagatcactaagggaagcaaggtcaaatacgaacttgacaaaaagactggattaattaaggttgatcgggttttgtactcatcagttgtttatcctcataactatggtttcatcccaagaactctgtgtgaagacaatgatccaattgatgtcttggttctcatgcaggagccagttcttcctggttgtttcctgcgagccagggccattggattgatgcctatgattgaccagggggagaaggatgataaaattattgcagtatgtgctgatgatccagaatataagcactatactgacttcaaagaacttccacctcatcgcctcatggagattcgccgcttctttgaagattgtatccttaaaaatcttattccaataacttga

SEQ ID NO: 97991 - DNA, 546 bp, Glycine max
  Peptide Sequence Number=SeqID_214769
atgcaattctggaaggagctaggtagtccattcaacaggatccatggcaaacaagtgtttgaggattttcacatgaactcaagcttcaatcagcttttcatggcagcaatgaccaaccgtgcgactttaattacgaaaaagattgttgaatcctacaaggggtttgagaacatcaataagctggtggacgttggtggtggcgttggggccactcttaacataataacttcaaaataccctcacattaagggtatcaattttgacttgcctcatgtgtggagcatgtgggaggagatatatatgtttgaaagtgtgccccaaggagatgccattttgatgatgtgtgtgcttcatgattggagtgatgaatggtgcttgaaggtgttgaagaactgctatgttgcaattcctaacgatggaaaggtgattgtggaggaagttcttccatttgaacccttaacaacaggtgcagtaaagagtatttcccaatttgatgtactgatgatgacaacaaacccaggagccaggagggaaagagagaagtga

SEQ ID NO: 97992 - DNA, 411 bp, Glycine max
  Peptide Sequence Number=SeqID_214770
atgacacgcaccttcgtgtcaatatttttggtcagttccgccagttccggcgactccggtctcgaccgaaggcagcgacagcgagagaggaggagcacgctttccagatcctatggcattaccaaatcctggaccccgacagcgacatcgtggcctattggaaccgggtgttccttgttacgagcctcctcgccctcttcatcgaccctctctacttcttcctccccaacgttggcggccccgcctgcctccaggctgatcccaaactcagccaggagaggaagcggcgacagcggtggaggaaggaaggaagaagtggagcgagaggagggattggaggacttggtgaggagggtttggaggggaggactggggtactgcaaatgcggcgtcatacgaacctatagctag

SEQ ID NO: 97993 - DNA, 301 bp, Glycine max
  Peptide Sequence Number=SeqID_214771
taccccagtcctcccctccaaaccctcctcaccaagtcctccaatccctcctctcgctccacttcttccttccttcctccaccgctgtcgccgcttcctccgccgtcgacgaccaatccgagttcatctacctctcctggctgagtttgggatcagcctggaggcaggcggggccgccaacgttggggaggaagaagtagagagggtcgatgaagagggcgaggaggctcgtaacaaggaacacccggttccaataggccacgatgtcgctgtcggggtccaggatttggtaatgccatag

SEQ ID NO: 97994 - DNA, 390 bp, Glycine max
  Peptide Sequence Number=SeqID_214772
atggaagaagaaagcttcacctacgccatgcagctggtgaactccaacgtgctatccatggccatgtactcagccatagagcttggcatatttgacatcatagccaaagcaggtgaagctgccaaactatctgcaaaggacattgcagctcagcttccgctcctagcatgtcactccatcattgactgcacagttgttgctgatcagcatgctcttcctatacatttgcagaggctctatggcatgaacgctgtggccaaatactttgcttccattgatgatggtgctggctcactaggcccttttatgatgttggctcaagacaaggctgcacttcaaacttggtcagtttttcccttcttgtactctactctattgtcaggagagtga

SEQ ID NO: 97995 - DNA, 291 bp, Glycine max
  Peptide Sequence Number=SeqID_214773
atgccttatcccactaggtggggtcggctacatggatcaacttccgccatgatgttctatcaaagagttatgaactgtaatccacgtcaacagtcaacacatgcgtttggaagtggcacccagcaattcttaagggcacaaaggtctcacattaaaggcagacctctcaaatatcaagtttccccacttgttgatgtaacatctccaactgtcaacacatgggtttgtatgtggtacacagcaactcttaagggcacacgtacgatcaagatctttggccgatatttttaa

SEQ ID NO: 97996 - DNA, 276 bp, Glycine max
  Peptide Sequence Number=SeqID_214774
atggcctcaacctcttctgctctcactatatcctcttcttccacccttcttgatggcaaggctccaagacagtcaccagctgcttcccctcaatgtgtgagcctcccccctccccctttgcactctcagaaccgttcatggaagaccactgcttattgtcgcaaggttgctcgaaaagttatggcaatggccacaggagaggcaccagctgaagctacctcaactgaggtgccagagattgtcaagactcttcaagaaactgtaagagtctcttaa

SEQ ID NO: 97997 - DNA, 153 bp, Glycine max
  Peptide Sequence Number=SeqID_214775
atgtggctcaagttcctttccttttttttggtgtcagaattgcttgataatttggaaatgagtgtggagatgctgttcccagggttggagatgcagcagaaccactcgtttcttttcttctggatagtgtgtgctgacatggctgcaagatag

SEQ ID NO: 97998 - DNA, 1162 bp, Glycine max
  Peptide Sequence Number=SeqID_214776
atggaaccatatattccttcttttgaattaaagttggggtgtatgaaattctttggagaccctttggaagtgaattgtttggaccaagttctggtggatgaagaaagcctgagactagaagaggaagagcagtttctgatatcaagcttagaggacaacatgccgttccttcagatgcttcagagtgtggaatccccacagtttttccctttgaaagagccaaactttcaaacacttctgaggctgcagcacatgaagaagccatgggagggaatagcctacattccaagaatggaagcacaagtgcaagcagcattggagctagagagttgtgtgacacatgacatgttggagatgcagtcaccagtgaagtcagaaagcaatgaactccaacacccactttcaatttcatgttttgagaaagtgaactatgagtgcaaccaggaaccacagaaagtttcacaaacatgccccaaatctcagccagcagcaacaagggaaaggagaaagagaaagagaacaaggccaagcaagaacaaggaagatgtggagaaccaacgcatgacccacattgctgttgaacgcaaccggcgacgccaaatgaatgaccacctcagtgtccttagatccctcatgccaccttcatatattcaaaggggtgaccaagcctcaataattgggggagcaatagattttgtgaaggagttggagcagttgcttcagtcccttgaggcacaaaaaaggatgagaaagaatgaagagggtggtggtggttcttcttcttccaccatgttgtgtaagcccccaccaccatcgtcattatcatcaccacatggctatggaatgaggtcatcaactagtgatgaagtgaactgtggggatgaagtgaaggcagaaaacaagtcagaggcagcagacataaaagtgaccttgattcaaacccatgtgaacttgaaaattgagtgccaaaggaggccaggacaattgttaaaggtcattgttgctttggaggaccttaggctaaccattctgcacctcaacatcacctcctcagagacttctgtcctttactccctcaatctcaagattgaagaagattgtaagctatgttcagcaagtgacattgcagaagcagttcatcaaatattcagcttcattaatg

SEQ ID NO: 97999 - DNA, 363 bp, Glycine max
  Peptide Sequence Number=SeqID_214777
atggcttcttcatgtgctgcagcctcagaagtgtttgaaagtttggctctttcaaagggaaaaactgtggggattccacactctgaagcatctgaaggaacggcatgttgtcctctaagcttgatatcagaaactgctcttcctcttctagtctcaggctttcttcatccaccagaacttggtccaaacaattcacttccaaagggtctccaaagaactgcaagagaaagaatatatcacaaggaattaaaaataatgaaatggggttggaggaaaaggaaaaggaagaagaaagaaaaagcggtggatgggaaagaattgaggggtccttggagcctttccatgatgaaagctgagcagtag

SEQ ID NO: 98000 - DNA, 708 bp, Glycine max
  Peptide Sequence Number=SeqID_214778
atggattttccgaatagagatcttggtgctttggtttctattcaaatgatatggttgcttgctgggattctggtatatgaagccattgatagaatcattgctggtcctaaaaatgtggatgatcagcaccatcacacacaccatcatgatgaaaaccatccaaaagatgctcaccatcatactgatgaagatcacttgcaccatcatgctcacaaagaggttactgaactgcttcttggtgagtcaaaaggtggaactaagaagaagaagcaatggaacataaatgtacagggggcttatctccatgttcttggggactctatccaaagtattggggtaatgattgggggagcagtcatatggtataaccctcgttggcaaattgttgatttaatctgcactctaatcttttcagtaattgttatggggacaaccatcaacatgctgcgaaacattttggaagtcctgatggagagcacacctcgtgagatagatgctactaagcttgaaagggggctgttggatatggaagatgtagtggccgttcatgaactgcatatatgggccattacagtgggaaaggttttgcttgcatgtcatgttaagatcagacgtgaagcagatgcagacttggtgctggacaaggttatagactatatcaaaagggtttataacatcagccatgtcaccatacagatagagcgttag

SEQ ID NO: 98001 - DNA, 738 bp, Glycine max
  Peptide Sequence Number=SeqID_214779
atggcagaaatgcagatacaacatcaagaagaccataaccataaccctaatcacatccttcgccctaaccctaaccctaaccctaaccctacacaatacacacattaccgcttccctggcaaagttccccaccaccaacaccaagtccacaacatggacaaaggcgcagcttcacgcttcaaacccaatgcccccaaacgtgaacactgcatttgcatcaccgttttcctcctcctactcggcatcatactcctcgttctctggctggcctaccaccctaccaagccgcgcttcacggtggccagcgccgccgtctacggcctcaacgccacctcgccgccactcatgtcaatcgccatgcagttcaacatggtcataagaaaccctaacaggcgcgtctcaatttcctttgacaggctctccgcctacgtgtcctaccgcaaccagcccgttacgccgcatgtcatgcttccgccgctcttcatagagaagcacagcgccgtgtcgctgtccccggagatcggaggcgtgccggtgccggtgtcggaggacgtcagcaatggactggccatggacgagaattatggggtggtgggcgtgaaacttgtgttgtttggaaggttgaggtggagagctggtgacataaactctgcacattatggattgtatgtcaagtgtgatgttttgatgggtttgaggaaaggttttgtgggtcaggttcctcttcttggtgctcca

SEQ ID NO: 98002 - DNA, 294 bp, Glycine max
  Peptide Sequence Number=SeqID_214780
atgaggcctagcgagagcattgaagcgaagaagcttgcgagtggatccaaggaaggaggaagaagggttgggtttggagtgatcgaaggagaaagagagaggcttgtcattggatctgggggtggtggaagtgagagggagaggagaagggaagttgaaccaaagaagtgggtgttattatatagaagagaagtggcagaaagaagcatatttggttttgttagaaccatttttattttggataattcaggggctgctgtgaatgatatcattgttgatgaatttaaggattga

SEQ ID NO: 98003 - DNA, 1350 bp, Glycine max
  Peptide Sequence Number=SeqID_214781
atggagctcgacctccgttcattccttcactctccgacctccacctcctcctccgacgccgacgccgacgacggcgctcctccccgcaccatcgatgatattctcaacgactgtgacacttcctcttcctcaccctcccctccttcttctccctctcactcactctccaacaattcccgccctcaaaaccccacactccaacaaaaaccactccaacccgcacccgattcgttttctcgggtcaaacccgctgaattctccgaccgcgcacgcgtttcgcgcccgttctcctctctcctgcacggcgtcaggtccaatgccaagcccggcgcggcgctcgccgcggcggcggcggcgtctcgatccgttcctacgccgcacgcggcggcgatcatctcccgtaggaaatccgcggctgcgaatattgtcgaatcgagttcgatcgctgccaccggcgatgtttcttccaaaggcgagttgggcgagcctagcgagaaattcgatccagtgccgccgaaaatcgagactccgtctagtgaaagtgcttctgctattggtgaacgttttgagattgatgcggaaattgtcactgatttgaaggctggcagtgatgacattcaggtgcacactgataataataataataatgctgatgatgatgatgataatgataatgattcttctatcgtgagtgaggaaaagagggatttagatgaggttgaccgtgatcatgagaaggatatgaattctgcaccgtttgatgacgatgatgatcgtgggtttgatggaaaaggcgatgatgagagaatcactgctacgggtgtagctgtggaaacagaagaagaagtagtagtgagtaatgatattagttctatggaagatgttaagaatgaggtgagtgttggtggtgatgatgagggtagttccttaggtgatgttgctgagctagtggaagagaggcttgaggaattggaaaacagaagggctgctaagagagctgagaagaaacgggagtcttcgatgaagccacttgaattggccgaggaactggagaagaagcgtgcttcaactggtttgcatttggaagagggtgctgctgcccagccaatgaggcttgagggcgttcggagagggtccacgacattgggatactttgatgttgatgctggtaatgcgttcacaagggcaatttcgtcccaaacattcaggcgtgagcaaggttccacccgagccttggcagttcatgctaattacattgcagtaggaatgtcaaaagggctcattgttgtgtttcccagtaaatattccattcaccatgctgacaactctgatggaaaggttggtgcctga

SEQ ID NO: 98004 - DNA, 735 bp, Glycine max
  Peptide Sequence Number=SeqID_214782
atgatgcttgctatacaaggtgatcggttgcatgctccagtgacatccatgtctttcaatcaacaaggagaccttcttttagctggttatggtgatggccatcttaccctgtgggatgtacagaaaggggtagtggcaaaagttattagtggtgaacatacagcaccagtagtacatacattgtttctaggacaggatcctcagaatactcgtcaatttaaagcagttactggtgattgtaagggtctggttctcttccacatcatctcagtggttcctttgtttagtagattctccatcaaaactcagtgtcttcttgatgggcaaagtacgggcttggtgctttcagcttcaccactcctttttgatgacttcagtggaagtgcttcgccttatacccagggaaacacctcagccccagccagcagtataagcagcatgatgggaggtgttgttggcggagatgcaggttggaaactcttcaatgaagccccttctttggttgaagaaggtgtggttgtatttgtcacccatcaaactgctttggtggtacggctgagccctacgttgcaagtttatgctcagctctctaggccagatggagttcgggagggttccatgccatatactgcatggaaatacatgacacaaatatgtagttctactgataaaacagtacaagtggtacttaacaaaggaaatacaaagcacctctggtgctgcctcccaaaataa

SEQ ID NO: 98005 - DNA, 3621 bp, Glycine max
  Peptide Sequence Number=SeqID_214783
atgtctgcagaagctgttgaaagagtttcattgcttgcaattgcttgggaacggaaggttttggttgcaaagttggtcaaatcagaattaaaagtatatggaagatggtctcttgatggtgcggctttaggtctagcatggttggatgatcagatgctggtagttctcacttcaagtggacaactgtatttattttccaaggatggaactgtgattcaccaaacaagtttttctgtagatggtattggaggagatgatctagtctcttatcatactcacttcatcaatatatttggaaatcctgagaaagcttatcataactctgttgctgtaagaggagcttctatttatatactgggcccaacacatcttcttgtttctcgtcttctcccttggaaagagcgtatttctgttttgcggaaagcaggtgactggatgggtgccttgaacatgggaatgactctttatgatggccatgctcatggagttgttgaccttcctagaaccttggatgctgtacatgaagccataatgcccttcttgatggagttgcttacatcatatgttgatgaagtgttctcctatatttcagtggcattctgcaatcaaattggaaaactggaccaatccaatgattcaaatagtagaagcaattcagtgcattctgagataaaggagcaatatgcccgtgttggtggagttgccgttgaattttgctgtcatatcaaacggacagacattctttttgatgaaattttcaacaagttcgtggatgttcaacagagagaaacatttttggagcttctggagccctatattttgaaggacatgcttggatctctacctcccgagattatgcaagaactggtagagtattatagcaccaaagggtggttacagcgggttgagcaatgtgtacttcacatggatatatcatccttggattttaatcaggttgtcagattatgccgggagcatggactatatagtgccctggtgtatgtcttcaataaaggattagatgattttagggcacctctggaggagttgtttgctgtcttacaaaatagccaaaaggaaagtgctactgcgcttgggtatcgaatgctggtttatctcaagtactgctttacaggtcttccctttccaccaggccgtggaagtattcctccctcacgtttaccatctcttagaagagaacttgtagagtttttgttaaaggacacctgtactccgaaatcacagacagtttcagactttgtgtacagacgaccacacctgaatctttatcttctcttaaagttagacactgaagctacattagatgtcctcagatgtgctttcatggaagatggaatttcaaatgccagctcatcttcaccagattcagccaataaacctataacggaagcaaaaaaggaaaatgataatgttaacaaaactcaaaatgctttggttcagaacacagttgatgctctcattcaaataattgatatgaatattgttcccacagataaaacctctagtagtggtgatgatgggttgataaaagattgtccttccaaggacataggttatttgtttgagttcattgcatattatgttgctctccaaagggctaagatttcaaagggtgtgctttgtcaaatattggaatatttgacatcagatagtcagttttcaactaatgtttctgttcaaggatcatctccaaaaaatagagagaagcaagtgcttgcacttttggaaatacttcctgaatcagactgggatgcatcatttgtgctagatctatgcgagagagcaaaatatcatcaggtttgcggattgattcatagtatcagacatgaatatgtggcggcattggatagttatatgaaagatgcagatgagcctgttcatgctttctcctttattaacagagcattctcacagttgactgacaatgatcatgcagcttttcggtcagcagtcatatttcgaattcctgagttggttgaactaagcagggagggcgcattccatatggttatcagtcattttagcaatgaaagttcccgtatcataactgatcttcactgtcatccaagaagtcttttcctttatttaaagacactcattgagcttcatttatttggcaccctagacctgtctaatttgagaaaagatggtactatgaatccccttaatggaaggcaggttaaggatcacccacaaggagtcagagattacttagagaatatatctaatttccccaagtacatgcgtgaaaatcctattcgagttcctgatgatcttattgagctttaccttgagttattatgcaagtatgaaggtggttcagttctcaagtttctggaaatgtttgatagctatcgagttgaacattgtttacgcctgtgccaagaatatggcattatagatgcatctgcgttcttattagaaagggttggtgatgttggtagtgctctttcacttacactttctgatctatatgataaatttgttgagcttgataccgctgtggaagctgtagttttaaaccatcgcagagttggttcttcacatatggaagtattcaacagtgttttgaaaacaaaggaggtaagtgacatccacaatttattgcgtgcctgtattggtctgtgtcagcggaacacccctcgtctaaatcctgaggagtcagaggcacattggtttaaattacttgactcgttttgtgatccattgatggattcaaatgttgaagagagagcatatgaaagtaagagttattttggaatgctagctggatcagcagattcacaacaggacaaagacacccataaaagcagttggaaaatttcaaagtcctggactggtcatatcttgaaaaaattgctatcccagttcattaaagagattgttgagggaatgatcggttttgttcaccttccaactatcatgtctaaactcctgtctgataatggtagtcaagaatttggtgattttaaacttacaatattgggaatgctgggaacatatggctttgaaagaagaattctggagtcaaagtattgttctaaccttggaccggatgctgccaaatcattaatagaggatgattctttttatactatgagtttactcaaaaaaggggcctcccatggatacgctcccaggagtctcgtgtgctgtgtttgtaattgccctcttacaaagaactctgttagctctggaattcggattttcaactgtggccatgcaattcatctccaatgtgaagtttcggaaattgagggatcgagcaaaacatcttcatctggatgccctgtatgccctgtatgcatgcccaaccagaaatcccagcagtctagaaacaaatcaatcattgcagcaaatggcttggtcaataaattctcatcaaggcctcaatacccccatggaagttccattcatcctcatgacagtgatttatcagataatatgtatggacaacaacagatatcacggttcgagatcttgagcagcttgcagaagaatcggagatttatgcaaatagaaaacttgcctccattgaagcttgccccacctgctgtgtaccatgaaaaggcaaggagaagaccaataagcggtgactaa

SEQ ID NO: 98006 - DNA, 1155 bp, Glycine max
  Peptide Sequence Number=SeqID_214784
atgaatcaaaatcaacatattgaagttgttatatctaagcaatctgaacaagttcgtgacttgtatcgaaggcgtttgacagtgtcaattgattgtatttgttttctattaaagcaaggattagctttctgtggtcatgatgaatcaaccaattctgctaaccaaggtaatttcctggaacttcttagatttcctgctgaacacaatgaatcaataaatcatgatgtcttggaaaatgctcctgaaaatcatcaattaattgctccaaaaatccaaaaagatattgtcaatgctattgcattagaaaccactaatgctattattactgatcttagagatgaattatttgctatcattgttgatgaagcacgtgacatatcaaacaaggagcaaatggctattgctttgcgttatgttaacaaaaagggaagtattgttgagcgtttttttggtatggttcatgttaaagatattacagctttatcattgaaaatggcaattgatgaattattttgtaaacatgggcttaatatatcaagaattcgtggacaaggttacgatagtgctagcaacatgcaaggggaattttctggtctcaaaagtttgatcttaaaggagaattcatctgctttttatgtacattgttttgttcatcaattacaactcacattagttgctgttgcaaaaaatcacattcaagttgcctctctttttaatttggtgtccactttattaaatgttgttgggggatcttgcaaacgacatgacatgcttcgtgaaaaacaaataaattatgttagaaaggcattgggaaaaggagaaattcctagtggacaaggtttgaatcaagaaactagtcttaaacgagctgttgatactcgttggggttcacattatgcaactttgatcaatttgatattgatgtattcttctatagttgatgttcttgaaattataaaagaagatggatcaaatgcagatcaaagagctgaagcaaatggtcttttacatttgctagaagattttgattttgcattcacattgcatttgatgaaaaatgtcttgggtatttcaaatgaattgtcacaggcattgcaaaggaaagatcaagacatcatcaatgctatgaacttggttaacatcacaaagctatga

SEQ ID NO: 98007 - DNA, 858 bp, Glycine max
  Peptide Sequence Number=SeqID_214785
atggtgggtgataacatcaattcaaggcaatataatattgatataaattctaccaaaatctttgttggagggttggcttgggagactcagagggacacaatgaggaggtattttgagcagtttggagagatcttagaggctgttgtgatcacagacaagaacactctgaaatccaagggttatggttttgtcacattcaaggatccagaggcagcaatgaaagcatgtcagaacccctctccaataattgatggaaggagggcaaactgtaatattgcatctattggtgcaaacaagaatcggacacgggctccacaacatcaacatggacggtctagagcagcacctggtgtgttggcctcacctgcttatcatggcacttcctctacatttgtccatcaaaacagtgggcaatacacatttcccaattcaagttttggatacactggatattcacaaggcacaatataccccctgagctgctatggggtatttggaggtcaacaaatctcaacttactacccgtccaatggggcatctggccaagtgggattggttcataacatttaccctttcagtgcccaatattcatacaatagccattctcatggttttggagtacaatatccacaaatgatgcagtttccaattctccctaggcactatggttcagctggtatccttgcacttccttcttcaatgccaatgccaaatattagtgcagttacaacaacagcaactacaacaacagcagaggcaataagaacaagtgtaggaacttcacaaaccgctggaacaacttctgaacaaaattcttctgctgaatctctacatagacaaacccatgatgccttgtaa

SEQ ID NO: 98008 - DNA, 126 bp, Glycine max
  Peptide Sequence Number=SeqID_214786
atgtacagagggccttggaggttgaggtcgcatgtggatctaggtgatggtgtttggatcatttggctcgcaatggtgcttgtggaggcatgccggcagcgtcgctgctttagactcgactacaag

SEQ ID NO: 98009 - DNA, 1626 bp, Glycine max
  Peptide Sequence Number=SeqID_214787
atgacgatgatgatggagttgggtggacccagagtgatcggggattacatagtgggtcctcgaatcgggtcgggttcgttcgcggtggtgtggcgtgcaaggaatcgaagttcgggtttggagtatgcggttaaggagattgataagagacacttgagtcccaaagtgagggaaaatcttctcaaagagatttctatccttagcaccatccatcaccccaacatcattcgactcttcgaggcaattcaggtgtcatgtttaatatctgatagtgtcttagatagtattgtctccaaaggaggatgcttgtgggaaactaaaaaaaggatttaccttgttttggagtattgtgctggtggggaccttgctgcttacattcatcgccatggcaaagtttctgaaccggttgcacaccatttcatgaggcaattggctgctgggttgcaggtgcttcaagaaaagaacctcatccatagagatttaaaaccacagaatttactgttggcaactactgcagctacaccagttatgaaaataggggattttggttttgcaaggtctctcacaccccagggattggctgatacgctatgtggttcaccctattacatggctccagagataattgaaaaccagaagtatgatgccaaggctgatttatggagtgttggggcaatattgtatcaactagtgattgggaggccaccatttgacggaaatagtcaattgcagctttttcaaaatattttggcatctactgaactgcactttccgccagatgcattaaaagtgctacattctgattgcttggatctttgcagaaaccttttacgtcgaaacccagatgagaggttaacattcaaggcattcttcaatcacaatttcctacgggaacctaggcctaccgtgaatgttgagcagtttcaattacatcaatcagaaagattgacagatcatcaattaggtgtctctgcctccgagaagatttctcaatcacattctaagtatcatgttgtagataatccagtggtagtcagttcagctgctgatgaaaccatgctgttgcaaagaaaggatggcaagattacagctggtactaagagtgctaaagggtcaactccaactattgcaagtgataagctggggaaggctgttgatgctggtgctcatttgtcaaaccaacccctaggtttaattgtctctggatactgtgtagcattttcccatttaatggagtccattgagaaagattatgtctttgtcaattcccatttcgcatcattcgaagctttctctgactactttgaagcatctgtgcaaaatatttcctcacataggatttctctgttttcttctaagaggactaatatggaggttggacatgcaaaacaaacaaaggatctgcccttttcctccactgaagtattagaaaatttaaaaagcaataaacaggaggcatgtgtggcttcctgtgaatttgctgccttaaggaaagagaatggaatttcctcactgctcccttcaaacagattacagctgttgcatcagtatgtgcggatccttgctgaactttcacaagaaaaggtaaggttgtgccattcagttaacctaaggtcattatgttaa

SEQ ID NO: 98010 - DNA, 1161 bp, Glycine max
  Peptide Sequence Number=SeqID_214788
atggagagaggcatttttgtgtccacgtctgcaggaaacgaagggccattccttgcagtgcttcataatggaataccatgggtcataactgtggctgctggcactttggaccgtgaatttcagggtactctcacgcttggaaatggagtccaagtaactggcatgtctctctatcatggaaacttctcttccagcaatgttcctattgttttcatgggcttgtgcaacaaaatgaaggaactggccaaggcgaaaaacaagattgtggtgtgtgaagacaagaatggaactatcattgatgctcaagtggctaagctgtatgatgttgtcgcggctgtgttcatttcaaacagctccgagagttcttttttctttgaaaatagttttgcatctattattgtttccccaataaatggggaaactgtcaaaggttatattaagagtactaactctggtgctaaaggaaccatgtcttttaagaggacagttttgggcactagaccagctccgagtgtggatgattacagttctagagggccttcaagtagttgtccatttgtgttgaaaccagacatcactgctcctggtacatcaatcttagctgcatggccacaaaatgttccagtggaagtgtttgggtcccataatattttcagcaacttcaatttgttaagtggcacatcaatggcatgccctcatgttgctggtgttgcagcattgttgagaggagcacaccctgaatggagtgttgcagccattaggtcagcaattatgacaacatcggacatgtttgacaacaccatgggactcatcaaagacattggtgatggttacaaacaagcctctcctttagccttgggagctggtcatgtcaaccctaatagaggcctagaccctggactggtgtatgatgtgagagttcaagattatgttaatctcctctgcgcacttggctacacccaaaagaacatcaccatcatcacgggaacctcttcaaatgattgttccaaaccctctttggacctcaactacccttcttttattgctttcatcaatagcaacggttcaagtgcggcacaagaatttcaaagaacggtgaccaatgttggggaggggaaacaatctatgatgccagcgtacacccgtcaaaggtaccactga

SEQ ID NO: 98011 - DNA, 1479 bp, Glycine max
  Peptide Sequence Number=SeqID_214789
atgatactactgggttatcatgccattggtggttacaaattgtttaatccagtaaccaaagaagtgctcgtgagtagagacatggtagttgatgaatccaaggactggaattgggataaagagatggtagagaagcctacaaaagttgtaattgaagctcctattgatgagccaagtgattattttgctgtagtaattgatgatagtgaccaaggaagagtaaggaaatcacagagagctagacaagtctctagcaggttacaggattatgaattgatacatgattcagcaataggggaggaaggtgagctagtacacttagctctatttgctgaatctgaatcactaaaagctattgaaaagaataatacatggcaacttgtgcctctacctgctaagaaaaaacctattgtagtaaagtgggtttataaggtaaaaaagaatctgaaagaagagatttccaagtataaggccaggctagtggcaaagggattcttgcaaaaggctggcactgattttaatgaggtgtttgcacttgttgcaagaatggagacagtgagaattattactgctatagcaagtcaaaaagggtggcatatgcaccatatggatgtgaaatcagccttcttgaatggtcctctagaggaggaggtttatatgagtcaaccacctgggtttgaaataaaaggaagtgaagagaaggtgtacagattgaacaaggctttgtatggcttaaagcagacgcctagagcctggaacaggcgcattgatggctttctaatgaagcttggattcctcaaatgcacaactgagcatggtgtttatataaagggcagcaatactactaacttgactatagtgtgcttgtatatagatgacttgcttgtgacaagaaataatgagactgagattgctaactttgaagaagagatgatgagagagttcgaaatgactgatttgaaccttatttcttattttcttggaattgaattcaagagaattgatgagggagtgattatgcatcaagggagatatatggagaatcctaaactttctcacttccgtgctgccaagagaataatgagtgattctgattggtgtggagataagagtgataggaagaacacaacagcttatgtgttcttctatggtgatgctccaatctcgtggagctcaaagaaggaacaagtggtagctagctctctcctcattgaattgaagatgaaggaaaagggtgctattacactgatggtggacaacaaattttccatcaatctagctaaacacccagttgctcatgggaggagcaaacacatcaaaacacaatttcatttccttatagagcaagtgacaaaaggcaagctaagtgttgagtattgtccaactactgtgcaagtagcagacatattcaccaaacctttgaagaatgatcagttcaaagagttaagcagcagattgggagtgattgaagtggagtga

SEQ ID NO: 98012 - DNA, 810 bp, Glycine max
  Peptide Sequence Number=SeqID_214790
aatccgaaaggagagatttccaagtataaggccaggctagtggcaaagggattcttgcaaaaggctggcattgattttaaggaggtgtttgcacctattgcaagaatggagacagtgagaattattactgctatagcaagtcaaaaagggtggcatatgcaccatatggatgtgaaatcagccttcttgaatggtcctctagatgaggaggtttatgtgagtcaaccacctgggcgcattgatggctttctaatgaagcttggattcctcaaatgtacaactgagcatggtgtttatataaagggcagcaatactactaacttgactgtagtgtgcctgtatgtagatgacttgcttgtgacaggtaataatgagactaaaattgccaactttaaaggagagatgatgagagaattcgaaatgactgatttggaccttatttcttattttcttggaattgaattcaagagagctgatgagggagtgatcatgcatcaagggaggtatgcaagagatgtactgaagaagttcataatggttgactgcaattctgcagacacatccactgccactggtgtgaacttggtgaaagatcctaatgaagaagaagtagatgtaactttgtatagacaaatggtgggctcactgagatatatggagaatcctaaactttctcacttccgtgctgccaagagaataatgagtgattctgattggtgtggagataagagtgataggaagagcacagaaggttatgtgttcttctatggtgatgccccaatctcgtggagctcaaagaaggaacaagtg

SEQ ID NO: 98013 - DNA, 471 bp, Glycine max
  Peptide Sequence Number=SeqID_214791
atggcctcaattacaaagagtgagttgcctggaagcagttcagctaatgaatccatatctgccagagatattaacttgccacagtctacagaacagaaaataaattttagtgatccttcatctatctccctaatttatcttaactatgtactccaaaaaccaattgcagaggcaactgagatgccagatgcaatggaaattatattccaaaaagctctcttaattgggacaagtggtgctgtagatgaatatatggagatcagagatagggctgctgcatcttactcaaaagcgatgcttctactttcatttattgtggcagaagcagagaaccttccactgaacccaccattttcacttgttgccactaataaggagcgaatctcacaatatattcacagcttgcagtctcgtaaagaatcttcatcagagtcctcttcaaagaaagtgcttatacttttatcaaagtaa

SEQ ID NO: 98014 - DNA, 198 bp, Glycine max
  Peptide Sequence Number=SeqID_214792
atggacgcatactcctccggcgaagaagtggttgttaaggttagacttattgtggtgacgagaaaaccatatacaatcactaagcaaagggaacgatggacagaggaggagcataataggtttcttgaagctttgaaactacacgggcgagcatggcagcgcatagaaggtgatagtgtgtttatcatttctacttga

SEQ ID NO: 98015 - DNA, 165 bp, Glycine max
  Peptide Sequence Number=SeqID_214793
atgaggagcattcccatgaatcaagagcttgagatttttgaacaaggaataaagttgtcaaaattggcccacccgatggtccggtgggccaagctaaaccaggctctcaaaattgaggccctaaaagttgttgggccaaacacgactgggcctatttttgcctga

SEQ ID NO: 98016 - DNA, 210 bp, Glycine max
  Peptide Sequence Number=SeqID_214794
atggtggggccctccggtgacgtggcgaggtcgaccgcttgcacccggtcacccggttgcgcgaggcgtgggccatttgggcctagtggtggcgatatccggccagcgtggccactcacttttggtcactgccacgtggcagctcgttggggctttattggtaggtgttccattcgtgcgtgcggtggacacgtgcacgtttttgggtaa

SEQ ID NO: 98017 - DNA, 336 bp, Glycine max
  Peptide Sequence Number=SeqID_214795
atgactataccactacctcctctaaagtatgtccctattacctttcccccttcaaagtcgtcatttgctctaaagacactagcaactagtgaagggaacgactctcctctgaaacgaatcatcatgtaccctccgacattgcctcaagaacttgattttcccacagcacttcgtaaaggtgatgccttatcttatcttggatggcaacaagctatgattgatgaaatgtgtgcccttcaaagtagtggtacttgggacctcgttcttcttccactaggcaagtctattgttgatcgtcgctgtatttttactgtgaaacttggctttgacagttaa

SEQ ID NO: 98018 - DNA, 550 bp, Glycine max
  Peptide Sequence Number=SeqID_214796
atggttggtgcagcaaagatgggaatgcattacgtgatatgctcacctgaatcgctcaggccagaaaaatggcttgttgacgaatgtatgaaattcgcagccgaaagtggtgcgaagatagagttcacagacaatccagaagaagcagtaaaaggcgcagacgttatttacacagatgtttgggcatcaatgggtgaagaggataaggctgcggagagaagaaaattgctacaaccataccaagttaacgaagaacttatgaaaaagacaggaaagccagaaacaatattcatgcattgtttaccagcggtaaaaggcgaagaagtcacatttgaagttattgaagcgtatatctttgtagcacttgcatctccagttccttttatatattccgctttactaagtgcttccgcttttattatagctgcttttttgtctgcttctgacctgattttttgtgcctctttctcgccttctgctcttatcaacgctgctatgctttgtctttctgatttcattctttcgaatactgcatttctattttccgctg

SEQ ID NO: 98019 - DNA, 306 bp, Glycine max
  Peptide Sequence Number=SeqID_214797
atgagaggaagtcaaagaagacaaaacttcaaacctaaaagaaggactgaagagtcatctcaaatcccaaaatgctttgagtgcaatcaacccggacatatgagggctgattgtccaatctttaagagaaagatagagaagtctgaaaagaagactattggagataagaaggcaaagaaggcctatatcacatgggatgataacgacttagaatcgtttgatgattctgaaaaagaaatggttaatctatgtccaatgggaaaaaattatgaaagcaatgaagagcaaatatgtagaagaaattaa

SEQ ID NO: 98020 - DNA, 699 bp, Glycine max
  Peptide Sequence Number=SeqID_214798
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 98021 - DNA, 322 bp, Glycine max
  Peptide Sequence Number=SeqID_214799
gtcgacaaaagcggggctcttgctcctacgtaccctccatcgaagaggaaatcagacctacgcagttctttttaagggtgaatcaagcgattctttttacttggaaggtgatcattttaaggcgttggaccttaaaaatgatccatttacttggcgagaaaacggcttaaacgatcggttaaagcttgtcaaaaatggaagaaaagaaaccaaaattgaacgaaataaaaatgaaagccaagaaacaagaaatgaattaaaagtctcggatttggaaacttacccgttgaagaacgaagaacggatgaagaacggtgaataa

SEQ ID NO: 98022 - DNA, 324 bp, Glycine max
  Peptide Sequence Number=SeqID_214800
atgcctcgtactcatgacacgatcctgtattacaacgggaaatggaacatgccaccgcagaacaaatttgttggatgcgcgttcacaggaaaaaatcctaagaaatttcaaattccttcaacatgtaccatcgatgaactaaagaatttaatcaagcaagttgcacctaaagggattccccctcttggaattcacgaatcacaaacggtgttaatacaatctaactactggaaaaaatatggaccaatagaaattttagttgtctttactaaatatgttgtgaaaatcgaatacgaggtcactgggacgtcgctaaacaactaa

SEQ ID NO: 98023 - DNA, 243 bp, Glycine max
  Peptide Sequence Number=SeqID_214801
atgaatttgttgcctagcgctgttcatgtgtcctccaccatcgagtctggagccccgcgaattgattgcctagctatgttcgccaattctccattctccaatcttattcagagacccacaaattcattgcctagcgctgttcatgtgtcctccaccatcgagtctggagccccacgaattgattggctagcgctgttcgcctatcctccagcctcaaatcttgttcggagacccatgaattga

SEQ ID NO: 98024 - DNA, 444 bp, Glycine max
  Peptide Sequence Number=SeqID_214802
atggctttgtgttcagtttttctcaatcttcatctttggctttttgtttgtttgaccattgaagcgttaggtgtgccgaagccttcagtagctagttaccttagccaggagctactggcagagcaagaagttgatagagtgcatggattactagcgcagcctccagtgaagctcaacaatatgttggttatatcactgtcaatgaaactcaaggaagagatctgttctattggtttttcgaggccacccataaatcggaacaaaaacccgttctcttatggctcaatggaggtttatgattatttggttgacactgctgcctttgttcaaacaagagaaagcatcaatgagttcttgacaagtgttaaacaacatgacctggcaaaagctaaggttctgagcatattaaacattgggccagctgctgattttgaactataccca

SEQ ID NO: 98025 - DNA, 615 bp, Glycine max
  Peptide Sequence Number=SeqID_214803
atgggagttaagattgaagtagttttcggtgaggagcccaaagatgacgcacaagagctagttgaggacttaatctacatcattacctcattcgctgggaaaatttacggaatgaggagtcacaagaaaacactcctagttcaagcacttaaggaggtcgagaaggagtacagagaggttctagaggaggcaataaattatgggctgtcaaacaaaactacctccttcaccaggattaaagctggagtttacaagactgagagggagaaacataaggacttaccctcccattatatttacacagcttgtgaggacgcaagcgagagattggacagttttgagaagttgaagaagagagggaggagttacactgagaaaccgtctgtgaggagagttactattcacctcgacgatcacttatggaagttcaaccttgataggatttcaatttccacaaagaggagtagggttttcatttcaccaaccttccctaagatcttctggagatattataacaagggctggaggattgcgagtgaggccaggtttaggctgatgaagggaaatgttgtagagttctacgtcatttttaagagagatgagcctaaaccttat

SEQ ID NO: 98026 - DNA, 432 bp, Glycine max
  Peptide Sequence Number=SeqID_214804
atgggtgaagtggaagaggtgcaagagcaagtgaaggctgacacggaggccttaaaagagcaaatggccacaatgatggaggccatgatgagcataaaggagataatggaggtcaatgcggttgcaatagccgctaccagcaccattgccgagtgcaaaaacaagcatgccttcccaccatatgacttgcctcccaactatacaccacccaatgtggcatacactcccagtgaggatgtcaataactccgctcccatactctttgaaagccgacaacctcaaactgatcatgcacatgtctctcaaaccatgggggagacacatgaaattccccaccacaatctagccgacttcgagccttgcctcggatatgccactgaagggcaagcagttggtggtatacccctgcaaaacactttggagagcccttag

SEQ ID NO: 98027 - DNA, 576 bp, Glycine max
  Peptide Sequence Number=SeqID_214805
atggtctccattctgaacgaagaaaaccaagcgaacaacggggttccgtactggattataagagaaatctctattctcaaagagctggaccacatcaacattgtgaggttgatcgatgtgatgaccgatgggcccgacctgtttcttgtttttgagtatcttgacaatgaattccaagctgatttcctgaaaaatccaaagatgtttatgtacccacaaatgaaaaaagagtttctttatcaaattctcaatacagttgcgtatctgcatgctcgtaaaattcttctcagagatttgagacctgagaatattctggttaatgtcagaacccaagttctgaagattgcactctttggggcagccagaacatttgaagctcctcttgaggcttactctagcagtgtgggttgtctttcttataggtcacctgaagtcttgtttcagtctggctgcgagaaatactcaactccaaatgatgtctgggccgtgggttgtatatttggcgagatgcttcttcaccggcctctattctctggtccaagtgatgtggagctgctggatgagatatttacgtaa

SEQ ID NO: 98028 - DNA, 378 bp, Glycine max
  Peptide Sequence Number=SeqID_214806
gattgcaaggtaattttcactgagagagaagaggaagaaaagaaaacagaggaagatgtgtgtgatgaggaaggagaaaagaagaaagaaacaaaaagaaatgaggagaaagcacaacaatgggagaagtactcacaagtagaaattcagcaagaaagtattctccaagtcaatacccctcctcatcaactgattgtcaaggaagaaaggcatggaaaacatgagaaagccttaagtgtcattctttccttgatcgctaccacttctcttgcaataatgtggaaggtgcttccagaatacacgagtttcatggcgtctctaactaagaggcgaaaatgcaaggaagatgtgttctacgtgaccttcatgccaccttga

SEQ ID NO: 98029 - DNA, 1373 bp, Glycine max
  Peptide Sequence Number=SeqID_214807
gtaatcaacttgaaggaaccattccaacttctttgggaaatttgacttctcttgttgaacttgatttatcaggtaatcaacttgaaggaaacattccaacttctttgggaaatttgacttctcttgttgaacttgatttatcacataatcaacttgaaggaacaattccgacttttttgggtaatctccgcaactcaagggagatagatttaacatttctctatctctctatgaataaattcagtggaaatccatttgaaagtcttggatcactctctaaattgtcatcgcttcttattaatgacaataattttcatggagttgtcaacgaagatgatcttgcaaatcttacaagtttgaaggcgtttgatgcatcagggaacaatttcactttaaaagtgggtcccaattggcttcctaatttccagcttttctttttggatgtgacatcatggcatataggtcccaactttccatcgtggattcagtcacaaaacaaacttcaatatgttggactgtctaacacagggattttagattctattcccacttggttctgggaagcacattctcaggtttcgtatttaaacctctctcataatcatatccatggtgagcttgtgactacaataaaaaatccaatatctatccaaactgttgatctaagcacaaatcacttatgtggtaaattaccctatctttcaagtgatgtgtatgggttagacctttcaaccaattcattctctgaatccatgcaagattttttatgtaacaatcaggacaagccaatgcaattagaaattctcaatcttgcatcaaataatctgtcaggagaaatacctgattgttggattaattggccatttctagtggaagtgaatttacaaagcaaccattttgttgggaacttccccccatccatgggttccttggctgagctgcagtcattacaaattcgtaacaacttgctctcgggaatatttcctaccagtttgaagaagactggccaattgatatccttggatcttggagaaaataatctttcaggatgtattccaacatgggttggagaaaagctctcaaatatgaaaatcctccgccttcgatcaaacagtttttccggtcacattccaaatgaaatatgtcagatgagtcttcttcaggttttagaccttgcaaaaaataatttgtctggcaatatacccagctgtttccgtaacttgagtgccatgacactagtgaaccggagtacatatccccgtatctattctcaagcaccaaatgatacagcatactcttcggtattaagtatagttagtgtgctactatggctaaaaggaagaggagatgagtatggaaacattctgggtttg

SEQ ID NO: 98030 - DNA, 736 bp, Glycine max
  Peptide Sequence Number=SeqID_214808
atgaatgtgataagggaaacattgaaaggtggtaaaggtgaagttataaaaaaccctaaggtctttattgatccgttatctgtatttaaggagattccgttcagagaggatatactaagggatgctgcaatagctattaggtattttgttaagaatgaggtcaagttttcgaacttgtttcttggattaactggtactgggaagactttcgtaagtaaatacatctataacgagattgaggaggttaagaatgaggatgaggaatataaggatgtaaaacaagcttatgttaattgtagagaagttggtggaacaccacaagcagtattatcatccttagctggtaagctgactggtttttcagtgcctaagcatggtattaatctaggtgagtacattgataagataaagaatggtactaggaacataaaggccataatatatcttgacgaggttgacacattagttaagaggagagggggagatatagtactttatcaactgctaaggtcagatgctaatatatcagttattatgattagtaatgacataaatgttcgtgactatatggagcctagagttttatcatccttaggtccttcagttatctttaaaccttacgacgcagaacaactgaaatttatcctttcaaagtacgcagaatacggtttaataaaaggtacctatgatggtgatatactgggttatattgcagctatctctgctaaagaacatg

SEQ ID NO: 98031 - DNA, 357 bp, Glycine max
  Peptide Sequence Number=SeqID_214809
atgagcggagtaaaggtcatgaccaaaccgattgataccggttcacgccacgttacgcccgcaggcggcaatgtgtttgcggatctgggattttccgccgacgaggctcggcaattgcaagcgcagtccaatgcggaaattgcgcagcttatcgcactgaaaaaacagctgatgggtgagattagcgcgtggattgaggaagaaggttatcgccaggaggaggcggcgcgttatctgcacacttcccggccgcgcgtgtccgacgtggtgaatcagaaaaccgagaagttcacgctggacgcgttggtcaacatgatggcgaatatcggcaagtcggtaaaactgatcgtcgagtga

SEQ ID NO: 98032 - DNA, 800 bp, Glycine max
  Peptide Sequence Number=SeqID_214810
tgagcaccgcgacggagggcgccggcgtcgaggtgcgcaacgtctccaagacgttcggtgtcgacggcgcgaaggtgacggtgctcgacgacgtcagcctgacgatcggcaggggcgagttcgtctcggtcatcggccccagtgggtacggcaagtccacgctgctcaaggtcgtcgcggggctcctcgacgccgactccggcaccgtcaccatcgacggcgagagcgtgcgtgcggcctcgagggacaagaagatcggcctcgtgccgcagtcgcccgcactgctgccgtggaagaccgtgcgcgagaacgtcgagcttccggtgcgcatcaaccgcggggcgaacggcggcaggaccttgcgcgaccccgcggagctgctgtcgacgttcggtctcggacacgcgctgaagaagtaccccgggcagctctccgggggtatgcagcagcgcgccgcgatcgctcgggccttcgtgttcgacccctcgatcatgctgatggacgagccgttctcggccctcgacgagatgaaccgcgacctgcagcgcatcgcgctcctggacttctggcagtccaaccgcaaggccgtgatgttcgtcacgcactcggtgccggaggccatcatgctctccgaccgcatcgtggtgatggccgcccaccccgggcgcatcgccgaggtgatcgacgtgaacctcccgcggccgcggaccgaggaggcgtacgcgaccgacgagttccgcgacctggaggcagtcgtgcgcggtgcgctgcgcgcgcagacggagaaggcccatgtctga

SEQ ID NO: 98033 - DNA, 579 bp, Glycine max
  Peptide Sequence Number=SeqID_214811
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttccaaccaccaagggactgg

SEQ ID NO: 98034 - DNA, 267 bp, Glycine max
  Peptide Sequence Number=SeqID_214812
atgacctctaagaaacataagagtagtgattctagaccacaggatcagaatgataacaagagatttcaatcagaggaagcctggaaccggtatatcgataatattttaaatcgaaggatccttccgcaaaggaatgtggaactatatcattctgaatttgatgagtttaaaatagaattagaaaggcaaaaccttcacaaacatctcgccaaccttcaggaaggaagcatagatgatgcaatcctaccccccaagggcattggatag

SEQ ID NO: 98035 - DNA, 1084 bp, Glycine max
  Peptide Sequence Number=SeqID_214813
atgacccctgtggaagcaaccttagtatatgatatgagtaaacattgtttacgaattaaaaactcagagacaaactggtcagattgcctgctggacaaaacgcaacttacacaaatgtctgctggaaaggcacaagtggctatcggaacgaataaaccagaaggtatactacacctccaaaatagtgataaagaaatgggtcttgttattccacgtgtaacctctgctgaatccacaacaggattaacaagtctgattcctgttaaagctacgctagttcttatttttgcacaaactctggaaaaaaggatcgatgatgtaattcttaaagaattcagtgatgcaaaaggtcctggtggtgtatttcaggttacacaaaaaggtaaagtcttatatcaaaaggcttttggaaaggcgaacctggaacttaatgctaatcttcacgcggattatgtatttgagatcggctccatgaccaagcaatttactgctatagccactttaatgctcgaacaacaaggaaaattaagcgttaatgaccctatttctaagtacatcaaagactatccgaatggtgataaaattactattcatcatttactgacccatacttcaggaatcaaggattttacgaaaatgaaatctatcacaacgattgcccaaaaggaaatgaagccagaaatgatggttgattttttcaaaaatgagccggtagattttgctcccggagaaaagtttgattataacaactcaggatatgttgtattgggtcatctgattgaattaatttcaggagattcctatgaaaatttcatccagaaaaatatttttgataaagccggcatgaaccattcttattatgcatcggacagaaaaatagttctcaagagagcatctggatatcataagaaagaatccggttacgtaaacaagacccttatcagtttcagtgtttctttttcctcaggctcactgatgtccacgcttgaagatatgctgaaatggcaaaatgccttacataaaaatattttactaaattcacaggagaccgaaaaagcatttcaaaaatacaggccttataatg

SEQ ID NO: 98036 - DNA, 667 bp, Glycine max
  Peptide Sequence Number=SeqID_214814
atgtgtcaggagaaattggtacaagaagccgtggatacacttcttgataatggaatccgcggacaaccgatgagggacggtcataataagatgtggattgccccgcgaaatagcaatagaacttttccagacatttctaattcgtggtctaattcgaaaacattttgcttcgaacataggattgctaagagtaaaattcgggaaaaagaaccgattgtatgggaaatacttcaagaagttatgcagggacatcccgtattggtgaatagagcgccgactctgcatagattaggtatacaggcattccaacccattttagtagaggggcgtgctatttgtttgcatccattagtttgtaagggattcaatgcagactttgatggggatcaaatggctgttcatgtgcctttatctttagaagctcaagcagaagctcgtttacttatgtggtctcatacgaacctcctgtctccggctattggggatcctatttccgtaccaactcaagatatgcttattggactttacatattaacgagcgggaatcgtcgagcttatcaacaaaaaagaataaacttcgatagtcctttgtggctccggtggcgactagatcaacgcattatttcgtcaagagaagttcctatcgaagttcactatgaatctttag

SEQ ID NO: 98037 - DNA, 431 bp, Glycine max
  Peptide Sequence Number=SeqID_214815
gggcgttacacagcttcgagctacttcatgtcgacgacgctgtcgatatgttggtggaactactcgaggtcagtgctgcaaaggcgagagctgagatgattcagtgtcatggctcttatgttcgactatcgtggctacgcgatcgtgagcatatttgttgcatctgctcactctttgctaacaagagtgtcacacatgtgcacgcagtattcttggatgtactgcgtgacttgacacagagtgggggttacgcttggggcgctgctgcacttgtgcacatatggggccccttgacggtcattcatcgaccgaaaagggttgtacaacagtttggctacatccagactattctgccacatcttgctacatcttcgctctctattgaagaaattgatgatggatggatgcagttcggtgagtacattgcacct

SEQ ID NO: 98038 - DNA, 279 bp, Glycine max
  Peptide Sequence Number=SeqID_214816
atgagagggctacaagccctcaattttagaagactacaagtgctcgctttcagagggctacatatcctcgccttccgagggctacacgccctcgctttcagaggattacacatgctcgccttccgagggctacacaccctcgcattcatagggcttcaaaccctcgccttcagaggactacacagggctacttgccctcgccttcggaggactaaacttcctcgccttcagagggcaacacgccctcgccttcagagggctacacgccctcctctttag

SEQ ID NO: 98039 - DNA, 880 bp, Glycine max
  misc_feature (828)..(828): n is a, c, g, or t
  Peptide Sequence Number=SeqID_214817
cgcagcgggggatcccgtcgacgcggcgacgatgacgatcacggcgcccacgtgggacgcctcggcgatccacgagttcgagggcgacccgccgaagtggcgcgtctgggccggggatacgacatcatcgcgttccacgccgcgccgttcacggccgacgtgctcgccgcccttcccgacctgcgtctggtcggctgcgcccgcggcggccccgtgaacgtcgacctggcagcggcgaaggagcgcggcgtgcgcgtgacgacgacgcccggcaagaacgccgacgccgtcgccgacctcacgatcgggttcctcatctcgctcatgcggaacgtgccggcctcgctgcgcgacgtggacgaacgcgtggccgacgggcgtccgctcgccgagtccacgttcgaaggcgcccgctggttcgggcgcgaggtgaaggggctgcgtctcggtctgatcggttacggcaacgtcgcccggctcgtcgccgccagggccagggcgctcggtgcggccatcacggcttacgacccgttcgtcgacccggcgacggttcccgacgcgacgatcgtgtccgacctcgatgcgctgctccgctccagcgacgtggtcagcgtgcacgctcgcgcgacgggggagaaccggcacatgatcggcgccgcgcagatcgcgcggatgccgcaggggtcgttcctcatcaacaccgcccgcgagtccctcgtcgacgagcaggcgctgctcgacgggctgcgcagcgggcacctcgccggtgtggcactcgacgtgaacgagccggacgggccgtggcgcgacctcgtcggcgaacccaanctcatcctcaccccgcacctcgccggggcgacgcgggagaccctcgcccgcg

SEQ ID NO: 98040 - DNA, 552 bp, Glycine max
  Peptide Sequence Number=SeqID_214818
atggttcggaggcaggcaaagaaggcccgcagtgaagatgaagaccaatgttacgcttgtcagagatgtgtagcacatcatgtgcgtgaacttcacacgccaagcaaaaaggtcaaccagggacaccttgagacggagggagagaagattagtgcaacattggtcaaagatgcatcacgtgtcatttggctgcgcacgcggaagcatgacgatctttggaaaggtcaccggaaaagcttaaacatgttgttggaaagagatgaagcacgatggttcggtcaatggattgtgggtcagccaaacagggacaaactaaggccaaacaagttcatcagaggagaaggagcacaacaaggaggttgtcggagaatgggtcttgcgaaaacaacatcatgtgccaaaaaggggattgcacatgagcatgatgtgctgaagtgtggtggcagaaaaggttgcagtcagcggcgttgggtttgccagggagaggcacttctaatcagagggaacgctgcggcgaaaagggggaaaatcgccgaagagaggaacagttag

SEQ ID NO: 98041 - DNA, 192 bp, Glycine max
  Peptide Sequence Number=SeqID_214819
atgaatgttagcgttggcagcaacaactacaatgatagtagtaattgtggtgaggataacaatagtaatggttgtgacggtaaaaatgtcaatgttgatagtagtgacgacaatgttagtgattgtgatggcgggaatgtcaacgacaatggtggtggtgatagtgatgacaataatgatgattgtgagtaa

SEQ ID NO: 98042 - DNA, 883 bp, Glycine max
  Peptide Sequence Number=SeqID_214820
atgtattttcatggtgctcgtttttccaattatgaggcatggttaagtgatcctactcacattatgcctagtgctcaggtggtttggccaatagtgggccaagaaatattgaatggtgatgtagggggagggttccgaggaatacaaataacctccggtttttttcagatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccatggtcataaaggtctatatgagatcctaacaacgtcatggcatgctcaattatctattaacctagctatgttaggttctttgaccattgttgtagctcaccatatgtattctatgcccccttatccatacctagctactgactatg

SEQ ID NO: 98043 - DNA, 234 bp, Glycine max
  Peptide Sequence Number=SeqID_214821
gggaaagagggtagagcaaaatgttcagcccttctggtatttgaggattctctcgaaattagtgagaaaaattgtttccatgaaaaacagccaagtcgaggtgtttccgtaacgcttccaagacatttccgtgagcgatttcgtgaagcttcttcaccgttcttcatcgttcttcgttcgttcttcatcgttcttcggtcttcaaccgaatctaaccgatcattcacgctgtaa

SEQ ID NO: 98044 - DNA, 1163 bp, Glycine max
  Peptide Sequence Number=SeqID_214822
ttgaagcaatgtctctaatgctaggaagtggcaaggactatccagttgcagaggttgatgctctgagaactattgaggagaagcttggaaggttaactttgggccttgccattgttagtggaattttgtctgagatacctataaccccaagcaggctcttagatacaataaacagaatgcccttgaaggacatgtcatggagtggtaaagaagctcgctcattcaggcagaacactttcctcctgcaactctttgatgtttgtttctcaatatttgatcatgcagacggcccaaggagcttggcaaccagaatggtactggtaagtggatggtttgcaccttgtgcaattccagtttccttattggcacttgctgctcagaagataccagaaaagcaaaaggggacttgtttctggagaaaattactgcaatccataacatgtgggttcacatcctcaaacaccaaaaaatcagaattagaagcatcttccctactgcttagattcaatattgcaaggagtagtactaagcaaggtcgtatccatttcaatgaaatcatcaaacaatatgctcggaaaagagaagttaccggatctgcgcaagcaatggttcaagctgttatcagtcaagggtcaatatctgaaagcatagagcatttatgggcggcatgttttctgctatttgcatttggtcataatcctccggctgttgaacttgaggtttcagagctcttatatcttgttaaaaaagtggttctgcctcttgcaattcacactttcattacatactctagatgcactgctgctatagaacttctgcacctttgcaccaatgccttggaagctgcagaccaagcattcgttaccccggttgacaagtggttcgacaaatcactttgctggaggtccatccagactaatgctcagttgaatccttgcctttggcaagagttggctttgtgtagagctactgtgcttgagactaggggcaaactaatgctaagaggtgcacaatttgacataggggatgatctaatcaggaaggctgtttatatcaggacttcaatttgtggtgaagatcatcctgataccatatcggctcgtgaaacattaagcaaactcgcccgactaattgcaaatgtccaaatccgcgcatctatatag

SEQ ID NO: 98045 - DNA, 174 bp, Glycine max
  Peptide Sequence Number=SeqID_214823
atggtgtcagactcggacacccatttgagaaagagaaggaaaggagataaagtgaagggaaaagcggcaagctttatcaacaagtgttgcgtttttattgtgcctgcaaagttcagaaaatggggtgaagaaggatgcaatggatctgacttgggtatggtggaatcgcagtag

SEQ ID NO: 98046 - DNA, 1116 bp, Glycine max
  Peptide Sequence Number=SeqID_214824
atggatattcaagaagagagctccaccacacttggacccttgacagcaatgagttcaaggaacatgtcatcctcatcttcagcttttttttcagctaatcaatcacccttcttctctccaagatcatcatcatgtcagttatcagagtctttgcgacctgatgctcccagtgacagaattcattcagatgctactgcccccagcaccagttcagggattccagaaccaaagtctctagtgaatgttggatgcaccttctctgaggtggttgcatctccagctggctgtaatgcaggtgatttgcagaaccttgatcgcatatcttcctcagtcggcatctctagtagcactgtatctggttactgccatccttatgatgatggttattctggacagaaagagaagagaagcaagaaaggcagaaacaaaagaacatcatcaacaccaggttctacatcactttcttcttatagactaaagagttgtgatgtctttataggattacatggtcgtaaacctcctctaataagatttgccaattggctgcgtgtcgagttagaaattcaaggcataagttgttttatatcagatagggctggatgtaggaactcttgcaagcttggcattgcagagaaagctatggatgttgcttcttttgggatagtaattataacaaggaagtctttcaagaacccatacacaattgaggagctgcaatttttctctggcaagaagaacttggtccctatatactttgatttgagtccagctgattgtcttgtgagggatataattgagaagaggggtgagatgtgggaaaaacatggaggggagctttggattttatatggagggttggagcaggagtggaaagatgctgttcatggcctctcgcgtgttgaagaatggaagttggaagctcatgatggaaactggagagattgcatactgagggctgttacgttattagcaatgaagttaggcagaagaagtgtggctgagcatttgacaaaatggagggagaaagtgaaagaagagttacctttcactcgtaatgagaacttcattggcaggaagaaagagctttctcaactggagtttatgctttttggtgat

SEQ ID NO: 98047 - DNA, 433 bp, Glycine max
  Peptide Sequence Number=SeqID_214825
atgttgtatacacacactagcatgcacatatcaaatgagagtgagagaaacaaatatcgatcattagattttattataaatcatagccatcttaaggctaattgcagtgttagttattttcagaatacagcaagagggagcatcagattcaagcatttccttgcatcagaggtcactttccgaaagaagtattgcccattatattcttcactaccaagggtcaagcaagtaagtaggcgactaatttgttcagttgccacagaggatttaccaaaggaagttgaaaaatctaacatggagacaccaagggaaatattcttaaaggattacaaaatgcctgattactactttgacactgtggatctaaaattttccttgggagaggagaagacaatagttaattctaaaattgctgtgtatcctcgcattgaag

SEQ ID NO: 98048 - DNA, 1326 bp, Glycine max
  Peptide Sequence Number=SeqID_214826
atgtatgacctttatgtgattcactggaagaagggatgttcaaggtgtaaaaactactgtaagaaaagatggggaagctggttgggcaaaattgggtgttttggatataaaaaaacccgaaagcgcattgggcatgctgtcctagttccagaaccaaccaccaatggagctgatcctgctgcagctgctagttcaattcaagcacctagtataacgcttcctttcgtagcacctccctcatctcctgcatctttctttcaatcagaacctccatcaactgcacagtcaccaattgggaaagtatctcacacttgtgtgtctgccagcatctactctcctggtggccccgcctcaatctttgccattggaccttatgcccatgaaacccaattagtctcaccacctgttttctcggcatcatccactgctcctttcactccacctcctgaatccgtccacatgactacaccttcctcgcccgaggttccatttgctcagctacttgaccccaacaataagaacagtgaaacctttcagaggttccaaatatctcactatgacttccaatcctatcagtttcatcctggaagccctgttggtcaactcatatcaccaagatctgccatctcagtttccggcacctcatcgccactccctgactctgaatttaatgccactttcgcccatatccttgatttccaaagagcagaccctccgaagcttctcaacttagataataaactgtcttcttgtgaaaaccagaagtcaaatcatggttccgggtctctgaccccagatgctgcaaggtccacaactcaatctggttttctatcaaatcattgggtttctgagatcaaaatgtccccacatcctagcaataatcgcctcaatgagattagtataaatcatagagtttcatttgaattatccgctcaaaaagtgttgaaatctctggaaaacaagccagcagcatcagcgtggactaatgtcctgccaaaattgaaaaatgatgctccaacaacagacaaagaagaaaaatcagaagaaagtgcgcttgatgacaaacaagtagtttctgaagctcacaatgatcaaccactggaaaccactttgggtggagataaggcaacaacagttcatgagaaggatcagtccttaactctttcttccgctaaagaattcaattttgataatgcagatggaggagattctcttgctcccaatatagttgctgactggtgggctaatgagaaagttgcagggaaggagagagaggcatccaaggattggtcctttttcccaatgattcaacctggtgtcagctaa

SEQ ID NO: 98049 - DNA, 528 bp, Glycine max
  Peptide Sequence Number=SeqID_214827
atggagggtacatcccttgtggatctttggcttgtaaaggattttacaatgttgaaagaaatctcaagaaccgctggttgtttggggactgaatgtaggcacgggccacttgatccaacaagtggtatcagagcaggtttcttgagaaaagtttcacaatttcaagattcatggcctcctcaaattctctgtttcctgaaggaaactccatccataggccacctgtctttaatggtgagggttaccactattggaaaacctgaatgcaaatctttattgaagtcagatttaaacatttgggaagcaatagaaataggaccttatgtacccaccatagtagatgcaagcacaagcacaacaacagaaaaacctagagataaatggactgaagaggatagaagaagaatcaaatataatcttaaagccaaaaacatcatcacttctgccctaggaatagatgaatattttagagtgtctaaactattcaaatgcaaaggagatgtgggatactctccaactaacacatga

SEQ ID NO: 98050 - DNA, 267 bp, Glycine max
  Peptide Sequence Number=SeqID_214828
atggctaggtctcctcaagaacaggtgcaggagatggctcagggctcagtaggggtgagctcatcctccccctctgctgctggctcctcaagagcaggctcctgggctgcggaggccccaccccctccagaagaagaaggttgggctcctagccaggccacttgcacatcaaactcattcgtgctcataatggatggcaagcccaagccctgcaagctctacatgatgatggactaccccatgtgtatgctctggagcatggaatga

SEQ ID NO: 98051 - DNA, 417 bp, Glycine max
  Peptide Sequence Number=SeqID_214829
atggggttgcaaatagcaactaggcccacttgggccttccaggatgttcctccagaaggtggttgcttctggaggaagcaacctagctcgcctgggcgagctgggtggcaaggttccaagggttctgcctgccccttgagtgttgagccagagctgcaggaaatcaacctgaccgaggatgatgagttcttgattatgggctgcgacggcctatgggatgtaatgagtaaccaatgtgttgtaaccatggcaaggaaagaattgatgatacataatgatcctcaaaggtgttctagagagttggccagagaggctcttaagcatcttcctcctaggatagagacacctccttctcgagtcaaggggagtatatcagcagaaggcctcaatttacttaaggatgtattggactgttag

SEQ ID NO: 98052 - DNA, 743 bp, Glycine max
  Peptide Sequence Number=SeqID_214830
atgaactctaatggtgcttatacagggcaggcaattactcagcatgacatgctagatatttatagcaatctaaaggacgtacctcaatcgataagtggcagagatgaactcaacaaagatgaactccataatgtggttgcagtgacagaagcgcagggcagtttgcagcaaagacgaactcaggcagaaggagaaaaaagaagaacaataaggttcaagcgcgcgggttgtgcaatttcagggatgaactggatgtcatgggatagactttgtgcgttgaaggaggatggtggtatggggttccaaaatggttctcaaagccaaatattttccaagggagaatttcatggaggcgtctttaaggtggtgttgaaggaagggtttcagtggaggctgggggatagggttagtattgatgtgtggaagcaaccatggttgaggtctactaatgtagcttatatccagactcccatgtacccgagaatggaagatttaaaggtgagtgaccttattgattatcattcgggccattggaataatcctctcattgataatttatttgaggctggtgatgattattcttcaaaagttcacactaattataatacggtgagtatgcatggtgattggaaactcgtttgggatttggagatcgtcatgagagtgaaagtgtttatgtggagactcccttccattcatttttctcatgtgctagcaacgaaggttgttgggaaagagtgcag

SEQ ID NO: 98053 - DNA, 228 bp, Glycine max
  Peptide Sequence Number=SeqID_214831
atgggtgccaagtacctcgaagtggtcaaacgagggtcgcatcccaacaacggatggtccccggacgaaattaggacacagcagcaggtaccagcaggcaggtgcaagtctgcgcaagctagcaagcgtatggtgcagacatgtctccaggatgcttggcgaaataagcccatgcaggattcaccaaaagcactggcgaaaaaagctacagtgctctcccctatataa

SEQ ID NO: 98054 - DNA, 201 bp, Glycine max
  Peptide Sequence Number=SeqID_214832
atgcatcaccatgctcgaaagacctatgtgtcctcctcactcaagctgccgttgaggttcgtgttcgggttcgcactggcttcaggagttcctactcgtgactaccgtgatttaggttttagacatagtcttggctcctggttgatgggttcacgagttcctgagttggtgggttcgggggctggtgagttcgttgtttaa

SEQ ID NO: 98055 - DNA, 393 bp, Glycine max
  Peptide Sequence Number=SeqID_214833
atggttgacaaacagttttctcttcctattaaagttgttcaaacagaccggggggaagtttataccttttacttccttttgcagcagtcagggatcattcataggacaataggccctgtgtcaatttccaccctttctaatggtggaatagacgagtttggtggatcagctccttggagaagggatcagggacaccttgttgatctagttcaaagagaggtgaaagcattgttgcagccatggtgttctaatagtgcttattcttcagaaaaagagaaagtagagggtgaagagctacataagtggttaagattggtagttgcaccgacagagcttgcaatcttcatagatggcaagcaatggtctctcctcccattgcagacaggttcctaa

SEQ ID NO: 98056 - DNA, 1632 bp, Glycine max
  Peptide Sequence Number=SeqID_214834
atgacgggaagagctgtaaacccactatttcgaggtgcatatttatcagaatttgcaaagcagaaagtcactctgctggttccatggctttgtaaatcagatcaagaactggtttgtcccaacaatctcacttttacttcaccagaagaacaagaagcttatatgcgtagctggcttgaggaaaggattggttttaaggcagacttcaaaatttctttttatcctgggaagttttcggaagcaaggcggagtataatacctgctggagatacttctcaatttataccatccagggatgctgacattgctatcttgaaagaaccagaacatttgaattggtatcatcatggaaagcgttggacgaacaaattcaaccatgttgttggtattgtccacacaaattatatagaatacatcaagagggagaaaaatggggcactccaggtattcctcgtgaaacacataaacaactgggttacaagagcatactgccacaaggtttttcgtctcttagatgctactttaggaattcgcatcactgtaagtaatcttcttgaccatcatagtgctagggttcaagatagagcaaaaacattgtttgacggctggaaaggagttggaaatggtgatactgaatctcatgaagtggagtttgctaaggttgacaatgcaagtgacaagattgtcagcaaggaaagccagccatctactttgaatgaagatggaaatgataatgatcctgcatcaggactaattggatgtgagaaatctctattgagaagctcgaatgatttactggtacatagttctgataatgtgccccaattatctaccactgtggaatgtattgacattaaagagggatcagcaaaccatgttgctagtgttccatcttctgctcaagaagttgctcccactcatgaaggattgcctatatgcactacaggtgaggccacttcggctggaacctgtaaatttttcgttacaaatcaaagcagttttgaaggacaatcagatgtggtacagttaagtaacttggctaaaatggaaaagcaagagcaaaatgttaatgacccttcagaaaaattaggagcaccagagatctattttgtgtcctctaataagcctgagcctcagcctatttccatggttgcttgtgaagccaaagcaccagaatctatgaaagaaccagcattagagaaaaatgttgaacacaatgaggatggtgtttgtcataaattaactacttctgctagtatgaggacacctgcatctgacaggagtggggaagatgatgcaactagcattacacaagtttttaaagctacagaaaatgataatgattgttgttctaatgccttgcagggcacatcagttagtgacagtaacttgggaaagactgaagtgttagacatgtctgtctctggaacagaatatgtcatagcatcaaaggaaaataagggccatgaagaagatacatcaagtggttctgattgtagtaaacctggaatagatttcagaggctctaacataattcacaagagtggttctgacaatgaacttgacaagaatctcattggatccctgagatttaacaaggcacacattagggtgatattcaagggaaactga

SEQ ID NO: 98057 - DNA, 2480 bp, Glycine max
  Peptide Sequence Number=SeqID_214835
atgggatacggcgaaaaaggaggacgacccccgttcaaaaagctcaaggcttccactaaattcgaagatccccaaaaaggaatcgcctacgatgacgatggttatggcggcgaagatgcgtacgacgatgacgatggtaaaaccaaggattttagcaaattagagctgaaaccggatcaccccaatcgccctctgtgggcctgtggcaatggccgcatattcctcgagactttctcccctttatacaagcatgcttatgattttcttatcgccatcgccgagcctgtttgcaggccggagtctatgcacgaatacaaccttactccacactcgctgtatgcggctgtttcggttggtctggaaacagaaacagtcataagtgttttgaacaagttatccaagaccaagcttcccaaagagatggttaaatttatacatgattctactgcaaattatggcaaagtgaaactcgtgctcaaaaagaatcgatactttattgaatccccgtttccggaggtattgaagacattgctccgggatgaaactatatctcgatcaaggattatttctgagaatgtaaatggagatggatttacaatcagcaaagcagcaggtgaaattgaaggcactcatgatgagttgctaaatgaagcagaagtggcagcggttgcagaagagaaagaagcccattcatttgaaattgatccttctcaggttgaaaatgtaaagcaacgttgcttgccaaatgccttaaattatcccatgttggaggagtatgacttcagaaatgacacggtgaacccagaccttgacatggaactaaagcctcaagcacaaccacggccatatcaagagaagagccttagtaaaatgtttggaaatggtagagcaagatctggtataatagttctaccctgtggtgctgatcagtgggctttccaatttaaactatggtcaactatccgagaagaacaaatatgtcgtttcacgtctgatagcaaagagagattccgtggtaatgctggagttgttgtgacgacatataatatggttgcttttggtggtaaacggtctgaagaatctgaaaaaatcattgaagaaataagaaacagagaatggggattgctcctcatggatgaggtgcatgtggttccggcccatatgtttcgtaaagtcatcagtatcactaaatctcattgtaaacttgggctcacagctacacttgtcagagaggacgaaaggattacagatctgaacttcctgattggtcccaagctgtatgaggcaaattggttagatctagtaaaaggtggatttattgcaaatgtacagtgtgctgaagtatggtgtccgatgacaaaagagttttttgccgagtatttgaagaaagagaactccaagaagaggcaggcactttacgtgatgaatcctaataagttcagagcatgtgagtttctcataaatttccatgaaaggacacgtggtgataaaattatagtctttgctgataatctgtttgctctcactgagtatgctatgaaactccgtaaaccaatgatatatggtgctacaagtcatgttgagaggacaaaaattttgcaagcattcaaaactagcaaagatataaatactatatttctttccaaggtgggtgacaactcaattgatattcctgaagcaaacgtaataattcagatctcttcacatgctggttcaaggcgacaagaagcccagcgtctgggtcgtattcttagggccaagggaaagcttgaggataggatggcagggggcaaggaggagtataatgcatttttttattcccttgtttcaattgatacccaggagatgtattactcaactaagagacagcaatttttaattgatcagggttacagctttaaggtaattactagcttgcctcctcccgatgaagggcctaatttgagctatcatcgtcttgaggatcaattggcacttcttggaaaggtgttgagtgctggtgacgatcaagttggattagagcaactagatgaagatgcagatgaaatagcccttcagagtgcccgtcgttctcaaggatccatgagtgcaatgtcaggcgcaaaagggatggtttatatggagtacagtactgggcgtaacaaaggccaaggacagatcaagagcaagccgaaagatccagcgaagagacatttcttgggaacacatagagctacacctgctagtcaggggagcaaccgtcactatctatcatgcggcagaagtgctcgccgacgcggaggacctgtgtcatgtcttgcgctgttgactaaatactgtggtcggggtggggacacaaaggaaagtgccatagacaacaatagagaactgaaagttagaaaaaggaaggtgaaggtgttggttggaaaaggaggaaggaaaggtggaggtaaagtcaggaggaggaagaaaagaggtggtggtaatgatgaaggaaaaag

SEQ ID NO: 98058 - DNA, 216 bp, Glycine max
  Peptide Sequence Number=SeqID_214836
ctttcggaatgttacgaaaactcacggattgcgcaacaacacttccatttgatttttggcacgttacggaattccacgaattgcgtaacaatgcctcattttgatttccggcatgtctcgaaacttcatgtattgtgcaacaaagggtgccaagtacctcgaagcggtcaaccaaaggttgcatgccgtcaaacaatagtccccggacgaaattag

SEQ ID NO: 98059 - DNA, 795 bp, Glycine max
  Peptide Sequence Number=SeqID_214837
atggtatcactggcagtcactggacgagttacaacgaaggttgatgtatacagctacggggtgattctcatggagatgataacaggaaggaaagcaattgacaacagccaaccagaagagaatgtccacctcgttacatggttcagaaggatgctactgaacaaagactctttcacaaagctcattgaccccataatggatgttgatgaggagaccttaccaagttttaggactgtggccgagttggccggccactgttgtgcgagggagccctaccagcgccctgacatgagccatgtggtgaatgttttggcacctcttgtcgagatttggaagccttctgaagcagatgatgatgacatttatgcgattgacttggatatgaccttacctcaagcactcagtaagtggcaggctattgaaggaaagaacacctttgatgtttcatgcacttcatcaatgcttactagtggagatactacacagtctagcatactaactaggccttctggatttgctgattcctttacttccaatgatggaagcattatgtctataggaagccctggtgcagcggtaaagttgtgccttggtgacttgttggtcatgggttcgaatccggaaatagcctctttgcatatgcaaggcaacataggtcaaaaattccaaaggcagtgcacactacaaaggctacataggaatatatccattatgattgttgggagccttcaagagttccatccttgggaggagcaaggtatttcctctcaatcatcgatgactgctcaaggatga

SEQ ID NO: 98060 - DNA, 687 bp, Glycine max
  Peptide Sequence Number=SeqID_214838
atgaatacatcatcatcgaatgtgtctgttgctaacgtcattgaggttccttttgcttatcatagacaatggtcctcaaattatccaagttatgtgttatttgactacgaaggagacaaacactttataaagcttcataaatatggtaaccgattcttttttggcgatggactgaaggaacttaggagaacccatggcattcacaaaagtgttctgatgcattttgttggaagggacaaaaatactactttcagtgtggacattgtgggacctctacaccaaagggcagccacaaccataaggcaccatgtttttaccattgatgtctctgaagatatgatacaacacaattatcaattggttctgccaccagaggcttcaatttatttaactgcatcaaaaaaatatatgattgtagatcgtggtagtggtaggcatcacaaatggatgatcaccatgaataatggcctatcatgtgttgctgacgcgtggatccattatttaggtgactgtcatttaaagcctggagatgaggtcatcttcttctacaacattgaccaacatttatgggaggtcctctataggaagtgtcgcaacctacccttccgcgggagggcgacgcgggactcgcgggatgcgtgttccacgaaaggaatacgcgcggagtcgccaccaacgtttatttga

SEQ ID NO: 98061 - DNA, 2418 bp, Glycine max
  Peptide Sequence Number=SeqID_214839
atggctctctgcacatcttccttcttcttcaccttcttcttcaccttcttcttgttcctcttcaatcttcaaccttctgtttcccaacaacaattcacatccttcaacatctcacactctccatggctcccagcacagaacaaaacccttctctctccaaacaaaaacttcactgcaggcttctttcccctgccaaactcttcaaatgtcttcactttctccatttggtactccaaagtgcctccaagtgcaaacccttttgtttggaatgccacagtccaagtcaacacttctggctcccttgaaataaccccaaaaggtgaacttctcctcaatggttcaccctttcaaagtgctgaaaatgctactactaactccacttccaattcaacccaacttcttctccaaaacgatggaaacttggtctttggggaatggagcagcttcaagaaccccaccagcaccgttttacccaaccagaacttcagcacagggtttgagcttcactccaacaatgggaaattcaggttcatcaagtcacagaatctggttctcagctccacctcagatcaatactacaacaccccaagtcaattgctgaacatggatgataatgggaaaatgagcatgcaaggtaactctttcctcacttcagattatggtgaccccaggttcagaaaactggtccttgatgatgatgggaatctcaggatctatagcttctaccctgaacagaaaaaccaatgggttgaggtttggaaagggatatgggagatgtgcagaatcaaaggcaaatgtgggcctaatgcaatttgtgtgcccaaagaggatttgagcacttccacttattgtgtttgtccatctgggttcacaccagcaatccaaaatgatccggaaaagggttgcagaaggaaaatccctctttcccaaaacacccaatttctgaggcttgattatgtgaactgctcaagtgacggtcatttgaatgaaattaaagctgataactttgcaatgtgcgaggcaaattgctcaagagaaaaaacctgtcttgggtttggattcaagtatgatggatctggctactgtatgttggtgaatggcacaaatcttcaatatgggttttggtcaccaggcactgaggctgccttgtttgtaaaggttgacaaatccgagtcatcagtttccaacttcattggcatgactgaggtgatgcaaaccacatgtcctgtgaacataagcctcccacttccaccaaaggattcaaacgccacagcaaggaacattgccataatctgcaccctttttgctgcagaactcattgctggggtggctttcttctggtccttcctcaagaggtacatcaagtatagggacatggcaaccacattaggccttgagcttctccctgctgggggaccaaagaggttcacctactcagaaatcaaagctgccaccaaagatttctccaacttaataggcaaagggggctttggagatgtgtacaagggtgagttacctgaccatagagtggtggcagtgaagtgcctcaagaatgtcacaggtggagatgctgagttttgggcagaagtcacaatcattgccagaatgcaccacctcaacttggtgaggctgtggggattctgtgctgagaagggccaaaggatacttgtctatgaacacatccctggtggatcattggacaagtacctcttcagggtcaataagtctcataacaataaccatctcaaggagcaatcaagtagtttgaatccaaacacaccacaacaagaaaggcatgttttggattggagcatgaggtacagaatagcccttggtatggcaagggccattgcctacttacatgaggagtgtttggagtgggttttgcactgtgacatcaagccagagaacattctactaggtgatgacttttgtcccaagatatcagattttgggcttgccaagttgaggaaaaaagaggacatggtgaccatgtctaggaggaggggcacaccagggtacatggcaccagaatggatcactgcagacccaattacctcaaaggctgatgtgtatagttttggcatggtgcttttggagcttgtgagtgggattaggaactttgagatccaaggttctgtggttaggagtgaggagtggtacttccctggttgggcctttgataagatgtttaaggagatgagagtggaggagattttggatgggcaaattagggatgcttatgatagtagggcacactttgagatggttaataggatggtgaagactgcaatgtggtgtctgcaagataggcctgagttgaggcccactatggggaaggtggccaagatgttggaagggactgtggagatcactgagcccaaaaagcccactgttttcttccttggtgaagagtag

SEQ ID NO: 98062 - DNA, 330 bp, Glycine max
  Peptide Sequence Number=SeqID_214840
atgagtgatcaccaagctcctgaagtgaaggatttgccatgtttgatgggttccccttttaaaggcacccacagtagattttctcgaaaatcctctctagtaatcgattacagcactggcgtaatcgattacacagttatttttattcaaaattcaaatgtccaacattcaaaagctctggggttgaaggagaagtttttcttcgatcccacaaagagtgtcaaatgtttttaccatatttggcaggaccttctccatgtatggtggtggagtgttgacaataataataatagtgacaacaagaataatgataatgattacaacaattga

SEQ ID NO: 98063 - DNA, 255 bp, Glycine max
  Peptide Sequence Number=SeqID_214841
atgaggagccttcaaaaggccaagagtggagtcgatgccacttattgctccctcttcaaagagaaagatgcatcgcacctaggaccatggaatgggggcttcaatcccttctccttctctctaacgtttgggaaccctaacagagcaactggaggaggagctttagagagcaccaaaaatgccacaattgataaaagagaatgcttgagtgactacatcgagataagggatgagttattcacaattggggattag

SEQ ID NO: 98064 - DNA, 267 bp, Glycine max
  Peptide Sequence Number=SeqID_214842
atgggtattagtccttcttattgtatgcatagagttttaatggaagaggattataaacttgtagctcagccacaaagacgcctcaatccaacaatgaaagaagtgttaacaaaggaagtagtcaaactattagaggcaggaatgatatatcctatttttgatagccagtgggttggagaatgtgtattgattacaggaagctcaacaaagccaccagaaaagataattttccattacgatttatggataaaatgctggagagactag

SEQ ID NO: 98065 - DNA, 210 bp, Glycine max
  Peptide Sequence Number=SeqID_214843
atggaatttcaaatagaaattgctagaaggcactggacacaacttgcagagcccatgactaaatatgatcttgaaattgtcatggagttttatgcaaatgtctggcctatcgaggaaggagttatggataagcgctccaaagtgcagggccaatggattccttatgacacagatgctatcaaccaatttttagggaattcattgatctaa

SEQ ID NO: 98066 - DNA, 354 bp, Glycine max
  Peptide Sequence Number=SeqID_214844
atgagcaagaagaagagtaggattgattctaggcttaatgataccagacttagcacgagtgcacatagggttgacattttgagacacgaagccttcaaaagtgaaacaaatgacttgtcagttttggaagtgaaactaaacgaacaaattgatgttgtacgatctcaaaagttggagatagtagcggaggcagataagctgagagcagagaaagcaaagtttgaagctcagtgggagcttcttcatgaaaacaaagaaaagttgcgggaagaagcagaatacataacagaagaaaacaaggtagtttcaaaaattcaggtgcaatttgcttatttgattcactttatgtactag

SEQ ID NO: 98067 - DNA, 609 bp, Glycine max
  Peptide Sequence Number=SeqID_214845
atgacgtcatattccttaacaccattctctcgcgacggtgttgaaggagtcgtcgtaggcccgactcccaatgccaaatatggcaaagcagcaacgggagaggaggagggagtcgatgcaaaagttggcggctgcgtcagtgaggcaggtggcgaagaagcggaaggtggcaggggtttcctggccagcaagcctgctcctacccagtgcctcatgtactatttcgagattcatgtcaaggatgtcgacgttaagggccagatagcaattggattcacctacgagaccttcaagatacaaagacaaccagggtgggagactaatagttgtggctatcacagtgatgatggtctgctttattgtggatattgcatgggggagcattccctctatgccaataaaaatggccaagttgttggttctgtttacaaagacatgaaaggtcccattttccaaccattgttgttcactgtcaaaatgaagagtatgtcacttgtactgctattgcattcttatttgagtgcccacaaccatgttttcattgtatctgaatcctttcttttattggcaacactacttgtcgcaacctaccttacaacgggacggtga

SEQ ID NO: 98068 - DNA, 909 bp, Glycine max
  Peptide Sequence Number=SeqID_214846
atgacggataaagtccgtattgatactttagttgcaaactcattaaacggaaacaatgaaacctatttggcgcgccaagccgaatttgagtcgaatgttaggagttatccgcgcaaattgccgttggcaattgcgaaagcccagggcgtttggatcactgatgttgagaataatcaatatcttgattgcctggccggggcgggaacgttggctcttggacataatcaccccgacgtcctgcaaagcatccaaaatgtcattaccagcggcttgccgttacatactctcgatctcacgaccccgttaaaagatcgtttctccgattacctgctctctctgttgccgggcgaaggcaaagaatattgcctgcagttctgcggcccgtccggcgccgatgcggtggaagccgcgctgaagctggcgaaaaagcacaccggccgttctggcgtgatcagcttctccggcggttatcacggcatgacccacggcgcgctgtcggtcaccggcaacctgtcgccgaaggcggcgatcaacggcatgatgccggaagtgcagttcatgccttacccgcatgaataccgctgcccgctgggcatcggcggcgaagccggcgtcaaggcgctgacctactacttcgacaacctgatcaacgacgtggaaagcggcgtgcgcaaaccggcggcggtgatcctggaagccgttcagggcgaaggcggcgttaacccggcgccggccgagtggctgcagcgcatccgcaaagtgacgcaggagcatggcattctgctgatcatcgacgaagttcaggccggtttcgcccgtacgggcaagctgttcgccttcgaacacgcgggcatcgagccggacatcatcgtgatgtcgaaagcggtcggcggcggcttgccgctcgcg

SEQ ID NO: 98069 - DNA, 309 bp, Glycine max
  Peptide Sequence Number=SeqID_214847
atgaaggattggagaaatacaagtagtggggatgtctcctccacctttaggacctcacaatcactcacaaactcatctcaagttctcaggacgacttcctcttcaagcttggttctctgcagtgcgcttatcgggatgacccttcactcagcgaacatgcacaactcatccttcttccagattcttccttgcgctcagccgaggagtgttgcgcttagcggatggctcgctaagccagaagattggcttagtgggagggtgaaaatcagtacttcacaaacttgcctaattaacctgaaattgagataa

SEQ ID NO: 98070 - DNA, 267 bp, Glycine max
  Peptide Sequence Number=SeqID_214848
atgtggggtagtcatgataataagaaatactctcattgtccaagaccccaagaatatctatctaccatcccatgtggtggcattaaagtctctataactggcagaaacacacatcttcttgtaacacttagtagcagtcacagaacaaatttcagcaatggcagcccatgtggtggtatcttcttgcaattatcaatatctatctatccatccagagactttgcagaaaatcaaagaaagaacaaggctctcaatgcagaatcctaa

SEQ ID NO: 98071 - DNA, 1864 bp, Glycine max
  Peptide Sequence Number=SeqID_214849
atggctgaaagcccagctgaacgcgatggcgattcccgtgggggggttttggtcacgttcgcggcctggggcttcccggccgacggcgaactctctgcactgctgcagaaaaaatgcttcgaagccggtctgattctggagcgtggcggtcgtcacggtgcggcgattgcccagagcagcgccgcggttgtgcagtggctgcaacagcctgagatgtaccagggcaaaacggttgccgaactgcgcgagcgtatcacgctcgacttcaatccaaacggcctgggcaaccaggccgcgattgaacgtgcgattgaatatttcctcaaagacagtctggcggtgcaccatccgcagtgcgttgcgcacctgcactgtccgagcctggtggtaagccaggcggctgaagtgctgatcaacgccactaatcagagcatggattcgtgggatcagagcccttctgccaccattattgaaatcaaactgattgagtggctgcgtgcgcaggttggctatccggccggtgatgcgggcgtgttcaccagcggcggtacgcagagcaacctgatgggcctgatgctggcacgtgacgctttctatgcgcgtcagggccattccgtgcagcagcacggcatcactggcgatctgcgcaagattaaagtgctgtgctcagaaaatgcccacttctccgtgcagaagaacatggcgctgctgggccacggctatcaatctgtggtgcaggtgaaatcggatcagttcgcccgtatggacgtaaatgacctgaaagccaaactggcacaggctgaagccaacggcgaacagatcctggcgatcgtcgcgacggcaggcaccaccgatgccggcgccatcgatccgctgcgtgaaatcgcagccatcgccgctgagcacaacatctgggtgcacgtggacgcggcctggggcggtgcgctgctgctgtctgaaaagtatcgtcattacctggatggtctggagctggtggattccgtcaccctcgacttccacaaacaatacttccagaccatcagctgcggcgcgcgtgccgaacctggtgtccaagtcgctgcaaaccacccgccgcttcgatgcgttgaagctgtggatggggctggaggcgctggggcagaagcaatacgccgagatcatcgatcatggcgtgacgctggcgcaacaggtggcgcgttacatcgccgatcaggaatcgctggaactggtgatgcagccgcagctggccagcgtgctgttccgctaccgtccggcgcagctggcggcgaacggcgacgcggccgtcgccttgttcaaccagcgcatcggcgacgccctgctggaatcgggccgcgccaacgtcggcgtgaccgagttcgatggcgtaacctgcctgaagatgacgttgctgaacccgatcgtgacgctggaagacatcaagctgttgctggcgctggtcgagaaaaccgcgcagcagctgccggcgtaacgtcgcgcagtctgccactcaagccgataacatgcgttatcggcttttttattgctcatcagatcgcaggaggcgcagcgtttacgctgatatactgcatcaaacgccttctctcttgccagcccacaggatatgcacgcatgaccgaccctgatttcaacctgttgatcgcgctcgatgccctgctgacggcgggcagcgtcgtcggcgccgcacggcgtctcggtttaagcgcttcggcgatgagccgcaccctcagccgattgcgcgcggccaccggcgatcccctgctggtgcgcgccggccgtcatatggtgctgacgccctatgccgaaacgctgcgcgagcggacgcgaaatacggcattcgaagccc

SEQ ID NO: 98072 - DNA, 663 bp, Glycine max
  Peptide Sequence Number=SeqID_214850
atgcagccacgacattatggctcaaacttaaaccaacccaaaaaattttatgcaccttttgaccctgcaggatatagttattgggattacattgacgcctggaccaatgtgttctggcatcaaaatagtaaattcaagcattcatggctaatttacttcaaaaataacaccgtgtataattttccaaattggttcctccaatggtggaactacttcagaccaattccacagatatttccacaagaagtccaacagggattccaacaattcagcaagctcttcaatagcaaggaatcaagaatttcggcagatttaaaacatgcctttgtaaaatggtggtcacaattcgatacctcaaaggctgctccagaacaagtcaagaactggtttcagagcaaccctgagtttctcaaacctgctgatccagagacatctttgtttctgaatcagaagtctcaacttgcagcattcttggcaagctcaaaatctaaagagagtcttgctcagaatcttaaggaagttctccaactacttcaacaggaagaagaagaagaaccccccaagaaggaagccgaatcatccgaaaataatgatgaccaagaagatgatccattctaccagaatgaggatgactgttttggcatatcgttagacgatgattag

SEQ ID NO: 98073 - DNA, 1023 bp, Glycine max
  Peptide Sequence Number=SeqID_214851
atgcaggcggcgattgtagagggcattttcccgcgcggctcacgcctgccggcgacgcgtgatttagcgcgcgagctggcggtgtcgcgtaatacggtgctcaacgtctatgagaatctggtcgcgcagggatatgtcagcgcgcgcaccggcagcggcacctggattgcagaaaacctgccggaagggtgcctgaacagcgcgccggcgctgccgcttagtgaacccctgatgagtaaaccggcggcgatctctaaacgcggcgccacgctgctcggtcacgccaatgcctcgccttatcagtggggcgcgtttgtgcccggcgcgccggatgtgcgtgagtttccgcataagttatttagccagattcagtcgcggctgaatcgcgaacctgacatcgagcgactgatttacagcagcaacggcggctgtccgcagctgcgccaggcgctggctgagtatctcagcgtggcgcgctcggtgcgtgccgacgccgatcaaatcatcattactgaaggcattcatcaggcggtggatctggtgacgcgcgtgctgtgcgacgcgggcgatccggtgtggatcgaggagccaggctactggggcacgcgcaacctgttacgcattaacgggctaaaaattcaggccaaagcggtggatgaacagggcattatcccggagctggcaccgcgcagcaaagcgccgaagatgatttttgtgacaccgtcacaccagtatccgctgggtgtgcatctcagtctggagcggcgcagacagctgctcgacctggcgcgtaaacataaaagctggctggtggaagatgactatgacagcgaatttcgcttcgccggccagccatttccctcgctgcagggctttgagccggatgcgccagtgatctacatgggcactttcagtaaaacgctctatcccgcgctgcgtctcggctatctggtggtaccaaaagcgctggcgcagccgctgcgcgtggcggcggccgaactctatcgcggcgggcatctgctg

SEQ ID NO: 98074 - DNA, 381 bp, Glycine max
  Peptide Sequence Number=SeqID_214852
atgggtttaagtgggatagtatgcaagcaatccaatgaattgataagagagaaagaaaaggaactgaagaagaaccagaaagttgactcaacaacctctttcattctctctttgaagaagaacaatactcatataatgaagaaagacccaagaaatggccaatgctatgtccccaacagcatgccaaggccactcatgtgcaagatccccaagcttcctctcaaagaagaatctccagaatgcaatggaaatgtgaagcatcacacacccttaggcaaagaaactctgaaactctatgtccttaacaaaagcaaccatcaagagaaggaatcctattgtgaacaacaacaagccagagaaggaatcagaggtgtcaattag

SEQ ID NO: 98075 - DNA, 231 bp, Glycine max
  Peptide Sequence Number=SeqID_214853
atgtgccttattgttagacaatggcattatattgagaattgtcaggttgttgttaggaggacatatattattccacaggaggatcctgaagtagcaaagtttagagggcaaggcctcaaattcttacctgagatggaattcctttttaagggtattattgctactggtcttgcagcatatgcaccatctgaagattcaagacaatatgaaggattcaacacaagaacataa

SEQ ID NO: 98076 - DNA, 180 bp, Glycine max
  Peptide Sequence Number=SeqID_214854
atggtagattacaatgatcctatcaaaattaatttcgtgagggtgaatccaaacacgcatttatgtggtctcattatccaagttgttgctgttgtctgccaaactggaatgaccagaccaagtcatctgaggaaaacaaaagcgcttcgcaacagtgtcttcttaatggttagcacttaa

SEQ ID NO: 98077 - DNA, 336 bp, Glycine max
  Peptide Sequence Number=SeqID_214855
atggctgaaaccaatactagtatcaaaagctctaggcaattgaggtatgtttatagttttgctgataaggtgaaaagttttcctggtttggcaaggagggcaacatggaaggttggcaaagaggatccaagaagagtggtccatgctttgaaagttggcatggctttgacactagtttctttgctgtatctgatggagccattgttcaaagggatagggaaaaatgctatgtgggctgtcatgactgtggttgtggtgatggagttcactgtcgatcaaagcttcaattttttagatcaaaaattcagagcattcatgcatatcactgagaagtaa

SEQ ID NO: 98078 - DNA, 141 bp, Glycine max
  Peptide Sequence Number=SeqID_214856
atgaaggaagggcatattccttttgagttgggtgctatgtttggtcataacactagtaacgtagttgatgaaggaagtagacaagatgggccaacaccaagaggagaatcatcattagatagtaattttcttgcaacttga

SEQ ID NO: 98079 - DNA, 144 bp, Glycine max
  Peptide Sequence Number=SeqID_214857
atggcagttgggataaagcaaaaagatcttgtgaacaaaatggttcaaaagtttctagcaagcaatttcgttgtaatgctcttccactacgatggtattgtcattagggagatcggtaacctgctttcacgaataatgaattag

SEQ ID NO: 98080 - DNA, 129 bp, Glycine max
  Peptide Sequence Number=SeqID_214858
atgtatatatgtgtggaaatggccccaagaaagctttcctcaaagagatctaggaaggacgccgcggccgcagggactagtgccactcccaagttcgatatccatcgtttcaggagcgctgagcactag

SEQ ID NO: 98081 - DNA, 378 bp, Glycine max
  Peptide Sequence Number=SeqID_214859
atgagtgtggatgagttccttgcacaggtggcttggctaggagtccagccttctccgtttggaaggggtgaggcctccacagcccaagagcctgtgccagtagaggagcctgtgccagatgtagaggatgagcctattcctccggagccatttatctttgagactgattcagtcgctcaggaggaagcagcagctcaagagcctacttctccaggcgcatccaccgctaagcgcaacttcagcacgcttagcgtgacaaggtcatggaagcttgcttgtgaagcttctatggaggctggatctttaatcttcaatgaggagcttcgccaccaagaatgtgtcttggataagaagcttggagaggatgctttgagatga

SEQ ID NO: 98082 - DNA, 228 bp, Glycine max
  Peptide Sequence Number=SeqID_214860
atgagggttcaagatttgtttacgcatagagaagggtcgataaagggtgttgcccttgctcctacatatcctcagatgatgaacgaagaacgatgtagaagtcgattagggtcgcaattcggtagcgcctcggcctcgtttttctcttcttccttcttcttctctctaatttctctcaatgatggaccttggaacccttttctaagccaccttcatgcttatttatag

SEQ ID NO: 98083 - DNA, 327 bp, Glycine max
  Peptide Sequence Number=SeqID_214861
atgaatgtcggagctcttatctctggacagatcacatcaatggcccagtctaactcctctagaattgggttccttgctcttatcacaactttatgtaggtccagaggagttgctttcgacagcttagtctttgaacgtttgagcccgctggtagcgcctccagactccatctcgacggtagagcaatttaatgaatggctagcctggccagggactcagcctcctcttcacagggaagatgaagatcccgccactcaggtaccccatcagccgaaggatgagtcatcagagtcttccactcctgagcccttgatcaagaagaggagg

SEQ ID NO: 98084 - DNA, 132 bp, Glycine max
  Peptide Sequence Number=SeqID_214862
atggcaaagctcagagatacgatactgttcgaatcgaaaagacaagaaggagggcttcgaaacattgggcgagtcgagtgggtgtatagtcgagtcgaaggcaatgcagcaagatttctggacttagcgtaa

SEQ ID NO: 98085 - DNA, 252 bp, Glycine max
  Peptide Sequence Number=SeqID_214863
atgcgaaaaataccaaaaaaaggggacaaaagggtcttttccttggttttcctggaccctagctcgcccaggctagcctctggctcgcctgggctaccaaataacttcatggtgaagaaaccaactcgccttggcgagctcattccttcagcactaagttttagcttgcctgggcgagctgcaactacccaaagtgaccctttgcctataaataggcgtcgtaggggtgttttaaggggttctgagagttag

SEQ ID NO: 98086 - DNA, 186 bp, Glycine max
  Peptide Sequence Number=SeqID_214864
atgcatagccagggggttagggatatttggaacagtctccctacgcctatttataggaaaaggggggacgaggttgccgcccagctcgcccaagcgagctgggttgcctcctctagaagcaaccctacttcgaaaatattctggaagggttttaggaattttactgaagcattacggaagccttaa

SEQ ID NO: 98087 - DNA, 1287 bp, Glycine max
  Peptide Sequence Number=SeqID_214865
atgcaggacctgcgcggcgcggcgtcgcaagcggcggcgccggcgcgagcgggattcgaagcggcctttgcccatgcgggcaagcggcgcgcgagccggatgctgttcgcgatcggcgcggcgttgatcgtggccgcggcgggctggatgacattgcaggcgtatcccgcggcctatctgacggcggatgtgcacagcgtgaccggcgagtggcgcgtccagttgctggaggacggctcgcgcgtcacgctggccggtgacagtgccgtgaacctgcgattcaaccgccagcgccgggaactggaattggtgcaggggcaggtgctgatcgaggtggcgaaggacgccctgcgtcccttcgtggtgcgcacgcgcgaggcgcggctgaccgcgctgggcacccgcttcgcggtggaccggcatgacggcgtgacgaagctggcaatgatcgagtcgcgcgtgcgggtcgaggcggccggcgcggcgccggcgcaagcgctggtggtgcaggccggccagcgcgtggcggtttcggcacggggcgccgggccgattgtggcggtcgatcctggccaggtggaggatgcctggaaattccatcagttggcggcgcgggatcagccgctggccgacgtgctgaaagagctgaatcggcaccggcccggccgcatcttctatgacggggccgcgttggcgggcattcgcatgacggtggtgttgccactggacgataccgaccgggcgttgcgattgctggccgagagcgtgcccggcttgacgctgcggttcgcctcgtcctatttcgtgtggcgggcgccccacaccctgtctcccgctgcccgccttgtgctggccgggttgggcgcctcggtcgcgctgattgcccaggcgcagcacgtcgacaggcaatacgacattcccgccggctcgctggcggacgtcttgagccgttatgcgcaacagtccgacatcgcgttgtcgctgattgccgaacaggtggccggtcgcgagagtccggggctgcatggccgctacgcagtggaagaaggcttcgcggcgctgttgcgcggtaccggcctgcaggcccggcgcggcgcgtccggctatgtgctggtggtgtcgccgggagccgtgaccctggcgccggtcgagatcgagggcgacgaggttgccgggaaagaggtctatgccgcgccacgttcttccgtgcatctgtccagtcaggacctcgaccgtttcggtcgggtgtcggtcggcgacctgctggccggcataccgggggtgcag

SEQ ID NO: 98088 - DNA, 159 bp, Glycine max
  Peptide Sequence Number=SeqID_214866
atggcatttttcctaagctacttggactacaaggctcaaaacgcacaagtgagcaatgctctcgggaacggaaacgtcgcgcacactccagaaattttcacaaagatcccaactatatatatcagggtgttacagtctctacaagacataagactatga

SEQ ID NO: 98089 - DNA, 250 bp, Glycine max
  Peptide Sequence Number=SeqID_214867
gtttttcgatgtttcggtgaagaatgtggaaaatacccaaaagggagggccaaaaggtcatttgaagttttttctgacccctggctcacccaggctatcctctagctcgcctgggcccccaaataacttaggggttgaagcaatagctcgcttgggcgagctgctgatcaaccaagtccccttatttcctataaataggcgtgagagggctgaaggaagggttcagactttcaacattgaaaggatttag

SEQ ID NO: 98090 - DNA, 390 bp, Glycine max
  Peptide Sequence Number=SeqID_214868
atgaaagaaatgattgagagcttctttctctaccgaatccttgaggtgcattatgaggattccgctccgattaagacgttcctctccatgtggtggtctagcggcaagcaaagacagctcatggtggccatcggtggtctgcgacatttcacgctgagcgcatgtcctcttgcgttgagttcaacatttcgtgctgagcacaattcctctcgggttggaattgcacttagcgcgcttcttgcgataagcaagatgtcaaaatgttttactttgaaaatcccaatggttaaaccatggggatgtgggttacaaacctatagtctaaatttgaaggcaatccaatggttaatgagtctaggatcactgttttaccagaatgggtttaggtaa

SEQ ID NO: 98091 - DNA, 1257 bp, Glycine max
  Peptide Sequence Number=SeqID_214869
atggcatatatgcatcctaaccagttcaccttttctattgggtttgtgcttgcagtaactcctcagatgcaagagcagagggtaaaaagtgctgctgttgttacagatctcaagcctcgtcctgcagaaaatgtgacagttgagagggtagctgtaaaaagtggatctgtaaagcagatgaagtcccctataacttccacattatacacagttgcttctctccaaagtgcaacaaatagctttagtcaagaatttattattggtgaaggttctcttggccgagtttacaaggctgatttcccaaatgggaaggtaatggctattaagaagatcgacaactcagctctgtcattacaggaggaagacaattttcttgaagctgtttctaatatgtcacgcttgcggcacccaagcattgtgacattggctggatattgtgcagagcatggccaacgacttctagtttatgagtatatagcaaatggaaatctgcatgacatgctccattttgctgaagatagcagcaaggcattgtcttggaatgcccgtgtacgcatagcacttggcacagcccgggctttagagtacctgcatgaagtgtgcttgccttctgttgtacatagaaatttcaaatctgcaaatatattactcgatgaggagctcaatcctcacctgtctgactgcggtttagctgctttgacaccaaacactgagcgacaggtatcaactcagatggtcggttcattcggttatagtgctcctgagtttgcattatcaggagtatacactgtaaaaagtgatgtttacagctttggggtggttatgctggaactattgactggtcggaagccacttgacagtttgcgggttcgatcggagcagtcacttgtgaggtgggctacaccccaactccatgatatagatgccttggccaaaatggttgatcctactttgaacggcatgtatcctgcaaagtcactgtcacgctttgctgatatcattgccctctgtgttcagaagaatgtcttaggttgtatgggcacgtgtggagtagaggtttcactaagaagactagatcagatggaggaagtcctattattagagccggaacccgaatttcgacctccgatgtctgaggtggtgcaagcattggttcggttagtgcaaagagcaagtgtggttaaaagacgacccagtgaagaatctggttttggtcacaagaccccagaccatgaggccatggacatgccattttaa

SEQ ID NO: 98092 - DNA, 768 bp, Glycine max
  Peptide Sequence Number=SeqID_214870
atggcagcgttgatttccaaaagaatcctacgttgttcttcttggtcattgcattcactaggacgatgttactttgattcacctagtgctgggtttgcctctatttataaacctcgtgatgtatgcagcagtttatctggggagagaatgttgcctgcagatcgttctttggtcaggtctatggtccgacagttttctacttctattttaactcctggagctgatgatagtgcatttccatctgatttattgtccaaaaagactctggcaacatctgagcgtactataggaaatctagatggagggctttgccaggatcttttaattccagttaccaactttcataatgaagacaagggctatatggtttttcctggagatgtttttgatttacctattcggaaggacattattcatcgtgttgttaggtggcagcttgcaaaacgacaacaggggactcactcaacaaaaactatcagtgaggtcagtgggactgggagaaagccttggaatcaaaagggaactggtagagcaaggcatggttcattgcgtgggcctcagttcaggggtggtgccaccatgcatggccctaagccccgaagccatgctttcaaagtcaataagaaggttcggcgtctagggctgaagattgctttgtcagctcgtgcagcagaaggaaaggcaagtctcctcccccacctgtgtccccactcaccatcaaaaaataaaaagtggcatcttatctacattattctatctgttgcatga

SEQ ID NO: 98093 - DNA, 222 bp, Glycine max
  Peptide Sequence Number=SeqID_214871
atgagaacagctttcataatttacatgaagctggcccttgcagagtcgacaggtctggatcagaagcaaatcaacaactggtttattaatcaaaggaaacggcactggaagccttcagaggacatgcagtttgtggtgatggatccaagccatccacactattacatggataatgttctgggcaatccatttcccatggatctctcccatccaatgctctag

SEQ ID NO: 98094 - DNA, 225 bp, Glycine max
  Peptide Sequence Number=SeqID_214872
atggcagaatcatcaaagaagcgcaagggctcatcttccttcaccaccactgcaggccaccgccgccacgatgcttctggtgactctctgacaccaccaaacccatctctttcctcaccatgctctttcactttattttccaccgatgtccaacgtcagaggtattacttctcattttccaatcgtgtcattcttgaccctaaattccttaattttgaattctga

SEQ ID NO: 98095 - DNA, 159 bp, Glycine max
  Peptide Sequence Number=SeqID_214873
atggcgaacgaagaacatcgaacaaagaacgatgtagaagtcgatgatggttgcaattcggtccgaccacttcctcagcctccctcacgcctatttataggaaatgagggcatttgggactatggtagctcagccaggcgagctgatgcttcatcttga

SEQ ID NO: 98096 - DNA, 254 bp, Glycine max
  Peptide Sequence Number=SeqID_214874
atgttttacattggcgcgcggctctttatcctatgcaccaattcaacttgcaacgagggtgctgagaggaatggatcatctgaagaggatgttgatctacacaacatgatagatccccaggcagaggacagggaattaaagggtcagcttttgcgcaagtacagcggatacctgggcagtctgaagcaagaattcatgaagaagaggaagaaaggaaagctacctaaagaagcaaggcaacaattacttgaatg

SEQ ID NO: 98097 - DNA, 423 bp, Glycine max
  Peptide Sequence Number=SeqID_214875
atgcatcaatcgaatattctgttttggaggttcaacgatatttcacaagttgtccctatcttgacgtatttggacaacattgatgcagatgtgttagcatggaaatttaagtatggaccttccttgcactatgatgatcgtgaagtcataacatatcatagtcaagacatagatgaatggtgtttctttgatgttgtgggattgttgaagggtgatgtttttgatgggtcaatgaaattatggtggaaagcagagcatgctagctttgaaggcaacctggaaccatttttggataacaatgatgccatggagttgaccacttatgcaattcaaaataaatgtgaaatggctatttatgttgaacacccagtcacaacacttgattatactcatgagatgtgctttgaagatggacaacgttag

SEQ ID NO: 98098 - DNA, 741 bp, Glycine max
  Peptide Sequence Number=SeqID_214876
atggagggtagtagttgctctaatgacacttcttatttgttggcttttggagaaaacagtggtgggctatgcccaatgacgatgatgcctttggtaacttcccatcatgcaacaaatcctagtaatcctagtaataatactaataataatgaaaacacaaactgtctcttcattcccaactgcagtaacagttctggaactccttctatcatgctccacaacaacaacaacactgatgatgataacaacaaaaccagcactaacactgggttagggtactatttcatggagagtgaccaccatcaccgcaacaacaacaacaatggaagctcctcctcctcttcctcttctgctgtcaaggccaagatcatggctcatcctcactatcaccgtctcttggcagcttacgtcaattgtcagaaggttggagccccaccggaagtggtggcaaggttagaagaagcatgtgcttctgcagcgacaatggctggtgatgcagcagcagcagctggatcaagctgcataggtgaagatccagctttggatcagttcatggaggcttactgtgagatgctcaccaagtatgagcaagaactctccaaacccttaaaggaagccatgctcttccttcaaaggattgagtgccagttcaaaaatcttacaatttcttccaccgactttggtgatgaccctcttcctctctctatcttctcaaaatattctgcatatttaaaaatataa

SEQ ID NO: 98099 - DNA, 144 bp, Glycine max
  Peptide Sequence Number=SeqID_214877
atggatggaagtgtcgaaggcagcttgctggtaaatttaggtctggtaaataacctaggaattagggtttcttctgcagtggtgcccaggagtgacgaaaaagtgggcagaaaagagctgaagttctttggggataagtgctga

SEQ ID NO: 98100 - DNA, 1344 bp, Glycine max
  Peptide Sequence Number=SeqID_214878
atgtcaccacaaacagagactaaagcaagtgttgggttcaaagctggtgttaaagattataaattgacttattatactcctgactatgaaaccaaagatactgatatcttggcagcattccgagtaactcctcaaccaggagttccgcctgaagaagcaggtgccgcggtagccgccgaatcttctactggtacatggacaactgtgtggaccgatgggcttaccagtcttgatcgttacaaagggcgatgctacggccttgaacctgttgctggggaagaaaatcaatatattgcttatgccctgcgtgctctacgtctggaggatttgcgaatccctactgcttatattaaaactttccaaggtccgcctcatggcatccaagttgagagagataaattgaacaagtatggtcgtcccctattaggatgtactattaaacctaaattggggttatccgctaagaattatggtagagctgtttatgaatgtcttcgtgggggacttgattttaccaaagatgatgaaaatgtgaattcccaaccatttatgcgttggagagaccgtttcttattttgtgccgaagccatttttaaatcacaggctgaaacaggtgaaatcaaagggcattacttgaatgcaactgcgggtacatgcgaagaaatgatgaaaagagctgtatttgccagagaattaggcgttcctatcgtaatgcatgattatttaacggggggattcactgcaaatactagcttggctcattattgccgagataatggtctacttcttcatatacaccgtgcaatgcatgcagttatcgacagacaaaagaatcatggtatgcactttcgtgtactagctaaagcattacgtttgtctggtggagatcatgttcacgccggtaccgtagtaggtaaacttgaaggggaaagagaaatcactttaggttttgttgatttactacgtgatgattttgttgaaaaagatcgaagtcgcggtatttatgtcactcaggattggttttctctaccaggtgttttgcctgtagcttcgggaggtattcacgtttggcatatgcctgctctgaccgagatctttggggatgattctgtactccaatttggcggaggaactttaggacacccttggggaaatgcaccaggtgctgtagctaatcgagtagctcttgaagcatgtgtgcaggctcgaaatgaaggacgcgatcttgctcgtgaaggtaatgaaattatccgtgaggctagcaaatggagtcctgaattagctgctgcttgtgaagtatggaaggagatcaaatttgaattcgaagcaatggatactttgtaa

SEQ ID NO: 98101 - DNA, 1074 bp, Glycine max
  Peptide Sequence Number=SeqID_214879
atggagcgtttggccaggtcagctcgaacgtggcgttggcattggcgttcattttcctctttccaaaccctagcttctcgctcctcacctccttcttcctttcccaaatttgcgtcttcttggtctacctcttcctctgtttcgagttccagagttttgcgcgaggattattcgttgcttccggttgtcttagctggtatatttgggacgggattcgtggaagctgcatatgcggataatggtgctgttgatgtccaagaaagtgctaagaaggaacgtgagcgaattgaggagttgcttagaagtagaggaattcgatatggctcttatcctcgcttcactgtttccgttaaaggccaaaaggtcagtattaagtttcaaattcctcctaattgtgaagtttcacaacttatcgcaaatcttactgcacatcttggaacaaaagctgaaggccatggtggtggttcagacatgttattacgagcttgggacagcaccgttgcttggcaacttacccttactcatccatcaaaactaaaacatattcaagggaacaatctgtcttcaacagatataattgcagatgatagagatctatgtatactcatatttcattctctcattggttcagataaagctgaaattgaattcattaagcaaggggacttgagtcctgaagagcttgatgcttttgtctctgttttacaattagctggtaacaagttgggacaaagaaacaccctggaaagaaaaccgagggaagagactgaaaaggtgccatctgtagataaatctatttctgatcttgagggtatgggagtgagaatttatggacttgatgaacccgtaggtatatcaaatgatggtgagatatcatgggacaacattgctggttatgaacatcaaaaacgagtggtagaagatacgatactattggctttgcatagtcctgaagtatatgatgatattgctcgagggactcgtcataagtttgagtcaaacagacctcgagctgtgctatttgaaggtccaccaggtgtgtcatttaggctcttttatacgttttgtgtataa

SEQ ID NO: 98102 - DNA, 246 bp, Glycine max
  Peptide Sequence Number=SeqID_214880
atgctaagaataccgtccctcctaaaagtcaatcttgtcttcagggttgaaagcagccaactgataacagagatttcagcaaaaccttgcttgcggtgttgctcctctttcgacggtgggagaaggagatatacttacaaagacactccgaataaaggcgcaaaggttaaggtactgttccaggcttccagcaacgacgtgaaaggcacccaaacgcctaactatcccacttatgccataccatga

SEQ ID NO: 98103 - DNA, 2754 bp, Glycine max
  Peptide Sequence Number=SeqID_214881
atggtggcttacctattggaattcgaagaattggctaatcgcattattggcttgcccgcccccttccttttgagttgcttcatctccggcttgacgccggagattcgccaggaagttcaggcacaccaaccactaacgttggcccaggccgtcggccttgcgcgcctccaagaggagaagcgatttgatcatcctcgatcccaacgcccgcgccttccacccatcacgccacctcctcgtcctatccctctcccaccgcttttgccctctccacctcgacccccgccacccatagtgaaatgcttgatgttggaggaaatcaccttacgccaggagtgtgggttctgcttcacttgtgacgaaaggtaccatagagggcatcgctgcgcctctagggttttccttctcgtcgcggacgaggaagagcccaattggcttcatatggaacctgttgacccgccccaacccgcaagccttgtatctaacccgaacccagcccatccggctcaaattagcctaaactcacttttgggcactttggcacaagaaacactgcgccttactggctctctcgccggccaccatggcgagaacgacactaccttgggaatcctcactcaacaccagcttcgtcgtctttctcaaaagcacgatgatgtttcctacttccacatcacgatgttccctaaagatcctcctacaccacttccggccgacacacctgcagcaatccacaccttactcactaagtttgcagccttatttcagtacccacagacccttcctccggcaaggtccaccgatcttcatatccatttggtcccggattcccctccagtcaaccatgagccccttctcatcgccggtattgctggttcggaagcaggatggaacgtggcgggttaccatcagattcggatgcattatgctgatatccccaagattgctttcagaacccaccacgtccattacgagtttaacgtattgttgtttgggttgtgcaacgcaccgtcgtccttccaagccaccatgaacctgctttttcgatcgtatctccgccacttcatcatcgtcttcttcgacgatatcctcatatacagttcttctttcgaggctcacctgagccatttggaaactgcttttcagcatgctctatcctctactccaattttggccctgccaaatttctcattgccgttcacagtcgagactgacgccttcgtgatagtcaagaagtggcggcagtaccttcttggttggcgtttcatcattatcactgatcatcggagtctcaaggagctcctcactcaaacaattcagacaccagagcaacatatgtatttgacgtgcttaataggctatgactaccaaatacaatatcgcgccgacaaccataatcaggctgcggacgctctatcacgactgccggcacaggaatcctccatgtccatgatattgtctgtgccttccttgactttcctcgaagagcttcgtcgacagctgaacacttatccggaatatactcaacaacgccaacaaattcttgaagaccccaccaaccaaccccagttctctctttcgaatgatttggtgctacacgctagtcatatttggctttccagagacattccaatcatctccacactgcttacagaatatcatgccacacccacgggtggccatgccgacgttgcgaaaactttggccaaaatatcggccaacttttattggcctggtctaagggacgatgtaaaacactttgtagccaattgtgtggattgccaagtcaccaaatacgaagcccagaaggttgttggtctgttatgtcctcttccggtcccatgtcgaccatgggaggacctttcgctcgacttcattgtcggattacctgtgtaccaaggccacaccaccatactcatggtggtagatcgcttctctaagggtatacacctaggcacattgcctgcggcccacacagctcacatggtcgccattccgttcatcaacattgttgttaagattcatggcattctgagaagcttggtctcagatagagaccctctattcattagcagtgatggtcaaactgaggtcttgaataggataatcgaacaatacttgagagcttttgtgcatcgccggtcaagtctatggggccttgggtggaatgttgttgaagagatgatgactgatagggacgacacctttcagcttattcgtaaaaagcttcttaaagctcaggaagccatgaaaagacaagctgatagtcaccgcagggaggtaaattacaaggaaggagattgggtcctcccgaagctccgtcctcgtcgacaaactacggctaagggctcccaagcaatcacgggcaagctggccaagcgattttacgggcccttcctgatcctacagtgcataggtccagtcacatataagttacagctacccgcagcatcaaaaatctatcatgtgttccattcttccatgctaaaacccttttgtggctcccctgagcagatgacgggtctagagttacccggtctttcaccagacgagacctcctgggaagattggactcagttatgtagcacttaccagcttgaggacaaggtggttttacaagggccgaaggatgataggaactcagaaacaacaataatagggacaagggtcgaaatagcaaaccaaggggtacagggagaagcaaagcctaaaagaaaagttgtaaaaccatcttacctcaaggactatgtctga

SEQ ID NO: 98104 - DNA, 330 bp, Glycine max
  Peptide Sequence Number=SeqID_214882
atggggcacaccggttttgtagtgcttgcaggaatgcttgccaggagggataaaggcggagttgtgaggaactggtggaggttggttcgtgggagacgaggtcacggaagctatgcgggtgaggaactcatccattttgagggtcatggcttgcatggtatcaccaagttgagcaaggacatcctcgaggtggccggaggagtcttcatgcttcctagtaacataatgattcaaaagatatttgcgataacgaaacttggtagtgcttgtccccctaaagcagaccacatcaagcaaggatattccctatggtgcgaggtgctttactga

SEQ ID NO: 98105 - DNA, 1119 bp, Glycine max
  Peptide Sequence Number=SeqID_214883
atgcttgaatcttctatgcaatgtctcaaatgttctaaagaagaggcaacaaaatggaacactgcccttaataataatgaagcatgcaacaagtttaatatgcttcatggaatgaagcatgttgaagaaaaacaaattgtaggtgactgttactttggtgtcactaatttgctagaactcctacgcgctcagaggtccatcaatgaacttaaggctacacaaaagtcctctaagaaaacagtggaacaatttttgcagaatcttgaagacaaaagggtctcccagaagtgtagagaatgcctcaagattggaacaatgttagataacataaaggacaagttggcaagggaaaaaagaagtagagaaaggatggagttattcaataccaaattggtacatgaattggctaaaaccaagatttctgcaaagcagtatatgacaaactacaagaaagaaaagagagaaagaaaactgatagaggaagtttgcaacgaattagccatgcaagtaagggaagacacggctaagcttgaggtgttgctaagcgattccgtgaaaatttgcaaggaggtggaagaagagagggagatgatggaaatggctgagctatggcgcgaagaacgcgtgcaaatgaagctagctgatgtacagtttttacttgaagacaaatataatcagatggtccagttgattgcttttctccaagtgtttttgagatcaaggggtgctgaactagacaccactgaactagaggacgcagagttgatcaaacaggtagttgaatcagtaaatatcaaacgcattctggagctttcatatgatttctcaaagtcagatgacacagtttccacttttgaggagctaagaaaagaaaacacagaagaggggaagattaaaccatgttattcccataccacacttactagccctatgtccacaatctacattgaaaatcttgatgaagagttgaatgaaagctctatattgcatcacaacagtccctccagtgattataattttggattagaaccaactaattattccttagaaactattggttatattgaggatcggaagtttagctcaatgccacaaagaggagacacctatttctgttaa

SEQ ID NO: 98106 - DNA, 981 bp, Glycine max
  Peptide Sequence Number=SeqID_214884
atggcgtctctctctcacctcaacaaactcctctgcatgcccccgctcaactcttcaccctctatttcgccaccacgcagcagcgtcggaatttggaccaaacctgtcggaaggccgaggctactggtgcgtgtccgagcggtcacgagcgacgacgagtgggggccggagaaggaggaggcgtacggcggcggcgtagcggtggaggagaaaccgacgaagtcggagacggagacggagaagctgaagaaggccttggtggattcgttttatggcaccgatcgtggactgaaagcaacgagcgaaacgagagcggagatcgttgaactcatcacacagctcgaggccaagaaccctaaccctgttcccaccgacgccttgactcttctcaacggaaaatggattctcgctttttacattacagtggatattaaaacaagtgatgtaaacattacagggatcaacaaggtagagattgtgaagtttttaactgaaagttaccaactcatgggtggatttgaggttccgcaggtagaggaaatatcccagattattgactcgctgaattttaccgtccaaaactctgttcagttcgctggtcctttggccaccacctcaattagtactaatgccaaatttgatgttcgaagtccaaaacgtgtgcagataaagtttgaggaaggcataattggcactccacagcttacggactcattagagataccggaaaatgtggaatttctgggtcaaaagattgaccttacacttttcaaaggcatccttacctctgtccaagacacagccacatcggtagtgaaaacaatttcaagtaggcctcccttgaagatcccaatttccaacagcaatgctcagtcctggttactcaccacatacctcgacgaagaattgcgtatctcaaggggcgatggtggcagtgtgtttgttcttatcaaagaaggaagctctcttttgacaagataa

SEQ ID NO: 98107 - DNA, 894 bp, Glycine max
  Peptide Sequence Number=SeqID_214885
ttggaactcttacgtgccgatcaacgtctcatttcgccaaaagttggcccagggcttcccggtatcaacagggacaccaggatttatgtattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgcagcggtggatgagaaagtcttggatgttcaagaaaatataccgtatggtgcccttcccactgataatgttgagcacagatctgctgcaattgttggcaaagttgaagctgactttgatggattagttgaaaaagatccttattgtgttatccctaagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 98108 - DNA, 330 bp, Glycine max
  Peptide Sequence Number=SeqID_214886
atggacaaagctagcaacattagggagaagaaacaatcaaacatatctttcaataacaagtatgcagacctcaacaaattgcaacagcacacccaatatagcatgggaacaagaataactgctctttggagtcaagaattcccctttgagctcagcattttgtccagaggcttcattgaagatgccactgagcagacatggacaatattccaaagccacacaccatccatctcaaattggactagcctcattgatctctatatcaccagcgtaattgaattgtgtcctcgtgatccttccctagcatctccattggcacaagcactatga

SEQ ID NO: 98109 - DNA, 1218 bp, Glycine max
  Peptide Sequence Number=SeqID_214887
atgggtgaggagctatcacctacgttggttgtgagagagttcgacctgaataaagaccgagagagagtagaaaccgttgaaaggtcatgcgaagttggacccagcggcaagctttctctcttcaccgacatgctcggcgacccaatttgcagggtccgccattcacctgcttttctcatgctggtagcggagattggcgaagagatagtaggaatgataagaggttgcataaaaactgtcacatgcgggaaaagattgtccagaaatggaaaatacaacaacactaatgtgaaacatgtcccagtgtacaccagagtcgcatatatactaggccttcgcgttgctcccaaccaacgtagaatgggaatagggttgaaactagtgcatagaatggagtcttggttcagagataacgatgcggagtattcttacatggcaacggaaagagacaatttagcatccattaaactcttcaccgacaaatgcgggtattcaaaatttcgtaatccgtccattcttgtcaacccagtttttgctcaccgagcaagggtgtctccaagggtcacaatcgtaagtctttctccctcagacgccgagtttgtctaccgtcgccattttgccacaacagaatatttcccgcgcgacattgactcaattctgaacaacaaactaaatttgggaacatttttggcgctcccaaatgggtcctacagtgccgagacgtggcccggcccggatctttttctgtcggacccaccgcactcctgggccatggtcagtgtgtggaacactaaggaagtgttcacgctcgaggtgcgtggtgcgtcgcgcttgaaacgcacacttgcaaagacgtcccggttggtggaccgggccttgccgtggctgcggttaccgtcgatgccggacttgtttaggccgtttgggtttcagttcatgtacgggctgggaggcgaaggcccagagggtgtgaagatggtgaaggccctgtgtgggttcgtgcacaacctcgctatggaaaaagggtgtagtgtggtggccacggaagtgtcctcaaacgagcccttaaggttcggaataccccactggaagatgctgtcgtgtgaagatttatggtgtatgaagcggttgggcgaggattacagtgacggttccgttggtgactggaccaaatctcagcccggcatgtccatttttgttgacccgagagaggtctaa

SEQ ID NO: 98110 - DNA, 285 bp, Glycine max
  Peptide Sequence Number=SeqID_214888
atggtgatgaatccccaagtgaatgtgttttggaagctcatgaaggtgaggattggtaaggcaaagaaagatgctccaaaggaaaaacctgcaaaaaagaaaaacattgagaaggaaacagcagggaagtggcacactgatgatgatgagtcctccagtcttgggggtcagggtgatgtatctgcagaagaagcagctatcatgagattgcagattcaccttttctgggctaatatgctttttcaacaatccctagttgaatgcaaattaggaatgagtgattag

SEQ ID NO: 98111 - DNA, 360 bp, Glycine max
  Peptide Sequence Number=SeqID_214889
atggcatatcacttttctgaatgtgtagagagtcatgcatttgaaacttatgacaaatttatcaaggttcaaggagatgaattgaaaaaaatgccagctcctgaggttgctgtgaattattatacaggagatgacttgtatttatttgagaatctgtacgatgtatttgtaaatatcagagatgacgaagctgaacattgtaagacaatgaaggcttgtcaaacccatgggaacctccggtcacctcattcatatgcagaggatgatgacagctcagtctgtgctcttgaagcagattgtgaaggaatagtagactgtataaagaaatctgttgcttctaatccagctaaggtgaagtaa

SEQ ID NO: 98112 - DNA, 354 bp, Glycine max
  Peptide Sequence Number=SeqID_214890
atgggccctgacccgctcagcctccctcccgccgggcccgagttcggcccggatctcaccgacccagacgacggacgcgacggtttcggctcgacgccggggatttccaacattttcccgagctcgccggacttcttggggtcgccgccggtgtacggaacagagcgtgacgtcatcgtcggcggacgctcttttacttgttcgggtgttggtggtgcaagtggaaggagaactaagttagaagtgcgggaggtaaaggtaaaggttcaatggaattgcagaaatggggttgagcgtaggcaaccaacggagacaaaactacggcagccctcaaatgtggtagttttgtactga

SEQ ID NO: 98113 - DNA, 963 bp, Glycine max
  Peptide Sequence Number=SeqID_214891
atggtgtacgggtcggcggtgacgagtttgagcgaggaagtgagggtggggtttagggtttcgagagcggtggtgtgggttttcatggtggtggtggcaatgagcttgctcgttggggtgtttctcatggtggcggtgaagaaagcagtgatcttggtggcgctcggagcggttattgtgcccgtcgttgttttgatcgcgtggaactgcgtttgggggagacgagggcttttagggtttgtgaaaaggtaccctgatgctgaacttagaggcgccattgatggacagtacgtcaaggttaccgggaataaggaagaaggaacgggaatagttgcctttttacagaaatggatgtcatattgttatactcttagttttttcttaatcatgatccttgaacaggttgtaacctgtggcagtattcctttggagtcatcctaccaaagagtacctagatgtgtatatgtctccaccgaattatatgaatataaaggattgggtggaaaatcagcgaattctaaacaccgttgcttcacttggggttctagatattctgagaaatacgtagcagacttctacgtatcagacttccagtccggattaagagcattagtgaaagcaggctatggtgccaaggttgctccttttgtggaaccaactactgtagttgatataacaaaggataacagagagttatctccaaatttcttaggctggcttgcagaccgcaaactctccagtgatgataggataatgcgcctcaaggaagggtacatcaaagaaggtagcaccgtaagtgtgatgggagttgtccaacgacacgataacgtgctcatgattgttcctgcggcggagcctgtctcaacaggctgccagtggatccgctgccttttgccaacctatgttgaaggcctaatcttgacatgtgatgatagtcaaaatgctgatgtcattcctgtttag

SEQ ID NO: 98114 - DNA, 861 bp, Glycine max
  Peptide Sequence Number=SeqID_214892
gaggttaacgatacttttccggatgccaggattgatttatttgtaaagggaagcatatcacctattatttttaaaaattataaaaatattgaccagatcattcagcttccgaagaaacctttcagcaatcttctgaaatacatccggagctggagtttgcttcgctggaaaaagtatgatttagtgatcaataccagccatagctcgtcatcgggaaaaatatccacacaactggccaatggcgattataagttctttaatgaatggagtgatgaacttcattcagaatatccggattatccgcatgcggcaaaaaatcctatttataatttgcgaaaatttcttacccacctgggatttgaaagaaatacaggaaaggttccttttttaaatataaagctgagcccggaagaaatagaaacgggtaaaaggaaattagaaggaattactaaaaacgataaaaaaaccatttgtctctttaccaatgccacaggcgataaatgctattccaatacctggtgggcatcattctatgaaagcctgaaaataacatttccagattataatattgttgaacttctaccggtagaaaatatttccagattagatttcaaaattcccagtttttacagtaccgacatcagggaaatgggtgcctttatagccaataccagtgtttttattgccgcagataacggtgtaatgcacttagccagtgccgtaggaacacccacaataggattgtttatggtaacggatgaaaatgcatataaaccctataacgataaaagcttctccattaatacaaataatgttaaggaatccgaaataccggatttaataaaaatggtccttcaataa

SEQ ID NO: 98115 - DNA, 834 bp, Glycine max
  Peptide Sequence Number=SeqID_214893
atgaatgacacaggggatctgcaggcagtaagcactactaggcccaagaggaagcctcatatctatgagttcaccactccacgtcacgcatccacttccttcgtttgtgatctgaatgttggcataagcagtgcaagaacaatccctgaggcaaaaatcctgacactcccttgggttcatgctcctgttcacaaacacataggttgtctacgtctgaacactcccacgcacgtgcaaaccgatgaagcgttggtagtcacacaacccataaggaccacacgctctgtagccatcacactgattcttaggcgtgtactaaaacgtggtccaagttttgctacttggcacccaacaaatgaagatagtgttgtggaagtcgagccattttgcggcatcgatagtagcataaaagaggaaggagtggttgttgcagcggctggagaactccttgcggacttgggaaatggtgatctagcgacgatcagaggacgcgtgggggttgctgttagcaaggaagggaacgaccataatgggaaacggagccggcaaggcatggacggcggaggtggcacgggcggcggagtcggcgtcggcagcggagtcggcaagggtgattggttgtgttgcatcggtacggggcatggaggtgcagtcagcctagaaggcggaggcgatggtggtgactgcacggaggacgatggcaagtttggccatggcggcctcgaggcgatcctcgcgagcggcagaaagttcggcatccgccattcgaggtgtgtgccgaaatggaaaggaaggtggttgttgatggagggtagtgtggagaggaagcaatga

SEQ ID NO: 98116 - DNA, 1020 bp, Glycine max
  Peptide Sequence Number=SeqID_214894
atgacttttcccattttcctatcctcgctttctcactctcattctccttcttccccacttcgcaaccgcaacaacctaacaacacaaactcctcctcgaagcacaagaagacactcccatcacgcgcttccagcgttacctccgtatcaacacggcccacccttccccagacgactcctccgtggtcttcttcctcaaagcccaggcccaaagcctgggcctcaaaacccaaaccctcgagttcgtccaaccaggtcgggctccaaccccttcctcctcctcaactcccacctcgactccgtccctgccgagcccgagaaatggctccaccctcccttctccgtccaccgcacctcctccggcgccatcttcgcccgcggctcccaggatgacaaatgcatcactattcaatatctggaagccatccgcaacctcaaatctcagtccttcaccctacaccgcacaatccacatctccctcgtccccgacgaggaaatcggcggcttcgacagcgccgccaagtttgttgagtctgaggaattcgacgggctcaacgtcggattcgcgctcggcgaggggcaggcctcgccgggcgacgaatttagggttttctactcggatagggttccgtggaacgtgaagattagggcaaggggactgcccgagcacgggtcgaggatgtacgatgggagtgcgatggagaatttgatggagagtgtggaggtagtgaataggttcatggagagtcagtttgatgtggtgaaggcggggaacgcattgaatgctgaggttgtgtcggggtttgtgatgaacgtccagcctttaggggcagaagctgggtttgatctgaggctgacaccaacgacagatgcggaggaaatgaggaggagaattgcaaaggaatgggcgccggctgttaggaatatgtcatatgaggcatttatccagtatgttgtcattggctgcattttttgttcaagtaggattttggattctccttgcttgggtgctactgactga

SEQ ID NO: 98117 - DNA, 195 bp, Glycine max
  Peptide Sequence Number=SeqID_214895
atgtcacaacgggtgagggatgagaatgggttcgaggtgggcccaatatcaagtgcctttgcccttgatggctttggtgcagaatgcaaggaggccttcaaagcatttgtggatgatgcatatgctggcgacatcaaaagggaggggtcaatggaagtagaggtggtagaggtcattgtgatgatggggttctag

SEQ ID NO: 98118 - DNA, 207 bp, Glycine max
  Peptide Sequence Number=SeqID_214896
atggaaagatgcttatcattagacttgttggaacaaactgaagaaacctgtgaacaagacatatttagatttggcattcactggaacaaacaagtaatgaaagctgatatatccatgcgaggtctagccaagaacgttgcagccaccatggtcgaggcaatgccatgctactctgccatggcacttggcaaaaactcaaccatgtga

SEQ ID NO: 98119 - DNA, 501 bp, Glycine max
  Peptide Sequence Number=SeqID_214897
atggctcgcaccaagaaaactaggcaaatgacgtctaaggcagcaaaggaaattgctgacaagattgcctcacaggatttttttgtcacccatggatgtcaagatgtattgactgctgccattgggcgactagaacaccctagtcgtgtgcgtggtgctagacccggtgtaatgatcaagaaatactttggaccggcttcaaggacctctcgcacgtcttcctccatggcttccaaagacctagagaagctgacgcaaaaaatcagggaccagctggaggaactcgcgctgcctcctgagtttgaggggtccacaactattcacaatattcctttgctccttgatcaagtcaaggttggtgttgaggaggttagagatgcagatgctcccattcctgtacccatagaaaaggttatgtgggatgctaccgtgtttggggtgtttaatgagaacttccccttgtacataaagcatgaagatttgtctaaaatagcaccggtg

SEQ ID NO: 98120 - DNA, 114 bp, Glycine max
  Peptide Sequence Number=SeqID_214898
atggcttacatcccaaagtgccccacttttatgcttgagaagtcaggaattaggttgatctgcaagtttgttaaggatcaagttgatccacaagttgctcacggatcaacttaa

SEQ ID NO: 98121 - DNA, 351 bp, Glycine max
  Peptide Sequence Number=SeqID_214899
atggaaagaagctggggtagctacggaatagcgttgagggagacgccgtggaagtttaagaatcgggtcatgacccgatccaaggacgagacggaggtggtggagatgaaggggcggagcagcaacgagatgaagaagacgctcaactcgtgggacctcatatggttcggcatcggcgccgtcatcggctccggcatatttgtcattaccggcctcgaggcacgtgacgctgccggtcctgctgtcgtcttgtcctacgttgtttccggcatctccgccttgctatccgtcttttgctacacagaattcgccgtcgaaattcccgtcgcaggtttttcccctaactattaa

SEQ ID NO: 98122 - DNA, 231 bp, Glycine max
  Peptide Sequence Number=SeqID_214900
atgttgctaagtagcaatgtcatccatatctgtgtaagagtggtcatgttggtgcgcatgatccacactcatctctttgtagcggtacaggtgaaatcttgccaagttgtgctcgcacagttggccttcttccaggatcaggggatggcccaggacctgataaaaggaaactactggccccttaaccgggagcgtaagtctcggttaagcattaagggcagaagaccttaa

SEQ ID NO: 98123 - DNA, 246 bp, Glycine max
  Peptide Sequence Number=SeqID_214901
atgatgaagaagaaaatgacacaggagaatgtgggccctccaaagatggtaactccatcgtggtcgaaggattctgtttttgagagcgagcaatcgaagaagagatcttcttcttctccgaggccctccaaagatggtaactccatcaagtctaagtccaagtctcccacttggtctaagggttcggagagcaagtcgctgctgtcaatgggggaggatgagcaaatggctgagcttgcaagctag

SEQ ID NO: 98124 - DNA, 294 bp, Glycine max
  Peptide Sequence Number=SeqID_214902
atgacgtgtggtgataacccggggtcgttgaatcacaacatcaattttatgaccgtctttcaaggacggcttttctacatcggttgtctagctacaaccgatgtagaatgggtaggtttctaccgcgattctaaggctgaaaccgatgttgaatgggtaggtttttacatcggttatcagtcaaccgatgtagaaaatgaaagatatggtagcgtggctacatcggttatcaatcaaccgatgcagaaaatgaaaggtttttacatcgtttatcgtccaaccgatgtagtatga

SEQ ID NO: 98125 - DNA, 261 bp, Glycine max
  Peptide Sequence Number=SeqID_214903
atgaattctaaatctaagaacaaaaaggaagaaaactacacactactcattcgtgggaattcatggacctggaagggaatgatgggatacaacttggtcttcaataaccagctcttcaaccctgaaaaagtcatggatgaagccttattccatacttggtccttaagggtgggtaccacagatgaggttgggcctttgtcacctgggccatctaggactgagaaagaccatagttgtactggtcagcatgttgacgaatag

SEQ ID NO: 98126 - DNA, 147 bp, Glycine max
  Peptide Sequence Number=SeqID_214904
atggctctgatcttgcacgcaaccaaagcaaacaagaattctttcaagactctgattgcggcagagtacagtggcgtccaagtggaattggaccctaatttcgagatgggtggtgtccaagtggaattggcgtcaaagtggaattga

SEQ ID NO: 98127 - DNA, 1368 bp, Glycine max
  Peptide Sequence Number=SeqID_214905
atggaagctcagaagaaaacccaaacccaaaccaaactcacccgaacccaatcctctctgcttcggtgttcctctcccaccaccaccacgcgttcttccgttcatagcctctcttcggtcaacgaagacttttttccagaagaagaaaagtcctcctccgatacgagcagcaagagaaagaagaagaataataaaccaattagacttagacccggttcgatccggttctcgttggctggaccggttcttgggttcttcaccgcgtgcacgttcttctcctacttcctctacctcggttcacgcgccgccgcggcaacctccgagaacgtgttggcggtgctggtgttcctcgcggcgacgctctatttcctgaaccggaacaagtcactgatccagcgaactttctcggtcctcaagcacgcgtgggatggaaacctgaaaagactcggtttctcgacaaagggtagcgagaaaccggttcagtggttcatcggcgatgacgctaccatgagtagtagggaggagggtatgaacaaacataagaagaataagaataaaattaacaacgatgttgttgttgatgttgatgttggtgaaggtgatgtcatagaaggtgtagagttttatagcaacggggatttttatgagggagagtttcatggaggaaggtgtagtgggagtggagtgtaccactattttgagagtgggaggtatgagggggaatgggtggatgggaagtatgatgggtatggaatagagagttgggctagggggagtaaatataaggggtgttataagcaaggtttgaggcatgggtttggggtgtataagttttacactggggattcctatgctggtgagtggtgtaatgggcagagtcatggggtgggggtgcaggcttgctctgatgggagttgctatgttggggagtttaagtttggggtcaagcatggacttggatgttaccatttcagaaacggagataggtatgctggagagtactttggagataaaatacatggctttggtgtctaccactttgccaatggccactattacgaaggttcatggcacgaaggtcgtaggcaaggttatggcatgtatatgtttcgaaatggtgatggaagatgtggtgaatgggatgctggcaacctcaaactctctctaccaccacaaaatgatgctatcattcgcacagttcaggctgctaggaaaacagctgaaaatgctataaatcttccccggaaggatgaccacgtgaacaaggcagtaattgctgcaaacagggctgccactgctgctagagttgctgcagtgaaagctgttcagaaccaaatgggtggaaaattttgcgatattgatgtctga

SEQ ID NO: 98128 - DNA, 709 bp, Glycine max
  Peptide Sequence Number=SeqID_214906
gagacaatggcttggatatcatgacttggtctacaaactaataaagcttaaagtggagatatcatgcctctatgaccaagtagaacaaaaagaaaagttaagaaatgagttggagcttatgaataaatcacttgaggaatctgaggctcagttacagagtagaacagtggaaagcaatgagctggtgagtcaaattgctttattgaagaaggaagcaaaaaggtcacttgatgagctaaataggatgaagaatctcaagtatgaaaaagagttggcgggtagagtgttgcagtcagagttagaagcacttagaactcaatataatgacttgaaaagttatcttcttggggatgaggctgagaaagaaaatgtgagaaagcaagttttccagctaaagggtgaactaaagaaaaaagacgacgcgttaatgaacattgagaagaaaatgatgagaggaaatcaacaaacactattgtattcaggtcatgagagagaggttccaccgaaggatatcaacatacattttgaggaagactataacaagttttatgaaggcttctctaagaacctgaaacttggtattcatgaggattctcagaacaagacaaagctagctgaattgctcaggtatgactcgagtaagagtgctgatgagatgaccagcctcaaggactatgttaccaggatgaaggaaggacagaatgaataa

SEQ ID NO: 98129 - DNA, 1653 bp, Glycine max
  Peptide Sequence Number=SeqID_214907
atggcttcgacaaacggaaatggagtttttctggcgcatatgccgattctggacgggaagaactacaacaaatggtgcattcagatgaagacgatattcgagatgcaagatgcgcttgatgttgttcaatctgggatccaagatttggagaaatcagcatctgatgctcctgaaaagacgttcaaggagctcaagaaacgtgattgtaaagcccttttccttatacatcaaggtgtggatgcagttaatttcgagaagatagcttccgctgccacgaccaagcaagcatgggaaattcttgcaaaggcgtatgcaggttctgacaagttgaagaagatcaggctccaaaatcttcgaagacaatacgaaatgttgcagatgaatgataaggagacagtgggcgagtatcttggacatgtgcagattatgaccaatcagatgagtggttggggacactttgcaaaggagtgtaaaaatcctaagaggcctagagttcaaaatgatgaggccaaattggttcaagaagagaattcagaatatgatcatgtgatattgatggtcaccactgcattagaaggaggtaacagagaagaaaatgcatggtatcttgacactagatgcagcaaccatatgacaggaaggaaggattggctggttgatctggatcttagcaaaaaagggaaagtaaggtttgcagatgacaataccataagaactgaagggatgggaacaatgcaaatccaaaagaaagatggaggaatttcttgcatttatgaagttctctatgtgccaatcatgaacaacaaccttctcagccttggtcaattactgcaaaatgggtataggatgttattagaggataatgctctaaagatatttgacaagaagaatagattcatcctgaaagcccctatgctgaagaataagaccttcaaggttgaaatacaagccaaccaggaggtaaactgcttatcaatcactgaagaaggagagagctggttatggcacaagagatacgaccatctaaatttcaagagcctcaacagattacatgatcaaagcatggtgtcaggattaccaaagctggttgcaccaggaagagaatgtgttgggtgttgtatttctaagcaaccaaggaagtcttacaggaacctgatcacgagtaggacaaagtcagccttggaagttgtatacttagatgggtgtggaccaatggaggttgaaacacttagtggtaacaaaatttttgtcacctttatagatgatttcacaaggaaggtatggatttatcttcttaaaaggaagagtcaagtgtttgaagtttttaggaagtacaaaaccatggttgagaagcaatctaaactgagcatacaaactctaaggacagatggaggaggagaattcacctctcaagattttgagatgctttgtgagcaggaaggcattgttcatgaggtcaccccaccttatacccctcaacaaaatggaactgctgagagacttaacaggtccatactgaacatcaccagaaacatgttgaaatgctatgaggttccaaagaagctatggggagaagcagtagcaacaactacttacctgctcaacagaagcccatcaaagaaacttgatggcattaccccggaggaagcctga

SEQ ID NO: 98130 - DNA, 600 bp, Glycine max
  Peptide Sequence Number=SeqID_214908
atgaccaaggtatacctcaccaccttcgtgaaagagcttgtggaggagcatcatcgtgaggaagttctgccaaattcgaaaaactttcccttcaaccactacataatcgtggcaatgaacgacggtgacaccaacaccgttaaccaaggaaagcgaccacgcaagcaggaattcaccatgctagggatgcttgccatgggtgcctctgaaaaagggaacccaacaaattttcccttctcggacaacttatgcaagaaaccgctggcaacattggaagagttgagagcaagggttgtcagcttcatccagatggagaagatggtcagattcaaagaaaaagtctatggggaatcatcaaagaaactaatggaagattcgttaaggataaagaaccttcatggaagcaagaaagggagtgtgataaaagtcgatagcgtagttggactcgagaaacaatataatcgcaatcatgatgagacttccccacctgaaactcagattcaaggtgtgatcaacatgatagcaggaggattcacaagtggtggaagctcaaaatcggcgagcaaatgctatgttcgtagtcttaagtttgtcaactag

SEQ ID NO: 98131 - DNA, 181 bp, Glycine max
  Peptide Sequence Number=SeqID_214909
ccctaagcaatttgggggcccaggcaagccagaggctagcttgggcgagctagggtccagaaaactccctgaaaagacccttttgcccatccctttgggtatctttcgcatccttgaccaaaacatcgaacgatctttcatcttgcgcagtaattggtgtcgaacaacacagttcggctag

SEQ ID NO: 98132 - DNA, 198 bp, Glycine max
  Peptide Sequence Number=SeqID_214910
atgcatgacgccaccaccactgacgcttccaataagagctgccacgtggagagggacgcgctagtagcagcagcggcttggccttctgcttacgtggagtgggacgcgcaagcaagcacaacagctttggcagaccaggagcagcttttgcagcaggagcagggaggaagcgcaaatgatgttggcattttagggtag

SEQ ID NO: 98133 - DNA, 273 bp, Glycine max
  Peptide Sequence Number=SeqID_214911
atgggtgccaagtacctcgaagtggtcaaacgagggtcgcatcccaacaaacggatggtcctcggacgaaatttgggtatgacacttacaaatttagggattaagcaccaagtgacttcagtagaacatccacagagtaatggacaaattgatgcagccaacaaggttatgcccgaagaggaaaaaagtgagtcagaaaaggaaaaggaaattgagttaaggagctttcgaccatcttatgggcttatcattgcactccgcagtcgacaatag

SEQ ID NO: 98134 - DNA, 588 bp, Glycine max
  Peptide Sequence Number=SeqID_214912
atggctaggtcaagtgctttaacgaaccttgtgctaaaggacgataaagccgagaaaaagaaggctgagaaagctaaagatgacaaaggcaagaagcatgatgaggtggaagaaaaatgggtgccccctccttctttcatcaaacctagtgccgcgaagagggcccatccaagtcattctcatcaacaagatgttgcagcaacaaggcaaagggtggaacttgttccaattgctactccttcctccatcaagaattgtgagatgttgagggaagccgatcaacaagcatcaatggattccattgctaacttccaagtaaggacttggagaattgtagatttttgggctaatgagtttgagaagactgtcaccaagtccaacaaggctcaaactgaacttgacaagactaagttaaaagaggtagaggcccaagaagaggccttgaagaccaagctcactataactgaggcttctactaaagttctcaaaaaagagattgaacgcctcaacaaggaattttctcttttcaaggtgaatgcagagaatttgaagagtgatcttagtaaagttgagtatgagatcctctag

SEQ ID NO: 98135 - DNA, 216 bp, Glycine max
  Peptide Sequence Number=SeqID_214913
atggtccccgagtccaagttaataacatttgtactcggcctcatccccctaaatttttttatggatggtggcagtgacgccagcaaccgcgacgacaccattgacgggaacactagactcttggtcattggcgacattagagccaccgtgatggttaaatacttggctaaagagaaaattcttgtcggacttggctacaatcaaactgatgagtaa

SEQ ID NO: 98136 - DNA, 579 bp, Glycine max
  Peptide Sequence Number=SeqID_214914
atgccgtcgcgcttgaggtccatcagttccggttcgaccatcgcaaccgtgcagcacgcccagtacggtggcgtgcagcatgcgcgcggcgatcttcgggtccgctccttcgcgcagctggcccaggtcccgggcccggcgaagcgcacgctccatccggtccagcgcatcgcggaatccggcctgctgcatttcggtcagcaccttggtgtcggcggaggcatcgctgcgcagcatgatctccatggtcttgagcaggcgctcatcctcggacagctcgatgaacgagtggatcatcaccgcgcgcaggtcgtgtacaggagtgtcgcgctgctcggtggaggtgcgttccagttcctgcatgaagggcaggtgcacgctctcgacgatggcggccagcacctcgctcttgttcttgaagtgccagtagaccgcgccacgggtatagccggcgcgggcgccgatcatctccagcgaggtacgggccacgccgtgttcatggaaacaggcttcggcggcgtcaaggatgccttcccgggttgcctgggtgtcctcattgggcttgcgggccatggatga

SEQ ID NO: 98137 - DNA, 399 bp, Glycine max
  Peptide Sequence Number=SeqID_214915
atgctatttcattcgtatcatgattcagtgtgtcttgacaaaggggaagggacggtcacagttcgattattgccctcgttttttattctcacttttgcttcatccactccgatgcaatgtgcagcttcagcagctctaagagcaccggattcttactttgtggaaaaagagggattatatagcaaagagggatatttaggttcaaggtttgaaggatgttggattcgagcattttgtgagtatctgattaaggaggcgggggtggctgcaatccctaccagtgtgttttatttgaaccctgaggagggaaagaatccagtaaggtttactttctgcaaggatgatgaaactctaaaggctgctgttgaaagaatgaaggagaagcttaaaagaaaatga

SEQ ID NO: 98138 - DNA, 1250 bp, Glycine max
  Peptide Sequence Number=SeqID_214916
ccaaccgccgcaatgcgcagttgagcctggtggccgagcccgcgactgcgtggctgacctatgatgccgatgcgcagcagctgaagatcgccgaggtccacgtagaagacctaggaggattcgctgcgcctggccgaggcccgccacgaacgtggtggcagttcggcgctggagctgacccagacccgtaccctggtcgagaccgcacgtacggatgctgcacgcctgcgtggccagctggcccaggaccgcaatgcgctggcgctgctggccggtggccagctggatccggcactgctgccggacagcatcgaaccgcagctgcttgcactggccccgccgccggccggcctgcccagcgacgtgctgctgcagcgcccggacatcatggccgccgaacaccagctgctggccgcaaacgccaacatcggtgcggcacgcgcagcgttcttcccgagcatctcgctgaccggcagcatcggcagtgtggcacccgtgtatggagtttcctgccgaagatcaccctgccgatcttccagggcggcaagctgcgcgccaacctggccatcgccaacgcagatcgtgatatcgctctggcgcagtacgagaagtcgatccaggtgggcttccgcgaaaccgccgatgcgctggcattgaatgtcagcctggacgagcaggtgagttcacagcagcgcctggtggacgcggccgaacaggccaaccgcctgtcgcaggcccgctacgacgcggggctggacagcttcgtcaccctgcttgatgcgcggcgtaccgcctacaacgcgcagcagacccagctgcaggcccagctggcgcaacaggccaaccgcatcaccctgtacaagctgagcagcaattcgataccggtagcgccgggccacgcccgccggcctttcgttcctgcatgcctgacgtctgggcggaccgcacttcgtgctcgccgggcatggccaggcgctaccgcatgggccaacggcaccatgcaaacggatattcatcgagatgcagggtcaatcctgctcggatggggttgcccaggatgtacaacgcatggcgcctcaaggcttcctcgctgcgtaccgcgtgatcgaaatagctcggctgccacaaaggcgtctgtatgccgaactgctgccccagcaaccggctgctgcgggatttcaccgttcccatcatgcgcgccagtgatccgtcgcgcagctgcatcagccaatgcagatggtcaggcatga

SEQ ID NO: 98139 - DNA, 306 bp, Glycine max
  Peptide Sequence Number=SeqID_214917
atgggaggtggtgcaaaaagaaggacaaagaactcaagggcagtaaacaatgggcccatcggtggctaccgtaagtggttgaaagcccacgtgcaagggaggaagtttgaggcaccagaggaagacgaaaaggtgcaggcccttagggcagaactcgagcaagcccaaacagtcaaagaaaggttcaaatcagcagctcttaagatccgaaaggagaatgccaaactaagagatataaatatagcctaccaccaaggccttggaacaagagaccaagagggctcgcaaggaagagcatggccgtga

SEQ ID NO: 98140 - DNA, 630 bp, Glycine max
  Peptide Sequence Number=SeqID_214918
gtcgactctagaggatcccacggccatcacgcggaacatctgcgcttcggccatttcgcgggccttgagccgcgccacgcgccattgcagcagttcgatgatctggtcttcgggggtgttgtcgatgatcagctgcacgccggtgcgcaggaacggattgctgaccttcttgagttcctgttcgaccttgtggacgtcggtgttcatccacagctgcgccatgttgaccagttcctcgatgtcgcgctgctggtcgtgctggtcgctgcggaacaccgtgaccaccagcttgaacacccgcatcacttcggacagcgggtaggcgatgaacagcgcggcgcaggtgccgcccagcacgatggccaggcccggcaggttgaagtacatgccggggttggtggcggccagcgcgatgacgatgaccagggtgagcaggccgacaacggcgccgatgacggtagacggattcatggatcttgcctgatagctagcgcatccggttcacggaatgcgggatggtggcaaattctagccacgggcgggtcgcgccaatccgtcggaaaacggggcgaaaggggcggtaagcgccggcttgaaccggcgtccgggcgcggggccccaggagaataa

SEQ ID NO: 98141 - DNA, 405 bp, Glycine max
  Peptide Sequence Number=SeqID_214919
atgaccctttcatcatggcagaacaagctaaacaggaaaatggttacaccacccaactctcctcctcctcctactggtgcagcatcacagtcacgatctaccttgaagcaaacaagaaaagccatatggctaagatcattggcgactagaccagttggggcagagagaccgctagtccatgtcgatactatgactgggaaagctgacagtccccacagaaagaagttaagaacatatttggggatcatcgctcgtgataaggctgaatttgatatccctgaagcattagatccgaggacaaaaaagaaaatacttcagactatgggggagcggtggagacaatttaagtctgatttgacatcaaaatgggcacttgcagccgacaaggaaagtgtcgaagacact

SEQ ID NO: 98142 - DNA, 133 bp, Glycine max
  Peptide Sequence Number=SeqID_214920
atggtggcacacaatttgcaagctccatctacacatatctctccaccatatagaagtagaggaattagtatatgtaggcctcttgcgagtgctaaaagtgaggaaattgtaacaaagagaacaaacacatcag

SEQ ID NO: 98143 - DNA, 225 bp, Glycine max
  Peptide Sequence Number=SeqID_214921
atgccattatcagttggactccaaacatggaattctggccagaagcgaatccgggatcagccactcattatccggatgaaaattatggatagaagaagaaagcttcattctaatgttatgaggaagctgaagcgagtcagcaatgggagagtcaaaacatcaattatccttccaaaagttgatatccgagcccgatccaatgagccaactagtattatcctttaa

SEQ ID NO: 98144 - DNA, 213 bp, Glycine max
  Peptide Sequence Number=SeqID_214922
atgacatattataagagagaagagagggattgggggcgtgcctatggcgccggcgatggggaaatggcagagagggcacgtcggagaggacaacgaagagggaggacgacacctgtgaccatgagaggtggcgacattggcgatagcgacgacgaacggctagggctccataggttattgcaagacgtttggattctgagatgtgaagaatga

SEQ ID NO: 98145 - DNA, 306 bp, Glycine max
  Peptide Sequence Number=SeqID_214923
atggctccatcaataagatttggtctccttaagcatatctggaggatagtgggaaggggtgaaaaggacgatggcaacagaggaggtgggggtgaaaaggaaaaggaaatggaagaggtcgagccaacaaaggaggtggagacagaggagagtgaggatggagcagggggaagagaaaaggaagaaacatggaggagggaaaagaagagtgaggtgggaggcacctttgttgttgaaactcaaggatatggaattgaggatcctcgggttgaggttggagctaaagaggaccctgctagtggttga

SEQ ID NO: 98146 - DNA, 1011 bp, Glycine max
  Peptide Sequence Number=SeqID_214924
atgtctttgttcttgtccgattctaccatcgatatgggtggcagtgattctgggggctcatttgagcaacccataatggatcgggaggtcatctcaataggcggttccttgtcagaggatacttatcgaggtgcctctgacagcaagtcctcctcttcggagaggggtacaaccttctgctgctactggggagccagtctcggtcactgttatcctcccccttctgcttctgggggtgtgaggagaggtagtggtggtgaagatgtgaaggcgtcttcctgcgtgcgacgtagcaaaagtgttaggtcactatcgtccaccccaaccgtcactggctatgagtgggtgaggaattacattttaaaatataagtcctccctcacctctatggcgagtgttgctgtgcttcagtgccaagtgaacctagcaaaccctgaggacttctgcaagttggccgttcaagcttgcgggagtgatgatttccttttcttgagggtctcgggtgtcattcttcccttgactgcttccgaatgtgctctgcttgagcacttgaatgtggcctcttctcaagtccacctaaaccattgggaaacgggtcgtttcttcaaggtcttggctactggtgtcgtggctgatggtatgccattgatggatgacaaagtaattttggagaagttgctgacctcactggacacgttggccattttgtctcctcctttgacaatcgatccccttgctgccttggatggtaaaatgcctaaccttgcccttatttgtatcttaggtcggccactcgtgaagcaggtcaaacctgcaagtgggactgtgccatcgtctaccgctgctcctgctgttggagaagagggtcaacctgctggtgaggttggccctattgttgttgttgctgtggtcacccccaacgctcctccctctgttttggtaaagaggaagagggatgatggtgttgggccgtctggtcggaagaagtcgaaggccccgatgagcctttga

SEQ ID NO: 98147 - DNA, 113 bp, Glycine max
  Peptide Sequence Number=SeqID_214925
gttgccaagctctgagccggcttgcaggcaaaagagattgtccaatgttgaaggagattgtctcgtgtcgagggagcttgtctgatgttcggggtagtagtcttgacaaatag

SEQ ID NO: 98148 - DNA, 411 bp, Glycine max
  Peptide Sequence Number=SeqID_214926
atgactaagctgctgcattacttgacgtttaatagcacaataatatcttggcataaaacaaaaagccgaaccaacctaagaagaatccaccaaacagacaggccgtccagatctcgtcgtttacacgcgcgcgactactgctgtggcggcagaagcagcgacgctgccgaggaacgagaggaatccggagctgttaggctcctgatcgtcgagaaagagatcctcgggaacgcgaaaagccccgtgcgcgcacacgatcgccaatccaaccatgagggcagagatcaacaaggatccaacactggtgagcaaaatgacaaaggtgtgtccgaagaggacgacaggctaatccgaagggcgaaagagataaaggaacgaccacgacgcgaggagaccgaagaggacaaatag

SEQ ID NO: 98149 - DNA, 384 bp, Glycine max
  Peptide Sequence Number=SeqID_214927
atggctctcggccaaatgcaacccatccaccaccaatgggcaaatatctccccgacagcagctattttggcaaaaatcacccaaaaacacgatcaagatcaaacagcagaaactaaatattacgagcgtacctccagtcattacagatcgaacgcgaagcgacgcatacacgaacccaaagatagttttgttcttccagacccttactcactctgtatagatggtgtattttctgaattgagaagtggttttagtgatccaaaattgagagcacctcatcctatttatagagtttgtccatcacagagctcaaccaatttgttatcagaacatggacttgaggataggtacgtgatttgttaccgaaggtggttgcaaagataa

SEQ ID NO: 98150 - DNA, 210 bp, Glycine max
  Peptide Sequence Number=SeqID_214928
atggataacagcaacaaagatgtgatcattggcgcatatcaccactgcaaggaagatgttgggatgatgaaggatatgaatttggattcatatagattttccatttattggtcaaggattcttccaaaaggaaagctaagtggaggtataaatcgagaaggaataaactattacaacaatcttatcaatgagctagtggctaatggttag

SEQ ID NO: 98151 - DNA, 1884 bp, Glycine max
  Peptide Sequence Number=SeqID_214929
atgaccttggtttctcgaggtgaaacatttgaacttggtttcttcagtcccgagaactccaacaaacgttatctcggaatttggtacaagaatatcccccagacagttgtttgggtttcgaacagggccatcaatgattcctcaggcatcttaacagtgaacagtacaggaaaccttgtcctcagacagcatgacaaggttgtctggtacacaacatctgagaaacaagcacagaatccagtggcgcagcttctagattcagggaatcttgttgtaagagatgagagtgaagcagactcagaaggatatttatggcaaagctttgactacccttcagatacaatacttccaggcatgaagttgggattgaacctcagaactggtattgaatggagaatgacatcttggaagaatcccaatgatccatccccaggagacttttattggggtcttttgctttataattatcctgagttttatctgatgatgggaacagaaaagtttgtgagagttggaccatggaatggcctgcatttcagtggcataccagatcaaaagcctaacccgatttatgctttcaactacatatccaacaaggatgagaagtactacacttatagcctacagaatgctgctgtgatctcaagattggtaatgaatcaaacctcttcaatgagtattagatacgtatggatggaaaacgaacaatattggaaggtctataaatcgctgccaaaagacaactgtgactattatggcacatgtggagcctatgggacttgcttgattacaggctcccaaatatgccagtgcttagcagggttcagtcccaagtcaccacaagcatggaactcatctgactggactcaaggatgcacacggaatcagccattaaattgcactaacaagctcaatgatggatttatgaaagtggaaggtgtgaaagtgccagatactacacatacttggttagatgagacaataggtcttggagagtgcagaatgaagtgcttgaataattgttcttgtatggcatatactaattcagacataagaggtgaaggtagtggctgtgtcatgtggtttggtgatctaattgatattaggcagtttgaaaatgatgggcaggatctgtatattcgaatggattcttcagaattaggggaacaagaagagcacaagaaggtggtgatcataatagtttctaccaccattgctacaattttagtaattctttgtattggttgttatcgtatatacattgtgcggcacagcataactgagtattcagatattgtacgtgatcaaaataggggaggaagtgaagaaaatatcgatctccccttacttgacctttcaacaatagtcattgccactgataacttctcaataaacaacaagattggagaaggtggttttggaccagtatacaagggaagattagtaagtggacaagaaattgctgtgaagaggctctcaagaggctcgggacaaggaatgacagagttcaagaatgaagtcaaactgattgctaaacttcagcaccgaaatcttgttaagcttcttggttgttgcgttcaagaacaagacagaatgctggtttatgagtacatgactaatcgtagcttggattggttgatttttgatgatactaaaagcaaactgctagattggcctaagcgtttcaacattatctgtggaattgctcgaggtcttctttatcttcatcaagattctagattgaggataattcatagagacctcaaagcaagtaatgttttgctcgatgaccagatgatccctaaaatatcagattttggcattgctagaatatttggaggagagcagacagaaggaaatacaaatcgagttgttggaacttag

SEQ ID NO: 98152 - DNA, 204 bp, Glycine max
  Peptide Sequence Number=SeqID_214930
ttgagcttagctcatcagtgggctaagcgtgcatccattgctaagcgtaacttcagcatgcttagcgcaacagaagaatctggcagagcatcaatatcaaggccgcatgctaagcgcgagattagtgcgctaagcacagcaattgtcttcagccaggctcagagcacgactggcgctaagctcgaagccacttacatgcactaa

SEQ ID NO: 98153 - DNA, 336 bp, Glycine max
  Peptide Sequence Number=SeqID_214931
atgacaagcagatttggtcattctgcacccttgtatcatccagaggcggcgggcccgatgatacgcagagataccttacggttattcgcacccttttgtcatccagaggcggcgggcccgatgatacgcggagataccttacggttattcgcacccatttgtcatccagaggcggcgggcccgatgacaagcagagaccaagtttggtcattctgcacccttgtatcatccagaggcggcgggcccgatgatacgcggaaatacccgagtggttatccgtataaacattcttttgctatctgtaagacagaacgcttgatagcatgcagaggctga

SEQ ID NO: 98154 - DNA, 189 bp, Glycine max
  Peptide Sequence Number=SeqID_214932
atggttagggcggaggaagagacgagagagaaggttggggagaaagagagagagattgaagagatgagacagagaattgaagatgtagagaaagttagagttgtggaaatgaaagagaaaggagagagtggatggttccatttatcttcaaagggacttcagtgtccaattgatgttcttcctatgtaa

SEQ ID NO: 98155 - DNA, 393 bp, Glycine max
  Peptide Sequence Number=SeqID_214933
atgtggacaagcttacggagcggggcaagtgcacatgttgggagtgtacatgcagcgctcgtggctgttcgcgtacgcggtgaactacccggcgcaaaagttcctgcaggcgcagagcaggatcatggtgatggcgtggatcgcggcggcggcactggtgctgcacactttgttcagctggttgctcattctggagttctggtggggtctcgtcagcgccgtcgtggtgctgaacgcgtcgtggtggttcatcgacattggacagctgcacactttttcttcaatcttatagaagacgacacaagttcgccatcagagcttgaagatgagagggcaaagagtgtttcttctctctcccgcgctcactatgacggcaatgaagagtcaggatag

SEQ ID NO: 98156 - DNA, 1230 bp, Glycine max
  Peptide Sequence Number=SeqID_214934
atgccagtgaaccgtggccaaggccaaaccacaaggtggtatcagctatgctttattcccactagttcagacaattcagatgattcagacatagaatctgtagtcctaactcctagtaacctaactcaaactagtagtacatggcaagaactttctccgccgataccaccagaatcagaacctgaaattgattggagtttaccaccaccaccaccaccaccaccaccaccgtcaccgccaccgccactgccaaattttctaccacttcagagagttgtactaactcttggtactccaactagtagtacatggcaagaactttttccaccgtcatcaccattgtcgtcaccaccacgtccaactcgaattagtagtacatggcaagaactttctccgccatcttcaccattgtcatcacgaccaccaacaaacctagaacctgaaattgatatgagtttgtcattgttatcaccaccaccactgttaccagattttctacagtctcggcctcttcagagagcttcggctagaacatttaatattgaagtacaacaagatagacaccaacctccaagtccaagtcatgtgtttgaaggtgatcaaagtgactgctcaatgaatgtcaagaatggcattacaagggtgagagtctcagagatagataaactctttcattgccccatttgcatggatgagtttaaagtgggtggtgacaaagcatgccagctaccctgcacccacacctactgttctgaatgcattcttcgttggcttgacaacaataaaacatgtccagtttgcaggcttcagttgaatggttgtagttttgatagcataaattgcaataatggtttggactcacaacctcaaattccgtccctgccatcacggtcaccaatagttcataatgattcgccccagcgttgggagaacttttcccaatcccctccctaccttttacaaggtatagagaatagcatcaatgataataatggtttggactcacaacctgaaattctactgccgccgccgccaccaccaccatcagctcataatgacttgcaccggccctgggagtactactttgaatctccctaccttatagtacaagatatagagaatagtgaaggtggtaactcagatgaagctgattatgatagtgcatgtgatgagcttggcgatcctcatgaagatggagcttctcagagtgttcctgctccactaacttaa

SEQ ID NO: 98157 - DNA, 279 bp, Glycine max
  Peptide Sequence Number=SeqID_214935
atggtgaatgggaatgggaattatcttggagtagggagtggttcacttgggaaatgggaattacaattcagagatagtttggcaacggttttggaaaatgctatctgcttgcaacatgtggaggacaaatggatttggcttgaagatggttcaggggaatacacaacttcatcagctaacaaggcattaaatgtgcagaggtgggcaagccaaatggatgacgtgatggaatatggtgcttcaaccggaggaaatcttatgccctttttggagttgtaa

SEQ ID NO: 98158 - DNA, 415 bp, Glycine max
  Peptide Sequence Number=SeqID_214936
atgactgccgtgaaccgccggaatctgctgctggacgtattaccgcgatggagagcactgtccaagaatccgggagtaccgcgccgcatgcttcgcctgccggactggcaggcagactggaacgcgggcatggccctgcttgcgcgtcatgcgcgcaatggcggtgaacttgcggaggagccgctgcaggggtatgcggcgttggaacatgcctacggctgggaagcggttgcccagaccggcagcaacatgatgatgaaaggcatcgaccgtggcttcgcccccacggcgttgcagcagatgcaggccgacgtgacagagctgtggttggaacacgcacgtttgctggcgttagcccgggacagcctgcaacagcaaggccaagacatcgcgctggccgcgtcgttgcaaccgc

SEQ ID NO: 98159 - DNA, 156 bp, Glycine max
  Peptide Sequence Number=SeqID_214937
atgaacccctctggcgacagcggttcaagctggccctggcagcgatggttcaagttggccctggcagaggcatcgtcggagaaggagtacttcggggtcataatttatttaaacttaaagtcaacctatcaagatccaataatagatggttcatga

SEQ ID NO: 98160 - DNA, 369 bp, Glycine max
  Peptide Sequence Number=SeqID_214938
atgagaaatttagagtacttacctcgtaagttatggtgggtagcgacgaaagccctccaacgacgtccaaagttgcgggttttgattcgtaagagtaaggaaaaccaaaaaaggggtagagaagagatgaagagagggggagaaggtgagaaatggaaaggagaaaaggaagtgagaaatctgagggaaagggagggagaggggctagggttcagtaacgaagaggggaagaaacatattcaaatctctaagccatcgttggctagctgcaacaatctacctatggctaaggttgaaagtgttcatgacttcctcaaaggaaagaccattttggttaccggtgcaacgggatttgtaggaaaaggttaa

SEQ ID NO: 98161 - DNA, 183 bp, Glycine max
  Peptide Sequence Number=SeqID_214939
atgtttgtattcaacaatgctttgaatggacttgatgatacttaccaaagtaaatccaagcctgctgctaggtggattgttgttaaatatttcactgacgctagaccattggaaccagagagattgaaggcgcttcgcatccagtgggcaaagtactatttgaaagttaaaaatgaaacttag

SEQ ID NO: 98162 - DNA, 333 bp, Glycine max
  Peptide Sequence Number=SeqID_214940
atgaagttagacgaactggaaaatgaggctgctattatattgtgtgagttgaagatgtattttttgcctgctttctttaacatcatggttcactttattattcatttggccaaagaaatcaaatgttgtggtcctatttatttgcgatggatgtacccggttgagcgatacatgaagatcttaaaagggtataccaagaatctacaccgctcgaaagcatctattgttgaaagaaaaaagttgatggatcagaagagaaagaaaaaattggaggaagctgctcaatccaaaagcactaacaccgttattgatcctccatctcccatcaaatga

SEQ ID NO: 98163 - DNA, 255 bp, Glycine max
  Peptide Sequence Number=SeqID_214941
atgcgatcagagaagaaaccatggtcgccactcctctgtgaggaactcatcgaggaaatcttgtctcgtcttcccgtgaaacctttgatccaattcaagtgtgtgtgcaagggatggaactccctgatgtcagatccctatttcatcaaattgcacctaagcaaatctgctgcaaaggacgatttggaacaccttcaactgatgaaaaatgtctgcctcggatccatccctgaaatccacatggaatcgtgtgat

SEQ ID NO: 98164 - DNA, 174 bp, Glycine max
  Peptide Sequence Number=SeqID_214942
atggctaccttggggctggagattttggttgaatctgcctcaagtgttatttcgaagatgatattatcatttgaccttgcttttgctttgattccgctcctaaagatcagtagcagcaaaatgactagcagcacaagcattgaagagctaggcatacattatatcaactgttag

SEQ ID NO: 98165 - DNA, 390 bp, Glycine max
  Peptide Sequence Number=SeqID_214943
atgctacgctccatcgaatcctggaagatcaatctgatatccgtctggtttggctgcttttttaccggcctggccattagtcagatcattcctttcctgccgctttacgtggaagagctgggtatccgtggcggcaacgcgctcagtatctggtcaggcctgaccttcagtgtcacctttattgtttctgccgccgtggcgccgctgtggggcagccttgccgatcgcaaagggcgcaagctgatgctgctgcgcgcttcgtttggcatgggcgcggtgattctgctgcaggcgtttgtcactcaggcgtggcagctgttgctgctgcgcgcgctgatgggactgacgtccggttatattcccaacgccatggcgctggtggccgcgcag

SEQ ID NO: 98166 - DNA, 2694 bp, Glycine max
  Peptide Sequence Number=SeqID_214944
cgccacggtttgaaagagcgtgcgcagacgtggatcgcccggatcaaaactgccaccgccggccgtttactgatcgtctatctgtttgtgcgtgaactgactgcggcgctgggactgaccagcctgggcgggcatccgcagatggtgcgtccgctgctggcgccgatggccgaaggtgccactgaaaaccgttacggcagcgtatcaccggagattcgtcagcggctgcgcgccatgtcggcggccaccgataacgtcgggctgttcttcggagtcggcgggcatcagcaccgaaccgttgcacatcgcgctgtggggcattccgacggcgctgtgtgcgttcctgattcatgctgcgcgactggcgctgcgcgcaaaaggaggcgagtgatgtttcagcaacagtatctgatgtggctggccggggcgatcctgctgattgtcgcgctgctgtcatggcgcgatagcgccaacccgcgccgttttaccaccggtttattctgggcgctgtacggtctgattttccagattggcgacggtgcttatcaactgatggggcagtgggccggtgatgcggagctgggacgtcgctggttgcatattgccgtgggcgcggcggtggtggtcatggcgctgattgccgggttcggcggcgtgcgcctcggtcgctaccatcagcgcagcgatgaacagaagcagcagagcgcgcagcgtctcggcaacaagctgtttctgccggcgctggcgatcccgctggtgacggtgattggcgtgctggcgttcaatcatattcccggtctgcaggagaaggtatttggcccgggcaatcattcgacgctggtcacgctgttttcgatgatgattggctgcgtgctgggctggctgatcgcgctgaagtttacccatgagaagccgctgcagtcgatgcaggagacgcggcgtttgctggatgcggtgggctgggcgtttattttgccgcagattctcgccacgcttggcctgctgtttaccagcgctggcgtcggcacggcgatttcgcatctgaccgaacactatctggcggtggataaccggctgattgcggtcgcggtatatgcgctgggcatggcgttgctgaccatggtgatgggcaatgcgtttgcggcgttcccgattgtcaccgccggcatcggtattccgattctggtgctgcagcacggcggcaatccggcggtgatggcggcgatcggcatgttctgcggctactgcggcacgctgatgacgccgatggctgccaacttcaatattgttccggcacgtttactggagctgccggaccgtaacgcggtgatcaaggctcaggtgccaaccggtgtgctactgttactggttgcgatgaaaacggtgttaatgacggcgttcgagccgtttggcggcgagcgcattaatccgtcgtgggaagcggtgcgcagctttgatggtcgggagttcggcggcgcgcggattgtggtgcgccagctgccggtggtattcgcccgctgcggccaggtgctgaccgccgcgctggaagagctgcagccgcaccgcgtgctgtgcgtcggccaggctggcgggcgcagcgatatcagcgtagagcgcgtggcgattaatgtgaacgatgcgcgcattccggataacgaccagcagcagccggtcgatcagccgattgtcgccgggggaccggcggcctatttttccacgctgccgatcaaagcgatggtcgcggcactgcgcgaagtggggattccggcttcggtgtcgcaaaccgccgggacgtttacctgtaataacgtcatgtatcacctgctgcactggctgcagaccacaggcagcgcagcacgcggcggtttcgtgcatattccttatatgccgcagcaggcggcgcagcatcctggggcaccaagtatgtcgaccgccagtgtgattcaggcgctggaaacgtcgctgcagggaccggagatccgccgcgcggcggatcaacttgcagcggcaatggtgggcaagcctttgaccgaggtatggtttgcttttccggcgctgaagacctacgaaccggcgctgatgggggaaaccatcgatgcctttgaaacgcgcggcaaggcactgctgacgcacttctccaacgggctgacgctgtatagccataatcagctgtacggcgtgtggcgtgtggtaccgagcgggactgagcccaatacttcgcgccagctgcgcgtgcggctggctgctgaacgcagatacgctcggcgcgcatccgtttttgcaacgcgtcggaccggacgtgctggacgctacgctgacggtggaagaggtgcgcgagcgactgctgtcgccgcgttttcgtcgccgccagttcagcggtttgctgctggatcaggcatttctcgccgggctcggcaactatctgcgcgtcgagattttgtggcacgccggtttgctggcgcagcatcgtgcacaggatttgagcgaccagcagctggatgcgttgagccacgccatgctggcggtgccgcgtttgtcttatcagatgcgtggcagcatgaagaagtatcacgaagaggcggcgtttcgtttcgaggtgtttcaccggcagggcaaaaagtgccggcgctgcgaagaggcgcgggacaggccatcatcgtcttccggcaaatcgcaccagagctaatgcactga

SEQ ID NO: 98167 - DNA, 147 bp, Glycine max
  Peptide Sequence Number=SeqID_214945
agccctgcctggctgagccccgtttcaggcgtcctcgcgccgctgacgcggtaccttcacacccttcgtcagtctgacggaccgccgtcgacgggacatcctgtcccggctccggctttcacccgcatccatgcggtctcatcctga

SEQ ID NO: 98168 - DNA, 489 bp, Glycine max
  Peptide Sequence Number=SeqID_214946
atgaatgtgttcataacaggtgcaagcgggtttatcggtatggcgatcgccgcagagctggttcaggccggtcatcatgtcaccggactggctcgttcggagcagactgttcagcgtctcaatcgtattggcgcggacgcgcaccggggtgaactgaagaatcttctgagtctgaccgtgggtgcccgcgccgctgacgcggtgatccactgcgcttatgaccacgcttttgctcacccgcaggacacggcaatgcaggaaatgcaggcaattgcagccttgggtaagggattactggattcgacgcgaccattacttatcacttcagttgctgccatgggcagtcgtgcaccgggtcagcttgccagcgaggatttttacgacccgtcgatgcaaaatccgcgcaaatcgactgaaatagcagcagcccaggtcgcagacagtggcgtcaatgtttccatcatccggttgcctcaagtgcacaacgag

SEQ ID NO: 98169 - DNA, 492 bp, Glycine max
  Peptide Sequence Number=SeqID_214947
atggatccactttccgaagtgcttactctgctcagattgcagggggctatctcaggcggttttccagtggaagcacagaccgcgctggtgtttgcgcctcatcagggcatcaaatgctactgtgtcgtggaaggtagctgctgggtagcggttgacggaatccagcagcctctgttactggaaaccggcgactgtgtatttctcacctctggcaaatcctttagtctggccacccatcccgcggcgaaaagacagccttttgtaccgcccgacagcgaaacgggcgcgctgacgcaggtcacgcccgatcagggctctgcccgcgatcattcccgtcaggcagggcacgggaaccaacattatgcgcagtgcgatggaatgcctgagagaggagatacaaacttcgcagccaggcggcgttttactctcgcagcaactggtgcagattatgctggtgcaggcgctcagggtatttcttcagcaggaaggtga

SEQ ID NO: 98170 - DNA, 579 bp, Glycine max
  Peptide Sequence Number=SeqID_214948
atgagtgaaagagcattggaaagatatcccggtttccgcaacaataacattcacttctataaaatcaacaagttagtgattgaccgagatacattacgagatattgattttgccatgcgaaggacaaagaaaccctctatgacctggtcggaatctgtagaccaggctttatgctatggctggattgatggagtaagaaaaagtgtagacgacgaaaaatataccatccgctttactcccagaaaaccgacaagcatctggagtgcgatcaatataaaaaaggttgaagatctgactcaagcaggattaatgaaaacagcgggtctcaaagcatttgcattgagaaaacaggacaaaacagcaatatattcccatgaaaatgctctcgccgaattaagtcctgcttttaaaaaacaattcaaatcgaataaaaaagcctgggatttttttagtaatcaagcaccatcatataagaaagtcatgctgcactggatcatgtctgccaaacaggagaaaaccaggatatccagattggagaaaacaatccgtgaaagtgaacaacaaaaacgagttttataa

SEQ ID NO: 98171 - DNA, 801 bp, Glycine max
  Peptide Sequence Number=SeqID_214949
atggacgagagctacaacttatactacgcgggcgggctcagcgcctcgcagattatgcgcaacaacattaccaacgcggccatccgcgatggctggaagggctttgcggcgcgctcgtcggataccgcgaacctgatgaatctggccacggagtccagcctgaccaagcagcgcctgagctgggcctcgttcggtaccatcatgggccgtatgctgccgatgtttcagtcgctgctgatgctgatactgattgcgctgttcccgatggtgatcgcgctggcgctggtgaatcacacgattttcggcctgaacacgctgaagctgtacgcgggcggcttcctgtacttccagatgtggccggtgatgtacggcatcctcaactcgctggccaatttttacctgcagtcgaagaccgggacgacggcgctggtgctgtcaaaccaggaccaggtggcgctgcagcactcggacgcggccaacattgcgggctacctgagcgcctctatcccgatactgtcgttctacctgaccaaaggggccggtgccatcgcctcgcaggtggcgggcagcgtcatcagttcggcggcgtttaccaccggcgggcaggcgtccaccacggcggacggcaactggtcgttcaacaacatgtcgatggataacgtcagcgccaacaagtttgacaccaacatgctccgccgttcggggtcgcagagcatccagaccggcaacaatgcgatgatgacgcagacggcggacggccacacggtggtggataccagccaggcaatatccaacctgccg

SEQ ID NO: 98172 - DNA, 105 bp, Glycine max
  Peptide Sequence Number=SeqID_214950
atgggttttgaagatctgctcttcaaaggtgttgtgcctcaacaaaggcagcagaaacctaaggttccggggacaaatgttgtattcaatttgggaaccatgtga

SEQ ID NO: 98173 - DNA, 917 bp, Glycine max
  Peptide Sequence Number=SeqID_214951
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatgggctgctggcgacggccctggtcggcctcttctggctcgactggctgctggtcgtgctcgtggtcgccctgctggtcggcgcggtgtccgagatcgcgacggcggtacgcggcatcggcctggacgtgccgcggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 98174 - DNA, 306 bp, Glycine max
  Peptide Sequence Number=SeqID_214952
atgactccaaagaaactcccagccaagaggtccaagaaggattccactagagagggttccagtgcggccccgcaggcagatatggaattcgataggcacaggttctggagtgcggaacaccagcaacggtttgaggccatcaaggactggcaatgggctcagctcgtatcacccatggctaagttcaatcctgagatagtcatggagttttatgctaatgcttggcccacagaagaaggagtttgtaacgacccgcctcgtcactacgatatcaccactctaaaccgcgagaatttcaatttttaa

SEQ ID NO: 98175 - DNA, 658 bp, Glycine max
  Peptide Sequence Number=SeqID_214953
atgattatgaggagccaagacatttatagtagccaatatgaggctactacttcaccttcctctagtgaaagtgaagaagcaaaaggggaagaatctagtgaagaaatttacccccaagaagaaggaaaacctttaatggttaaggaagagtgtaaggaggtaaatgtctcctccaagaggttagctaagaaggaaagacattttgaaataaatacaaatattaaagaaatttcccttcttagacaacctccacattttctcctttgtaaaaagacacttgttagcattgccacacctcttgggcttgagtttattcttctagtaaaggagttgttggatgagggtttggttcgcaagagcttaaatccttgtgctttgttggtgcccaaaataggtattattaggcaccgaatccctaaaataggtggtatgatgaatgtttttagtggtgcaaccctcttttgtgaaatcaatcgtgcacccaacaacttcatgatttgtgtacatagggactcattaggtgggaataatcagcataaaaataaagaaaaaggtatgttttattccattactttccttaactttttaaatagtgatcaagggcttcccatggaccctaagagaataaaggtcattcctgagtggcctactccaccaa

SEQ ID NO: 98176 - DNA, 564 bp, Glycine max
  Peptide Sequence Number=SeqID_214954
atgaatcccttcacatttggagattaccctgatataatgaaaaagaatgctggctcaaggcttccttcttttactcaaaaggaatcaaatctggtcaggggctcaatcgacttcattggaataaacttttactactcattttatgttaaaaacagtcctggcagcctgcagaaggaggatagagattacattgcagatctatcggtggaaattgaaagccaacaaacacctcataattcatcattagatgactggccgagggtgaattacttgcatgaatacataggaagtttggttgatgcacttaggagtggattaaatgtaaaagggtactttgtatggtccttcttggatgcatttgagttactgcttggatatgaatcaagttatggcttatattacgtagatatgaatgatccaagcttaaggaggatacctaagctctctgctgaatggtactcaaattttctgaaaaggaagcctatggacccaaagatcaccaaggaaattgagaagaatgcaactttgctttcacacaatctctcactgcacaatgccacataa

SEQ ID NO: 98177 - DNA, 493 bp, Glycine max
  Peptide Sequence Number=SeqID_214955
atgcctaaactaccccttcctctactgctcctgcattccgtcttgtcgatgaacagtgtcgccatgaacagttccgtgaaggtgaaggtgaaggcgttgtggtggtcggtggcggcatatgaggtacacagtgttgggtgtttgacagccaagaggatgttctgcgatgggcttgatccgttgcttatgaaaatggatttgtggcggagtggcgagtataggtgtaggaacaaagaattcgttataagagacactaggactaggaaatgtaggtgtcccttcaagcttcgtggcaagccagtggttgagggacaaggctgggtgaagttgatttgtgggattcataatcatgaattggccaagtcattagttggacatccatatgtctggcgattgagtaaagctgaaaagacacttattggtgatatgacaaagtcaatggtcaaaccaagaaacattctgctgactctgaaggagcacaatgtcaatagtt

SEQ ID NO: 98178 - DNA, 807 bp, Glycine max
  Peptide Sequence Number=SeqID_214956
atggcgacgctgctaagaaaactgtgcgaatcggcgacgatgaagcgatccggctctcactctcaccctcaccctctcccgtcctcggaacaagcacgcccatcctcccctcttggcgccttcgaccctctccctgccgacatcctcatgcaaatcgtccgcctcttaggccccaaacacgctgccagactctgcctcgtttccaagtcttggcggtcactcgtctccgacaacgccctctgggcccacttcctccaaacccaccacccccactccccgctcttcgccgaaaccgccctcagctccggctaccctctcccgaccttgcctgctcagaattcaccacgtgtctcgttccagcatgcttacgcgctgcgtgaacgagtccctccttctgttgtcatcgacgggggttctggctattgcaaattcggttggagcaaaggggcctctccttcggggagatttgctacttttttggaatttggtaacgttgagacgcctatgtatactagactgcgacattttttctccactatctataacaggatgcaggtgaaaccaagttctcaacctgttgttgtttctataccaatatgccactatgacgataccgaatcagccaaagcatcaagacaacaacttaaagaagcaatctatgttgtcttgtttgacatgaatgttcctgctgtatgtgctctcaatcagtacaatgagaacaagattacaagaaaagctgctagatgggttgttggagacatactggagggccacacgccagagggttgcatgagagttctccagtag

SEQ ID NO: 98179 - DNA, 306 bp, Glycine max
  Peptide Sequence Number=SeqID_214957
atgggtactttagctctgtatgctgcaaatcaaacatctgggatagctgttaatataggctttcaagtcacatctatagttccaattttaaatggtaaagtgatgcgaaaggtgggtgtggaggttgtggggctgggagcactaaaacttactggatttcttagagaacaaatgcaacaaaacaacataagttttgaatctttgtacactgttcgcacactgaaagagggatgtgatttgtgtaagctgtcaacactcaacagctatgacactgatgttggtcattctgaacttgtgtacatgtga

SEQ ID NO: 98180 - DNA, 2286 bp, Glycine max
  Peptide Sequence Number=SeqID_214958
atgaatctgttattgcagaatgcttctcaacctcctggaagttctccgaacaatggctccccgatggtgcaattaattaatgcttctttgtctgttaaagagatctcacttggatttcctcacttcgatggaacgacgcgggtgatggagtggatcttcaaggcggagaaatttttcacttatcataatactcctgatgcgtctagagtggatattgcggtgatgcattttgataaggatgtagtggcatggttccagatgtcacagaaattatctctagtgtctacttggtctgagttgactggtgctctagagtctaaattcagtccttcaccttttgattgtccaatggctgagctcttcaagcttcaacaaacaggttcagtatcagattattacctcaagtttatgtctctagctaatagatctttgggattaagtaatgaggctctccttaattgtttcattagtggtttaaatcctgatattagaagagatgttgttgctatgtgccctcctaccttattgcgtgcagttgctttagctaaactttttgaagaaaaatatggtcctggtactcaagaagatgaaatagtagaatctgaagatcatcatttgtccttcaatgctttgaaaggtggtaggggagttggtactaacaggttcatagcttatattgaaaagttaccagtgactgtgttgattgatggtggcagttctgataattttttgcagccaagggtggccaagtttttgaaattacctagggaaccaactactcaatttagagtaatggttggtaatggtaattatatgtctgctgaaggattggttaagcaattgaaggtacaggctcaaggcaatacctttcagttaccaatatttttgctttcaatttctggtgctgatctcattttaggagctagttggttgaagactattggctctcacattgctgattatgatgctctacaattgaagtttttgtggaagggtaaatttactactttacaaggagattgtgaactggtacctgagcaagctcaattacattgtataagaagaatggtggccactaattcaattgttgaagtttatagtctgcaattgatggaaccagatgttgttcctaagtctatgcttgatttactagttacaatgaagcctgaattagccttattattgcatacttacagtgtggtttttgatactcctagcagcttacctccacagagatcccatgatcactctattcttttattgagtggttcacaacctgttaaggttaagccttacagataccctcatagtcaaaaggaagaaattgaaagattggtgtcaggaatgttagatgaaggcatcatacaacctagtaagagtcctttttcttctcccattatattgtttaaaaagaaagatggtccatggagggtgtgtactgattatagggctcttaatgcaattactatcaaggacaacttccctattcctactgtggatgagttgattgatgagctttttggagcttccttcttttctaaattggatctaaggtctggttatcaccaaattttgataaatccggatgacagacataagaaagcatttaggactcatcatggccactatgagtggttggttatgccatttggcttaaccaatgctcctgctacttttcagagccttatgaatgacatttttgttggaatattaagaaaatttgtactagttttctttgatgatattctggtgtatagtgcaaattggaaatatcatttataccatttggaagtggttttaagtatcttgaaacaacatcaattatttgcaaggttttctaaatgttgttttagagttcaacaaattgattacttgggacatacactgtctggttcaggagtagctatggagggaactaaattggaagctattcaaaagtggcctgagcctattaatctcaaacagttgagagcatttttaggagtcacaggttattataggaggtttgttaagtcttatgctagcattgctgcccctttaactgatttgttgaaaaaagattcttttaaaaggagtgttgctgcatcagaagcatttcaacaactcaaaattgccatgacatctactcttgtattggctattcctaatttcaaggaaatttttgtattggagactgatgcctcaggaagtagaattagtgttgtccttagccaaaataagcatccaattgcttatttctctaagaaattgtccttaaggatgcagaagcaatttgcttatatttga

SEQ ID NO: 98181 - DNA, 423 bp, Glycine max
  Peptide Sequence Number=SeqID_214959
atgtcccaattgttgatccaatgggaagtaactgaagctaaggatgctacttgggaagacttgcgggatatatgtgaatcttaccctcagttcaaccttgaggacaaggttgttttttatgatcaagagggtaattgtataaagaactgtatctatggtacaaaagtggtgtacaatgcaaattttgaggctgccaaggttctaacaaagaggatgcttcataatttggattcactatgtgtaagtttgagtcaacttagtgatggtgtagttagtgccgatgttggttttcttgaagttacactaaagaaaaagattgcaaggaggattgttctcttgttgttttatgtattgtcaaacatattattaatgatgaagaatggtggtacacaacctatacttgtagtaccgaatcaaggttag

SEQ ID NO: 98182 - DNA, 558 bp, Glycine max
  Peptide Sequence Number=SeqID_214960
atggaggttaggcaatggacccaactgtggctttggaaaaaagataagtcctatgtttcgttcttaccaccgcttggtcttgaatttatgactgttaactctcttatagaccatgaaaataatagctggagaatggatatagctgcacaaatcctcaatgaggatgacatgaatgatttacaaatggtgcctttgactaacactcatgatagtgatcgtccatgctggaaatatagtgcacatggaaaatatacagtcagatcagcctatcatcacttaatggacaacatgatttgcaatgaaaatctcaaagttaaaggctgcaatctaaaggaaaggagtccattgcacgagtcttctttggctgccaacaagttagaaacgtgtgggaagaagcaggaatctagaaccagcaactcactctacattgccccgaatgaatctgctcaagatctcgagtggtgcaagcttgtggcgggattccttaaagtatatattgatgcaggaatcttcgaagaaccaaatctctttggtgctggtattgtacgtggtgtgtga

SEQ ID NO: 98183 - DNA, 690 bp, Glycine max
  Peptide Sequence Number=SeqID_214961
atgcaacccactaggatctgcttagtagtcggaggggggggaggggggttgatatttgcatctgatagctttcttgaacttacggaatatacacgagaagaaattttgggacgaaattgtcggtttcttcaaggaccagaaacagatcaggcaactgtttccaggataagagatgctatcagagaacaaagggaaatcactgtacagttgataaactatactaagagtggaaaaaagttctggaatttgtttcacttgcaacctatgcgtgaccaaaagggtgaacttcaatacttcattggtgttcaactagatggaagtgatcatgtagaacccttaaaaaaccgcctgtctgagacaactgagcaacaaagtgctaagttggtgaaagccacagcagaaaatgttgatgaagctgtccgagaacttccggatgccaacttgagaccagaagatttgtgggcaattcattcccaacccgtctttccacgacctcacaagaaggaaaatccttcttggatagcgatacaaaaggtagctgcaagaggtgaaaaaattggcctgcaacattttgtgcccataaggccgttgggttgtggagacactggcagctttccaataactggacaaaacagaattcctatttcagaaccatctttaataaaattacctcatgaagatgattcttga

SEQ ID NO: 98184 - DNA, 717 bp, Glycine max
  Peptide Sequence Number=SeqID_214962
atgacgaagcacgagtcagatgtatacaacgtcgttacggatctcgcttgctctgaggatctgtgtttctcgtactgcgacgacgatggcgacgagtcaaagtattgttcgagtcagggaactgtgttctccgaatttcatttcgagattttcggtgaatgctcacaggcggagctttcggattactctccgtcactgttcgtggattccgaaagccagtttttggaaggatctgtcggagaaactccttcgccaacgcatttgttgttccttcggtaccgcaaagagttcgcggcgcttgtttctgctcctccagtgaagaacgcttcaaacattgaagatgctgccaatttattaaatgttagtatatttattgtttgtggattttggtttgtgagattcaaagattgggatgacgaagacagctaccagatgctgaggaagagggagaggaagcagggttttgtgtcgaattatggtgatagatatttctctaccactgaattcggagacatcgtgattgagcaacgtgcgctaatggttcagtggatcgttgagcaatcttgtcgaagacagcttcggcaggagacagtgtttcttggagtcagcctacttgatcgattcctaagcaaattaaggatacttcaaagccaacagaaaccttcaaattgttggaatagcttgggcaaaaatgtctcttcacttgtattgagttga

SEQ ID NO: 98185 - DNA, 408 bp, Glycine max
  Peptide Sequence Number=SeqID_214963
atggggattctttcttttttgctgctccctttagttgggctatgtataatttaccgtgacttaaagcctgaaaatatcttacttcagaaggatggtcatgttgtattagctgattttgatctatcatatatgacatcttgtaaaccacagctgtgctttgtaagagaaaaggttatggagaaaagacttcaagtggttcatgttcctactatcgatcaatatgcagacatcctcaccaaatctctctccccttccaacttcactgtctttagggacaaggttgtgaagcaagcgatacctggtaaaagaagatcacgaagtgaaccaccaccaacatttgttgcagagccagttacacaatcaaactcattcgttggaactgaagaatacattgctccagtatggtga

SEQ ID NO: 98186 - DNA, 369 bp, Glycine max
  Peptide Sequence Number=SeqID_214964
atgtgtacggtagatgcgaggtggtattacctaaaagcagctaatgctgatgcagaggttcagaagagggtcaagtatctggcagagctggcactgtcaggtcatgagcaactgtgctaccggccttcaacagttgctgcagcacttgtaatcctggcttgtcttgaagtcaatcaaatttcataccacaaagtcatagggattcacgttagatcaaaagatgagaatttgtacgaatgcatagaggatagcatactagttggcatggaggcattgcttatgcaattcagtttggtgacgatggttcctaaccatcagaagacaaatggctttctcatgcctggttggttcttcattaatacaaaataa

SEQ ID NO: 98187 - DNA, 117 bp, Glycine max
  Peptide Sequence Number=SeqID_214965
atgcagtcaattatgtttctcctagaagtaggccatttatggcacacgggaagagctcgggcagctgccacaggatttgaaaaaggaaagtacggtagggattggaagaagcaatga

SEQ ID NO: 98188 - DNA, 306 bp, Glycine max
  Peptide Sequence Number=SeqID_214966
atggagaaattgccacgttcaatccgttttgatttgttacagataagaacagttaaggttagcaacatatcattggttacttccaagaaggacattgaagaattcttttcattctcaggtgatattcgatatatcgagatgcaaagggaaagtggtcacactcaggttgcttatgttacatttaaggatacacagggagcagacacagcagttctcttaacgggttccaagataggtgatctatatgtcaccatcacaccagtggagaagtatcagctgccccctgaagcacttccttcaagtcca

SEQ ID NO: 98189 - DNA, 306 bp, Glycine max
  Peptide Sequence Number=SeqID_214967
atggctgctcctcataacactgttcatacatgggtgggtgctgttgataagccacaccatgaagacatgggagtgataaatattgaaccggaccagacagagtttgtgggaacttttgttaatttgttccatggacaaggccataatatcaacactagttttaaggtagggatatcgaaagtgctcgagtgtttagaagctgaagaagacgatgttgtgctggttactttggtgcctaaggttggaaaaggagatgtcatcataggaggcatcaaagttgagtttattccaaagtacaaggattag

SEQ ID NO: 98190 - DNA, 324 bp, Glycine max
  Peptide Sequence Number=SeqID_214968
atggatcaagtgatccgtaagcatgttacggatcaagttgatccagaacatgcttacggatcacttgatcccgggttacggatcaagttatccttggttttcggcgcttacctcgacggtggacggtcacgaagctccctccatggtggttacggtgttgctcttcacgaaagcctccttaatgtaccactgcgacgccctcacataaccagtcacaatgatctttacataggcgttatgctacaaataggcaaagagtcactcctatatgtaatgtggtaccatgttcgtgagaaatctcatgtgccacctaggagtacatga

SEQ ID NO: 98191 - DNA, 147 bp, Glycine max
  Peptide Sequence Number=SeqID_214969
atgcacacgagacacagacaagatcgatggctgacaaccttggtggtggggttggatgccagaaaacttgcgcaaagcggcggtggttggaaatctgtcaaaaaaggacaatgtcaggataggcaacggaaaagttattcatcataa

SEQ ID NO: 98192 - DNA, 450 bp, Glycine max
  Peptide Sequence Number=SeqID_214970
atgggttctaacataaaattaacaaaatatttaaacaggattcatagaatcaggacatttgatcagttgcatttacctggtatcttgttgtatgagatgctctatggtcgtacaccattcagaggaaagaatagacagaagacattttccaacatcttacacaaggatcttacctttccaagcagcatcccggctagtcttgcagccaggcagttgattaatgcactactccaaagagacccaacaagtcgtataggttcaaccactggtgccaatgaaatcaagcaacatccttttttccgtggaatcaattggcctcttatccgcaacatgactccacccccattagatgttcctcttaaattgataggaaacgatcccgtggcaaaggatataaagtgggaagatgatggagtgctagttagctctattgatatggatattttttga

SEQ ID NO: 98193 - DNA, 402 bp, Glycine max
  Peptide Sequence Number=SeqID_214971
atggttcattggcccattcctagtaatgtgaaaagcctaaggggatttttgggcttaactgaatactacagaaaatttgtgagaaattatggaaaaatagctttgccttttacacatcaactaaaaaaagatagcttcaactggggaagtgaggctcagatggcttttgagcatctcaaccaagcaatgactacaatgtcagtgttagcagtcccaaactttgagaaaacattcattgtggaagctgatgcttcggggaaggaactaggtgcggtgctcatgcaagaggggcaaccaatagcctatatgagtaagaccttaggtgagaaggctcaaaataaatctatttatgagcacgagttgatgaccattattctagctatccataaatggcaggactag

SEQ ID NO: 98194 - DNA, 282 bp, Glycine max
  Peptide Sequence Number=SeqID_214972
atggctgtccttttcacggagttatatgcttctgaaactcgtaaactggttgaacgtctcattaattatgtcatttacaagattccactaggagtgattttagccattcttgatcttgcgctcattgctctttcaaaaagtgctccagcactcattgctggaaactcatttgtgctcaaacctccaactcagatccatatcttgtgtcactttataatgccaccaacatccattaggacagtagccactaggatgataatgcctaataatatgctatgctag

SEQ ID NO: 98195 - DNA, 2706 bp, Glycine max
  Peptide Sequence Number=SeqID_214973
atgacacttgggagcattataacttgttacctaaagtctgaatcatggaatactacattcttctggagcagggctgcaaatataaagaaagctcggggatcttatttttcagaggagtgtttgtttggctgggggacaatggaaggaaagggaggggagggtgaatttggacttgcaaagcttcttaatactgaagaccttacttccccggttgttggaactctaaactacatgtgtcctgaggcctttgctggtatgccttatggttataaatctgatatgtggtcactcggttgctgcatgtttgaaattgttgcacatcaaccggcatttcgtgctccagacagggctggacttatcaataaaataaatagatcatccatatctccactgccaattgtttactcttccacacttttgaatcttccaaatgcttattctgatggatttggagaaatttgggccttgtctcttggtcattctagccatcagtgccacatcagcactttactaaatagaacagaaagccggcaaaagaaacaacttatcaagagcatgctgaggaaaaacccagaacatagaccaacagcatctgaattattaaagaatcctcatttacaaccttatgttctacgctgtcgtaatgcatcatctatttttctaccagtacatcttataaatagtaactcaaaggataaaacaaaaaccaaatctagtagtggtagcaaagaccattgggaaagggaggcagcattggctggattggtaaatcgtttggatcgactttatccattagagggaaatggagatgtacagtcacggaattggcataatgatggcaagctagcagtgtcaaccagtgcagaagacaaccttgagactaaaatggttgatttgaccagctatactgtggagttttctactagtattagcggctcgaaagatggatcaacaacatctgaatcaactgtctgcagtgtgtgcaaggaaggagactctaaaaatagacttacaagggacacagctgacagtgagatcacttcaaagagtacaatggattctgggcttgaagaacaaggacttgattgtcacaagtcatatgcaattgacataaatacggtgattaataaagttgaagatactttttccaatgaagatttcaatacagatgaagcacttagtgaaggtgtcaaacctgaggactccagtaaatcaataatgtccagtgaagacagcaacggtaatgataaagatgagttaattgatgagatcacatcaaagagtactctagattctgtgcatgaaaaacaaggatttacagctgaacattttcagaagtcagatgtgattgacacaagtgcagtgtctacaaagattgaagataattttttcagtgaagatagaacagaagcagagagggaaaatgccaaacctgaggactccagaaaatcaatagtgtcaagtgaaaacagcgatgttaaggataatgagggatccattaatgagatcacttcaacgagtatgctagattctgtgcatgaagaacaaggatttacagctgaacattttccgaagtcagatgggattgacacaaatgcagtggctataaaagttgaggataatttttccaatgaaggttttgaccaaacagaaacagagagggaaaatgccaaacctgatgactccagaaaatcaatagtttccagtgaaaacagcgacggtaatgatattgttgctgttgatgagaccacattaaagagtatgctcaattatgtgcatgaagagcgagggtttacagctgaacttgttcaaaagtcagatgttgaaataaatgcagcggcttcaaaagttgaagacaaattttctaatgaaggatttgataaggctgaagcacagagggaagatgccaaacttgagagctctagtaaatcaataatttcctgtgaaaacagaaacgataatgatgactatggatctggctatgagatcacatcaaacagtatgctagattctgtaggtgaagaaaaaagacttcctgctgaactctttcagaagtctgatgcaattgacataaatgcagtgactacagaagatgaagataaactttccaaagaaggttttgatagagctgaaacacaagagaaagatgataaacctgaggactccagtaactcattgtctagtgaagacagcaacagcaacgataaagaggggtccattgatgaggaaaggtcatcaccaattgcacatgcggttaaggttgagcatgacactgacactggaaacagcttgaaggaaaatgaaaaccctaaagtgttgacagaagactcatgcatggacagcttggcttctgagagtaatgaaatgcgtccaggtaaggatgaaggccaagcagatacacacacaatcagttgttcaacgcataaagaagttgacaatgctgtcatggctgataagccaccaaatggcgtttcattaaggacacgcatatcaagaggtggtgataatacttgccatcaaagagctgatgctctggaatctctgctcgagttatgtgcgcagctacttcagcaaggaaagcttgaagagcttgctgctgtgctgagaccatttggagaagatgctgtatctgtatcatccagagaaacagcaatatggcttacaaaaagcctggtggcctcacaaaatcttaatcctgagatatag

SEQ ID NO: 98196 - DNA, 201 bp, Glycine max
  Peptide Sequence Number=SeqID_214974
atggacattaggaaggttacctgtgccgttctcattgccgctgcctccatgagtgcagcattggctaccacagaggtctctgcacccgcccctggccctagcagcggtgcctccgccgccactgttggctccttgggttatggggaaagaatgttgaaggaacatgcagctcaaggaagaaggctgcatatatttacttag

SEQ ID NO: 98197 - DNA, 459 bp, Glycine max
  Peptide Sequence Number=SeqID_214975
atggaacttaggagaacccatggcattcatgaaagtgttctgatgcgttttgttggaagggacaaaaatactactttcagtgtggacgttgtgggacctctacaccaaagggcagccacaaccataaggcaccatgtttttaccattgatgtctctaaagatatgatacaacacaattatcaattggttctgccactagaggcttcaatttatttaactacatcaaaaaaatatatgattgtagatcgtggtagtggtaggcatcacaaatggatgatcaccacgaataatggcctatcatgtgttgttgacgcgtggatccattatttaggtgactgtcatttgaagcctggagatgaggtcatcttcttctacaacattgaccaacatgtatgggaggtcctctataggaagcaagttaaatgggatgacgaagaggatgaagctgaatccccttga

SEQ ID NO: 98198 - DNA, 571 bp, Glycine max
  Peptide Sequence Number=SeqID_214976
atggtggtgagtactataacagatatgatggatcgggagaacaacgttcaagaccttttgcattttttctcaaaagagtgtgaaattgttccgcaatacaccatgtcaggaaaacctataatgaatgagtcgctttggcgagaagccttaaagaccatagcttacatccttaataaggtgtcaaatgattatactatctttctccaagatcatgaggatgacattagtttaacagaggatgatccaatcaaattttgtcaagctatgtgtagttctaactctcaaaattgggtcgatgccatgaaggatgagatgaaatctatgcaaggcaatgatatttggaatcttgtcgaattgccgaaagatgtgaaacctattggccaagaaagaaccaccacaaacgtggcgagcgccaccaccgcagcggttgtggctttagagagcggccctgggtggcatagacgtggaaggcgtctcccaaagcacatcgtttatgataatgagaatgctgggaaggctatgagggtgatacaactcactatggtgcatgctagggctgttcggaacgcag

SEQ ID NO: 98199 - DNA, 324 bp, Glycine max
  Peptide Sequence Number=SeqID_214977
atggacgaagcacctgaaggtgcacatgttgatgtagaccagcctcgacatgcagtgagcacgaccagacaacttacaggatatatcacacttttacagtgttggatttacaagaactttccttttgttggttttgttattgctgctgaggattatgatgagaggaaaccatgtgcctgtcgttggaagtttgggaaggcattgttagcatatcagatggggtccatctattgtcatacaccgaccggagaggataatgttgctcaacacccggtggtggcaacgactatggacgaagcacctgaagggcaaatgttgatgtag

SEQ ID NO: 98200 - DNA, 540 bp, Glycine max
  Peptide Sequence Number=SeqID_214978
atgaagatttcgacatctggggcatattcttcatcatctaatccagaaacaccagtcgaagctaatacaccgtctccaattatccgtccaatgggtcaaaaggcaaccaaaaggaagagcaagggaaaaggagtaggaacatctaccaaacctgttgatctgagtggtgtggaggaagcaatgagggaaagaaatgttgtcaatgccaaactagaagccttaagggtgaaagaattggaaaatgagtataacgacattctagtgaaggacacttttataatgtctgagactcaacttaaagaccatgaagtcttttgtaaaataattcgaagtcaaaataatgacttcgaccaagcttggaaacaaattatttacgaaacacttgaagacaatagtgatgaacaaatcatgagctacttacgtgcgatgcaacaacaaggagacaacaacagtcaacaaagaaggcctagaaaattcattaatcgcaatcgtgaagatggacatctacgattgatgaatgatacttctcagaaaatttga

SEQ ID NO: 98201 - DNA, 324 bp, Glycine max
  Peptide Sequence Number=SeqID_214979
atggatggatggagtagtgctattttttcaaattatatgaaggtgttgcaagggaaggtgggaaaggacccagtatatgggatactttcgctcataaatacccaggtgctgcaagggaaggtggaaaaggaccaagaaccaaatcaaccaatggtgttcaagcaaaagaaaatgtcagttgagcagattatatgcagcaggtacaccgcctcattttaccgcttactgaagacaataaaagtgttacaaggaggaataaaagatctgcaacaaagtttatgccaaatacttatagtatcaaagtggcagaatctctggccttga

SEQ ID NO: 98202 - DNA, 360 bp, Glycine max
  Peptide Sequence Number=SeqID_214980
atgtctatatcctatattataaaagagaagtataggaaaattattgatttgtcttcaggggatgaggttatggtgggaaaacatggttatgaagctgaaattgaagcaattggagccttgaaggacaatcaattgcagaagatgcgcaattgtacaaaagagttctcatggatagggttgccatggacgtgtaaaaaattggttttaatgttaagtcttgcatttgttcgttgtgttcctttgtttccctggatatgtagtgatttagtatgctatgacaatcaattgcagaagatgcgcaattgtacaaaagagttctcatggatagggttgccatggacgtataaaaaatggttttaa

SEQ ID NO: 98203 - DNA, 558 bp, Glycine max
  Peptide Sequence Number=SeqID_214981
atgcacggtgcgactcaaagaagaaaaaggtgcaatgaaggcttccacgagttcacggctgaaacgatcagtgaagaaggaatggtgaaacaaacgatgaaacgaacagtgaagaagcgaagaagtgaagagggtgaaaacaatgtgaaatgtactatcattaatggagtatatttttatataacaacaattaatgacttggagctagagtcgtgcataaactcgaagacatgcttaacaacgacaccgaagctggagcttgtgaatagaggtattagccaaagcatctaccttgacaatgcagcatacaggtctttcatctacaacgaatttgatgtgagcccagtagacatggaaagtgcgtcagtggctcttatttgctatcaacaaagggtacccttcattgctattagggctctccccgacttggccggtggtggctccgccgagtccaatgaggctgataccttcttatcaatagctgccaccaactctgtcactgtggtcattgagttcgtgaagctcttgtcactccactctaagtggtggtccatgtaa

SEQ ID NO: 98204 - DNA, 399 bp, Glycine max
  Peptide Sequence Number=SeqID_214982
atgaagaatcttcgtcagaatttggaggttagagccacgattcccgttaaactagggaaaaaatcgacttgggaagttttgtttcctcgtaggttgtggttaccgatgtggacgtttgatcagaggaaggaggggaagttgaagttgaagcgcgtttgggtttggcgtttcggccgcggtttgttctctgtgttctgccactcgcccgcggcgctagcggagtccctcaccgttgcttttcccgtttctcgggcacctgagggtcactgttttgcgaaaatgctccaaccatgtgggatcggcacaggcttaaaggagcactcaaaccgagtgacccccaaggcctacactccgaagagtccatcagggcctctctctcctgattcaggtccaacctag

SEQ ID NO: 98205 - DNA, 213 bp, Glycine max
  Peptide Sequence Number=SeqID_214983
atggcaccttttggtagattcactgctgaaattttgatggctgtgatgtttgtgggcttgttttgtgtgaccaacattgtggcacaggattcagagattgctccaacagggcaattggaggctggaactgggtttgctttgcctgtttctaagctttatgatgagctacagttacaagtatgtaaaatttctactcagctattattggtgtga

SEQ ID NO: 98206 - DNA, 675 bp, Glycine max
  Peptide Sequence Number=SeqID_214984
atggtgtcccacactaagcatgttgatgtagacataagagatcatatagaggacatgatatgtgatcttggacaaaagtcttttcaacaagcacatgcacctttgatgcttcctaaagataacatgttgtcaaagaatcactacgaggtaaaaaagatactatgtcctatgggtatggagtaccggaaaatacgtgcatggcctaatgattgcatattgtacataaatgagtttgcagaaatgcgtaagtgcccgacatgtggggtatcatggtacaaagcaaaggatgatgattgtagtaatgatgaaagcacaaacaaagatcgcccaacaaagcgaaaatacattatgttgtttatgatgataacggatccaagacaaccaggaaatgaaatcggtgtctatcttagtcccttgattaaagacttgagaaggttgtgggtagatggggttaatgtatttgatgggaatcgccagcagaccttcaagttgtgtgcaatgtacatggaacaagtgaaacctgttggacttcctcaaactcgtcatgacgagagacggggagtgcaaaataatagggttagtcttgatgctgattccttgcatttttctagtgcatcagataacaacctcattcgtgcatccatgccttactttggagtgattgaagaaatctag

SEQ ID NO: 98207 - DNA, 1044 bp, Glycine max
  Peptide Sequence Number=SeqID_214985
atgtgtcgaacatgtagagaaagttgtttaatcctacagatatggtacacactgctgtgtgctcttcaattcactccagcacaacctcctcctgttgtgtctcttgcaatggaaggtctctcagaaatggaaagcgtgatagaagaaccccttttgagcaagcagaattccaatgccaagggtggcttcagaaccttacctttcatcatagcaaatgaggcctttgagagactggctagcctcgggcttatgcctaacatgatattgtacttgacaagagagtatggcatgcagacggcaggagccactaattttctcttactatggtctgctgcctcaaatttcacccctttcgttggtgctgtcctttcagactcctatgtgggtcgatattccatgattgcttttggatctattgcaagtctactggggatggttcttctatggttaacaactttgattcctttgtcaaagccactttgtaaccaatttaccaacagctgcaataactctcctacaacaattcaccttttgatcttgcattcttcttttgccctcatgtccattggagctggaggcataagatcatcctccttggcctttggtgttgatcagttgagtaagagggacaaaaatgcaggaatcaaagagagctacttcagctggtactatgctattgttgcaatgtcatcactgataggtttaactgttgttgtctatattcaagataacatggggtgggcagtggggtttggaattcccgttatcctaatgtttgtagcaactgcatcatttttcttagcttctccattttatgtaatggtggaggttaaaaggaacatgctaagtgggttagctcaagtccttgtagcctcttacaaaaatagacttctgcagttaccacaggagaccgagaatggtatctaccacctagaaaaggattccgatctcctaatgccaactgaaaaattaagattacatctttcaatcattactgaaacacaccatttggacaaccggacaaccagcacagttgttaattaa

SEQ ID NO: 98208 - DNA, 903 bp, Glycine max
  Peptide Sequence Number=SeqID_214986
atgggatttactttggtagaccttgataagggaagatcaagtggtgttagtcatcaaaatggtgattcaacactagatatttatgagactccttctttcaccaaatgcatgccttccataattgaagaacatgaagtggataatcttatggctacaccactaagctcccatcttcaatcatctgcttcttcagaatctacatctaggaggcctagacaatccacacgactcaaaatcttgattgctagacacttggataagcccaaggtagtggttcatgtcaaccctgccactaggaaagcttcagggccacaaaaagagaaattttgcagctatttagggatggaaacatttgatattccagaagtgtccaacacgaagaagaaagtcatttcatcaatggcgatactatggaggcaatttaagtcatccttggccactaaatatgtatatgcaggcaaggaagggcaagattatcagaatccttgtaataagtatggcctagatccaaagacttgggaggaatctattgcaagccataaaaccctttcttggaagggaataaaaaagaaggctcaaacaatccaaaagcaaaatgattgttcacacttattgtctcgtgggggactccttacaagatcagatgacaaaaggaagctttgtacccatggttgtcaggatatactaactactgccattaggcaacctgagcactcaagtcgccttcttgttgtggaattcggtgtgattattagccaatactttggacatgcatcatatggctccattaggcaacttgagcactcaagtcttgttcgtgttgtggaatttggtgtgatcattagccaatactttggacatgcatcatatggctccaatagttctacatccatcaccccataa

SEQ ID NO: 98209 - DNA, 138 bp, Glycine max
  Peptide Sequence Number=SeqID_214987
atggatatctctacaaagaatcttgcgatcctctatgatgtcatggaaataagactttcaagtgttatgttgagttgtccaagcgaccaagcttgtaccagttgcaagcactcagactccaccacaaacgagggttaa

SEQ ID NO: 98210 - DNA, 264 bp, Glycine max
  Peptide Sequence Number=SeqID_214988
atggcaacgaacaaggcatttgagaaaagaatgctgggttttcattttgaggtaacgaggcacatagattacgccatgcagctggatgtcggagccacctctgtgcatgtgatccgtgtctgttcagcagttacgattttcaagctcgtttttgacgattttcttgctcgttcatgtgctgtgtggtgccggtggctccattgccacccttttgttcatgtttatgttaacagtgaaaacaaaattcataagaatctatcataa

SEQ ID NO: 98211 - DNA, 1340 bp, Glycine max
  Peptide Sequence Number=SeqID_214989
atggttagaactagagggttaggtcgtgccttaggcatggttataggtagagccctgggaaaagaggatcatcatcattcaaatgatgttctccagcgacgaaggcctacaacattcgcacgtaggcaacggaaagttgctcctattgctggggatgctcctgacgtgactgaagacgtacatgcacatgctaaaaaagttgttgatgatgctaagagatttttaggtgggtcgcgtaacccattagtgctgactgactatggtgaccatgttgcagtcatcgtatggaatggagaggaacgtcttgaattgaaactatcctcccatggaaggaaggttcagaaatttgagaggtctgctcctgaaattgaaaggctagtcgttgccacaggattaagtcctttgatcgcatgttcagtggacactggcgatcgaggacttatatccgcttttgtggagaggtggcataagaaaactagcagtttccatcttcttgttggagagctgaccatcaccctggatgatgtgtctccagagaggaagctagagctgagacaacacaatgtcaaggggcatacgtacatctatcgtggctacgatatatttatcagagtaaatagtggaagctatgcatggaaagcttccgccatagttcatatgtatgatcatttgaatgatgcttgtaagagcgacaaccgacagcttgctggttacatcatcctattacagtgttggatatatgagtattttccctctgttgctgagtctttgagtgatctagactatgatgagatgtcaccacgtgcctgccggtggattgctacgaaggcttcttcaaagttattaccagcatcaacgtaccagaaacgtctagatggattgacaattgttgatactacgagttcaatgttagcatttgaagatattgacgataggtggatgcatttctctgactatcttgcagtagtggggcatatttgtgttatgccaggacaatgtgcatcagattacatgcagtggttcttcatgatttctcatccattcatgacaccggcacagtctactgattcggctagacatccacctgtgacgcaggatgacacatatgtggagccaaatatccttgaggtcctagtggcaccaacaacagcaccggcacatgccccttctaatgtggagcagcctagacatgtagtggaggcttgccaaacaatcgcagaaaggttggagcgtttgctcaacctaaggatagtcactgcaggcacagaaatacacgaggtcatggaagactgcttaaggatcgctagggatgtcacaacagagggcaatgtttatgtcag

SEQ ID NO: 98212 - DNA, 555 bp, Glycine max
  Peptide Sequence Number=SeqID_214990
atggagagggtaatcggcgggaagtttaagattggtcggaaaatcggaagcgcatcaaatatggatacctctgagattgtcgccatcaagatgatccttggaaacaagaaatgccaaaataatgtgaatggaaatgaaagcaagaagaccaaacatccacagctattgtatgaagcaaagttatatagtattcttcaaggagaaagtggtattccaagtatgaagtggtgtggcactgatggagacaataatgttctagttattgatcttctgggacggagtcttgaagacttttttgtctactgcgggaggaagttttcattaaaaacagttttgatgttggccgatcagatgctgacaagaatagagtgcatgcattccaagggatttttgcatagagacataaaaccagataacttccttatgggtcttgggaggaaatcaaatcaggtttatattattgattttggactagcaaaaagatatagggaccctaacacaaacaaacatattccttacagttttagtttaactagcaaggatctcatggcctaa

SEQ ID NO: 98213 - DNA, 405 bp, Glycine max
  Peptide Sequence Number=SeqID_214991
atggactatagtgaccagtgtgaagccgccactagggtcaagattagggactacgacatgagcccggttctgtcgccttcctgggtcgagaagaagcttcaagctagcgaggaatgcaacaagtacttgctgcagatcgagtgcagacttgccattaatggacgacttcgtgacagcaatcttgacttgtgtaacgtacaacgcaaagacaaaaaggaagaagcagaaaagccttattctgatgaagaagaagaagttgggtatatggacatctcaaacattttgatggctcgatccacggaagaaccattctatgactctcccgtagaagaagaaccactgatctcaacaagttcatcctccaaaccaaatgcaggaccttggtttactcttgacgatacttga

SEQ ID NO: 98214 - DNA, 1302 bp, Glycine max
  Peptide Sequence Number=SeqID_214992
atgttggccaatctcgaacgtccaagtgcaccacgtgtgcagcctaagccatctaatgttcagaatctggatgccaagaatcatattgagaaacatggtgtgaacaatagtccatctacttcctctgccactcccaaatcctctacagtaaatgcctcgaaaccagaaaggcccgcaggaacctcaaaccttggtcgtgtatttgggagtaatgcccgtgtttcaagcagctggattccttcactacgccgaatttcttctgccaaatacccaagcgcctctaactctatatgctcagttcatcagctggagaacatagatgagaatgctcctgcagattggcctgcatcatcctgtccccctcctgatactccaactgaatctatggagttccttgcgagatcatggagtctttcagccatggaactctccaaagcactgcacagcaccaacgttacaatctccaccggtatagagatgccactttcgtgcccttcaggccaccaatttgataccaagagttccactgcttccaaagctgtaagaacattggctgtgtttaatttaagagttatttgtattaggagcttgctaagaggtaggacaatgggtaggtggttgaaagatcaaaaggagaggaaaaagcaggaaattagaacccataatgctcatttacacgctgcagtatctgtggctggtgttgctgctgctattgctgcagttgcagcttcaacagcatcacctgaaatgccttatgcaaaccaaaagaaccctcccccagcttcttctgcaattgcatctgcagcagctttagtagcctcacactgcattgagattgcagaagatatgggagctgagcatgaccaaatattaacagtagtcaactctgccattaatgcaaaaaccaatggagatattatgactttaacagccggagcagccacaggagcggctactctaaaggcaaggctgcagaaggggcctggagctacttcaattcctctagttgaggaaaagtgtgatgaaaggaaagaagcaaacatcttgacagcactggattatgtctttagaggtggagaacttctcaaacgtacaagaaaagatatagtcaccggagtttgcaatgatatcccagcttggcccggaagggagaaggaagacatcagtgaaaagagggcatattttggaataaaaacaacagacaggacaatagaatttgaatgtggaagtaaaggagacaaacagttctggcttgaggggatccagtatatgttgaattgccgtgtcaaagtaacattataa

SEQ ID NO: 98215 - DNA, 579 bp, Glycine max
  Peptide Sequence Number=SeqID_214993
atggcattcttgggagagacaagtagtcagacagttgtgaactctacattaggttttatttttccaaatggatccattgttcacaacgacagtggtgtttccttccaagctttcactccagttcccattcgagtacctaacgggtgtgattttcaaacgttaaaaaccagaatacacaatacccttaagctaatcgacaagcaatttttggatgaaatttactaccggcagcctttcacgtatgcaggaaaaaatcccaaaaactttgacattcccaccggatgtaccatggatgaactgaaggatttgatcaaacaagttgcgtctcgtgggattcccccttatggtgttgatgaaatacaaatggtaacacgattgttttttcggaaaccaagtcaccatgagtattcagaaaaagttataaaatttgaaataattgaactcaaaaccaacgaggacgtgatgaaggtgcccatcgagtctaactactggaaaaagattgggccaatagaaattttagttgttttcaataaacctttaccgcaaatggaagacgagttgtccttgtcgcaaaattag

SEQ ID NO: 98216 - DNA, 207 bp, Glycine max
  Peptide Sequence Number=SeqID_214994
atggtgcggggtgctcacatgcgtggtgcgctggtgcggggtgctcacatgagtggtgcgctggtgcggggtgccacgtcgctggtgcgtcgtgctgctgctgtcatcgcgctggagattggagtacgccgtcgctgtcgtcaaactaagcctgttgctgttcttgcttgcgctccttgtctccttttgcatgcgaaattcggatag

SEQ ID NO: 98217 - DNA, 453 bp, Glycine max
  Peptide Sequence Number=SeqID_214995
atgaattacgacatcgattcttatagaaccgacgtagaatgcgagaatacaatgtcttcagggaatgtgaacgggttctctctcactccttattttcatcttcttttcaatctctttctcctccttgctctctctctctctgtccgtgcctccatcaccatggagatccccacgaagccagtgaagatacagaggcacaggtgttcattgctcatgagattgacttggattcttcaccgccagaagctatcctgtttctggttcgaacatggcatctacatcctccttattaggggcttaaataggaaccatttttcattcggtttttcatctgttgatctacccttactaacaaccctgcatttgcaatcatttatactggagtgtagggatacgatagagcttcctggtgggagtttgaatctcaagttctcgtgtgtgagctatctttga

SEQ ID NO: 98218 - DNA, 245 bp, Glycine max
  Peptide Sequence Number=SeqID_214996
gaaaactcaaggctctggatggtgaatggatccaagttatatttgaagcacctgaattgaaggtaggatcatggcaggtccagtatggtggccagagtgaagttaaactcagaatcacttatgttgatgagaaaatcaggagcttgaaaagaccgctttactctttggctgcagagtttgtctcaaaatggactactgaaatttggtcaggggatgaagaatgtgggatggtttccaacctctag

SEQ ID NO: 98219 - DNA, 435 bp, Glycine max
  Peptide Sequence Number=SeqID_214997
atgcagggtcatgagggaaaattctctgtttatgtacattcgtcaaaggaaaaaccaacacatgtcagctccttctttgttggccgagagattcacagtgaaccggtaggctggggaaaaatttctatggttgaggcagaaaggagacttttggcacatgcacttttagaccctgataaccaacattttgtcttattgtctgaaagttgtatacctgtgcgccgctttgaatttgtgtacaactacttattattaacaaatgtcagctttattgacagctatgtggatcctggtcctcatggaaatggcagatatatagaacatatgttgcctgaagtagaaaagaaggatttccgaaagggttcacagattgtagaaacaatggaaacatcaatggtttcagttataaagtattttttcttctttataatatga

SEQ ID NO: 98220 - DNA, 585 bp, Glycine max
  Peptide Sequence Number=SeqID_214998
atggctgctacggcttcagcttccgctgcttctctctcccttcgctcttctcccttcaaactcaaccctccaaaactcaactccgttacgctccgtttccctcaccttaatcgccgttataacagcgccttcagagtcgtcgccgcttccgtttccgtctccaaccccaacgtgcaaaccggccccgacgatctcgttgcttccattctctcaaaggtggtgcaaacggatggaggagtattgctgaaggaggaagagcataaagaggtggccgaagtggctcaggaactgcaaaagtattgcgtgagtgagccagtgaaatgccctttaatatttggagagtgggatgtggcatactgttcacggccaacatcaccaggtggtggctataggagtgcaattgggcgccttttcttcaacacaaagcaaatggttcaagttgttgaagctcctgatattgtgagaaacaaggggtcgacgttatcgataagctttctggatgtggaggtttctccgcaggccgatatcatattcagaaaagctattgatagcaaaactgaaatttctcagttttgctatcaatag

SEQ ID NO: 98221 - DNA, 243 bp, Glycine max
  Peptide Sequence Number=SeqID_214999
atggctaaagaaggagggtttcccctaagggataggctcaggctttggatagctctgagactcagtcttacttttcacgctgactttgcgctatgcgcgcctttgggcttcgctgtgggctttcttcacactaagcctagagtgcacgctaagcctagacttgcccgctatacgagagtgcacactaatcctggacttgcccgctatacgagagtgtgcgctaagccgagacttggttgctaa

SEQ ID NO: 98222 - DNA, 171 bp, Glycine max
  Peptide Sequence Number=SeqID_215000
atggctaaagaaggagggtttcccctaagggataggcttaggctttggatagctctgagactcggtcttacttttcacgctaacttcgcgttaagcgtgcccttgggcttcgctgtgggctttctctgtgctaagcctggagtgcgctctaagcctggacttgcccgctaa

SEQ ID NO: 98223 - DNA, 528 bp, Glycine max
  Peptide Sequence Number=SeqID_215001
atgacaagccgacaacctctacaagagccagaatcaaggataaaagatatggtggaagaacccatggaacatttcattgaccagaattattggcaggttcttgcaaatggtgggaaaaagaaaagcaaaaccatgagtaatagccccatgaagaattcaaaaagtgcagcggtggttttgtctgataattgcaaatggaactatatgctcacttggatgaaaaatgaggacgtggaagcagagaaattatggaatattgcaatacaactgggtgtggtattcaaagggaccgaggaggaattcatgcacaagatgattaaatggagggggcttaggaagttaatttccaaggaggaacctcatttggtgtgcttacaagagattaaaatggaaaatatacaagtcgaagtatctggagcaataaggtgtgatctgaatgtagagtggcatcatgcgactgtaaatcatggaggagttgaaaaaagaatgttatgggtagaacttctcaacttaaaagcattggagtag

SEQ ID NO: 98224 - DNA, 390 bp, Glycine max
  Peptide Sequence Number=SeqID_215002
atgaggaatgacaacttggagatgagtgtgaaggaccaaaaagccaccttcaacctgttcgaagtaatgaagcatcccagtgatcataaagcatgcttcaaggtcgaggcaatagagaaagaagtcgacctcacagtgcaacatttggccattcactccccattagagaaggcccttataaatgatgttgattgcttgaacaatgaagaagaagaagatctcagagattgggagcagacctttgaagagttgaagaaagacaacccaacaaagaagcccaaagtggagttgaaagctctacccattcatctgaagtatgtgtttctggaagataatggaactaagccaatcatgatcaacaataacctatcatcagacgaagaagcatga

SEQ ID NO: 98225 - DNA, 249 bp, Glycine max
  Peptide Sequence Number=SeqID_215003
atggaggcagtgtcagacccaacgagtggtgccattcctcatggcgggtccagcaagaagcgtttcaagactaggttcacccaagagcaaaaggagaagatgatggcctttgcagaaaagcttggctggaggattttgaagcacgatgagagtgtcatgcaggagttttgttcccaagctagcatccaacctcatatgcttaaggtgtgggtgcacaacaacaagcacaccttgggtaagaagccctag

SEQ ID NO: 98226 - DNA, 288 bp, Glycine max
  Peptide Sequence Number=SeqID_215004
atggtggatgctagacaatcagcttttttgggagataaaaatattcttgatggtatttttgttgccaatgaagtgatctatgaaatgagagaaaagaagaaatattgccttatttttaaagccaactttgaaaaggcatatgatttggggttgagtggattggttagggaagcggaagccaaggaattgttttatgaggtgaatgtgggagctagcaatttgaaggtatttcttcttcaatttgcggatgataccattttcttccttagaaggtggcaatcaccttga

SEQ ID NO: 98227 - DNA, 675 bp, Glycine max
  Peptide Sequence Number=SeqID_215005
atgtataaaggatgtttgcacctggttagtcatcagttttcaagtttttatttacttgttagcttctcagtatgtcagatcgaactttttcacaggttgacctgcgtatatgctgcttgtaaaatagaagaaaatcatgtgtcagcggaggagcttggtaaggggatatcgcaggatcatcaaatgattctcaataatgagatgataagtttggaatttgatcttattgtgtatgcaccatatcgctcagttgaaggttttataaatgatgtggaggtttgtctggttggccctgatgcagcggaattctgtaatgctggtgatgaccagcttgaaatgctcaagactttgcaagagacagcaagatttgaagttgataaaatgatgcttacagatgcaccacttttatttcctcctgggcagttggccttggctgctctaagcaactcaaatgcactccacagagtcattgactttgatagttatcttaggggcattttttcccatgagaattccatgcatacaatgtccgagctttctgaatcactgaatgcaattgattcttgggttagaaaatataaaagtccttctgagaaggaattgaagcatatcaaccgaaaactgaagtcttgttggggtcatagttctcatgacgagtactttctctacccttaa

SEQ ID NO: 98228 - DNA, 351 bp, Glycine max
  Peptide Sequence Number=SeqID_215006
atggtcaacctgcatccatctttggtcatagttaaagatgtagagaaggatactattggttctagtgatgtgtggtcggaggccaaaattcagctatgttcagtacgtgaaaaacttgacacaagaacgaaagaaacacatgatgatgaggctaagatggaagtgaatgacaatgagatagaaatgacaactcaaacaacatcttctacagagggaagtgggcaaaggaagagaagaagaaagggtgacaaaagaattggggctatttataagctctcatctcaattagatcaagttcttgaaaaatacgatggtgaatctcttgatgacccaactagcatcaatgcatga

SEQ ID NO: 98229 - DNA, 396 bp, Glycine max
  Peptide Sequence Number=SeqID_215007
atgttttgtaatagagcacttcctatacgtatattgtcagtggggaagaagcgatcacgtggactgcaactcatggttgatgagtatgctgataagctcagtgaccaaagggctcaggttgatgccgaagatgaggcagtgatgaaccttataaggtctgatgattgggttgtgatgttggatgaacgtgggcaagacattgaatctgagcaaatggcagagttggtgggtgatgcaggaaatactggtgcttcacgattatccttctgtattggtgggccctatggtcatggaagaaaaatgcggcaacgagctaacttatcaatcaagttatcttcactggtcttgaatcatcaaatagcattacttgtgctcatggaacagctttacaggtag

SEQ ID NO: 98230 - DNA, 225 bp, Glycine max
  Peptide Sequence Number=SeqID_215008
atgctcaagagtgaatcagaaccatggtcatggtataaaatgtggtatttatggtgccaattctgcagaatggattatgagcatgcaggtgttggggctatagagtttattatatgccattcagaggtctcaattgcacttgcagaagagaagaagatacctgagctattcaagacatttccaaatgcaacaaagtatcttaagagatcaaactcagagctttga

SEQ ID NO: 98231 - DNA, 1032 bp, Glycine max
  Peptide Sequence Number=SeqID_215009
atggagcttcgtgacattgatgtcaaaatagaagatgaagatctggcaataatttcgttagcctctctccctccttcctatgacaatttgcttcgactacaagcgtctgggaattatgatgaagcctctgttttcgggttatcagtgactgattctaccaaagggcgggaaaaaaaaggcaaaggtagcaaaaggagcatgaatgattcctcatcagaaaacgatttggttatggttgttggtgaacaaatacaacaacaacattttgaacaacgggtactagactcaatttggtcttatcatatgtgtccacacaatagctggttcataacatatgaaaataagtctcatggtaatgttttgatgggtaacaatgcttccttgcaagatagacggtataggctctatacaaatcagactgcaaatgaaattgttagaaccttaactgatgtggagttatgcaaatcagagggaaaagggaagtttgtggtaatgcaggctttgtctcaactattctacaagatgggaagccatgcgtctaatggctcatccaatggaatctaccactttatctatgggaagcaacattcggtgaaattcccaaaggttgtgcacactacaaaggccatattggactacgtccattcttattgttggtggcctttgagagttctatcactaggaggggcaaggtacatcctctccatcatcgatgattactctagaatgacatgggttgaagcagtcaacatagcatggtatctcatgaatcgctcctcgaccactgccatagatttcaagacccttattgaggcatggtctaacaaacctgctaaatactcaatactaaaggtgtttggatgtccaacatactatcacataagtgaaggtaagttggagcctagagccatgaagggtgtctttatgagctctgaagatgaagttaaaggattcaaaatctggtctccgtcagaaagaaaggtcattttgagtagagatgtcatatttgttgaactctatattgcattctaa

SEQ ID NO: 98232 - DNA, 433 bp, Glycine max
  Peptide Sequence Number=SeqID_215010
tgacattataattcaagggctgaccattctttctccagttgactctccaaacactgatggaatagatccaggcatgttcacaaatgcaaggccgtatctgctgttagtggcagttcaatttgggtctgctggcatgttcatatttgcgatggattctataaagaagggtatgagccattacgtgttcatcgtctatcgtaatgccatcgcctctgtatctcttgctcccttcgcatttgttcttgaaaggaaagttaggcccaagatgactttccgggtattttcagagattatggcactggctttcttcgaaataatgctggaccagtgcatcgccctcttgggcatgaaattcgcgtcggcatctttcctatctgttgttatgaactccgctcactctgttacttttgtgatgtctgtcattctaaggtaa

SEQ ID NO: 98233 - DNA, 171 bp, Glycine max
  Peptide Sequence Number=SeqID_215011
atggaagccagatcagagcaagctctgataccgaaaagagctagacgcgagagcctcagtgtatgggtccaaatgcttctgatgagagaatgcttgccatctctacataagccttggagtacatctatccaagagcctccagattgtttaaaagaacttgaagtctcctaa

SEQ ID NO: 98234 - DNA, 390 bp, Glycine max
  Peptide Sequence Number=SeqID_215012
atggaactccaacgtctaaatcaaaatgaagaaatcgacaaaaagaaaagaagtatagcacttaaagcctcttcatcaataagtttcaaaaattcatcaagaagagaagaatcgagaggcgtcagaacttcaataatggaagaaaatctcaagaagactcccaaattcttatatgctacaaatggaaccaacttggtcacatcaaagcaaattgtccctcaaatgaggaatggcttgagaagagtgacaagaaaaaggtatgaagaaagaaggaccaagaaggcctacattgcttgggatgacaatgactcatccgatggtccagagaaggagatcaaccttctaaccaaggattatgagagcggtgagaacatcgctcaagaagattaa

SEQ ID NO: 98235 - DNA, 339 bp, Glycine max
  Peptide Sequence Number=SeqID_215013
atgaatctcagacatagagtattaatgaaggtttattgggggttaggtttgtggtttaatgattatagagaaaagtggaagggaacaacggtcaggtgtcataagctgctagtagtggtggtgttgcaagatgtgatggtagttgtcttcggcagggtgttgcaacaaatagtgggttacgcacagtggtggaagaaggtgtcgcgacataaccgttggggatgtagatcttgtcaacagacaaggacaacatcaacgatgagctcgcaagcaacacacatggaggttaagcaagagtcaggcattgagggagggagatcacgtggtgaaggagcgtga

SEQ ID NO: 98236 - DNA, 1551 bp, Glycine max
  Peptide Sequence Number=SeqID_215014
atgggtgttaaggctgataagtacacttttgccatgatgttgagtttgtgctctttggagcttttttattatggaaggcacatgcattcggtggtcatcaaaatgtttgaagaagcagaagaaggtggctcgtgtgattatgatacatataatgcaatgatagatggttttgcaagtgcggagagaagtgaggatgcgtttttgatgttcagagacatgcaaaagggttcttttggcccaacggaggttacctttgtgagtgtcatgagttcttgtttgagtttaagagctggttgtcaagcgcgggctcaagctatcaagatgggttttgttggttgtgttgctgtgaacaatgcaatgatgactatgtattctgggtttggggaggttaacgaagttcaaaatatttttgagggaatggaagaaagggatgttgtttcatggaatataatggtttcaacctttttgcaagagaatcttgaggaagaagcaatgttgagctatttgaaaatgaggagggaaggaattgaaccagatgagtttacttatggaagtttgctgcttgcttcagattctttgcaagttgtggagatgatccactcccttctatgcaaaggcgggcttgtgaaaattgaagttttgaatgcgttagtttctgcatactgcagacatgggaatataaagcgtgcatttcaaatcttttttggtgttccctctaaaaatttgatatcttggaacattatcatgtctgggtttttgatgaatggacacccgttgcaagggttagagcaattctctgcattacttagtatacaagtcaagccaaattcctattccctcagtcttgttttgagcatttgttctagcatgtcagccgtgagtcatgggaaacaggttcatggttacattctaagacatggatttccttcagaagtttctttgggtaatgccctggtcacaatgtatgccaaatgtggatctttagacaaggctttgagagtatttgatgcaatggtggaaagagatacaatatcttggaatgctatgatatctgcttatgcacaacatggacaaggcgaagaagccgtgcactgttttgaggtaatgcaaacctcacctggaatcaaaccagaccaggctacctttacttcagttctttctgcttgcagtcatgcaggtttggtcgatgatggtatccatatacttgatacaatggtgaaagtttatggatttgtgccaagtgtggatcatttttcttgcatagttgatctgttgggtcaaagtggataccttgatgaggcagagagagtgattaaaactcatggtaatttaagactaggaagaacagttgctagacttatcctggaaagagaccataacaacccttcagtttatgtgcttttatcaaatatctgtgcagcagcagatggagtcagtgggattggtgtcgagggagtgaaagacgtggagggcttgggcgaggttgttctagtgtgcatggatggagatgatggcgttcggtggttgaatgtagatgggttggcgtgttga

SEQ ID NO: 98237 - DNA, 138 bp, Glycine max
  Peptide Sequence Number=SeqID_215015
atggtgattttcagccatggaattgcagcgaaagataaagaagaagagcctagcacatgggaagcttccttgagaagcaaggaaggtagcttccttgagaagctagaggggggctactcacacccctctgatagctaa

SEQ ID NO: 98238 - DNA, 204 bp, Glycine max
  Peptide Sequence Number=SeqID_215016
atggcggcggtggtggtggggaagaggggcaaaagaaacgatgatgttgttgagattcttgctgaacatccttgtcctcgtcatcctcgtcggtggcatttccctttctccacaatgacgcttctgaatccctccgtggcagcgtttcctccccaagttagtagctatgttcctaagtcacaactcacaactcaatatctatag

SEQ ID NO: 98239 - DNA, 327 bp, Glycine max
  Peptide Sequence Number=SeqID_215017
atgaggattgacatgcattccgaggaaggaacggacgaacaaggtacaccaggggacagttcgaacggtttaaaggaacttggtgggatgttgagtggtgataacttgactaaggccatttttttatccgatgtcaagcacgacgttgactccctcgtcttcattgatgccatcaagacgtggaagcagcatgatgatgtgcttcatgtggatcacttctacggtttcctctgttgttgtagtgtgctagtggatgcaccagagtataggccatgtatagttgatttaagtttaagcacaataagcaattattatgatttattttga

SEQ ID NO: 98240 - DNA, 1080 bp, Glycine max
  Peptide Sequence Number=SeqID_215018
atggcagacccttactccaatttcttctcaccaggtagtttcttccaccactatccttctccaaacccttcaccccaccaccatccctatgctcacaacttcctcaaccaaaatggttccaacatcaataaccacaacacctttttccacttccaccactttcaaaccactatttgttcttcttcacctccttcccctcccttgagagaagcccttcctcttctaactctcagcccaagaaatgaagaggaacaagaagaggatgaccaagatcaagatcaggagattcttcaggaaaatatttgcactgccatggatgtggaagagaattacaacaacagaacccttcaccttcacccaaaaggggaggaacaagatcaagaagatactgatgaaagtgtcactgttgcactgcacatagggttgccaagccctagtgctgctgagatagcttctgttctttcttcagcagcttgttctacagacaaagaacaacaaggaggacatggagttggtaataacaacagtaataatgggagtgaggatttttcttcttcagggttcttgtctaacaggctcaacaagggacagtactggatccctaccccttctcagattctcattggtcctactcagttctcttgtcccgtttgttgcaaaaccttcaacagatacaacaacatgcagatgcatatgtgggggcatggatcacagtacagaaaagggcctgaatctctgaggggtacccaaccaacaggttgcaggaacaacattgatcacccaagagcaaagcccctcaaagacttcagaaccctccaaacacactacaagaggaagcatgggattaagcccttcatgtgcagaaaatgtggcaaggcctttgctgtgaggggtgattggagaacacatgagaagaactgtggcaagctttggtattgcatctgtggatctgatttcaagcacaagaggtcccttaaggatcacatcaaagcctttggaagtggccatgcagcttacgggattgatggatttgaagaagaagaagagcctgcatctgaagtagaacaagataatgactga

SEQ ID NO: 98241 - DNA, 570 bp, Glycine max
  Peptide Sequence Number=SeqID_215019
atgtacagtgacgaacaacacattgccacatgggctttttacagcatctgtgtatttttccgttgcaattgcaacctccctcttcacactttccctcctccgtcttcttcctctgcacgcattttccgctgcagcaactccaaagccgccagctcagcatcctcgaaatcagtcctcgcaactgctgattctgttcaggctttgtttctgaaactgctgcaggtgttgcaatctggcatggatttcctctggagcgagaatgcgacgacgccgcgcgcctcgcatttctccgtcgcgatctgcttcgccttcgccagtttcgcggccaggttcttccttgacagattcgtctttcgcagtttggccattaggatgttgacaaagggcagagctccttcacgtattactaaggaaatgcaagtaaagattggaaaatgctcagagtcaatgtggaagctaacatattatgctgcagttgaagcatttgttcttaaaattacctaccatgaaccctggttcactaatacgaagttatacttcaatgactggccaaatcatgagttgaagtaa

SEQ ID NO: 98242 - DNA, 342 bp, Glycine max
  Peptide Sequence Number=SeqID_215020
atgaaagaacattctaatagaaagggaagatttgtcaagcatttctcagttctattagagattccaagcatttacagagactcagatctaagacgtaaatctattaagtatctaggactagaagtttcaagctatattcagattgatggaaaggagtggaatggagcccaatggaatgaattccattccatccaatccctcttttctcccccttcaagttggggattatgggataaaatcaatctttttttatccatccactgcattttgtaccaccccattcctctccaatcaacagtagatatccaaacattgcctcaagaaataatactggctctttaa

SEQ ID NO: 98243 - DNA, 366 bp, Glycine max
  Peptide Sequence Number=SeqID_215021
atggaagctgccaaggttttcaagtattctggaagggagtttggtgcaagtgtgtgttttggattctttgctgtttcgtggctcatactgcggctaattttctttccattttgggttattaaagcaacgagcattgatcttcagcaagtcttaagcctgtcagagggttttcatatgtttctttactatgtttttaatacaatgctcataatgctgctcatcttccatatatattggtggaagctcatttgtgcgatgatcttgaggcagctgaaaaataggggaaaagttggcgaggatataagatcaggaaccaccgctgttaggatatgttccactgagtttattcatactatcttgcactga

SEQ ID NO: 98244 - DNA, 303 bp, Glycine max
  Peptide Sequence Number=SeqID_215022
atggaagaattggaaagcccgcttagcgtgcaaaacaagcccaacgcgcattctcgctcaccgcacaacacatgcttagcgcgaaaaagacccacgaagaagtccaaagacgcgcttagtgcggaagcttgcgctaagcccgaagtcagcatgaaaattaacctacctagtgcctatataaggaggaggaagcagaagaaaaagacacggagtctcataacccatgcactgggtctatcccttagggaaaaccctctctctttagtcatccatcattttcttccatccacctatatcccctaa

SEQ ID NO: 98245 - DNA, 537 bp, Glycine max
  Peptide Sequence Number=SeqID_215023
atgcagattgttcagagaacagccaagaagttttgcctccaaaattttggaaaggttggtgaatgtaaagctattacatgtaaagaaagtggagtaatctactatggtaaagatgacagaaaaggggatgagatttcagcctttgagaaagaagaaataccagcacttcagacatcaggggtacattttaaaacattttgggagttggaagatgatctggatgtgagccagggagaccatcatcagggaagtacagaatgttttcatatatcagtaaatatccggcacttgaagctcaatgccgactttatgacacactctggtggctactgcctgatgaacagaacggggagcatagcagactcaacatcccttttcatcaaaatgtgctttgagacagctgccaaatttattgttgaagcagcttatcatgggcaagtggacaatttggagacaccatctgctagaatttgtattggtttgccagtgaagatgggaactgggtgccatgacttgatacagaagctggagatatga

SEQ ID NO: 98246 - DNA, 246 bp, Glycine max
  Peptide Sequence Number=SeqID_215024
atgaagcccaaagaggagtgcaaggtaattttcattagaagaaaagagaaggaaaagaaaactgaggaggatgtatgtgatgaggaaggagaaaagaaagaagagagagaaagaaatgaggagaaaacacaacaatgggagaagtgctcacaagtgtttccgggatacatgagtttcatagagtctccaactaagagacgaaaatgcaaagaggttgtgttttatgtgaccttcatgccatcttga

SEQ ID NO: 98247 - DNA, 789 bp, Glycine max
  Peptide Sequence Number=SeqID_215025
atggtgctgaatcccatcccagtgcttctcattatgctgataaaggagatatctgaccatgagtttgaagggaaagttgtttatcgccacttgaaggatggcgatgttgtgcttgccaatcgacagccaacactccataaacctagtataatggcacatatagttcgcgttctaaagggggagaaaactgtacgcatgcactatgcaaactgtagggttactacagttaataacttctttgttttattttttccccttcgtgatctctgtacttataatgctgattttgatggtgatgagattaatgttcattttccacaagatgaaatttctcgggctgaagcttacaatattgtaaatgctaacaatcaatatgtgaaacctacaagtggggatccaatcagagctttgattcaggatcatattgtaagtgctgctcttcttacaaaaaaggatacttttctaagctatgaagagttcaatcaactactgtacagttctggtgtatccatggctgggctaggctcattctatggcaaacatgggcagaaagttatcagtgcattgctatactatatcaccagaggttcaccatcatttactgttgagaagaatgcaaaaatcccatctaattttttcaagactcggatcaggaaggggaaaagatacactcaagatacatcaaaaaagaaggaaaagcctgatgaggataaattattgatatataaaaatgacttggtgcgtggcatagttgataaggctcaatttggtgactggtatgatacatag

SEQ ID NO: 98248 - DNA, 342 bp, Glycine max
  Peptide Sequence Number=SeqID_215026
atgacaaacaagcttaactcaacaacaagctcaggtatattaaaggagctactatctgaaggaatattgcaaccttcaggaaaaaattgtatttctcttatgactacatctggagctaagggtagtatggtaaatttccagcagatatcttctcatctaggccagcaagagttggaaggaaaacgagtcccacgcatggtttctggaaagaccttaccctgctttcctccctgggattgttcccctagagcaggagggttcattattgatcggtttcttactgcccttcaccctcaggaatactacttttgtgacaccctctacccctcacatatatactaa

SEQ ID NO: 98249 - DNA, 429 bp, Glycine max
  Peptide Sequence Number=SeqID_215027
atgctccaaccatatgagatcagcataggcttaaaggagcactcaaatccggtgacccccaaggcctacactccgaagagtccgtcagggcctctccctcctgattcagggtgggttcctcaagtgtttggcttgagtgcttatcaattggtatcagagctggttgttgatatctcgataaaggctgcttacaaagccgccgagatgtcagctctcaagggaggtgctatgattgggacttgggaattatgggtccttggttctcccccgttaacaactagttttgaagggtgggttcccaaatgcttgggtgcttatcaactgatgttgggtcccatgggcagtgctatgatggggacttgggtattatggggtgcctatgtctctcatcgagtagtgtgggatgctcggtggagtattaagtgcttg

SEQ ID NO: 98250 - DNA, 639 bp, Glycine max
  Peptide Sequence Number=SeqID_215028
atgaagaacctcatgctagaggacacgggaacacaacgctctgataggatggtgaagggcagtaagaaaccgatcaataatgaaccctcctgctctaggggaacaatcccagggaggaaagcaggggcacatttggaagacatgtttgattcagaacatagtaaccaaatgccaatgcttccaaattatattgatcttaagatgcaagcacccgtcttcagccagccagcccaacagttactttcggccagtgcatctgggacaaagacaggggccactgcatctgggacaaagacagggaccagggcagcagggacaaagaccgggggccagtgcatctgggacgaagacagggatcagtgcatctgggacgaagacgggccagtgcactgggacaatgaaagctcgaatggagatgaaactccaaggataggagcagtcagtaggggcgaccactatgctggaagcgctgccaaaacggcagcaagacacgcactgtcatgtgctggaaaagcttccggcacaggtgtatttagctcactgaaaaggcgtgtcgggagagcacatcatgagttctttcaagatgccgtcaatggcgtggatgcctcattaatagatttcacaaaacaacaggtataa

SEQ ID NO: 98251 - DNA, 707 bp, Glycine max
  Peptide Sequence Number=SeqID_215029
atggagtgttgtcaacaaatttttcacatcattttttattatttaaattatttaaaaaatccaattcgccctcctcctcttctccttcctcgtctccctcctcttcttcctcttttaaagatcccttcctccaccacaaacccccttgtcttcctccaaaactacttccaaaccctaagagccagcggtggcggcaacctccaactcgtgatcaagtccagcaaccctggcagagccttccacttcctcggcgtcacccacaacgactacttcttcaggtcaggtcttgaggagttgatccaacacctcaccgaaaattatcgtaatcgctacggcaccccactagcctccaagtttgatgtcgagggcttgggacttagaaaagttgtatcgttttcgtttccacaggttgcgactatgtgcaaggagcgactacatgagatcgtgaatgaagaaatggaccacgcgcatgagaatttggagtggaaactgacgatgaagaacgaattcgctcgcatggacgataaggttcactgcctaagccagagcaaccagaccttcacctgtaggtgtgacttcaaactcctcactgtaatgccgtcatcgccatcgtcacaccagacaaactctttgtctccaactgcaacagctcccacatcttactctaccataatggcaccaccatccctctctcctccgatcacaag

SEQ ID NO: 98252 - DNA, 228 bp, Glycine max
  Peptide Sequence Number=SeqID_215030
atgcataatgatgttgttagaactttaattgaagttcttcacattcaaaagcttaagaaaactcttgtatctgtggataccatggattcaaaaggccacatgagtggaaaaggtctaaatattatgagcaaacgaggcttacttggaaatcacaaggtgaccctcttcagttttgtgagcactacatatatgggaaacaacatcgaacaaagtttccaaaggttgtga

SEQ ID NO: 98253 - DNA, 537 bp, Glycine max
  Peptide Sequence Number=SeqID_215031
atgtcttatgttccttatgcaagtgttgcaggtagtctcatgtatgctatggtatggactaaactagacctagcacaggcagtaaatgttgtgagtaggtatattggtaatcctggtaaggaacattggcaagttttgaaacatatactcgagtaccttaagggtacaactaatattagactcgtctaccatggagacacgtcttgtgctctccctaattactcaaattctgactatgcaacagattgggatgcaaggagatctgggactgggtacacattcactattggcaactgtcttgaaaaggctatcattttatgtgacggtttgaatgcaatttgtttagccaaggatcaagtccatcatgaaaggactaaccacatggacatcaaatataacttcatctgtgttgagaagagggttgaagtccataaagttgatacgagggacaatccaactgatatgttcacgaaggctatttcgagaagaaagatcatgcattgtctagatctacttaatgtagatttctggaaatga

SEQ ID NO: 98254 - DNA, 600 bp, Glycine max
  Peptide Sequence Number=SeqID_215032
atggtgaaaatatctctcagtttatcattagagttcacagatgagataatgggttttgtttcagcagtaaaccatatgcgctcgtttgttcctgccatttatgatgtaactgtggcaattcccaagagttcacctgctcctacaatgctaagactcttcagagggaaatcttcattggtgcatgtgcatattaagcggcatgcgatgaaggatttgccagaagaagatgaagctgttgctcaatggtgtcgagatgtgtttgtggctaaggatgcattgttagacaaacatatagctgaggacacatttagtgatcaagagctgcaggatactggtcgacccgtaaagtctcttgtggttgtcatattgtgggcttgtgtcgttgttacgggggtcgtaaagttcctccaatggtcttcactactatcctcctggaagggtgttgcattttcagcatttggtttgggagttgtcactctactcatgcacatcttgatcatgttctcacaatctgagcgttcaaccccttccaaggttgcccctacaaaaaagtccaagaatagcgaacaactggaagctagggataacaaacaagactag

SEQ ID NO: 98255 - DNA, 255 bp, Glycine max
  Peptide Sequence Number=SeqID_215033
atgaatattcccttcacttacttggggatatcggtgggtgcggacactaagaagtcaagcacgtggaaactaataattgacaagatgcatgctaagttggctccatggagaaggagacacttgtcatttggagggaggatctcatcgaaggtcttgaatatccttaataggatacaaaggaacttcttggggtgtgctaaggatgaggagaagaaagactctcttgaggaagtggatttggagattgttgagtga

SEQ ID NO: 98256 - DNA, 141 bp, Glycine max
  Peptide Sequence Number=SeqID_215034
atggctagaattagtgattatgaaactcatgggtccaagtattcacagatcctgaaacctttcattcaatgggtaaagagcatgctcttgtcatatccaatcacagaagtgacattgattggcttgttggatgggttttag

SEQ ID NO: 98257 - DNA, 615 bp, Glycine max
  Peptide Sequence Number=SeqID_215035
atggtgcagcaaaatgttagtggcatatctgtgttgagaaaacttaatgaacatagtaaaggcaaccagcaagaaggtggaaagggtgacaagttgtccataaaggtacttacatttaaggtgagaggtcttggtagctgcttgaagtggaatgctatcatgaagttaatagcaaaagaagagccaaatctaatcttcttgcaagaaacaaagttacaaagtgtggatgataaaatatatggagcaatgtggggtgatgcttttgaggaatggagacaagtacccgcagtgggagcattaggtggaatccaatgtttttgggagctaggtagcttacaagttatagattggatgggaggaaaaaaatttctatacattcaagggagatggtgtggaggaagtgaggtgattttaatgttattagaaagaatgaggaagggaaaggaagatgtgagagtcaactttggagcgagaggtggggcaatgaataagttggatagggtgttggtttccacaaaatggttacaattgtggcctaattctacacaaagtgctcttgatagatccacctctgatcatcgtccaattttggtgaaccaaaaacatgttgattga

SEQ ID NO: 98258 - DNA, 216 bp, Glycine max
  Peptide Sequence Number=SeqID_215036
atgagaggttcaattgggatgttaaagaaaataagaaatagagaatggggtgacctgaatgaggttaacgatgaggccggaagcgaagaagagaaggcccaatgggacgaccacactgcagtcatagccagcggattcccgaaattgttgtctgtcgatgatattgatgttgctggctatgttatgtcgatctctgctatgctatggctaccttag

SEQ ID NO: 98259 - DNA, 813 bp, Glycine max
  Peptide Sequence Number=SeqID_215037
atggctcatctaaactcttatgaagaatttcatggcactttcccatctccagccaaggacttcttctctaacagttgtgactccaaggacaacgacttcatcttctccctgttgatgccgctgccgcgagatatagcttcatcctcgacatggtttctttttctggatctgagatccatttcccttcctcctttttctagatctgacatggtggcttcgtcctcttcttctctttgcaccgactctccttccctcacactttgtcctcattgtataaaggatgttgatgttactaatcctagaagaagagccattgttgcaacgggttttggggggatattaaaagtatcggcaaccgtattaccagagaagttatgctgttttttggtaccgacattcaaggaaatcgtccatgaagaaatagcatgttctttcggtaatccggcaacctacataagggacttcttagtggaaggaattaaaaattacaggcgtaagattactatggagtattctggctgcatttacttgctattgattttatatgctgaacatgttttatatggttctataccgagatggacatccctagaagagctcccaactcattattggaacaataagttattaaataagcttgcagaaactattgagagggaaggcggattaggagttatgacagtaaaggtacttgctcagacaaagtataatgaacattctctcatgccaaactgtgttcaggacctgtccaagcgagtgaatatgttggaaggcacagcgacttcacaatcttggttgttgcagtactattaa

SEQ ID NO: 98260 - DNA, 219 bp, Glycine max
  Peptide Sequence Number=SeqID_215038
atggctcacaatggtggaaggatctattggggtgttgtgaggttgggagggatgttacaagggaggggtggttccaaaagactttccttcatctctgagcaaaaaccgagtaaagtgtgggaggtgggtggttggcatagggatatttgggtttgggagttaaagcggagaagaaagagatcttttatatttgctgtaatggggagtcactccttgtga

SEQ ID NO: 98261 - DNA, 1824 bp, Glycine max
  Peptide Sequence Number=SeqID_215039
atgggcacttctcagagccgcgaaggcctcgaagtcaccgactcagactccgactacgaaaacgaagaagaaacagagcactacgaagacgcgaaaaccacccactccaccgagctcgatgacgtggacgcgaaactcaaagccttaaaactcaaataccaaacgccgtcttcctccgccaaaccgcttccccaaaacgccgttaagctctatctccacatcggcggcaacactcccaacgccaaatggatcctctccgacaaacacacctcctacgctttccacaaagacaccgacgaaaacgaaaacgacgatgtttggctcctcactgtaggttccaaggtccgcgctagggtttcctccgaaatgcaattgaagatgttcggcgaccagcgccgcgtcgatttcgtcgccgacggcgtctgggccctcaagttcccctccgatgacacctaccgccgattcgtcacggaatttcagagctgcatgttcgagaacgtgtacggaatcgagtgcacggaagaaaacaaggtcaaaatctacggtaaagagttcatcggctgggtgaagccggaagccgccgacgattccgtctgggaggacgccgtctccggagaaccgtctccttcgccgtcgccgtcgcggcggagaaacgatttaatggaggaattcgaagaggccgcgaatggcggggtccaaaccctaaccctaggcgctttggataatagttttatggtgaacgacaccggcgtccacgtgtaccgcaacttcgaccgcgggatccacggcaagggcgtcgccgtgaaattcgccggagatggttcgacaccgaacaaggctttgttgatgcgcgcagaaacgaacatgatgctgatgagtcccttaaacgacggaaagccccacgcttcgaagcttcaccagctcgacattgaaacggggaagattgttacggagtggaagtttggaaaagacggtgctgacttaacgatgagggatatcaccaatgacaccaaagggtcgcagttggacccttcggagtcaacgtttttggggctggatgataaccggttgtgccagtgggacatgagggataggaagggaattgttcagaacattgccacggcgagttcttctcccgttttgcattggagccaggggcatcagttttccagagggactaactttcagtgctttgcgaccaccggtgatgggtccattgttgtggggtctcttgatgggaagataaggttgtactcgaagacgtcgatgaggatggctaagacagcatttcctgggcttggttcgccgattactagtgttgatgttacttatgatggcaagtgggtgcttggcactacggatacctacttggtgctcatttgtaccttgtttacggataaagatgggaggacgaagaccggatttagtggtagaatggggaacaggatacctgctccgaggctcttgaagttgactcctcttgattcgcatttggctggcgcgaacaataagtttcacggtggccatttctcgtgggtcactgagaatggtaaacaagaacgccaccttgttgcaactgtgggcaagtttagtgtgatatgggattttcagcaggtgaagaacagtgctcatgaatgttacaggaatcaagaagggctgaagagctgttactgttacaagataatattgaaggatgagtccattgtagaatcgcgatttatgcacgacaaatttgctgttagtgactctccagaagctccgttggtggtggcaactcctatgaaagtcagctcaatcagcatgtctggaaagcgacatggttaa

SEQ ID NO: 98262 - DNA, 108 bp, Glycine max
  Peptide Sequence Number=SeqID_215040
atggctgagattaatgaattaaggtttcaacaatggagggtccttggaacacacattcagcaagagaaaatgacgaatcggagaaagaggtcaacgtccttcatctga

SEQ ID NO: 98263 - DNA, 261 bp, Glycine max
  Peptide Sequence Number=SeqID_215041
atgggatgggttgaacaagagtgcagttcttcagcaaggaagtggtcatccgaagaagagaaggcgaattgggttggagcgaagagggactgggagacgctagcagtgatgagaattcgaaattggaatgttggttgggatggaaggaggagatatatgtggggagtttatttggacggtggagttgggagtgagagttggacccgagggagattgagaattaagtggggaggaattgtagattggatcaggtggatttaa

SEQ ID NO: 98264 - DNA, 1017 bp, Glycine max
  Peptide Sequence Number=SeqID_215042
atgggtataccgcatcaagcgtggatggctctattgctcgttacatggccagtgttgggtcattgtttgtctatcgccgcagctcaatgttggcttactttcttgtatatgttgatgacctcctcacagttggtccctacaccggatggcctcttcctcacccaacaccactacattcgtgacctgctgcacaaacacaacatgcatgatgccaaaccagtttgcactccaatgtccgcttcggttaatcttgccacaccctctggtgatgtgcacgagtatcgtcaaattgttgggtctcttcagtatctagctctaactcggcctaatgttgcttactgtgtctccaaggtgtctcagtttatgcatgctccaaccaccattcatatgcaggcaacaaaaggcctcctccgctacctcaagtctattggactatggtctccatctccgccactcattggatcttcacctaatggcctcttgacccgatgccatttcttggtcttgcaaaaagcagaaaaccattgccaaatcatctgtggaggcagataccgcaccattgggtccatcacggctgaaatcctttggctcaaggaactattcaaggatcttcgcctaactcttccgggtaaaccacacatctactctgctactattggagctacctatctctgtgccaatcctgtgttccacactcgtatgaagcatcttgccattgattatcactttgttcgagacccagtcaccaacttgcagatctcctcacaaagctctctgttcaataagacacaagtggctgacatccaagattggggttgcttcctccacctccatcttgtgggggcatggggtgtcagtgccaaagtcatcggtggtgagcttggaaaggggttgttgagagtaaagagggagatgaaggtggctttggggatgaagagaacaccatcactctgtttctcttccattgtctgcgccatgttggaaataaggctttttatgtttaggaaaagtgtttag

SEQ ID NO: 98265 - DNA, 492 bp, Glycine max
  Peptide Sequence Number=SeqID_215043
atgttccctttagatgtacctccctgtgtggaaggatgtgtgtggtgcattagatgccaaacagttgtggaatgtaacgtgttttctcaggtttggctgcatgactgtgtaaaacggtttggtttgtcaactgttttgcacagcgatcttattcgtcattatcaacaattcaagggccttgttagggtccttctgttgacatggatgggtgcacttggacttcatgaacttagcatcagagaggtggcgggttctattctagtttttcgcgagtgtttcctggtgagggatcctgtgagggacaatgtagttggactcacggtcccaagccttgcacgaaaaggagtggaggaaggaggtctcgaggatggagaatctcgcagtgacttagaggaactaggagacattgtagtagtcaaggtggtccaacatgaccttgcaaaagtgaaggatagtgagaggaactttaccctaactgcgatctaccggtag

SEQ ID NO: 98266 - DNA, 396 bp, Glycine max
  Peptide Sequence Number=SeqID_215044
atggaccttggagggagtccattgtaccaggtcaatgccacccctttaagagacatggggaagacacaacataggattgcattgtcaatggtgtacagatttgtctgggtcaggaaaaaatctagatgttcatccggattggtggtcccatcataccgctctaggttgagtggtttccaacccagaggtatgtcatcttccatgatgcggttgacaaagcggtgtcgacaagtagtcaaccttgtaggacggtggacatggcagagacttggatcatccagagtgttgaatgtgcgtcacaggaggattggatccttcaaaaggggtcttgcgtttgaggccacatcaagtgctaaccataggtgcgaaagagagatagataacgagagaccgtag

SEQ ID NO: 98267 - DNA, 531 bp, Glycine max
  Peptide Sequence Number=SeqID_215045
atgggttttgtacaaatcagaatgcatgatggtgttgttaaaaccttgattgaagttcatcatgttccagagcttaaggaaaatcttgtatctgtgggtgtcatggattcaaaaggtttttattgtttggttgaaggtggagttatgcatatcagagggaaaaagaagtttgtggggtccattgagacaggctctatctctattgtttcacaattgggaagccatgcatccaatggctcgtctgataattctctgtggcatttgcatctgagccacatgagtaaaaaaaggtggaacctcttcagttttgtgagcactgcgtctatgggaaacaacattagacgaagtttccaaaggttgtgcacacaacaaaggccatgttggactattggggaccttcgacaattccataactggaaggggaaaggattgaataggagtttctgggttgaggtagtcaacccgacatgctatcttgtgaatgaatcaccgcccactgtcatagacctcaaggcccctattgaggtatga

SEQ ID NO: 98268 - DNA, 537 bp, Glycine max
  Peptide Sequence Number=SeqID_215046
atggatgaagaaaagtgttggaatatggttgtgttgatgttggactctaagccaatgtcatactttagtgaaaaacttagtggaataacattgaattatcctacctatgacaaggagttgtatgttttgtttctgaaaactcaaggcaagcttggaaagagacatgccaagtcgttggagttcactaagatgtttccttatctgatcaagtacaagaatggtaaggaaaatgttgtggttgtgacacattgtctagaagatccacttgtaccccactacttttttgcctttaggtaccacaacaaaatcccaactggttcttctaaagagatttcatctcttcattcatggccatcattcactcctcaacttcagaacaggaaattgcttctttataagtggttgctcttaaattccacctacttagtgacatctttaaccttgcccaaatcttcatcatatttagaatgcaacataaagagttcatcaaagacgacatctctactcaaaatgacctttctttcagatggagactag

SEQ ID NO: 98269 - DNA, 204 bp, Glycine max
  Peptide Sequence Number=SeqID_215047
atgtttatttctattgcgattaaacggtacagatccgacgatgagtcctgtgaagcgagccaagccaaggatggagaggatgaggatgcagggttttccccgaagctagaaaggatggtcgctcaggaagaccgagaaacgaagccacaccaagaagagacgaaaatcatgaacttgggtgttggcaaagaaggaaagagataa

SEQ ID NO: 98270 - DNA, 1257 bp, Glycine max
  Peptide Sequence Number=SeqID_215048
atggcttccgcaaccaacaattctaatccttcaaatcctccaccaccgattaactctggccgacgtggtggtcgtggtgatggtggctgcaatggaggtcgcaacaattatggtagaggagatggccgtggcagaggtaggtttgctaacattcagtgccaagtttgtcataaatttggtcatgaagcttcgttttgctattgtcactatgaagaaaaccatgatcctacacagcccatgatctatgctaacacagaaaccactcctccaacacagcaagcttccacacagcaatctgtaatccagcaaccttcaacacaacaagctgtaacacagaaagttccctctgttcagcagtacatgcctgtaatggctccttttccatactattattctcagatgccttatgtacagacatacttcaacttcacaagccaaagtcttttgctaataccactgtgctcaaattctagttctgaatctgtaaatagttcttcaaataatactactgttggcaattctgcatttctgcctcttgtaatgctttgtcatttgccacttggcatgctagactgggtcatcctagtatgcccacaccagtttgagcagttcaaggctatggttaatactcggtttaatttccctataaaagctgttcaatctgactggggtggagatcaaaatttccctacccagccctatttccttcaaaaaacctccacacccattccttctcaacctactcccacaccccttactgttttacccattatccctgctactgttgttcctcaaccttcacctttatctactgcttctatacaacagccgcattccccatatcagccttcaccagaacctagcttttcttcccatgacacctctatttctgttccacagcaacagtctcctccacccgagccaatcacctcttcccttcctgtcaacacttcaccacctctgccaaatcttctcagaattgtgaaacctagacttaaccccacattgttgctgactcatgctgaacccaaatatgtcaaaagtgccatctcaaatcccacctggtatgcagctatgaagtctgaatatgatgctttaatcagcaatggtacttggaccctagttgaattaccatctcaacaagttgcaattagcagtaagtgggtctgtaggatcaagcagaatccagatggctctatcaacaagtacaaggcaaggttgattgccaaaagggtttcatcaaaggcttggacatga

SEQ ID NO: 98271 - DNA, 2637 bp, Glycine max
  Peptide Sequence Number=SeqID_215049
atggggttctgtgttttggagattcagatccgagaaagatgggatatggctttggtcattgtgaggaatagtgatagtgattttactgttgctatttcaggttatgatgtcaaaatagcctggtgttcttggtctcttgctgcaacaattgcttctgttgtggcattggtttctgtagtacatttgttcttgttccctttgacacccactttcaattattttaagatagcccaggactcgtgcttcccaactaatgcatcggcagaatttccaagcaaccgtgaccaggagtggcctgcagttgattttaagcgtcagtttccggctgacttacacggagcatttgtttatcagggtgcaccgtggaaggctgaaattggccagtggcttgctggttgtgattctgttattaaggaagtcaacatcactgagtcctcaatgtcgtttcgagttgctggttgcactactctgcttgttggcactactcagcctcttttagtgagtggttgccctagctgtggtgttttgagcctagttaataggtttgcaattctttctagtacgtggtacgagtacgggtgtgtgtaccaatcctactctagaggcaagtgtaattgctgcaatgtgtatctaattgacaaattcaacctagtccagcaaccacaattgtctgaactagagtattcattggagaaaagtattggtagccctgagtcttcagtaattctccttcagaattcagatgattgcctttatagttctgattatttacccattgacttgagaaaagaaaaaggggatggatgcactgaaaaattgcaattgcaatgcaacttccttggatcaccagatcaaccatttgggagatgggttgtctcaatttgcccagccaactgcgacaagacaagagcaatgtgcttctgtggagaaggcacaaaatatccaaatcgaccattagcggagacatgtgggtttcaatttaatccaccttctgaacctgacggtcccagaatagtgaattggacaaaaattgaccaagatgtcttcacaaccaatcgtagcataccaggttggtgtaatgtggacccagctgaagcatatgctggaaaggcaaaaattaaagaagaatgtgactgcaaatatgatggtcttgcgggccgactttgtgaagtgcctgtggaatctgtttgcattaatcaatgctctgggcatggccactgccgtggcggattttgtcagtgcgacaatggctggtatggagtagattgcagcatgccatctgttatttcttctattaaagagtggcctagttggcttcgtcctgcccggattgatattgctgacgatactcatgccaatgaaaaaatgattaatctcaatgctgtggttgcaaagaaaaggcctcttgtatatgtttatgatttgcccccagagttcaacagcttgctacttgagggacgccattttaagttagagtgtgtaaatagaatttatgatggcaataatataacagtttggacagatcaattgtacggggcccagatagcactttatgagagtttgttagccagtcctcatcgaacactaaatggtgaagaggcagattttttctttgttcctgttcttgattcatgtatcataactcgtgctgatgatgctcctcacttgagtatgcagcaaatgcttagattatgttatgtcactcctggtggggaatctactccttggctatgggttcccaagctactccggaaagcgcttggtgtaggtgaacaaataagaaagggagaaaataggatttggcgtgaaaggcatatattcacattgttgaacaatatccttattggaatcgctcatcaggaagggaccacgtctgggcagtctttttcatgggatgaaggtgcttgctatgctcctaaggagatatggaacagcatgatgttagttcactggggaaacacaaacacaaagcataaccattcaaccacagcatattgggctgacaactgggataaaatatcttctgacaaaagaggcactcatccatgttttgaccctgacaaagatctcgtgcttcccgcttggaaagttcctgatgctaatgtgttgacttcaaaactttgggcttggtctcatgagaagcggaagactttgttctacttcaatgggaatttaggaccggcgtaccctcatggaagacctgaagataccatgggtatcagacagaagttggcagaagagtttggttctagccctaacaaggatggaaaacttgggaaacagcatgccaaagacgtcattgtgacaccagagcgttctgaaaactatcacttggatctagcaagctctgttttctgtggagtgtttcctggagatggatggagtggtcgcatggaggacagtattttgcaaggatgcattcctgtggtcattcagaatgttttcataaccttttctcttacaaagaacaagtccagctccatctgcttggttctggaatgcagcactgggttgtgggctagagcaacagtgctcatattatcacagaagaccatgggtgtagtgtgtctgacttgtaattcagacagcaaggacacaagattaggtcctaagaaaatagctgcttctgaagcctag

SEQ ID NO: 98272 - DNA, 480 bp, Glycine max
  Peptide Sequence Number=SeqID_215050
atgcacgccagagctagagtaatgagtgaaatagaggaagtgcaagagcagatgaaggccaacatggaggccatgaaagagcaaatggctccaatgatggaagccatgatgagcatgaaaaaaatgatggaggccaatgcggctacaattgttgccacaagtaccgccactgagatggaccctcctcacccatctggcctcaatcaagtaaatcctccagtctcagatatagtaaggcagggaggcgaagcgttaggaagtatgggtgacccccatcttatgcaagatcagaacaagccttccttcccaccttatggcttgcctcccaactatacaccccccaatgttgcacacattcccgacgagaacgccgacaactctgcacccatacccactaaaagccaacaaccccaatctaatcatgcacatgtctctcaacccatggagggacacatgaagcaccccgagaccatactctag

SEQ ID NO: 98273 - DNA, 930 bp, Glycine max
  Peptide Sequence Number=SeqID_215051
atggaaggttgcaaaatgtttccaccaaagccatggaagaaagggccaacaaggggcaaaggtggccctcaaaactcctcatgtgagtatagaggtgttaggcaaagaacatggggcaaatgggtggctgagataagagagccaaagaagagaacaaggctctggcttggctcttttgccacagcagaagaagctgccttggcctatgatgaggctgcaaggagactctatggccctgatgcttaccttaacctcccccacatgatgatgcaaccaactatcttcacaaattccaccgccacaaaatctcacaagtacttcaagtggttcccttccaagaacttcatttcaatgtttccctcaagaggtggattgctcaacctcaatgctcaacctagtgtccatgtcatccatcagaagctgcaagagcttaagcaaaatggggtggttgcaacaagtcaaactcaatcatcaccacatactagttcattgtccactcatccaaaggtggtggaccttgagaactttgacatccaaaaccatgcagaaattcttcctccactgcaagagggtaattctcgagtttcatcacagaaaactattgttggtgattttgaggagaagcctcagattgacctacttgagtttcttcagcagatgggaatactaaaggaagaaagagaggaagagaaaactaatagctcaggaagttcaacaacagtgtctgaagctgcatcaagagatgagagcagtgaacaagcaggagtgttttctgacatgagtagtgttaactgggaggaattgattgagatgcatgagcatgaccatggagttgcagatagtttttatcgtgcatcagaagaaatccagtttgaagcatatgacataaacgaggaccttactttctccccttccatttggaactattaa

SEQ ID NO: 98274 - DNA, 321 bp, Glycine max
  Peptide Sequence Number=SeqID_215052
atggtggaaagggagaaattggatcatatagaggaaaggctaagggccattgaaggaggcggagattatgcctttgctaacatggcagagttgtgcctagtgcccgacgtggtcattcatccaaagttcaaggtgtcggacttcgataaatacaacgggactacttgcccccaagaatcacctgaagatggatctggaagctcaagtagcacctccaatgatggagagggagatgataacaatgagggtagacaccctggggcaaatggagagaataaggaggagggaggaacccatgttgtgactggcattcctacatga

SEQ ID NO: 98275 - DNA, 684 bp, Glycine max
  Peptide Sequence Number=SeqID_215053
atggccttgagaaagcttcccacaaagaggtccagaaggacaccaccggagagggctccaacgctaccctgcaagctaacatggacttcgaccagcaccgaaagacaggtccagctaagggacgatgagtttattgactttcaagggaagatagcccgtaggcactgggcaccacttgtgacacccatggctaaattcgatccgaggataatcatggagttctacgctaatgcctggcctaccaaggaagggtggattcctcttgatgcagatgccctcagtcagttcctagggcacccactgatcttggcagaggaccagcagtgcgagtacagccagaggagaagacaagtctctggctttgatgaagaggctattgcccaactgctatgcataccggggcaagactttgcccggaccgccacagggagacggctgatttctgacgccatttatcagtttgaaagtattgcacccacgagacaccttatggacccagagaagtccaacagggccttggggtttcccgctctgatcacgggcctctgccagtcctatgaagtgcctatcacccctagcaaggtcattcagccgcctattaacagggccttcatggagaaatattgcatccacaagcaggccgcagtagccggaggaggaccaacagccagctacagaggatag

SEQ ID NO: 98276 - DNA, 249 bp, Glycine max
  Peptide Sequence Number=SeqID_215054
atgcaggagtggccgttgctcacaggcatgagatgcccaacaacccatttcttgcttgaaggtattgatttcatgggcctttttcatgtttcttttggttattcatatatcttgcttgttgtggattatgtctctaagtttggtgtgcctaaagccatcatcaatgatcaggggaggcatttttgcaacaagaccatgccagatttgcttcaaaagtatggggttatacatagatttgccacaacataa

SEQ ID NO: 98277 - DNA, 603 bp, Glycine max
  Peptide Sequence Number=SeqID_215055
atggatataaggagaaatggttgctcaacatcatggtcattgatacacgtggtgcacaagataagaaagcttgcactcaatgacaacttacaatgcaagcaaatagagggttttcaaggttcaaagagaatggtttccttaagatacaaaattagttgggttgattggaacatataccaaataccagttaaggtttacacacctgattccaccgacagagtgaggtcaaatggttccaaaataattcatgattgtcaggcaaagtataccattccagcaactgctggtggtggtgattctcctcatgtccaaaaagcaaacatcccaatggaaaaaggaggttttatatcatttatggcactgttcatatgcattcaggatggaaggactttatgtacatcaacaccaaaatatggaacaggaaaagaggttggaaatgagaaaggttatgtcattggaatgtttgtatgttatccacaaccaggttcaatcaagattcatgatggtgaaattttgactctagaatctaaatataaaaatgagtttcatactggagctatgagacatttctacatctatttggcagaggaactaccacaatga

SEQ ID NO: 98278 - DNA, 114 bp, Glycine max
  Peptide Sequence Number=SeqID_215056
atggtggaggtgataattggttatcaaggatggggttgtttgaagggaaattcgatgatctatctaaacggtaaaaagaatgcaagtgaggcagggtggggtgttttgcaataa

SEQ ID NO: 98279 - DNA, 171 bp, Glycine max
  Peptide Sequence Number=SeqID_215057
atgtcgcaagttctcaaagtatatcagaagttgtgggaaggaggaaatctcacctcgtcgccgtcgcgaagagttgtgagtgagagcgagatcgagactaacaccgataatgagagcgagagtgagactgagaatgaggagtgcaagtgccgtgggagtgagagtgagtaa

SEQ ID NO: 98280 - DNA, 114 bp, Glycine max
  Peptide Sequence Number=SeqID_215058
atggggagcgaggagagttctgagagatctgcagcgaggggcatggcggaggcgaggatagaggtgaattgggagagctctggcatggtggagaggaggatgcttttaatgtag

SEQ ID NO: 98281 - DNA, 790 bp, Glycine max
  Peptide Sequence Number=SeqID_215059
atggtgcttacttcaactggtgttagcgaccagcagcgctgggcagaggagcaaattccattgcgagaagtagctgttctcaggaatgatgccccttttgatgttattttctggcataaggtaccatttatcgcttgcactgctgttgtgatagatattgaattcataataattgaagggatcatatcatcttatgctttcaggaatgctttctcaagtgatgaattaggcttggaaatactgaatattgcactccctactactctggctttggcagcagatcctattgcttctctaattgatactgcattcattggccacataggtcctgtagagctagctgctgtgggagtctcaattgctattttcaatcaaatctcaaaaattacaataattccactagtcagtgtcacaacctctttggttgccgaggaagatgctgctgatgaacaaaatcaacagtcagaaaaagaaatgctgatgaaggtctctaatgaggatgtaaaattggatgtacatgaccatatagagaaagctggtaacccttcatcagcaaatgttggtagagtagctaaacttaaacatgacaaaagctatattccatcagcatcatcaggagtagttatcggtggtgtgcttggggtcctacaagctctctttctcatttttacagctaaaccaatgttgagttacatgggcgttgattcggtgagtactttcttggcaaaccatgaaatgaatgttaacttcaaatatgagattagttccatgattcacatcacatgggctg

SEQ ID NO: 98282 - DNA, 564 bp, Glycine max
  Peptide Sequence Number=SeqID_215060
atggctgcatttcaaatctgcttacagatttggatggcaacctctttgcttgctgatggattggctgttgcgggacaagctattattgcaagtgcatttgcgagaaatgattacaaaagggttatcgcatctgcctcacgtgtgctgcagcttggcttgattcttgggctggtgctctctgtccttcttttaagtctactaccatttgcttctaggttatttactaatgacaacaatgttctgcaacttatcagtattggcattccatatgttgctgccactcaacccatcaatgccctggcatttgttttcgatggagtcaactatggagcttcagatttcacatattctgcatactcaatgtttatttctccctcatggcatatgtactttctgttactcccagattatggtagcattggtgagcatattgagtttatatacgctgtcctcaagccttggctttaccggtatctggattgcgttgtcgatttacatgactctaaggatatttgcaggcttttggaggattggtactggatcagggccttggagcttccttaa

SEQ ID NO: 98283 - DNA, 141 bp, Glycine max
  Peptide Sequence Number=SeqID_215061
aaccatgatttcactctcgaaaaaagcttggagagaaaaacatatcgtcaaagcgagagtgacaatggcacctacaccgtgagcgagagtgagaccagcagtgacgacatcgtgaaggacacgacagtgatttcaccatga

SEQ ID NO: 98284 - DNA, 603 bp, Glycine max
  Peptide Sequence Number=SeqID_215062
atgagcccttttacaagagatcagcctgccaacaagctgtcagcaacctcacccagcctgcccccagccacaagtcagtatggcgtcccccccagatccgattctactattacatctgagagtttcaccaatgttcctctcattgtgaaaagcacactgggtctgccaattatccagctttggttcaatattctgccttcaagacatgctatgacaattggaacaaagcatggttctgattacatggaagatcctcatctttatcactcaattgttggtgctttgcaatatggtacacttaccagaccagagcctgcacctgctgaccaacccctctcttcaagcatactggtgatgctgactagggtagtgagcatgataataggcaatctactcctggatcatggggatctttacttcaagaatttaagatcaccactcactccaatcatcatattttgtaacaataacagcagtcttctactgtcacataattctattctacacactaaaacaaaacacatggagctagatcttttcttggtcagagaaaaggtccttagtaggaatccacatgtctaccatatccctgctcaagactag

SEQ ID NO: 98285 - DNA, 174 bp, Glycine max
  Peptide Sequence Number=SeqID_215063
atgtgggccttttcttctcttaaatacatgtctctcaaagtaaatgaatcttattcaaacaggcttttaagggaagaacggttacaacgtatcacaaggtatagaagtaggcttaggcttttgcttcctccagccattgaacagtgtagaaatgacacagctgctgggaactaa

SEQ ID NO: 98286 - DNA, 585 bp, Glycine max
  Peptide Sequence Number=SeqID_215064
atgcctctcgaccccgccgccgccgccacaaccaccacatcacgacccatctcgccgctccctcagccgcagatgcagcagcaccaccaccattacccttcccagcaacaaaccctcccaattcgcgccccaaacccccacttcgtctacccctttgcgcccaaaggcgtccgagccgccgatcaaggcccgttcccgccgccttccatgatgcacggcggcgtgcccttggactacttcagtcacgccttgcacgtggcccggccgccgactcacgtgccgttctctcacgccgccgccgccgcacctgccgcctcgcctcccgttaaaaagtcggctgctcggtctgcggttgctcatgttaatggcggtaaagatacgaatacgagggaaaaaagcagagaggatacctacattgttgttagagatcgaaaatcttctttcacccttggtcatatgaggaaaaaaggctttgttagaggtggctttattaagattatgaataagggagaagtgcttttgagcagcaaaccccaaaaatgctgtagtggacctagtggtagagctatagggctactatactga

SEQ ID NO: 98287 - DNA, 105 bp, Glycine max
  Peptide Sequence Number=SeqID_215065
atggatgaaatgaatgaaggaatgcttcatttgttatttgtgattggaaaggtgatgggtagcaaggtgtcaatgagagcattagctgagtgttgcatagattag

SEQ ID NO: 98288 - DNA, 1157 bp, Glycine max
  Peptide Sequence Number=SeqID_215066
gagaggcccatggtgttagagaagtggcggaagcgatagcgagcctggaagagataattggttcgagccaatatgcaaaaaccaaattcatcaaaggaaagcacaaggagttgcctccaacctacacgaagcttgttctcattcgtctcaataagactgttgctgctagcaagctcattaaggtgaaaaactccttcaagcttgcaccaatcaaacctgctccgaaaccgcggacaaccccttcctccgccgcacgcggcgggaatatcgccgccgctccacgatccgctgtacggcccgcgggcccaccaccaccaccatcatcatcatcatctagtgggccccgtcccgccccacccccaccaccttctagaagacttccgcgactcgcagctagggctgggcccaacgcgcggcggcgccttgccgcccagcatcaggacatccagggtctgctgggcgacaaccagcgcctcgccgccacccacgttgccctcaagcaggagctcgaggccgcccgccacgagctccagcgcgtggcgcacttccgcgagtcgctccgggccgataccgaggcccgcatgcgcgagctctacgacaaggcggcccagctcgaggccgagcttcgtggcgctgaggccgcccgcaccgagctcctccaggtccgctccgacgtcaaggagctcaccgccgtccgccaggacctgtccggacaggtgcaggccatgacgcaggacttggcccgcatgaccgcagacgcgaaacgggttccggcgctgagggctgatgttgaggccatgaaacaagagttgcagtgtgcaagggctgccattgagtatgagaagaagggatttgcagaaaactatgaacatggtcaagtgatggagaagaaattggttgcgatggctcgggagatggagaagcttcgtgcggagattgccaatgcagagaaaagagcacgggctgctgcagcggctgggaatccaggtcaagggtataatgcaaattatggcactgctgatgttggatatgctggaaatccttaccctggcatttatggcatgaatccacctggagtggagaattttcctcagtatggacctgggcctgctgcttggggcgcatatgacatgcagcgagttcaaggacaccgataa

SEQ ID NO: 98289 - DNA, 1017 bp, Glycine max
  Peptide Sequence Number=SeqID_215067
atggcagagtctcagaaacaaccagcttctagaccaaagcaaaagcttcactccatgcaagagcccaaggcgatgagaaaactgcacatcatttgcaacgatcctgatgctactgattcatccgaagatgagttggagaggattcagaacccgagaagagtaaaaagaagtgcatgtgagatccctcttcctcacacattcaccactcctgaaatgagggttagcactaaagatcaaccccaaagtaagaagagggctttgactcataccccatcagcgaggaggaacacttctaggaaatatagaggtgttaggcagagaaaatggggaaaatgggccgctgagatatataacccatttcagagtactcgtatatggataggcactttcagcactgcagaagaggcttcccaagcctatgaggccagaaggcttgagtttgaagctatggcaaaggctcaagcttacaaaactggttctcgttctgctgctgaacctttggctacaacttctgagaagagtaactgccgtaactcctcttctgctgctgctgcagttgatgtgtctgtatctgagaaggtttctactacttctgatgactcagacaaaagtgtgttgtcacacaattcaccattgtctgtgcttgagttggataccccagcttccaaattcattgagatgggtaatgtttcaactgacgaagctattgaggctaacaatttggtcgatgaacttgcagagctagagataccagatttgaatctgttgaacttgccgccaccaccatctgctgctgttccatctgagattgagccaaactttgggcttgattttgattggctatcgttcgatgattatggacagggttttgatgattttggtggcttggaagatattcatatttgtgggtttgatgacaatgagcctagtgagcttcctgatttcgattttggtgattttggtgctgatgagttttctggttggactgaggatcccctcaatatacattatgcctaa

SEQ ID NO: 98290 - DNA, 1263 bp, Glycine max
  Peptide Sequence Number=SeqID_215068
atgtgtgtacgaatcatactattgtcaagtgaaaaggaagacaacttattgtctcaaaataaaaaggaagacaacttacaaaaagagaatcggaagaaagatgcacacattaagcttttcaatgtggcagagtacggtgcaattgcagatggcaaggaagataacagtgtggcatttttgaaagcgtggagtgatgcatgcaagtggaatggatcagcaacggttttgatcccaaaaggaacctacatgctcaaaagtgttatatttaagggtccatgcaatgattcgattaccttccaaatcaaaggtgttctgaaggctccaatagatccatctttgctcactgatcaaaaatggataaatttcagatatatcgaccaattgaatgtgaatggaggcggcacattggatggtcaaggatctgccactcgccgaaaatgcaaaaacaatgcgaattgtgaaattctttttacaactatggattttgacttcatcaccaatggccatgtccaaaacttgcattccattgatagcaaaggtggccatttcatagtgttcggatgtgagaacatgaccttcacagatctaaccctaaaatcccccgagcacaaccgcaacacagatggaatcaaaatagcccaaacaaatgggataaacatcaccagtgtgaaaattggcaccggcgatgactgtgttgctatgatttctggcactaagaatgcttggatttcaaatgttgtttgtggccctggtcatggaattagcgtgggaagccttgggaagaatgatggagaaacggatgtggaagatatagttgtcaagaattgcacgtttgttggtactagcaatggtcttagaatcaaaacatgggctgctccattaaagaaaactttaaacgcttcaaattttgtctatgaagacattgtcatgaatagtgtgcaaaatcctattgtcattgatcaacaatattgtccactacatcaatgcgaccttaaggagatttcacacgtgcaaatcagcaacgtgacatacagaaatattcgaggaagcagcgaaactgatattgcagtcaattttaactgcagtaaagataagccgtgtcaaaaaataactctggacaacattaatttgtggcgttatggtgttcgtggcaagggaagacctctactaagaaataattgctttaaagtcgagggtgcttcttatggcaaacaaacccccccatcctgcatcgctcatcgtgcaacacctctttcaacctag

SEQ ID NO: 98291 - DNA, 1425 bp, Glycine max
  Peptide Sequence Number=SeqID_215069
atggcaaggattccaaacaagattaagtctattgatgggtcaagagagacgcttaaacttgctgtaagaatcacggatctttggttcgttgggactcccaacaagtctgagcatgcggaaatgggtgatcaaattcatgttgtttgtaaagcgaaccagctaaagtcttggaaagcttatttgaaggaaaattccacttatgttatgcataatttcaaagtggtgaagaatgatggtcaatttagagtgtgtgaacatcagtacaagttagtttttattggagtgactgttgttagaaaagctgatttgcatgagctgccttttaaggaatttagatttgttgaatttggaaatgtcgttggtgggaattttgtggctggcctgttggttgatattattggggtcattgatcagttcttagcctatttgaatgaacgtgggaatgatggaccgatcattattattttgacacatgccagaataaaagatgcgcagggaagtaatccagcttcagtgagcaattcgttcaaggcctcaaaattattaattaatgaacctgtattggaaatccaggaatttagggagaggcttttagatttaggtgttgaggtcaacccagttttgccacctggcgatcaaggaagttcacaactttcaggggcaagccagttatcattaaaggatgcgtttctttcaaaagctgaagccaaaactatttccgagatcaatggcatttctgagtatgttgtttctgttatggtgggcactattagcaaaatagtcatggataatcattcatggtgttatccagcttgcgttcaatgtcatagaaaaattgacatcgaaataggaccattcacatggggatgtggcaaagataatgatcagcctgttctaaggtataaagttgaagtaatggttagccaaaacaatgacagtagcaagtttttgctctgggaccgtgaatgtgttgaattgattggtcaaatagctgatgaagtgaatagggtcaagattgaagatggtgatattgatttgaatgcttctcctcaagcacttgataggctgttgggttatgtccttgcttttaaggtcaggattcaatcaaaattcaggaatgtcgttgttcttagatactcaaatgaattagatttgatcaatgttgtgctcgacatgctggctgacactgaggcatgttccaaaatagatacttcgaacgttgattgcaataatgctacgcatcctgaatgtcaatctctgtctgtgacagcggaccatgatccagttgcaggattccctttaacgcccaaaaaacggctatcatctgatgaagttgatgatgagctaggaagctcccagatttccccagcccaactatcgtctaacaaattaacaagacattcttataagagtgaatttagctga

SEQ ID NO: 98292 - DNA, 3510 bp, Glycine max
  Peptide Sequence Number=SeqID_215070
atggtggaacacggaacccgccggaccaccaccgaccgcctagaagaagctatcgctgccctctttgggagacattcaaacctcaccaacaaagtagaagccatgtgcgagcgcctttcgcacatcaccgcccccaaccctccgtcaactcaaccttcttatcccccgagaccgccagtcaagcttgatgttcctcgatttgacgaccatgatccactaggttggatcttcaaaatctcacagttcttcgactatcaaggaactccagaagaagagcgtatcacggtggcttccatctaccttgatggcccagcactcagctggtttcaatggatgttcaagaacggatttattacgtcttggtcggcgctgcttcaggcgatcgaaggccgtttcgctccttcgttttatgatgatccatgcagaacattattcaagctggttcaacggagctcagtaacggagtacctcaccgaattcgagaaactagcaaaccgtatcactggcctttcaccttcagtcctgctaagctatttcatctcaggccttagtccagaaatacgccgagaggtacaagcctttcaacccatatccttacctcaagctacgtccctagctcgcctccaagaagacaagataaatgatcgtaagaaacactaccccaaaccttcaccttccttcctaccatcacattcatccttctctcttccaaacaatacccaaccacctaagccaaaaaccccattcattcaaagaactcaagaagatatggcttataggcgtgaaaagggcctatgctataattgtgatgaaaaatggagctcgtctcaccgaacttaccccagccgaacacccataagaaatacacctgaccctcatcccattccactcgagcctgacccaacttttgaccctaccccacttcaaccccatatcagccttcatgccatggcaggagtacccgctattgataccttccgtctttacaggttcatcaacaacactcgtatcactatattgatagacaatgaaagtactcataatttcattcaaccccacgtcgccaagttcctgaacttgcccgtcgaagatatagtaccccttcgagtaatgttctcctatttggacaaatccattgatcttcacgcagatgttcaaacagattccagcccagcctctgctaaccaggttaaatgtatgatctccaccagttccacttcaggtttgtttcatctttctcttttacccatggcttcgaccgaaacaccctcgcaccctctacacaccattcctgccattaacgagcttctgctcaagtaccagtctctatttcatcaacctctgtccttgcctcccccacgacaacacgaccatcatatcaatatccttcctgcagctaaccccgtcaacaaagatgggacgtggcgtatgtgtgttgactatagggtgcttaatgtaatcacggttcgagaacgttttccacttccgacgatcgaagaacttctcgatgagttaggaaaggccttatggttctcaaagctcgatctatggcagggtttccatcagatcttgatggcggaagaagatatccagaaaatagcctttcgaacgcaccacggccactacaagtaccgggtaatgccgttcgggctttgcaacgtgccgtcaacgtttcaagcggccatgaatgctttactcagcccattcttgagaaagtttgcgacagttttctttgacgacattctaatctacaacgcaaccctcaatgatcaccttcctcatttggaatgcgtcttcagttcccttttgcaggctcgtcacatcgtctccggtagcggcgtcagacctgaccatgctaaaattcaggcgattgttgattgggctacgccgcaatctccaaaggatcttcgagcttttcttggcctcacaggattcgacagaaaattcatgaagggatacgcagccattgtggcaccactaacaaagatcctctgcaaagattcattccagtgggctgttatgaccgccgcgctggtattgtctgttcctgatttcaccatcccttttgccctggaaacagacgcgtcaagcatgactatgggtgtcgtccttcatcaaaaaggacaccccataatgtacttcagcaagctattctgccaacgtcttcaacatgcttcaacctatgttagagaattgcatgttatcatagccgcggtcatacaaactccagaacaacaattttacttggccaaactacttgggtatgattatgatatccagtataaagaaggaacttcaaatatagtcgctgactctctctctcccatacgttctcagcctgaagcgtatcctgatttttcgatttcggatgatttcatcatctttaagggcgcaatatgggttgattctcagaatccattcatcccatctttactgcatgagtatcatgcgacacctgtcggcggccattttggagttaagaagactttgcatcgccttcaatctaacttccaatggcctaatatgctcaaggatttcaagaccttcgttctctcggaagacctttccatggacttcgtcacacatcttcctaactttcgtgggttcactacagttctggtcatggtggatagattttctaagggcattcacttcggtgccttaccaactcaattcacgactttcaaagtggccagcctgttcatggacactgtgtgtaaactccatggctttccccgcagtatcatctctgatcaagacccaatcttcatcaattcgttttggaaggagcttttcaagatgagtggaacaatgttgcgcatgagcacagcttaccatccacaaacggatgcaaaatggtcgtacaacaccttgcaacatacatgtactggtctaaccccttatgaagtcatctatggcaagcctctgccatccttccccaactaccttcgaggttcttcccgcaatgacacagttgatatggtgttagtcacacgggaggaaattcacgccaccctcaaacgaaaacttctcaaagttcaggaggccatgaaacactttgcagataagatgcgtcgtgacgtcgagtacaaagttgatcagctgctgcccgagggatccaagatacaccccgtgtttcactgttcaatgctacgacctcaccatggtcctttggatctgcaacaagctcctcttccaccagatgcacttaacaatcatcctatactggaacctctcgcaatcctcgactcacgagtggattcttcaactcagcctcccacacaacttgtattggtgcaatggacgggtttggcctcgaaagattccacttgggaaaagtgggttgatgtttgtagtgcccatcatcttgaggacaaggtgattttcccagtggcggataatgtcagcgccaacagcagaggtaggaacgaagacccactacctgcaactcgtgaggaacgtccgcgaaggaatatcacgcgacctaggcacttggagaattacgtataa

SEQ ID NO: 98293 - DNA, 315 bp, Glycine max
  Peptide Sequence Number=SeqID_215071
atggaaaaaagtgaaggcatggacgtatcaattttgtgtgcattgggaaaggatattctacttgatttgttggaaaatcccattctggtatcagcctcaaactctttgaaggctaactcagagaggaagttctcagtatctgatgagtctagtccagagagatcaaaatgggtttatatattccagagagaatatgctaccgttgaccccgcccttgttgatgacgtcagttgcccatatggattcaccaaaaattgtagaaatgggcctctcccaaatgttatcatcactcgtcgacaacagtttggagactga

SEQ ID NO: 98294 - DNA, 603 bp, Glycine max
  Peptide Sequence Number=SeqID_215072
atgcaaagggcgacgcaacaaggcatatcaagttcaaggggttcaaagtgccatgactgtgggaaccaagccaagaaggaatgttcatactcaaggtgcagaacttgctgtaaaaacaaaggctttcactgccaaacccatatcaagagcacttggactcctgtggataatattaggagacgccatattcctcaaaatcacaacccatattcaggattagagttgaaatttccgggtgctacaaattcgatggctatatttcggtgcgtgaaggttcgttctatggatgatgcggtttatgaaatagcgtatcaaacatctgtgaacatcggagggcatgtatttaatggactactatatgatcaaggtcctgaccaaagctataataataattgtaagggtgaaagttccacgagccttgttgatcagcagcagaataatctgggttttgtgaatattaataatggttcaatccagagtagagatagtagtggtgcaagtgcaagtgcaactatggcttctgttggtccggaagagactcttttaactccatcaccatatccgttttcccttgcttctttcaggtccggtatgccatattaa

SEQ ID NO: 98295 - DNA, 768 bp, Glycine max
  Peptide Sequence Number=SeqID_215073
atgaagatccagtgtgctgtgtgtgacaaagtggaagcctccgtcttctgctctgcagatgaagctgctctttgccatagttgtgaccgcaccattcaccacgccaacaagcttgcaaccaaacacccacgcttctctctccattaccccacctcccaagacttccctctttgtgatatttgccaagagaggcgtgcatatctattttgccaagaagacagggcattgctatgcagggagtgtgacgttcctatccacagggcgaatgagcatacccagaagcataacaggtttcttctcaccggagtgaagctctctggtacttctttggatcctgctgcgtcctccaccaattgcacccatggctctgaaggaagaaacaacgctcgatctagaatgaacagacccagatcatcagtttccaatgaagaaaatgcaagtaattcttcttgcaaggttgaagacaacgtggctagtgacactggttcggtttcaactagcagcatttctgagtacttgatcgaaacaatacccggttactgttttgaagaccttcttgatgcttcatttgcacctaatggtttctgtaagaaccagaactatgatcgtcataggcgtttcaggaccaagatcttcaagttattaggacgtgtttggatttttcaagctgttatgtttgcattgtcaccttggaggatattaagagaacgacttcacataagcttcaaacccaaacaaggggttggtgcacgggccatttttctttga

SEQ ID NO: 98296 - DNA, 476 bp, Glycine max
  Peptide Sequence Number=SeqID_215074
atgactctattgtctaatttctgtcctgatgacaacactaacaccaacaccatagccaataacaacgacaacgataacatgaaagtcgatagcggcgacagcaacaccatcgtaacctctttcccttctaaccaggtacgaacgaaaggaaaaagtaaaggggagaagaaagaagagagagagaaagagaaaggtcatcgaaaatcattttccactatagtgtatggtggttcaggtgaagagaatgtgcatgcggggtggggtgctgttaatcacccaggccatcgtctgtcgtgcatcgccatcatctacccagtgtcgctccctaacaatacctatgtattgcaccactactgcgccactctacgcatgccatcccacctcgtagccaaacctaaatctcgtcaccagccacaacaacaaccaggccaatggtcatggggttggtgttgtttggatgtgggcaaggagaaagg

SEQ ID NO: 98297 - DNA, 627 bp, Glycine max
  Peptide Sequence Number=SeqID_215075
atggggaagaagaagagaagtagggtttccgaagacgaggaaatcgaatctgacaccaaccctttcgatcaaaacgaacacactctctaccaggttcttggtgtggagaaaacagcatctcaacaggaaataaagaaggcatactacaagttggcattgaggctgcatcctgataagaaccccggcgatgagatgtttgcggttgtaattgatcatcttttacaggaagctaaagcaaagtttcagcaattgcaaaacgttatcgctattcttggggatgaagaaaaacgggctgtttatgatcagactggttgtgttgatgatgctgagcttgcaggggatgttgttcagaatcttaaagaatatttcagagcaatgtacaagaaggtcactgaagctgatattgaggagtttgaagcaaactatagggggtctgactctgagaaaaatgatttgattgatctgtacaagaagtgcaagggtaatatgaacaggctattctgttcaatgctttgttcagatcctaaacttgactctcaccgattcaaggatattattgatgaggttatagctgctggtaagaatatcactatctcttcttgccccaaatttcacgcagacatttga

SEQ ID NO: 98298 - DNA, 297 bp, Glycine max
  Peptide Sequence Number=SeqID_215076
atgtcgtgccactgccgccatcatcgtgatcctatggcggcctcgagccaccaagccctgctcctgctagcgttaggggccgcacctcctcgatggaggtgtgatgaggacatgaccaagagcaaaggcaatgatccacttgaaggacttggaagacctatgacaagggctagagcaagaaaagccaaggaaattcttcaacaagtgttgtccatactatttgaatacaagcccaagtttcaaggagaaaagtcaaaggttgtgagttgtaccatgacccaaatggaggaggactaa

SEQ ID NO: 98299 - DNA, 351 bp, Glycine max
  Peptide Sequence Number=SeqID_215077
aactttgtcttacacattggagggtacatcctttgtggtacaagtagagggtacatctacttgggttgttgtgactgagaacaagagagggtacatctcctgtggatcagttctagtggagggtacatccactagtgttgttcaaagagaacaagggagggtacatcccttgtggatgtttgcttgtaaaaggatttttacaaggttgaaaagaaatctcaaggaccgcaggccacttgatccaacaagggttaggggtcacttcataaagtttgatgagaatgccctcaacactttcctcaagacgcctgtgattattgaggagggggagagcctatctgcctactccag

SEQ ID NO: 98300 - DNA, 222 bp, Glycine max
  Peptide Sequence Number=SeqID_215078
atgaccaggagtaggagcagacaatcagtggataccctccaacaaatggtagcagacatacttaacatggcccaaatttatcaaggtaatccttgtggcgtctaccctgacttatcttccctcaccggaagtggtgtcatccaaaactttgtaacctatatcaagcgatttgttcctagtaaggatcacatcaaaagtgctcaaggttcttactctatataa

SEQ ID NO: 98301 - DNA, 318 bp, Glycine max
  Peptide Sequence Number=SeqID_215079
atggaatcaagcaatgtgaagaacaagtcaagtggaaagagaaagatgtttggtgaggacacaagaagttacttcgcatggaacttgaaaatggagcatgtactagctgatatctgcttagagatcaaagaaatttggacaataaaggatagagctactggactccgagcagaaaatgcattagatgcagatgatatcatgagcaaagaaacaaatgaagaggaagcaattcatagtgtgagttttgacttagagggatcaagttccgccacaagaaaagcattcgcccaagtaagagtggaaagaaagaagggatga

SEQ ID NO: 98302 - DNA, 198 bp, Glycine max
  Peptide Sequence Number=SeqID_215080
aggggagctcgtcgggttctctggctcaggacggaggaaacgcgcggcggcgcccacgctggtgctcaaaggggagaagggaacgagcctggggcgtccacgtcgcctggcgacgctagcaggcaggcaggctgcgtgcctgcgcgcacgcacgcggcgctgcgcgcgcggtgcccgtgctggacagggagccggtga

SEQ ID NO: 98303 - DNA, 1311 bp, Glycine max
  Peptide Sequence Number=SeqID_215081
ctggctgtctggcgatcgcgacatgttctacaacgccatcggccacctgtggttgccggtagtggcgttggcgctgttgtcgatggcgggcattactcggttgctgcgggcggcgatgctggaagagtgcaacaaggaatacgtgacgctggcgcgttccaagggggccgggcgcctgcgcattctgctgcgccatgtgtttcccaacgtgctgggcacgctgatcaccgtactgtctctctcctacgccagcctgctggagggcgcggtattgaccgaaacggtgttcgcctggcccggcgtcgggcgttacctgacctcggcgctgtttgccgccgatacgccggcgatcctcggtgccacgctgctgatcggcacctgtttcgtgctgttgaatgcgctggccgacgccttgacctatttagtggatccgcgaacccgatgagccaatatctctctgaacacgaaccgcaaagcgagccagccgtcggttaccgccgtggccggcgcctgactacgctgacgctgggcacggcgctggtggcgattctgatcgtcaccgcgctgctggctccgtggctggcgcctttcgatcccaatctgcagcatatcgagctgcggttactgccgccttccgccgtacattggctgggcaccgacggttttggccgcgacttgctctcccgagtgatttacggcgcgcggccgacgctgattctggtgtcgctgattctggtgttgaccattcccatcggcctgctggtcggcattggcgccggttacctcggcggctgggtagagcgcattttgatgcgcctgaccgacatttttctgtcgctgccgagcctggtgatcgcgctggcgttcgtggcggtcatggggccggggctgatgaacggcgcgctggcgctggcattgaccagctggccggcctttgcccgccaggcgcgggccgaaaccctggcgctgcgccgcagcgattacctggcggcggcgcgcatgcagggcatcaacgggctgcggctgatggtcggccatattttgcctttatgcctgccgagcgcggtggtgcgcgcagcgctcagcctgggcggcatcatcctgtccgccgccggtctggggttcctcggcatgggcgtcgcgccgccgaccgccgaatggggctcgatggtggccgaaggcagtaaagtgattttcgaccaatggtgggtcgccgccgcgccgggcggggcgatcctgttcgccagcctggcgtttaacctgctgggcgatggcctgcgcgacaaaatggatcctcgtcatgggcactga

SEQ ID NO: 98304 - DNA, 765 bp, Glycine max
  Peptide Sequence Number=SeqID_215082
atgacatcaaggaaaaggaagagcactgcttctaggccacaggctcagtatgataccaggagattccaatccttggaagcctggaaccgatatacagataacattttggaccagaggatccttccgaaaaggaatgttaagatttatcatactaaattcgacgagtttaaggcagagttggagaggcttaacctacacaaacgcctcgccaaccttcaagagggaagcatagatgtggcggaggttaaagaattctatgccaatttatacagcctagaagaccagagccctaagcaagtgagggtgagaggacacttaatcaggattgatgctgacagcctgaataccttcttagagaccccagtagttttggaggagggtgagacactgcctacctattccagatttacgaggatgaggattgatcctcaagagtttgttgcccctctttgcatccctggtaggggttttgttctgaatgcagagggccatccttggaagcttttgaggaaagatctcaccactcttgcacatacatggagtgtcctctcctactacaacctgactcacacttcccacacctctgatcttagtatggacagagccaagttggtttacagcttagtcacaggcatggacatgaatatcagagccctaatctcaggtcagatttctatcattgcccagagtaactcctctaggcttggatttccagccttggtcactgccttatgcagagctagcggagttacctctgcagtctga

SEQ ID NO: 98305 - DNA, 258 bp, Glycine max
  Peptide Sequence Number=SeqID_215083
atgtggtaccatgtcagtgaaaaaccaccttgggggcgcttaggagtacataacaagacacaccacacaatgggtttgtcagtcagggtcacgatgttttgcaagaatgctccaaccatatgggatcagcatagacttaaaggagcactcaaacccgaagacccccaaaggcctacactccaaaagagtccgtcaaggtctctccctcctgattcaggtccaacccctaaaatcattttagcacacagacactgctag

SEQ ID NO: 98306 - DNA, 708 bp, Glycine max
  Peptide Sequence Number=SeqID_215084
atgatgaggccaaaccatgactctgacctcttttttcgccacatggccacgaaatacaacaccttcttagtcaaggtcctcatcattgttctctgcattatcctttcaacctatacaccctccttcacagtaacttccatcacagtctccaaattcaacgtcaacacacatgtggagttagcggtgaagttgtcaaactggaacatgaggttgaggctctcgtacccgatgaaaactccgacaacctcattttggagcccaccaacaccagccactacctcgacatcctctcacttgccgcccacccccttgtctacatcaccaccgcctcctccctcgatagcttcatccgtgtcttcattgtcgattcaaacgccaccatcgccaccctcgaggcttctccctctaaagtctggcaaatgcactttgatcccaaggtatgcgtgtatcctagggcaccaatttaggcaagatatagatgtagacatttctgtgaagcaatttactgaggaatatgtaaagacacggatttccccagaagagctaattagtggtatttgtaagacaacattgaagtgttttattttcaaggagctgagtttagttaatagaggggtctgggtagataaaaacctagcttctcaaagaagcctttcgagaaagcttctcaaagaatccacaaggaagcttctcgaagaagcctcttaa

SEQ ID NO: 98307 - DNA, 502 bp, Glycine max
  Peptide Sequence Number=SeqID_215085
gtcgactctagaggatcccacgtgtagtcctctgaaggcgaggacgtatagtcctctgaaggtgagggcgtgtagccctttgatggcgaggacgtgtagccctctgaaggcgaggacatgtagtcctttgaaggcgaggacgtgtaggcctttgaaggtgagggtacgcggcactctaatggcgaggatgtgtggtcctctgaaggtgtgggtatgtgaccctctaatggcgacgacgtgtagtcctcttaaggtgagcacgtgttgccctcggatggcaaggacgtgtagtcctctgaaggcgagggcgagtagccctctaaagacgaggacgtgtagtcgtctgaaggcaagtgcgtgtaggcctctgaaggtgtgggtactagacaactcaggtattagacaactcagtggagagagcctgtatgagtactgggagcgatttaagaaactatgtgccagttgccctcaccatcagatttcggagcagcttcttctctaa

SEQ ID NO: 98308 - DNA, 453 bp, Glycine max
  Peptide Sequence Number=SeqID_215086
atgaagaagatcataggccttcaagctccaatagagcttacatcagttaacttggcatattatcaatctatgattgatgctattagtagcatgagtccaggggattgttttcttaagcttttcaaggagatgatgttatatgttggagcagaaaatgttcacattgtgatcgataatgcagcaaattatgttgctgctggtaggttattggaaaaagagtttcctgaattatattggcctccttgtgttgcttactacattaatttgatgttgcaagactttggaaaatttgaggaatacgtatataacttgatgagacaacatataggtggaagagatatactccgtccagctccaactcagtttgcaactaatttcattgtcttgcaaagcatattggtccagaaggatgcattgaaggctatggtgacatctaaggattggacaagctaa

SEQ ID NO: 98309 - DNA, 324 bp, Glycine max
  Peptide Sequence Number=SeqID_215087
atggctactcttgggtttgtacacaccaagttgcaagatcaagacttggatgctagtaattttgtgcagttgaggaaggcactcatgcagtatttcagaccatcctcttttgtgagagaacacaccaaaaacaaacctgaagagcatgtttcatcttctctggttcatggtagtcaaatggattctaacatgataaaattttatgacaaaaatccaagagctcagcatgaaagttatgtttctgcactatggaaattgcgtgatcaggttctctctctacacaaacaaatgcctcacaaacactactgtgcaggatttgtttaa

SEQ ID NO: 98310 - DNA, 366 bp, Glycine max
  Peptide Sequence Number=SeqID_215088
atgcctcaaagtgattcaactcatcgggttcccatagtggatcccatcataatactcgtcgtacaaaaattcatcgccctcaaagggtcttacaattacttgtcaccgtcgtttgcgacttgtcaccatcgtctcctcctcacaatcgtcgctgttgaactgctccgtgagttgggtttcctcattgccgtgaggttgagcatccattggagtccgacatcaacgcaagatgctttgatgtttgtgatgcaatcctactccgcaagggcattggatagaagactccaagaagattgggccggagatgcaagagaaggccctagggttttcatgagccttagggtagatttcgggcccatgggctaa

SEQ ID NO: 98311 - DNA, 321 bp, Glycine max
  Peptide Sequence Number=SeqID_215089
atgtcacttgctagtggagttggagcacaaagcaaaataaaggcgtaccatgacaagaagctgcagaaacagaacttccagccaggacaacaggtcttactctttaactccaggcttagattgttcccagataagctgaaatcgaagtggtcaggaccgtttgtcattaaagaggtgagaccccatggtgcaattgagttggaagatcctacaggaagcaatcttgaaaagaaattgatagtcaatggacaacgcttgaagatctacaagggaggacaattagagaggctcacaagcattgtctacttaaatgacccatga

SEQ ID NO: 98312 - DNA, 207 bp, Glycine max
  Peptide Sequence Number=SeqID_215090
atgggtaaagatactctgaagaggattttccagggaaaagttttcaagtgcgagagtcgagattttttgcctgtcctatactcaggaggaggccgtgatggcttgaaccgtcgaatcaagggaacttacgtgggaaaacatgtattgggtctgccacggaagaagaaccctaggaacctgtttcttttaattaacccaaacgtgtga

SEQ ID NO: 98313 - DNA, 651 bp, Glycine max
  Peptide Sequence Number=SeqID_215091
atgctttctcagtatcctctcaacccaaacgcccaatcttattattcgacaccaaataatcaagtattttatgatcctcgttttatccatcactacgtgcctccttctaatttgggggtttaccctccgtctccgtttccgtttccctgtgatcagaacgtgaaaccggttcaagtgtgggccagggttagaggaaggaagcttctagctgagaataatgctagggcaaagcctcttggtaatcgcgcagttccgtttccaaacaccgttcaagaagctaagacctcttctatcaccactgtcatgattcgcaatattcctaaccaattcaagtttgaagacttgcagctaatactggacgagcattgctttaaacagaacaaaagcgctgaggatcctaaggcttggtccaagtttgatttcgtttatttgcccatggattatgggaaacatgcgatagagaagaaaaagtcgaatttgggatacgcgtttgtgaacttcaccactcctgctgctgcgttcaagttctacagcgagttccaaggtttcgagtgggatgtcgccaaaaacaagaagatatgtgaaatcaacgtggctcagtatcagaatgccattttttactctaacatctgcaaacgcggatcttcataa

SEQ ID NO: 98314 - DNA, 1407 bp, Glycine max
  Peptide Sequence Number=SeqID_215092
gcgagggaagataggtatgtctctctatgcccgtcttgctcacataacccaaagggtgaggaagatgaagatgagttggagattccaagtcttataacaaacaagaggctcggagagaggttgtgtctttggacccccagccaggacagagatgggtggtttcgtgatctagtcaaggctgagggggcgaatgagaagtggattaggtggatccaggagcaggaagccaaagagtgtgaggcaatggagtttggtcgtttctttcggtgtgttaggggaggggggactttaatgtggtattgtccaatagagagtgacgaggtcgtggctcttaggtggaacgaggggagtaggcagagttctaaaagtttattgaccagatgggacttgtggatgtggcaattgtggggaagaggttcacttggtttagtgctaacgtgggtggggaagagggacatttatgatcattgtccaatagcattggaagttcaagttgttgggtggaaatcttttgtattcaaggagaagctaaagcttttgaaggcaaagattagggtgtggcagcaggaggtctatggtggtttgtttgtggagatttccactttggtggatgtcatggataagtcagaccttaggaaaatgcaggccaagaaaagaatgttggctccgaagtcgcaagttaggtggacgagggaaggtgatgctaattctggttacttccatacttccctaagagagaggtcttggaggaactccttagtgggtctccagccgatggaagagatgcctatgcttgatggagttgtgtttatacaattatcctttgtggattgcacctgtttggttgctcctttctcccctgaggaaatcaaggaggatgtttggaactgtgttggggataagagtcctaggcctgacggctacttggatcagttatctcatcttgcttttcagcttttttgcttggatggtgtggttgttgttaatgagttggtggacttagtgaaacggagtaagaaagggtgtttcatgttcaagattgattttgagatggcgttcagggttggggcggatgtagtaatcccatactcgtacccgtatccgtcttttggttatcggggaaaacctgaacccaaactcatacccggttttgatgacacttggaggaaatgggttaaggcggtggtgtgttcgagtaggatgtttgtgttagttaatgggaaccctacaatgatgtttcaagatgagcgagggctaacccaggggggactcgttggcaccatttcttttcttgacggtagtggagggtgtgctgatgattcaattatcataggggagccttgttatggtaatctgtgggatgttaaatccattttacctggctttgagctggtgtcaaatttgagg

SEQ ID NO: 98315 - DNA, 372 bp, Glycine max
  Peptide Sequence Number=SeqID_215093
atggcagcatttccgaccattccaacatgtgagaagatgctagagtatgatcgcaagcagccgcttggagctaggtggaagccattgaggggtatcgacatggctgattcgaccaaggaggcgctagataggttgtatatgtttggtgttgtttggtccctatatgcatcacgtagagaccttagacctttcgaggataaacatgtcactatatgtactagagagggttttaaggttgttccacatggggcaccatgggcctacactatagactacttgccttggtattacgagcattcacattcatacctgattccgccacaagagggagaggcaccacgtagtcttgtatgtatttcgcctcagccttaa

SEQ ID NO: 98316 - DNA, 267 bp, Glycine max
  Peptide Sequence Number=SeqID_215094
atgtgggggacgattggttttatagtaaggtggtttgttgaattgtttatggacgggacacctccttctaggaggacccttggtttggaaagtcataaggtcagtatgggagatgttagtagaggccaacgatcatggggtgacatggagttggagatgacgaagagttctatttgggcgagaggaggtggtggtacaacagatagagggcttactttctccggtccgattgaatttgatgataaaggatatatggttgtggattaa

SEQ ID NO: 98317 - DNA, 187 bp, Glycine max
  Peptide Sequence Number=SeqID_215095
atgcctttggtattgtggggtgtggttcgtttagtggtgtcaagtcttgcgaacgtgagggtgctgacgattggttcctgtgttgcctacctaccaaacggtattcgtgtggctagtcagacccattccatccaggcctctttgttggggacgctggaggatttcaaaagtcccacacgtgaaccac

SEQ ID NO: 98318 - DNA, 252 bp, Glycine max
  Peptide Sequence Number=SeqID_215096
atgagattgcatgagttagaacaaggtgcctgtgctacggcccgtagtggcccatttagcccgttacccgtgtgggctaaggcttttaaatatggagcccaattcgatatgaggcttttcatctcaaacagcataactcacgggctgaatgaattcggcgtgcagaaagcccactccagaaggagcacctgcactctcaagcaggctttccagaacgaatatttggcttccaaaaaggcctatccggaataa

SEQ ID NO: 98319 - DNA, 147 bp, Glycine max
  Peptide Sequence Number=SeqID_215097
atggcaatggggccatccactcacactgacgttacttctgagccagaagacattacactaaaatgtttcaaaagagaacaaggtcaaaacacaacagagccagatgatgctgttgtttttactgctagtgctaagtgttttatttaa

SEQ ID NO: 98320 - DNA, 1020 bp, Glycine max
  Peptide Sequence Number=SeqID_215098
atgttttaccgcgacggaacgacgtcggattgtgaagagaaagagatgaagaggaacccttgttgtttctcgagcgaggtgaaaagacctggagaaacagtttccaaggggcataagaattatgagttgatgcttaatctgcaattggggataaggtacactgttgggaaggaggcttcgattttgcgggagcttaagcagggtgattttgatccgaaggagaagttctggactaggtttccgacggaggggtcgaagcttacaccgccgcatcagtccgcggagtttcgatggaaggattactgccctgtggtttttaggcatttgaggaagctgtttcaggtggatcctgctgattacatgttggctatatgtggaaatgatgctcttcgggagctttcgtctcccgggaaaagtggaagcatcttctacttgacccaggatgatagattcatgataaagacagtgaagaaatctgaagtcaaggtgcttattcggatgcttcggagttattatcaacatgtgtctcgatatgaaaattcacttgtgacgaaattctatggggtgcactgtgtcaagccaattggaggccagaagatccggttcattgtgatgggaaatcttttctgctctgaatatccaattcatagacgatttgatttgaaaggatcttctcatggtcgcaccacagataaacctgaggaggacattgatgaaacaaccaccctcaaggaccttgatctcaactttgtttttcgtgtacaaagaaattggttccacgaactcatcaagcaaattgagcgggactgtgagttcttggaagctgagaaaattatggattacagtcttttggttggcattcattttcgtgatgataatacgtgtgacaaaatgggattgtcaccttttcttttacgcactggcaatcgggatacttatcagaatgaaaagttgatgcgtggttatcgctttcttgaagcagagctacaggatagagatcgagttaaatctggaaggtaa

SEQ ID NO: 98321 - DNA, 354 bp, Glycine max
  Peptide Sequence Number=SeqID_215099
atggtgtgccttagcaacttgtctatgcaatggtatatatttgcaatggcctcagcaacttggaaaatatctatagttagccaaaatgagaaatatcaccctcaagcctccaagttgcgttttattgcacctcagcaacgtgatggcaatgtcaaccttccaaaatatagggtccataggcgcaagagtcctaagtctggaccagttaagtcactgtctcaagtgggcaaatttctcgacatagaagccattggcgagtttgatcagcctttgacacgtggcactagtctcaccagtgccactgacgatttgagctccacgggactcgccagtttgactgacgagttgagttag

SEQ ID NO: 98322 - DNA, 207 bp, Glycine max
  Peptide Sequence Number=SeqID_215100
atgaaagccataaaaggaggaaacactgtctatgatgatgagagaatagatgtgagaccttggcgtggttgttgggggcaaggtcggcgttttcaagggctttttgtcggtgacaatgcaatagcggaggcagttgttcttgtcgtcaatgtagctgttatgaccagaagcaaggagcagcagagtcaagaaccagagaatgcataa

SEQ ID NO: 98323 - DNA, 697 bp, Glycine max
  Peptide Sequence Number=SeqID_215101
atggcagattcaactcggtccaaatccaattgggatcgccttgaagaagctatagccaaattggcctctaaccatattcatgttactaagaaactcgatgaccttctacaccgcgtcaccacactcgaaaacacctccaacccagcagtctccccttcatcctcctcatccatacctgcaccaaccacacacttaatcaatcccccaaaaatgaaactagatgtcccaagattcgatggtttcgacccctcgggttgggttttcaaaatcacacaattctttgaataccactccacccctgaatcgaaccgcctcactatcgccttcttttacatggagggaccggccttagtctggtttcagtggatgatgcgcaaccaccagctcaccacctgggcaagcttcttgcaggcaatcaaggcctgctttgtgcactcccaatacaaggacccaatcgggatcctcttcaaattaacacaaaaaagcgcagctcttcagcctctcaccttggtccacgccgatggtaaactccaattttgtgacctaatgttgaatcaaactcagtttcaggccaaagacgagaaggttaaagctgctgatgtagcccttggtagagaagctgcagatttggccgctgaagcacgtggggaacttggatgcatcaaagcggtcgatggcagtgatgctggtttcgcca

SEQ ID NO: 98324 - DNA, 207 bp, Glycine max
  Peptide Sequence Number=SeqID_215102
atggcggatgaaattgattggcaagggaagcgcgacttagaccttttcatgaacaccacggacgacttccaacactggagatttgttctgttcacgcatccttccacattcaacaccatcaccatggaactagatctcacaagcaaagtcaaatgcgatctcgaatcgttcctcagagtgaagcaatactactaccacctcgactag

SEQ ID NO: 98325 - DNA, 189 bp, Glycine max
  Peptide Sequence Number=SeqID_215103
atgggaggggtatggaattgtaagttctacgctgaatttggaaatagaactgggagctctgagagcctttctcaagcttgggggagcatttgctctcatttggtcaagcaagtgaagcctgacgttctcctaggattatcggctgttggaggattattctcaaaagaggtatctagactgatgctttaa

SEQ ID NO: 98326 - DNA, 183 bp, Glycine max
  Peptide Sequence Number=SeqID_215104
atgtcagattcaggcgcatcgtatatcaagatgctcgaaataaaacatcaaagtgcaaggcaaattcaaacagtcagaacttttgactcggatgttcgattcagatgtccgattcaggtgcataatatatcgagatgctcaaaattaaacatgaaagcacatagcaaatttaaactgccataa

SEQ ID NO: 98327 - DNA, 350 bp, Glycine max
  Peptide Sequence Number=SeqID_215105
atgaagaagtccatcacaattcacaagtatttttctttccagttctttactggtgagggtgacgatcaatgcattcactcaactagcaacgaagtgggagccttgtctttcgcttatgtcaatcagtcaacatcaacgttgtcgatcagttttttgggaggtggctgtgaggacgttgttaccaatatagagcaagaaaagaaatgtgtattgttgatagtctattttgacaatgtttgggatatgtccaatgaagagatggtagatgaagatgatgtaacaggtgacgaggaagttgatggtgaagttctgactaatgttgagtatagttgggcaaacgagagagccct

SEQ ID NO: 98328 - DNA, 1062 bp, Glycine max
  Peptide Sequence Number=SeqID_215106
atgaacagcatgcgtcagcggttactgatcatgctggcgctgattctcctcacctgccaggtgatgagcgccatctggctgtggcacgaaagccgcgaacagatcagtttcctcgtcaacgaaaccctgtcggcccaggcgcgtaacgatcgggtagaaaatgagatccgtgaggccatcgcttcgctgttgctgccttcgctggtgatggtaagcctgacgctgctgctgtcgttctgggccatcaactggattatccgtccgttcagatcgttacaggacagccttgcccaccgatctgccgacaacctgacgccgctgccgatttactccgagatggatgagattgttgcggtcacctcctccatcaaccagctgttttcccgtctcgaccatacgctgcagcaggagcgattatttaccgccgacgccgcgcacgagctgcgtacgccgctggccgggctgcgcctgcatcttgagcttttgcatcagcagcaggtgccgcaaagcgccatgctgattgagcgtatcgaccagttgatgcacaccgtcgaacagctgctgatgctgtcgcgcgccggtcaggcgctggcgggcggccactatcagcagctgcagtggcagcgtgacatcatgcagccgataatgccggagatggctgaactgtatgcgcagcgtcagcagacgctgcactggccagacggcgacgatgtgccgcagcagggtgaagcggtgctgctgcgcctgatgctgcgcaatttgctggagaacgcatcgcgctacagtccggaaggcagcagcgtgcaggtgaagctgcgtcaggtgcaacagcaggtctgggttgaagtgtgggatcaggggccgggtattgatgccgatgcggcagaagagctgacgcaggcgttccggcggcgcgatcaacgctatggcggcagcggcctgggcctgaacattgtgctgcgtattgtgcagatgcatcgcggcaggctggaactggtgaaccgcgaagacagcagcggactggtcgcccgctgctgtttgccaacgcaactgattggctga

SEQ ID NO: 98329 - DNA, 627 bp, Glycine max
  Peptide Sequence Number=SeqID_215107
atgttaggaagcaaacctgtctctactcccattgactatgctgtaagactacaccaacaatctggaactccacttgatgatacaacagcttcatcataccgtaggctcattggtcgccttatttacctcacaaaaacaaggcccgatatcacatatgcggtgcaacatttaacttataggattctcagatacttgaaagcagcactaggttctggtatatttttccctgcttccagcacattgcagctcaaagcttttaatgactctgactgggtaggatgcgttgatacaaggcgatctatcactggttactcagtcgatcttggtaattcccttatttcttggaaatccaaaaagcaggccacagtgtctagaagttcatccgaggctgagtatcgggcactagctagtgctacatgtgaattacagtggttaacccacttgcttaatgactttggaattgtttacactcaaccagctcttttgttgtgtgataatcgctctgctcttcacattgttgtgaatcctatcgttcatgaacacatatatactaaagctcttccaccaggcgctttccattttcttcagtgcaagctgggaatgtcagacatacattctccagcttga

SEQ ID NO: 98330 - DNA, 243 bp, Glycine max
  Peptide Sequence Number=SeqID_215108
atggctgctgatatactagctactccaatttcaactatggcatcagagtccacatttagtgctagaggtagagtaattgatgaatttcgctctaaactaaacgaagaatctgttgaagctctaatttgcgatggagattggtttcgtcaaaaatataatgtgaagaaaaaatcaaagatattttatgtaccagttctgctcgaatggaatgaagatacttggatgatgctacctcaagtatga

SEQ ID NO: 98331 - DNA, 1093 bp, Glycine max
  Peptide Sequence Number=SeqID_215109
atgaatcaagaacaagatgaatctctcagtgttcatagcccttattacctgcaccctagtgaaaatctagcaatcgcattagttttgcctcttctggatccaacaaactacaattcttggagcaaaccagttctcacggccttgagtgcgaagaacaaagtggaatttgttgatggttcccttcctcgactagcctcaaatcacagattgtatgcagcttggaaaagagcaaataacatggtggtttcatggcttgttcactcagttgcaacttccattcgtcaaagcatcttatggatggacaacgcaggagacatgaatataactgattattttacaaagctaagaacaatttgggatgaacttgagagttatcgacccgatcttgtgtgtacgtgtgcctctaaatgtagctgtgatgctcttgttgaagcaaagaaaagaaaggatcaagatagaataatggagtttatgcatggtctcaatgatcaatacaatcatgttagatcaaatatactcatgatggatcccttgccatcaattaacaaagttttttcctatatggcacaacaagaaagacagcttgcaagttctaatgcacttgggaatttgagtttagttaatgtcgctactaatacaagatcatctaattcttgcagctactgtggtagagacaatcacacagtagaaacatgttataagaaaaatggttttcgacctaacttcttctttaatagaggaggtagaggtggaggtagaggttttggtagaggggggacaggaggaaaaaacaccaatggtaaagtttgcacccactgtggtatcattaaccatacagtggatgagtgctataagaagcatggttattcacctggtcacaagttctataagcctcaaggagcttcaattaataacactgttaaggaagaagaaaaagtttcaagatcggagactagttatcatggccaagacattaaaataactcagcaacaatatcaagcacttatgtctttgctggctgccaacaataatagttctcatggatcacaggttaaccagattggtacaaattctgctcatacatcaaccatag

SEQ ID NO: 98332 - DNA, 276 bp, Glycine max
  Peptide Sequence Number=SeqID_215110
atggcaatagggactatcagtgaccatgcatcaccagaagaggaaaactctagacgagggaccatgcttcactgttatcaagttcgcatactggtaccaccacacaaatatcacaatactccaatggtgggaaacttaggcctcaaattcaccctagctagacttgctacctccttcagctggcctgtctatggccgagctccacccactgcctatgactatatcccaggcttcaatgacctcccttctttggacatgtccatgcatcaaagatag

SEQ ID NO: 98333 - DNA, 621 bp, Glycine max
  Peptide Sequence Number=SeqID_215111
atgaagcctggtagaattaaattgggagccactggcactaggtctttgttaaatgggctttcgaaggtttataaaattgggctgactcttgggcttccacagaggggtattgatgatttgaaagggctaaaacttccaccacctccaattattacttcttgcaccccattgcattgcagaaaactcaatccaaaatgtaaaaatgcatatgattcatatgttggagtgatacaaatagcagtaaggagcatgcacgcatgcaagtacggagggtccctcaaaagaatttatgttgcaaaagggattaagacaagaagatccacttgttcctttccttttcactattgtggcagaggaattaagtggcttgatggggaagtgatctctagaaatctatatagaggctttaaagtggggactaaggaagtggaggtcaatttgttacaatatgcggatgacacaatttttgtgggaaagttcaatgtggataatgtggtgatcttaaaaagtatgatgaaatgttttgaactagtttccggtttgaaagtgaattttcacaatactggtttggaggtattggagtggaaaatggggaaatggagagattctcaaaaattttaa

SEQ ID NO: 98334 - DNA, 702 bp, Glycine max
  Peptide Sequence Number=SeqID_215112
atgcgtatacagggaaaccaagactactcttgtaatctgaaattcaaggagcaatctataattgaccggaatcctcaccaggttcatggtattgttcaggataaaaatgggaaaatattgtctacattactcggaaaatgggatgacagcatgtattatattaatggagactacagtgggaaagggaagggttatgaatctatgtcagatgcccatctactatggaagcggagcaagcctcccaagtttcccactagatataactttactcggtttgccatcacattaaatgaacttacccctggattaaaggaaaagctgccacctactgattccaggttaagaccagatcagaggcatttggaaaatggggaatatgatatggcaaattcagaaaagttgcggctagaacagcggcaacgccagttgattgttgattcttcccttcgtcgtaaaaagggattagaaagatgctatttagctcaaggatatcagcatcctaattccttgtctatggaacggttagctcggaaaatgcaagagagcggttgggaaccacggtggtttggtagggataaagaaagtggcacctaccgctacttaggagggtattgggaggcccgaaaacaaggaaattggaactcttgtcctgacatttttggccatattccttctgatcatgtttcagacgaaggtcaataa

SEQ ID NO: 98335 - DNA, 717 bp, Glycine max
  Peptide Sequence Number=SeqID_215113
cgcatatccttgcatcagaccttaggcttagcgggccagctaagcggaccatgtctcgctaagccgtctatggcttctaggaaacataaaagtattggttcaagacccacaacacagtatgatacaaggagatttcactcctttgggccctggaatcgatacatggataacgttttaggaagacacatcttaccagagaggaaggtgaaaatataccacactaagctggacaagtttaaggctgaattggataggcgtaacttccataaacgccacaccaatttagttgacaacaacatagactcagctttggtgaaggagttttatgccaacctttacagctctgaagacccttcaccaaagcaagtcagggtcagaggccacctggtgagaattgatgcagacaaccttaacacattcttggagacgcctgtgatattagctgagggggagactttaccagcatattccagatactgtagttttcccatagattataaagagattgaggttgccttatgtataccaggccgagggtttgttttgaactctgagggccatcctaggaagattctcaggaaagatttgatgactcttcctcagatggacatgaatgtgggagcccttatctctggccagataacatctatagcccagtctaactcttctagacttgggttccctgctctgatcatcgccctgtgtaaggccagaggg

SEQ ID NO: 98336 - DNA, 330 bp, Glycine max
  Peptide Sequence Number=SeqID_215114
atgcagcctacccgactcgacggcattaaccgctccccctccatgattggcaagcgggccaggcattattcggttgagtggcccggggttttcccatgggatggcaagaggtcttcgtacgtcattgggatcggggtgaatcctggagttggcctcgaggaaaatttccttgtcgcgttggaaccaatgccaaagtgggcattgctggccgggcgaatcagggttggagccggagcttgggggggctccctctggatgggtgcaggcgccctagtttgtacgagtgctgagttggaggagtccccggtgcgagcagagaagctcgggtga

SEQ ID NO: 98337 - DNA, 243 bp, Glycine max
  Peptide Sequence Number=SeqID_215115
atgacacccgacttcatgggtcaggatgacaaaggtgctgaagacgatgtaagtctctgcttgtcaacgggtttgcttgcccctgattgtcaaagggtgcaaaagacgacgttagtctctgcatgctaccggactctaagtttgacggatagcgaaatacttgggtatctccgcatgtcacccgacttcacggaagatgacgtaagtctccgcgtgtcaacgggtttgcttgcccctgattga

SEQ ID NO: 98338 - DNA, 732 bp, Glycine max
  Peptide Sequence Number=SeqID_215116
atgtcaatatttcttggtaagacagaaaaggttgatctggagaacactgttgttgacgagagccaaagacagttgaatgatcaagaggcttcctctagattgaggcaggagaaatctagtgaagcaagtgcaagtgagtctgaggatgataacgagagaaatgatgcagccgaggaagaaacagatgaagatgactccgctttttttgacactcgtgattttctatcatcatccaattcttttaaaagtaatggatctgatattagggcctcatctttctcttcagatgatggactctatacagttgaatcagaggaggatgtagatccttcaattaaatctgttggaggcaactatccttctgttaaacgacgtaggaaattgcctgaccctgttgaaaaggagaaaggcgtcagtctttggtcaatgattaaggataatattgggaaggatctaactaaagtttgccttcctgtttattttaatgagcctctctcatctctgcaaaaatgttgtgaagaaatggaatattcgtatcttatagaccgtgcatatgaatggggaagaaggggtaatagtctcatgagaattctcaatgttgctgcgtttgctatatctgcctatgcttcaactgaagggagaatttgcaaaccatttaacccattactaggggaaacatatgaggctgactttccagataaaggaattcgatttttctcagagaaggtctaa

SEQ ID NO: 98339 - DNA, 267 bp, Glycine max
  Peptide Sequence Number=SeqID_215117
atgggtcatgtggctttgtttgttgggcaccaaacagcagcaactatcaacaataataatgctatctcttactcggccaaattagagcaacaacacacactgaaaatgcagattgaggtgagtaccatcaatgttaggaagaagaaactatccactttggaagatggcaccggtaagggtttcacggccgtagccaaccttggagacattggggatggtggcaaggtgtcaagcatgctgcagtgggagatacaaccgcgaagatga

SEQ ID NO: 98340 - DNA, 921 bp, Glycine max
  Peptide Sequence Number=SeqID_215118
atgcatcccttctgctgcgtctccgccgtctccgacaactcctccccggccccattcgccgcccccgccatcgccatgccccctctccccgggagatccgactccgcccctcgccacgctcagctccacctctgcctctccaacggcggcgtaagcggccgcgcgagcctccctccggcgccggcggcggtggacgtcagaatcaacgacctcgtcgggaacggaatctcggggattctacacaagtgggtgaactacggaaaaggatggaggccgcgctggttcgtgctacaagatggtgttctctcctactacaagattcacggtcccgacaagatcgtcgtcaactccgaaaccgagaagggatcgaaagtcatcggcgacgaatccgcgcgcatgatttctcgcaaccgcaattccaatcacgccgtcaaccatcgccgcaagcccctcggcgaaatccatctcaagatttcgactattcgagagagcaggtcggatgacaagaggttttccgttttcactgggactaagagactccacttgagggccgacacccgggaggatcgagtggcatgggtggaagccctgcaggctgtgaaagatatgtttccccgcatttccaacagtgagctgatggcgccagtggacaatgtggccgtttcaaccgagaaactgaggcatcggcttatggaggaaggtgtaagtgaggcagctattcaggacactgagcaaattatgagaaatgagtacgctgcgctgcaaaaccagcttcagctgcttaagcagaagcaggtggcgctaatcgacactttgcggcaattagaggtacatttaatgaaaagtagaaaacttcatgccagtcaaactggctattcttggtggatttctactactgcaaagaaagctggtcattcttag

SEQ ID NO: 98341 - DNA, 1644 bp, Glycine max
  Peptide Sequence Number=SeqID_215119
atggatgaaaaccctaacccctcaatccctcgcgcctcttcctcttcctctcaggaattcctcaaacaagtccaagctgccctaaagcgccatcgccctctcggtactacgcaatcgcataacgtgaggccgaagcgcgccatggtggctctacgaaaggccacgaacaagctcgaggaggatccgccgtcgatctccgacacgtgcaccggcgaaggctgcaaaaatgagccctctttgctgctggaatctctgagtgttggtgcacacaacaaggttcagtttttaactgagatcaacaatgccactgcacagccgcaggccactgagttggagaacatatcatctcatatgggttcacttgcattgacagatgaagcatcgattggattcaatcaacatgagaagcaccaaaatatgcagcaggcagaatctgaaactagcttggtatctgagggaggcaagacttctatgctgccaaaaagaacaatagttactcaagatcatctgcagcaattcaaaaactttttgaggcaaccagctacacaatcttctgtagtgggattgccatgtcctacaactacgtcagtccattcaacttcagctccaatgctgaattctataactcattcgaattcctgtatagatagtggttcacatgtggctgcagaaccttatgggaacctgaatgttaattctcgtcctataattcaagggtatgttaaatcaccaaatatttctctgaaagacaccaatagaatgtcaattgatcaggtggcaagtgcagtccaagattgtaattcaccaattgatgcagagttgacgtttaagcagagtgacccatctaaggagcagcaaggatgtatgttaaaggatacaagtatttcaaagtatacctcttgtcatgatgacttgttaagtaaagggcaagagtctgcagctgttaccaacatacagcctcaggttctcacttcatcttcagatttgaaattggagtcttctaagttagaaaagcaagagaaaaatacaagttctaaagcatcatcaggcattcgaaagagggcctatgaccctgaattgtttttcaaagtcagtggcaagctttatcaaaggcttggcaagataggtagtggtggaagcagtgaggtacacaaagtgatttcatcagactgtacaatctatgcacttaaaaagataaaattaaagggtcgtgattatgccactgcatatggcttttgtcaagagatcgagtatctaaataggctgaaaggaaagaataatattatccagcttatagattatgagggagtcataaatggctccttcagtaataaggatggtagagtcaaggatgatggatatatatacatggtacttgaatacggggaaatcgatttggctcatatgttgtctcaaaagtggagggaactgaatggaagcaaccagaccatagatgagaactggcttcgattttattggcagcaaattcttcaagctgtcaacacaattcatgaagaacgtattgtgcattctgacttgaagccagctaacttcctccttgtcaaaggttccttaaaactgattgattttggaatagccaaagcaatcatgagtgatacaacaaacatacaacgtgattcacag

SEQ ID NO: 98342 - DNA, 660 bp, Glycine max
  Peptide Sequence Number=SeqID_215120
atgggtcctgatagtctgcgaaaaatacatcttaaagttggtacactaagttacatgtcaccagaagcatttatgtgcaatgagagtgatgcaagtggaaacatcataaaatgtggtcggccatcagatatctggtccctcggctgcattctttatcaaatggtttatgggagaacaccctttgcagattacaggacattttgggcaaaattcaaagttataactgatccaaatcatgaaattacgtacgaaccagtttcaaatccatggcttctggatcttatgaaaaggtgtctagcatggcatcgcaatgaaaggtggagaattcctcagctactccagcatccttttctagttcctccagttccatgtcattcatcttcgtcccaagaccaaacctttaaattgctgcgacttatatctaaaacttgcataaatgaccctgaagcatcacagctctgttgtcagctccaacagctgcttggtaatcccatcaaattaacaacacggacactccagtcccttgtcgtgtctggtgttcaacacgcatccgtgtctggtgtccaacacgcatccgtatcagtgtccgaaacgcatccgtgtctggtgtccaacacgcatccgtgtcagtgtccgacacgcatccgtgtcagtgtctga

SEQ ID NO: 98343 - DNA, 123 bp, Glycine max
  Peptide Sequence Number=SeqID_215121
atgtgcaagcccatagaccccaagcccaataaggtcaatataaaaaagggtgaaaccccaggtaacctccttgctcttccaaacactcgtgcacccatggcttcggcaaggaactacaagtag

SEQ ID NO: 98344 - DNA, 213 bp, Glycine max
  Peptide Sequence Number=SeqID_215122
atggagtcgactgttccttccaactggcagaacttaactattgagaagtacgatgacaccacaaacccagacgagcacctcgatgtgtatattacccaggtgtgggtcgatgtcgtgtcagctaagaaagataatgacaagcctagctccaacaaagctcaagatgatggaaggagggatcggctgttggacaaatggcctcagttatcttaa

SEQ ID NO: 98345 - DNA, 183 bp, Glycine max
  Peptide Sequence Number=SeqID_215123
atgtcctctaacaactacatgaggttcttggaccgaaaactcaatgaattcttgagtggtctcggcatcaagcatagggtcacgtcggtggagcacccccagaccaatggacaagctgagacagctaacaaggtcattttaggcaaattgaagaagcagctagatggagccaaggggagatga

SEQ ID NO: 98346 - DNA, 1050 bp, Glycine max
  Peptide Sequence Number=SeqID_215124
atggtgttggtcaaaggttcgtcatcgagggagtcgattggaggcgagtttaacattcatgggtacaacaatgtggtttatgaagtgtcattcgactttcactccttaaggtcggatttttctagcttgattgacttctcggcattcaaggggtctagcaaccttttggcaaatatggccaaaaaagtgcccaatgctaaaggagaagcgtctgcctccaccaatcacgcttatggacacgataatggatcggagacgtgccctgtcactctacacatggtccgattagatgctacaccacccacagagtttgtgttcatgaaccgagaagggatgaacaaagatttcttttatatgtacaattttttgttttgtgatctgcgtgtaaaggtcttattcgacgattttattatgagtatgttctggatacttgacattgcttcgatgcaattgcatccgaataggtgggcggctatacagtctctgaatcctatctgggaccttgagggaatcatgactcaggccgatgacaacatgaatgtttttcgccaggcttggctaaatcaaatcgttgctgctggtgaaccttcgttgaatcctgctactaatcaaacatcggggccttgtgatgagcactggagcggctcgggggaacactccgggcaccaggaagacacctcttgggagaagaggcttaagcagccaataattggatttcaacctgatgttgccacctctttgggcaacatctcggcccctaacgaatcaaggcttcttcaaccattccttctggctggaccgccttatcctgacggaaattgtttcgaagcaagggggtcgtccaaagccgatgctttgaaggaccagttcctaaaggtcgaggattccttgaactcagcgcttcaggccaacatgaagctggtcgaagacaacaaaaatcttaaggaccaggttcttcgactaacaaatgatgccaagggattggagacgtgcaccctaaatgtcgaggccttgattagatctcaagatactgaaatatctaggctttga

SEQ ID NO: 98347 - DNA, 186 bp, Glycine max
  Peptide Sequence Number=SeqID_215125
atgaaaaactcatcttttgttcctgggcgcaaatgcggtcatgcacggcctcttcctttacatggcaatcacggtccattgccatacctttatcaacaattgaataatggagtgaaagattttaacgaagaggcaggggagtggaaaacacaaaacctgattaatcaaggaaatcacagttgctga

SEQ ID NO: 98348 - DNA, 1086 bp, Glycine max
  Peptide Sequence Number=SeqID_215126
atggagcggcataattacaatatgactaatatcactaacatcagagttcaagcttgggctcctgtcagttattaccttggagttgtttctcctatcttgcaaaaggaaggggtaattcgaatagctccatttgccaatcgtctggcaatgagtgtccctccacatattcaatttctaagatgtcttactaattataaagcattgaggttttcttcttcaatatctgcactaggcaagaaattagtttaccaaatgattgagaagagctcaaggacagatggaaaatacattgctgtgcatcttcgttttgaggaggatatggtagcattctcttgttgtgtatatgatggaggaaaggcagaaaagttggaaatggattcagttcgagaaaaagggtggaggggaaaatttaaaagaaaagaccgtatcattttgcctgacctcaatcgggttgatggaaaatgcccactaacccctctagaggttggtatgatgctgcgtggcatgggatttgataacaatacttcaatatacttagcttctgggaaaatatatcatgcagagagatatttggctcctttgataaagatgttccccaatctttatacaaaggagtctcttgcaacatcagatgagcttgctcctttcatgagttgtaacaagaaccacgacaaagtttatgcaccgacctcaagaatgcacgtgatgataaaggatggctattcctcccaattggctgcactggactatacagtatgcttgtctagtgaggtttttgtaacaactcagggtggtaacttcccccattttttgatgggccataggagattcctctatgatggccatgccaagacaattatcccagataagcgcaagcttgttgttcttttggatgacgtgagtattagttggagagctttcaaggatcagatggaagacatgctcggtgaaagtgaccgcaaaggaatcatgcctaaggtcctatacagaagtaattacttagagctaaacgtaggagatggaactctcataacagcacgcaaaatttgggtacattgcaccaatctgggtagctatttccaatga

SEQ ID NO: 98349 - DNA, 516 bp, Glycine max
  Peptide Sequence Number=SeqID_215127
atggtttatgattatgatgcattacgctggttcggttcagttacgcacctcgctagcagaggaattatcggcctcgatatcgtgccagaggttgtggaagatctcgtggctgcggtagcgggagccgggaagaggagtgtggccaatgaggccggagaagggccccacgcacatcagcagccccgagatgtacaccagcggcagcaggaagaagtatcggaggctccgccgcgccatgattccggccaccagccgccggctctcggccaagtccttcgctggccgcacccgcctccggcaccgcggacctcccgagtgccgatgcggcgacggcggcggactcggagagctgctgctcccgcacccgccgccgcccacgccgacggtctcgtttgtgagagtgagagtgagaccgtttccgccagttttggatttcatgacgagattatctctctaaaaagagagagagagaatgacttgatggaggtgaaaaatgatgtgttttactgtgtttag

SEQ ID NO: 98350 - DNA, 333 bp, Glycine max
  Peptide Sequence Number=SeqID_215128
atgtctcgtataaatttgtctctcaaggatgataacttgacaatgtctggaacaaaattgtttccaaaggaagatatcggaaagaaacgaaaaatgtcacctggactgaatgggtttttgattgtggaggccaatgggggtcttaaccagcaacgctctgcgatttgcaatgctgtggctgtggctggactcctgaatgcaatactagttatacctcagtttgagtttcacaatgtgtggaaagatccaagttgcggttgcagcctgcaattacaggctgatctgctgttatggcagctgctgcaaccaagatgtttcagctgcatcacttga

SEQ ID NO: 98351 - DNA, 201 bp, Glycine max
  Peptide Sequence Number=SeqID_215129
atggaaatactaaggatcttaggcaccatggccagagctgacgatgactacatctacaagagtgaaaaagctggtatttctgacaaaaaagcatggaatgagaacatttatacttcaatgaaactcggacaagtaaaaccacattttatactcatggatccagacaaatttgtcccaaatttgggggaatgttttgggtga

SEQ ID NO: 98352 - DNA, 171 bp, Glycine max
  Peptide Sequence Number=SeqID_215130
atggacaagaggtcaagtgtcacccgagatgacctgggtcgcaacatcagtcgtgatggtgatggtgacaacattgagagttgtcaggaagtaccttatattcatcagttgtatgatgtcagacaaatgggtttgtggggccgtgcaaaacttggcaacaaaacaatggat

SEQ ID NO: 98353 - DNA, 324 bp, Glycine max
  Peptide Sequence Number=SeqID_215131
atgtggggaatagatgtgatcgtggccattaagcccaaggctttgaatgggcatcgcttcatcttggttgcgatcgactacttcaccaaatgggttgaagccacctcatactctagcatcacaaagagcgtggtagtcaggaagattatcatagacaatgccaccaatctgaataacaagatgatgaaggaaatatgcgaggatttcaagatccaacaccacaattccacgccttacaggcccaagatgaatggggcaactgaggtggctaacaagaacatcaagaagattattcaaaagatgatcgtgtcatataaggattag

SEQ ID NO: 98354 - DNA, 655 bp, Glycine max
  Peptide Sequence Number=SeqID_215132
ctagtggtccctgcgccaaatgtagaggttgacgtatttctggatgacccgatggcaccagctgatgtagaggacactggggcagacattcccacagacacaggcgcccaggctgctgaggatgagcatgaaggattttcgggtggtccgagcgacctatctgtgctgacccaatatgcggatcactttgcttgcagcgagcgtcctgagttgaagttatcctctcacgggaggaaggtccatagtttaggcaggcttgtccctgccattgagggactagttgctgggacaggactaagtcctctgatcactttccatctccctgtgggagagctcacgatcacactagacgatgtctcctcgattctacatctgcctgcggttggcgacttgcacgcctttcagcccttgcacatggatgatgcggttcagatgctggtggacttattgatggtctccgcagaggctgccagagctgagataggtcagtcagactgggaggtacgcctggggagtggctgctctggtgcatatgtacgaccagctaaacgatgcctctatcagcagcagccgatagcttggcggttacatcacactactacagtcgtggagtccactgttgatcaggactacgacgaggattcctcgcgtgtcg

SEQ ID NO: 98355 - DNA, 450 bp, Glycine max
  Peptide Sequence Number=SeqID_215133
atgtcttgttttctacttgattttgccatcggtcaaggtggcagtgtatctgagggctcaattgagcaacccatcatggattcagaggtgccttcgatagtgagtcctcctcttctgagagggggtgcgatattccactactgccaaggagcctatctcggttactatgatcctcccccttctgcttctaggggtgtgaggagagctagagggggcagagatgttaggtcgtctccccatgttcgacctagcatgagtgttgggtcattgtcatccaccccgaccattactggctatgagcttgtaggagtgatgatttcccatcttgagggtggcacttggtcttccacccttcttctttatgtacagatgccttggatcttcttcatcaatggagtcctttgctacttgaagatggatgacagcggaatagagaaggaagaagtatga

SEQ ID NO: 98356 - DNA, 330 bp, Glycine max
  Peptide Sequence Number=SeqID_215134
atgacaaaaagggtgcggataaccgtaagaatgaccaaacttggtctctgcttgtcatcgggcccgccgcctctggatgacaaaagggtgcggataaccgtaagaatgaccaaacttggtctctgcttgtcatcgggcccgccgcctctggatgacaaaagggtgcggataaccgtaagaatgaccaaacttggtctctgcttgtcatcgggcccgccgcctctggatgacaaaagggtgcagataaccgtaaggtatctccgcgtatcatgggtgcagaatgaccaaacttggtctctgcttgtcatcgggcccgccgcctctggatga

SEQ ID NO: 98357 - DNA, 336 bp, Glycine max
  Peptide Sequence Number=SeqID_215135
atggcgatgttgtcgttttgggcatcgaaaccagctgcgacgataccgccgatgctgtcgttaattgagaaagatttgcagtttccattcatggcccaacttatttcagaaagcggtgtaaggacgagggaggagaggggaagagaggtacatttctcacgtacattttctgagtggagacgagggaggagaggggaagagaggtacatttgtcagatgaagattgcaagattgtttccaggattaggcaaagatcgtcgtggacatgtaaggattcaagcatctcgatctccagcaggtgacattttcacagtcatggtgctagaagtgacataa

SEQ ID NO: 98358 - DNA, 330 bp, Glycine max
  Peptide Sequence Number=SeqID_215136
atgcctaatctgatgtttatgcttccaagtctcccattcaggatcaagcttcaggcaccaaagagaaaagtggcgattttaaagattgttgtgtctctgaacatcaagccagagacaaatgtggtgcagcaggatgtaacagacaatgaaaagggactgtgtgatgaagaccatttgttgggcaacaacttttgctcaactacctttggtatgtgtatgaactatgaacacattgttctattttccataagatatatgggttcaccttgtttcaccgttcttgcagaggcctttaaggtttcgtcaacattgttctcatggtttgattaa

SEQ ID NO: 98359 - DNA, 430 bp, Glycine max
  Peptide Sequence Number=SeqID_215137
ttttgaccagtttccttcggttttcccgacgttttccacaaataaacattggtggcgactccgcgcatctttcctcctttggaaagcgcacccgtgtgcctcgcctcgctcgcccgcaaaagggaacgttgcgacagcgaggacgtgtagtcctctgaaggtgagggcgttcagccctctgaaggcgaggacatttagtcctctgaaggcgagggcgtctcaaaggtcaagaacacttcatgataacaaagatgatgatcccaaagaatcaaagaatgagttcaagatgctcaagattgaatcaagaacacttcaaggttcaagaggaaatttgatttcaagaatcaaaaatcaagattcaaggttcaagcttccaagaatcaagatcaagattcaagactcaagattcaagaatcaagagaagaattaa

SEQ ID NO: 98360 - DNA, 818 bp, Glycine max
  Peptide Sequence Number=SeqID_215138
attctggcagcactgatgggacagttaggatatgggactgccatactggtcaatgtgctaaagtcatcaatcttggtgctgaggttacctctttgatcagtgaggggtcatggatttttgttggtctgcaaaatgctgtcaaggcttggaatatccagaccatgtcagagtttactcttgatggacccaaaggccgagtccgtgccatgactgttggcaacaatacactctttgctgctgcagaggatggtgtcatttttgcttggagaggaagctctaaagccgattctccttttgaactggttgcgtcactcactggccacactaaagcagtggtttgtctggcggttggatgcaagatgctgtactccgggtccatggaccaaagcataaaggtctgggacatggatacattacagtgtacaatgacactaaatgatcatactgacgtagtcccatcccttatctgttgggatcaatatctgttgtcaagttcatctgaccgcacaattaaggtctgggcttgcattgaagcaggatctttggaagtgatatatacacacaccgaagaaaatggtgttgtttcactttttgggatgcctgatgcagagggaaagccaatattattttcctcgtgcagagacaattcagttcacatgtatgaattgccatcattttcagagaggggacgtttatttgccaagaaagatgtggcattaattgagttaggtcctggtggcctcttcttcactggagatgagagtggtttgctgatggtgtggaaatggttggaggtacccaaggtggcatcctcttga

SEQ ID NO: 98361 - DNA, 326 bp, Glycine max
  Peptide Sequence Number=SeqID_215139
atgggcaaacaagcccatagatgcacggagactaacatcatcttctgtaccttttgtcgtcctgaccctttgaagtcaggtgacatgcggggttaccttatagttacccgcacctttggtcaaccagtggcaaacaagcccgttgatgcacggagactaacatcgtctgctgcaccttttgtcatcctgacccgtgaatcagatgacatgcggggttaccttatggttacccgcacctttggtcaaccagtggcaaacaagcccgttgatgcacggagactaacatcgtctgctgcaccttttgtcatcctgacccgtgaagtcag

SEQ ID NO: 98362 - DNA, 461 bp, Glycine max
  Peptide Sequence Number=SeqID_215140
gaaagctccagaagtgtcttcaatttagctatgcttgcgaagcaaggctggaaatctaaatattttcctaatatgaactttttggccactaaggttggttacaacccatccttttgtttgaagagcacacggacttcaagagttgtgctgaaggaaggctacaagtggactttgggcaatggctcaaatacttacctctatcccgatacaagagaccttttgaaccttattgttaatgatcttatgaaaggaggaaatgagtggaattcggaaattatcaataaaatggaatggagtttactcagaaagtttgaaggagttttgcttttgagcctcacactggaggctaattctaaggatctctttgtcatgattatatggagtatgtggaaagatagaaatgacctactatggaacaatagttcttcgattccctctcttattgttgaaagagctagaag

SEQ ID NO: 98363 - DNA, 399 bp, Glycine max
  Peptide Sequence Number=SeqID_215141
atgtggatgcagcgtttcaccctcatttacatcgaacaagctgaggtctttgtgtttgtaatgaagatggcaatttcatggcaacaaaagttgtctagaaggatcacaacttccaggtgtttgaaggagaatccagtggggcacttattggcccttgagtggttggaggatctgcatctgtctcatgcagttgttgaactggactgcaaaggatttttcgactttgtcagttcattaattcttcataagtttccgaactttagtgttaagtttgtgaggagacaagctaatgcagctgcccatgcccttgcaaaggctgctgcaaacaatgttagtccttatttctatcatactattcctcattgcatctcttatattagtatgaatgaatcagcttaa

SEQ ID NO: 98364 - DNA, 969 bp, Glycine max
  Peptide Sequence Number=SeqID_215142
atgaacatgttaggccttagagacctatttctcatagctccaactccttctcaacttcaccaccatcaacaacaccaacaccaaaaccaacccatttcagcagaacaccattccaacctccctttgccttcacaagcctctctcagcgttggccttggcattttccctctcctaacagtgccacacactaatgatgttcatgctcaggttcaagactgtgccaacaacaacactaacaacaccaacaccaactattggaacctgaagatgtgtggtcccactgaagtgaattccacaagaaaaggtgtcatgaacatggaggatgaggggagcaataagcaaatgatggagagtgaggaaagtggtggtgagttcagggtgtgccaagattgtggcaatagggccaagagggattgcagcttcagaaggtgcaggacttgttgcaagggacgtggctttgattgcagcactcacgtgaagagcacgtgggttcccgtgtctcatagacgcggtggcagtaatagtggtggtgatcactatgacgatgacgatggtaatgcttccaagaggctaagaactttggggtcatcaaagaatgttgctgctacctctcacagttccacttccaatgctaccccaacaaagagctttgatactagctcttgtcaacaagatgctggtttcaagcagtctttgccacggcatgtgcgtgcacctgctgtgtttaggtgccatagagtgtctgctattgggagtggtgaagatgagattgcttacatggccacggttcatattagtggccatgtgtttaaggggtttctgtatgatcatggtgctgataccagaaatgatgtgcctagtgtctcagaactgcaattgggaaacaatggaagtggaaagaataacaatagggaatgttcttctgcaattggggttccaactagtgcttaccctgcttctgtttgctga

SEQ ID NO: 98365 - DNA, 411 bp, Glycine max
  Peptide Sequence Number=SeqID_215143
atgacatgtggagacaaattacggtcatccgcacgctcgatgagtgataaacgcgcagagactaacatcttctacgccttttgtcatttaggagcagcgagtcgagtgataaatgcgcagagacaaattatggtcattctgcgccgtttgtcattcagatttcacaagttgagtgatgaacacgcagagacaaattatggtcatcatgtgccctttgtcattcggggacagtcagtcgagagaggcgatcatgtccggtggcacgcaaagacaaattatggtcattatgtgccttgccgcccaggctcgatcacgtccaaagacacgcagagacaaattatggtcattctgcgccttgtgtcaaccgggaggaacgaattcgacagtatcaggatgatgtgtcggtactga

SEQ ID NO: 98366 - DNA, 207 bp, Glycine max
  Peptide Sequence Number=SeqID_215144
atggctagctgggatctctcatcggatcgaagctctaaagtctatataaagcttgaagatgttcatgataaagttgttgaatcactagagaatcatctgagtcaaaatgaacatagtgttggggagattaaaggtagtgccaagagtgacctagagagtacttgttgtgccatcaaagatttgattagtggaacccttcaagtttag

SEQ ID NO: 98367 - DNA, 612 bp, Glycine max
  Peptide Sequence Number=SeqID_215145
atgccgcactcacgagggactgccagtgatatactggaggaaggtggggatgacgtcaagtccgcatggcccttatgggctgggccacacacgtgctacaatggcaattacaatgggaagcaaggctgtaaggcggagcgaatccggaaagattgcctcagttcggattgttctctgcaactcgggaacatgaagttggaatcgctagtaatcgcggatcagcatgccgcggtgaatatgtacccgggccctgtacacaccgcccgtcacaccctgggaattggtttcgcccgaagcatcggaccaatgatcacccatgacttctgtgtaccactagtgccacaaaggcttttggtggtcttattggcgcataccacggtggggtcttctgactggggtgaagtcgtaacaagtagcgagcgagcagtaaagaaggcaaggcgcgacggcgcacagccagcggagcgtactgaagtacgtgagcatggcgagcaccgcgcaacgacgcattctttacgcgcagccgttacggcagacagagaaacatctgcgggttgtgaggttaagcgactaagcgtacacggtggatgccctggcagtcagaggcgatga

SEQ ID NO: 98368 - DNA, 390 bp, Glycine max
  Peptide Sequence Number=SeqID_215146
atgcatgctttgttagggtcattcaacagtggaaactggtctgactctaaagtccttgatagtgcagggttgagttgtcgtgctttcacgagaaatcagggtgcgataatattgtatatgcatagatctcccataagcaatttagctcctctggacttagaaattgaagctacatcgggaaggaacaaggccaagaggagaaggaaacttctgcaagttacaacagttgcatccatacttgaggaggagactcatttctctgacttattatcacctgattcaccatcatcaagggaatccaaaactcaattacctgaagtcattaccatggcagaagagcatgaccagaggattacccttgaagattactcaagtagttcaacaccataa

SEQ ID NO: 98369 - DNA, 154 bp, Glycine max
  Peptide Sequence Number=SeqID_215147
atgattgcggagacagagccctttggcagcaatgaaaatggcgaagaggaggaggaaggggtgattgagatttgtgtccctgaccgtggcagcacacacaacaaaaagggagaagtggatgtcagacggaacgatgccacgactagaggacttt

SEQ ID NO: 98370 - DNA, 1248 bp, Glycine max
  Peptide Sequence Number=SeqID_215148
atggctgagaagagtcaaacctataattcgagaaagactaacttaaccaaattcatgcaagatgatttcattaatagtaagaattctctgagaacacttgatggtgaagatacttttataacttgtggttctgcacatagaaaaaactcatcctgtagcatcatccaaaattttaaagatgaagacaaactttctcatagtaatttgagttgttcgcttaaaagtccaaattcatttagaaaggtgaattcacctggtgctgtagacctgaagtcagcacaatatgggaagaaccggatggaggatcatactgaagtgagtcaaaatggtcagaagccagagaaagtgcttcctcactcattagatggttttgatgacatgacatatgcatcattaatctcattggtgaaaggtaagaattctaaatcaatgaataaaaagcatagatctttgatggaagaaaagagaagtattttaatagatagcttgaaaacattgcaaggtagcaatgttcgtacacatgaagagcttgcagtttttgaggaccaaataaactcaagggaccatcacactgagaagccaataactagtgatgtacataaatgtgctggtgagttagaaattggtagaaagtgcttcctggacaacatagacatgaatgaagatgaagagacatatagtcattctaatgctgtaaataaagctaactcagaatgtacattggctatggatatttcccctgacaatgttgtaggagctataggtgaacaacaagtttggaaaaaaatctttgtcaagcaagtgtttgagttgcatagactgataaaggtgcaaagattaatagcaggctcaccccatgtattgcttgaagataaccttttacttaacaagccaccaccaaaaacatccacaaccaagaagtttcaatctgactttgccagccaaaaaccatcagcagttgttaaacttgacaataaatctgtgaaggtcaatactgttgagaagactacaaacagcgtagttgggaagattcccattccttgtatcagcaacacaaccaaaggaaaccttgcattagcctctgcagattcaaattcaaattccaaacagtcgccaagctatgtctacccccaacctgggaaccagtggctagttcctgtcatgtccccatttgaaggcctagaatacaaaccaatcatatggccatgccctgcaaatgcaggcttcatggcacccataaatggttag

SEQ ID NO: 98371 - DNA, 414 bp, Glycine max
  Peptide Sequence Number=SeqID_215149
atggaggatcctgaagtagcaaagtttagagagcaaggcctcaaattcttacctgagatggaattcctttttaagggattcaacacaagaacagaagagacaaatgataacattgatgataacactgacatggaagtgaatgagcctgagatagacacgacaactcagaacacgtctttgatttcctcacaattagatcgtactattcaaacatttgaatctagtgcatctgctcaagacccaactagcattactgcatgcatagcaaagttgaaagatctaccaggacttgagtgtgggagtgaactattttacaaagctactagacttatgaaaaaaagggcaaacatgatcacctttgttgctttagaaaagcctgagctacaacttggatggatcaagtctgacacttaa

SEQ ID NO: 98372 - DNA, 306 bp, Glycine max
  Peptide Sequence Number=SeqID_215150
ggcacctcaaactctctaccggacaaccttacccatgaattcttacagaaaagtggcaatgccccctaaggcaacggggacctccctaaggggtggttggaatccaagtagaagtctcaagttggctctaacagagccaaacacaaaaacaaactcttctgactcaccaatccagcttaggtcttctacccagaaaattaaaaaagaagggtcgtcgacccaaatcatctcagtcaaacctgagtcattcgctcaggaacctcccaaatcggaaaccgccaaacaaacatcgactgactatgcttg

SEQ ID NO: 98373 - DNA, 234 bp, Glycine max
  Peptide Sequence Number=SeqID_215151
atgttggggatggacatcttggcttactgtttggagttagtcattttgtttctattagatgttaggcactcctatgctataccgtgtggaaaatatgactatgggcaaaagagggttttacccttttcggctttaacaaacagacttgactacatggaaatgggtgtgggaagcaatttggtaaagttagaggttgtgtggaatacatctgaagaggtgggaaatgagaggtag

SEQ ID NO: 98374 - DNA, 720 bp, Glycine max
  Peptide Sequence Number=SeqID_215152
atgacatgtggagatacctttatggttatccgcaccatttgtcagccagaggcaagcgaacccattgacacgcagagactaacgtcatcatttgcacctttgtcatccagagacgacgagtccaatgacatgcggagatacattatgattatccgcaccttttgtcaaccagaggcaagcgagcccgttgacacgcaaagactaatgtcgtcatctgcacctttgtcatccaaagacggcgagtccgatgacatgcggagataccttatggttatccgcaccttttgtcaaccagaggcaagcgagcccgttgacacgcagatactaacgtcgtcatctgcacatttgtcatccaaagacggtgagttcgatgacatgcagagattccttatggttatctgcaccttttttcaaccagaggcaagcgatcccactgacacgctgagactaacgtcatcatacgcacctttgtcatccagagacgacgagtctgataacatacggagataccttatggttatccacaccttttgtaaaccagaggcaagcgagtccgttgacacgcagagactaacgtcgtcatctgcacctttgtcatccaaagacagcgagtctgattacatgtggagataccttatggttatccacaccttttgtcaaatagaggcaaacgagcccgtcgacacgcagagactaacatcatcatctgcaccttcgtaa

SEQ ID NO: 98375 - DNA, 550 bp, Glycine max
  Peptide Sequence Number=SeqID_215153
atggtcaaagataaagggaaagtggatacaactaaagttagagcagccttggacgaacaattggggtcaaaggagtttcaaagactaccaactgcttgggaggtgatggagaaaactaagaaattgaagtcgagagaatgggagaaatatcaacatcgtcgagatgaaatcttacaacgttcgacagaggaaggcacatctacacaggattcccctaacactgctacttctattaatgataatgaaatatatttgaatgttgttggaggcccaaattacaaagggaacgtgtacggcctaggtactttgagcaaaaggtttagttgctcaaaatcagctctatctacttctattgctcctgtggaggaccaaatagaggaaatgcgtgagacaattaataaattgaatgttgagcttttggcaaaggcaaataaggagaagacacttgaggaaaagatgttgcagatgatggagaatcatgaccaccaaagtcaggagatgcgacaacagatgcaacaacaaattcatcaacaaaatgagcaaatgcaac

SEQ ID NO: 98376 - DNA, 1012 bp, Glycine max
  Peptide Sequence Number=SeqID_215154
gctgcctgggagattccggcgtatgagcccaccgccatgaatggtgcctggtacgaggcgcctgggcaggcccttttacaagcgattagcgaaacctttccacaacttagcctggttgctgaggatttaggtattattaccgccgatgtggatgccttgcgccacgcttttgacctgcctggcatgaaaatcctgcaattcgcgtttggcggtggtgaggataatccttacttgccggagaatgtcgaagaaaacagtgtggcttataccggcacgcatgataacgatacgacgctgggctggtatcaggttgcgccggaaaataagaaagcggacgcctccatgcctgatgcaaatgcggcttaccgtctcgggttggatgtcggcggtaccaatcttcgcctaggtgtttttttggactcgaacctcgttgaagaaacgcgttttcaggcgaactactctgccatttgcaaagagtttgaacctgcaaaggcgtggcaaaccattttgcaagtcactgcagatgcaatccgcccactgctggataaatatgctggaattcaggccattggcataggctttcctggattcatagatccacagacaggcgtcttggcacagtcgcccaatttgcccggattacgtaatgtcaatcttggtcatgaccttggtcagttactcggcttgcctgtacgcgtggagaatgatgccaatgctgccgcctatggcgaattctgccatctgtcgcagcctgctggaggtctactttacttgggattggggactggcgtgggtgcaggcctggtggtgaatcatcacgtctgggctggtcaacatgggtatgcactggaagcggggcatattattgtggttccggatggtcctttatgcggctgtggtaaccaaggttgtgtcgagcaatatgcttctgcgactggaatcagcagggcatatgctgacctggcgggtcaaacactctctgcacaggagattgcgctggctgcgcaaaatg

SEQ ID NO: 98377 - DNA, 234 bp, Glycine max
  Peptide Sequence Number=SeqID_215155
atggaagaaagaaagaagtttgatctcatagaggaaaggatgagggccattgaggggattagtgattatccatttgttgacatgacggagctatgcttagtacccgacatcatcatcgctcccaaattcaaggtgtcggacttcgacaagtacaaagggaccacttgccccaagaaccacttaaagatgtattgtcggaagatggggcatactcaagagatgagaaactcttga

SEQ ID NO: 98378 - DNA, 252 bp, Glycine max
  Peptide Sequence Number=SeqID_215156
atggttatgcaatccgtgaaattctataatgcaacggaaactaggaggagtaaaatgggagatgcaaatagtaatttgcgaatctgggcccttctagaggtttctgggaaatttcttgcttacggtggaagcaaactagctcgccttggcgagctaggtggcaaccacctcccccatttggttaacacatgggattccggggcttccgggacacccgtaatgcttccgtacaattcccataaccctaaataa

SEQ ID NO: 98379 - DNA, 102 bp, Glycine max
  Peptide Sequence Number=SeqID_215157
atgggtcgcttagcggctggcgaggagcccgctaagcctaaggtcagccgcatggatttgcgcttagccaagggtaggatgcgcttagcggcactaaattga

SEQ ID NO: 98380 - DNA, 777 bp, Glycine max
  Peptide Sequence Number=SeqID_215158
atgaataaggcaagaaagaattgccaaggtgtccatagagcccctaatcatcaccagaagcaaactcaaaacttattgaataaaatttctgtggagaagatattaagagttcaacctgacataaaaaagttataccttctattgagagcatcaaatccttatttagctactcaccgcttgcaaaatgaggtcattgggaaggacatatttcgggtgctacgtgataagtggggtgcagattttggttcttttatatcaaagaaagtggtagcagttgctggtgatgtttctcttaacaacttgggaattaaagacgaaaacatgaggagccagatgtttgaagagttaaatgttatagtacacaccgctgcaactaccaattttaacgagagggaaatgaattcagtatctggcctcctagccagtttagctcataagtttgatgtggtaatgcatgttcccgctatccctcttgtaggatatgatattgcgataggtactaacacgatgggagcttttcatgttgtgaacttcgctaaaagttgtcataaattagggattgttctccatgtatctactgcctacgtgtgtggggaggccgaaggacttatagttgaggaacccttacatgtcaatggaatgcaaaaaggatctacaaaattagatatcgagttagaaaaacagttgattgaagaaaaactgaaagagttcaaagcacataacactgataaagaagtaatcacatcggttatgaaaagttttggacttgcaaggtaa

SEQ ID NO: 98381 - DNA, 705 bp, Glycine max
  Peptide Sequence Number=SeqID_215159
atgcctctgtctgaattaaaaagtaaatatagaaaaatttcatctttagaaaaggctcagtctggttgggaagaagaatatgaagtttcatctaaacagtataacatcgtgatcagtatggtagtacctacaaatacatttatatggaagtgcatgcatggtcccaattgtaagattggcaacttttgtacagttggtagaagactacaggaagtaaatgtcttgggtggcctcatccttcctgtttggggagccgtagaaaaggctctctcaaagcagaaaactaactgcaaaacaaaatctgtacaggcccgcctaagccacaggaggctacgtgttgtacgcattgaaactactgtggatacgcaacgtattgttgggcttcttgttcctaatgcagctgtggaaactgtgcttcaaggttctctctctaagacttcagtaccacatcaagttagtacctcaaagtgtgcttcttatagttggtatagttttgtggatagaagctccggaaacacctttttttctgatttagttagatccagtaccatgaatagaagtttagcaaaaatatgcattaacaatggcttggagttggagatgaaaatgagagatcttgctatatggcaagtcatgcaatttaggtgtcttggatttaacgtgaaaagtatcagagatagagacgtaaatcaccaagttggatag

SEQ ID NO: 98382 - DNA, 860 bp, Glycine max
  Peptide Sequence Number=SeqID_215160
atgtcatcttctcctctttcaaatgttgaaccaaattctgttactaatgaacactctaacactgtttctgacttaaacagatatccaagtgaactgtccagtacctcttcttctcagtctcacactgtcttcagaattaaggagaatgttgatgggattgttaacaggttcaaggctagattattagatgtcaacaatgcctttttaaatggccttcttaaagagactatctacatgcagcagccacaaggaactcttttacagtttaggtttgtggtctgcaaaggaatatatcacagcgggaggtcagatcttcctttcttctcagaagcttattccaaaccttttgtagactcatcttcggcgccttccgctcttgatcttcgaaaggaagatctgattcgagagaatttgcaccttagaaagggtgacctcgcacaaggccaatcggtcgcggaagtgcgaaactgccttcgtgcgcgttgtcaccgccgttcgtgccggtgcttgtcgccgccgttcgtgccagtgctcgttgccgcccttcgtgccggtgctcgtcgccgccgccatggtgtcgtcgctgtcagcccaactccttctgcgaaaaaaacaaaaagaaaacgctattttccgcccgccataaccgccatggcgccgccattcgaaacccgtcacgccaccgctattcggtggcgttttttcaaaaaaccgccacacctttccgccatggcgctgccatggccggtttttaacaacactgattattatcattgtgattcatctctctataggtctgttgttggtgctcttcaatacactaccgttacaagacctgagttaagcattgctgtgaacaa

SEQ ID NO: 98383 - DNA, 771 bp, Glycine max
  Peptide Sequence Number=SeqID_215161
atgggttatatggttcgacttggtctttggggagatgggacttcattcactgatttccgggaatttctaggagctcttgacagagggggtgttggagctcttgaactagttgccatggacatgaaagcaaggggtatgtatttatgccggacacttagctatgagggtgcagagtttgaagttatcgaagcaccattagaggataaaatgatggacatgtataaaaaggcagcagaattttgggctgaattacgtgtagaattgctgtcagccagtgccttcctaaatgacaaaccaaattctagtcaactatggcgattatactgggccagccaccaacgtttctttagacacatatgtatgtctgctaaagtccctgctgctgtgagactagcgaagcaagcattagttgaagaaaaatctgtagtcattggtcttcagagtactggagaagctaggacagaggaagctgtaacaaaatatggttctgaacttgatgactttgtttctggacctcgagaattgctgcttaaatttgtggaagaaaattacccgttaccagaaaaacctgaacttctcccaggagaggatggggtaaaagaactccaacggaagaggcattctgcaactcccggtgtttcagtaaaaggaagggtcagaaaagtagccaagtggcagcctcctagtgatgctgaaagtgatgaagactctgagagcatttttcctattaccaatatccaagaccgtagccctctatgttgggtcagctaa

SEQ ID NO: 98384 - DNA, 132 bp, Glycine max
  Peptide Sequence Number=SeqID_215162
atgcatatgacacagatgcaatttaagggtagcaaaagtgccccaacgtattgtcacaaagcaaaaaatttggtccctgaatctggtagtcagccgacacgaactggagaagcagtggttgatatccagtga

SEQ ID NO: 98385 - DNA, 149 bp, Glycine max
  Peptide Sequence Number=SeqID_215163
atggaggacttgattacaaaacgcaactctctctcccaaaataatgccaatgtcatcacgttggctcagcagctcctcaccataatcttactccttgcaccatgctgtagtcattctgcttccacgaacaaggttcgcaatcatcacag

SEQ ID NO: 98386 - DNA, 1488 bp, Glycine max
  Peptide Sequence Number=SeqID_215164
atggagtttgtcgcatcggggaacaatttaactttaaaagtgggtcccaattggattcctaattttcaacttacctatttggaagtgacatcatggcagttaggtcccagctttccattgtggattcagtcacaaaaccaacttccatatgttggactatctaacacggggattttcgattctattcccacacagatgtgggaagcactttctcaggtttcgtatttaaacctctctcgtaatcatatccatggtgagattgggactacattaaagaatccaatatctatcccaactattgatctaagctcaaatcacttgtgtggtaaattaccctatctttcaagtgatgtgttttggttagatctttcaagcaattcattctctgaatccatgaatgactttttatgtaacgatcaggacgagccaatgggattagaatttctgaatcttgcatcaaataatttgtcaggagagatacctgattgctggatgaattggacacttctggtggatgtaaatttacaaagcaaccattttgttgggaacttaccccaatccatgggttccttggcagagctgcagtctttacaaattcgtaacaacacactctctggaatatttccaaccagtttgaagaagaataaccaattgatatccttggaccttggggaaaataatctttcaggaactattccaacatgggttggagaaaacctcttaaatgtgaaaatcctccgccttcgatcaaacagatttggcggccacattccaaatgaaatatgtcagatgagtcttcttcaggttttagaccttgcacaaaacaatctgtctggcaatataccgagctgtttcagtaacttgagtgccatgacactaaagaaccaaagtacagatcctcgtatctattctcaaggaaaatatattgtgtcttactctgccacggaaagtatagttagtgtgctactatggctgaaaggaagaggagatgagtacagaaacattctgggtttggtaacaagcattgatctgtcaagtaacaagttatttggggaaataccaagagaaatcacatatctaaatggattgaattttttaaacatgtcccacaaccaattgattggtcatattccacaaggtataggtaatatgagatcattacagtccattgatttttcgaggaatcaactttttggtgaaatccctccaagcattgcaaatttgagctttctgagcatgctagacttgtcttacaatcatttgaagggaaatattccaacaggaactcaattgcaaacctttgatgcctccagctttatcggcaacaatctatgtggtccaccactgcccataaactgcagctccaatgggaaaacccatagttatgaaggaagtgatgggcatggagtgaattggttttttgtcagtattgacagttggatttattgtgggattctggatagtgattgctcctttgctgatttgtag

SEQ ID NO: 98387 - DNA, 302 bp, Glycine max
  Peptide Sequence Number=SeqID_215165
ctggtggtgtcggtgtggaaaccccacattctcagggcttgttgttacatgatggggcactctatctaaaggctttgaaaccttcagagctggttgacagcggtctacacaagcagttagagatgcagttccaccagttccgtaaagatcggactttctccatccgtgtagagttcatcccggacaaatggctccgcctctccctaaaggaacatttttcaatgttggtactgctactgcatcgcgatccagctataggaattacggatgctggtggtgctggttgccatgatgctaggtag

SEQ ID NO: 98388 - DNA, 762 bp, Glycine max
  Peptide Sequence Number=SeqID_215166
atgtgtagaaaagacattgatcctctcaagttagatgacctaaaaaatgaggccgttattatcttgtgtctattggagatgtattttttgccttcaattttcaacatcatggttcacttaattgttcatctattgagggaaattaaatgttatggtctcatttatttgtggtggatgtacccggttgagcgatacatgaagatcttaaaagggtatacgaagaatctacaccatcttgaagcatctattattgaaaggtacattgcagaagaagttattgagttttgttcaaagtatattgaaaaggcaaaacctgttgtgcttctcgagtctcagcatgatgaaagaatggaagttcatcacgaagctttagccaaggaaagtaacccaaaaatgaccaagaatagggtgttgaaagagcaaaataagactttcttgaatcagtttaaagatataatctttgatgacaataatgcttctgaaacactaagaaagttagcagatgggcctaaaagaaatgttataacttggcatggatacgatatcaacaagttttcattctacccgaaatcacaagacaacaaaagtacattgcaaaatagtggggttagtctaagtgctgaatctcaacacttcgctactgtacgtggtgacaatcctcgtatagcttccatgccttactttggagtcattgaagaaatatgggtgcttaattatgacaaattcacgatctttgttttcaagtgtaagtgggtcagatag

SEQ ID NO: 98389 - DNA, 808 bp, Glycine max
  Peptide Sequence Number=SeqID_215167
atgtttattactttaacctgcaatccaaactggcctgaaatccatagattgctgaatccgttgaatctgaaagcagcagataggccagacataatctccaaagtcttcaaactaaagtatgagcaaatgcttatgaacctgacaaagaatcacatgctaggcaaagttattgcatatgaaattgatcaaattatatcagcagagataccttcacagcaagatgatccagaactgtattcattagtaaaaaaccatatggttcatggtccatgtggaagtctgaatcctggatctccatgcatgaaagaaggcaagtgtagtcgtttctatcctaaaatgttccagccgcatactgttttagatgctgatggttttccagtctatcgtagaagaaataatggtaatgcaattgagaaaaatggtgttataattgataacatgtatattgtaccttacaatcctagattgcttagaaaataccaagcgcatatcaatattgaatggtgtaacgaaaacacttctatcaaatatttatttaagtacatcaacaagggatatgatagagtgactgctgttttgattgatgaagataacggtcaaactgagaatggtggcactcataatgatgagatcaaagaatatctagattgcagatacatatgtccctgtgaatctacttggagaatctttggatttccaatacatggaaaaaaacctgctgttgaaagattacacttccatcttctaggccaacatagtgttctctacgaagaccatgatgatattcatgatgtattgtctaagccaa

SEQ ID NO: 98390 - DNA, 396 bp, Glycine max
  Peptide Sequence Number=SeqID_215168
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccctagacaccctcaactttaccaagagatgccgaagatgtcaagagtttgcagacgttccatgcatttctcctaacaaccttcacagtctaagctccccttggtccttcgccatgtggcgcttgccctttcgccatgtggggaatggacatactgggactgctaccaaaggccctaggagctgtgaaatacttacttgtcattattaa

SEQ ID NO: 98391 - DNA, 196 bp, Glycine max
  Peptide Sequence Number=SeqID_215169
atgaagactcctaggcatcccactacatatcttggactggacgaggaatcggcaaagatggatgggactcagtacaaagcaatgattggttcattgctctatctcattgggtacaagcctgatattttgtttagtgttttcctaagtgcaatatttcaaaaagaaccaagggaagtccatttaactgcaattaaag

SEQ ID NO: 98392 - DNA, 171 bp, Glycine max
  Peptide Sequence Number=SeqID_215170
atgtctctagaaggttcctatcagttcaggttcttggatgtcgaaaaagtgttcaacatggatggatggctcattgtttgtgtgaatgctagtgatttccatggttgggattgtctcaataacgagggtgtttgcaaaggccattgtagagagatgagagctagggtttga

SEQ ID NO: 98393 - DNA, 168 bp, Glycine max
  Peptide Sequence Number=SeqID_215171
atggccaaggacattgttaatgaagaccaagtgaccttagtcacagaaaggttgaaagacctaagtgagacagatgaagatgatgaagggttggtgcgagtggccctacaaaagaggaaagttgcagctctagaagcctctcatccaaagaaggccaagaaagcctaa

SEQ ID NO: 98394 - DNA, 156 bp, Glycine max
  Peptide Sequence Number=SeqID_215172
atgagggcgaccaaggctaacccgaagattgtgagtccactgatgacaatcctttctcgctcctttgaaagcatgcactatccacacaattgtgtccacctctatcttctctgcatctcgacagattcagaatggtatctccaagggaaccattaa

SEQ ID NO: 98395 - DNA, 369 bp, Glycine max
  Peptide Sequence Number=SeqID_215173
atgacctctaaggttttaggagtgaaggtggaaaattgggtgaggaactatgactcatatgtcactagagcactctacaaagacaatgttgacaaggatggtgaccaaaagatcatagtatacaacctgatgtgtgagaaggaaaaaatatgggtcaacattttgaacaagagtgtgctccataaagctagttccaaaacaaccctctttgatctccataagttcgtgctatttcaattgatgaagaaccttccgtttgaccttccacacactatatacatcaacatgttgaggaacctcgaagacttaggtgatctagatgacatctactatgcagccctcctcaacaagctcctatgggatcaatga

SEQ ID NO: 98396 - DNA, 534 bp, Glycine max
  Peptide Sequence Number=SeqID_215174
atggctttggctaaagaacttgcaacattaaaattcctgcaccgtagagtatctgatctggacattgatgaagaggaggttttgaagcttgccactttgggtaatggggccaatagtaaagacacaatagatacattgaaaagatgtatggtcatgcggaataggagttacaaagaattgatggccaagtgcaatattcttggaagaggtaaggctcgttatagcaaaaagcttgagaaggctaaagagaagatcacaaaactgaagacacgagaagaggagcaaagagtgctttggtgccaatggctgcaacgaaagcaagaaaacttaccagagcgcgacgatggcagtgaaaagggtggctttgcaaccagagcacaaccagggtggctttgtgagactctgcgttgtgggtcaaggacaatggcaatgaagagggtggctttgcgagactcagcttggggggtcaggagcaatggcagtaatgagggtaggtttgcaagactgagtgtgagcaatgaaaagagtttctag

SEQ ID NO: 98397 - DNA, 1578 bp, Glycine max
  Peptide Sequence Number=SeqID_215175
atggcaggaaagaacaaccagcgatccaattcgcgaatcttcctcttcttcttcctcctcgctttctctctcctccttttcctcttctctctctctcctctccgcaccccttcttctccttcccccacccatttccacgttcccattgccgaaacctcgttcgtggcctccctcgaccacttcctcgcccacgctcaaacgtccctcaaagaccacacagcgcgcgacgtcacgaagctcgacgacgccgtttttcgctccgagacggacaggctgtactcagatccttactacccggtgtcccttccccttagggtttacgtctacgacatgccccccaaattcacccacgatttgctctggctcttcaaaaacacctacagagacacctccaatctcacctctaatggaagtcccgttcaccgtctcattgaacagcactccattgattactggctctgggcggacctcattgctccccaatcggaaaggctattgaccagcgttgttagggttcatcggcaggaggaggctgacttgttctacatacccttcttcaccactatcagcttcttcctcatggaaaaacaacaatgcaaggccctttatagggaagctttgaagtggatcactgatcagcctgcttggaagcgctctggtggcagagatcacatactccccgtgcatcatccctggtcttttaagtccgttcgaagatatgtgaagaatgcaatatggctcttgcctgatatggattccacagggaactggtacaagcctggacaggtttatctagagaaagacctgattctcccttatgttcccaatgttgatttatgtgatgccaagtgtttatctgagacgaatccaaagagaagcacactgcttttcttccggggccggctcaagagaaatgcgtttctggacagaggtctcatcttgtttttccctacttgtggagggaagatacgctctaaacttggagctgagttaagtggggctgatggtgtggttatagaagagggaacagctggagagggaggaaaagaagctgctcagaggggcatgcgcaagtctctattttgcttaagcccagctggtgacactccctcctctgctagattatttgatgcaattgtcagtggatgcattccggttataataagtgatgagctggagcttcctttcgaaggaattcttgattacaggaagatttgtatagaaaaagaattttttctggagaaatataatgaggccgaggtaaagatagcggtgttcatttcttctaatgacgctgtaaagccaggctggcttttgaaatatttaaaaggcattagacctgctcatatcaaagaaatgcaacaaaatcttgccaagtactcaaggcatttcttgtattctagtcctgctctaccattgggtcctgaagacttggtttggaaaatgatggctggcaaggtggtgaacatcaagcttcacaccagaagatcccaacgtgtagtggaaggatcaagaagtcagtgtacttgtgaatgcaggcctggcaacatcactaatacggcttcaataatttcttga

SEQ ID NO: 98398 - DNA, 900 bp, Glycine max
  Peptide Sequence Number=SeqID_215176
atggcggtatcggtgaaagtcagcaacatctcttcaactgcaaccgagcaagatttgagggaatttcttgcgtttccgggaaaaatcgaatatattgaaatgcaaagtgataagggaaattcccaagttgcgtatgttaccttcagtaatccagagggggcagaaactgcagttcttctctcgggggcggtggtgtgtggacagtctctaaccatagctttggctccggatcatgctctgcctgcctctgctgcatctgtatttaattatcatgatcaggcaacacagactagtaatgctgagagtggcgaatctggtttgagaaaggcagaggatgttgtaaccggcttgctagcaaagggcttcattttgggtaaagatgcattgaatcgagcaaaatcctttgatgaaaggcaccagctaacttccacggcaacagcaaaagttgtttctttggaccagaaggttggtttcactgaaaagatcagtgccggtacggttatagtgaatgacaaaatgaaagaaatggatgagaaatttcaagtgtcggagaagactaaatctgcaatttcagtagctgagcagtcagtgtctagtgctggatctgccataatgaagaatcgttatgtgttgactggggctacatgggtaacgggtgcttacagcagggttgctaaggcagctgaggaggtgggacagaaaactaaggagaaggttttggcccaggacaatcaaggaaaaactgaagaaggtgctcatgtccacacatccatttctgaacctaatcaaccatccaaaactgaacctcaacaggcaaccacagctaatcagccttccaaacctgaacaacaggccaccaaggatggtcaaccttccaattctgcaacaactaaggattga

SEQ ID NO: 98399 - DNA, 990 bp, Glycine max
  Peptide Sequence Number=SeqID_215177
atgagtgacaatttgatgggaaaagtcaacgctttgggggagcgtctcaaaattggtggggctgaggtgggtcggaagatgagtgctggcatgagttctgtgagcttcaaggtcaaggaatttttccaagattcaagccatgctggtaaactcgttggggaagctacctctgaggccctacatgagcctgattgggctacaattcttcatatatgtgacttgatcaatgctgatcaacttaacactgctgaattggtacgtgcaattaagaaaagggtcgtggccaagagtcctagaggtcagtatctggctttggttttgcttgaagcgttggtcaagaactgtgacaaggctttcttggaggtggcaactgagagagtccttgatgagatggtcaagctcattgatgaccctcagactattcttaataaccggaataaggctttgataatgattgaggcatggggagagtcaaccattgagcttcgctatctgcctgtctatgcagaaacttacaagagtttgaaatcaaggggtattcgattccctggccgtgacaacgaaagcttggctcctatatttactcctcctcactctgccattactccagaggctgatgtcagttttgcagatcttattcagtatgatattcatgggcaaagcttaacctctgttactcctcctcgttctgccactactccagaggctgatgtcagtcttgcacatcttatgccgcaagatattcatatgcaaagttttaagtctgaacaaataaaggaaacatttgatgtcgcgagaaatagcattgagcttctttctactgtgttgtcttctacaatgcagcagaatgtgttgaaggatgagttgaccaccacattagtacaacagtgccgtcagtcccagactagtgtccatagaatcgttgagactgcttgggataatgaagcagtgcttgttgaggccttgaatgttaacgatgagattcagaag

SEQ ID NO: 98400 - DNA, 636 bp, Glycine max
  Peptide Sequence Number=SeqID_215178
atggctgatgactctgctaaaggaattgaaaatgcttctttgaactcaacacaactagagaaccctcagattgagcccataagactgccctcagtagaggaaatccgtggtcaagacatttggaacaattgtgcagtgcgcagtgttgtcagtggagtcatgggtggtgggcttggcatcttcatgggtttatttcttggagcactggacaacccattgatgcaggaggaaatgactggcagacaacaatttatatatcaagcaaagcagatggggcgaaggagttggagttcggctaaagcatttgctgttatgggtttcatattctcagctgccgagtgtgttgttgagaaggctcgagcaaaacatgacataacaaataccgttgttgctggatgtgcaactggaggtgcaatatcagcaaaagtggggaaagggttggttgttgaagagtgtatcattgattttcaagagctttatgctctagtcctcatgttttgcttgctggttgctgatggcaaagaccatgacttgaaggatgatggtgaagagaatggttgtaaagaagagtatttggtgcttgtgggtgtgaagctggatttttctcttttaggaaacatctctgttggacattaa

SEQ ID NO: 98401 - DNA, 225 bp, Glycine max
  Peptide Sequence Number=SeqID_215179
atgttcctcgtattcaacagtgctttgaaaggacttgatgatactccacaacctaaatccaaggctggtgctaggttgattgttgttaagtattttaacgatgttagaccattggaagcagagagattgaaggcgcttcgcatccagtggacagagtattatctcaaagttagaaataaaagtcaggatgttagggaactatttcatattaggttacttaattag

SEQ ID NO: 98402 - DNA, 204 bp, Glycine max
  Peptide Sequence Number=SeqID_215180
atgaaagctgagaagtgggaaacaacagctacatggatatatttgactgtgactggaaaaagattgaagcatttgttggatcaaagacagtcatccaggttcaaggcaatgtcagtggcagctagattgtcactccagagtcacaaagttaggcagaacctaatctcattgagtaaagatgcacctataataactctgcactag

SEQ ID NO: 98403 - DNA, 999 bp, Glycine max
  Peptide Sequence Number=SeqID_215181
atggagaaaggtgtagatatttacatgttcagcaacagcggaaacctaatgttaatgggtttggaggacagagcagttctcatcaacagcaaaatacaaatccctttggatttgggtctggctctggctcacaacaacagcagaaggccttttgaaaacaaatggaatcgacagtcatccaaaccccagcagaacggcgtgaaatctgaaaacaaccccaaacaatcagaacatcatatatgcacagatcctgagaactgcaagcgccagattgcagtagattttgagcaagagaaaccactttggatacttacatgctacagtcattgcaaaggtgctccttgtgacattgttggtgatattagctatgaagaattgcgggcatcagcttacgaggatgctaatcgtggtatgagcttgcaatcaatagttgagaaagagagaaatatactaaaatccaagttggttgagtttgacaaactactttctgaaccttacaaaataccaataagttcttctcttggcagtcaaacaccccaatctattggagccaatgcaaatccgttttcaacatctcaaagtaatggtccattgtcagtctcaagctttagccaattgagtactccattgaacatgggttttgaaaggccatctgcaccactaacaaacactccgacgaagcctggtttctttggaagtggaggaaactctttggcatccaacacagcaaacctaaacagcaatggtgtcttcggtgttcaaagcggcccatattctacaccattggatttgaaaatgtttccaggttcaactcaggaaacatcgactgctttcagtaactctggtcccacttcaatgtttcaaacaacaccagatgtccagttgttaagtcagtcccaagtggagaaagtgtcggtagatccgagtatttggttaaaagagaaatggaatccgggagagattccagaagaagctcctcctgatacatttgtacggtag

SEQ ID NO: 98404 - DNA, 1479 bp, Glycine max
  Peptide Sequence Number=SeqID_215182
atgtctctgtctcttcttcgtatcttctcttcgccccacctttccacctctctcttctttccaactccaactctttcttccctctgcccttctttcctttccaaattaccaaatgccccctctcccctcattgttttatgccacagggacgcctcagcttcgaagcaaggtcacctcggagtccctgaaggtgcagaacgtgacagtgggagcgaagaagatgatgatgctgttgaacaacccatgagggccagttacgacgacgacgaagacgaagaagaaggagctcttagctccttagtttttcctgaaagatgggatgtattgggtctcggtcaagccatggtagacttctctggcatggttgatgataatttcctgaagaatttgggattagagaagggaacacggaaagtagtaaatcatgaggaaagaggtagagttttgcaggccatggatgggtgcagctataaagctgcagctggtggatctctttctaataccttagttgccctcgcaaggcttggaagtcgctccgaaaaagttcctgctataaatgtggcaatgaccggtagtgtagggagtgatctattagggggcttctacagggaaaaattacgccgagcaaatgtgcaatttctttctgcaccaatcaaggatgggactactggaacagttatagttctcacaactccagatgcccagcgcacaatgcttgcatatcaggatattttaggcattttgaagtttcttttacctttattggctaataccatgagctctatgaatagtgaagatgctaatatttctgtactctggtgtcagggcacatcttcaactgttaactatgatgcatccttagctaatgcagtttccaagacaaacatacttgtcgtcgaagggtatctatttgaacttcctgataccattaaaacaataaccaaagcatgtgagaaagcacggtcgaacggtgccttggttgcaataacagcttcagatgtctcctgcattgagagacactttgatgatttctgggaaattattgggaattgtgtggatttagtctttgcaaatggaaatgaggccagagctctttgtaattttgaagcaaaggaaagtgctgcttcagctgcaaggtatctgagccactttgttcctctagtatccgttacagatggtcctacaggctcttacattggtgtaaaaggagaagctgtatatatccctccttctccatgtgttccagttgatacttgtggtgctggggatgcatatgcatctggcatactctatggtcttttaagaggcatatcagatttgagaagcataggctcattagcagctaaggttgctgccactgttgttggacaacagggaactcggcttaggatttcagatgcagtcaaattggctgaatcttttgaatttcaacttgattcctcctctgttggcactgatcataatatttccagcgtctaa

SEQ ID NO: 98405 - DNA, 870 bp, Glycine max
  Peptide Sequence Number=SeqID_215183
atggatgaaatacacaaggtgcaagagcagattaaggccgacacggaggccttgaaagagaaaatggccacaatagtagaggccatgatgagcataaaggagatagtggaggttagtgcggcttaccaaacccgtgctagagctagagtaatgggtgaagtagagaaggtgcaagagcagatgaaggcagacatggaggccatgaaagagaaaatggccaaaatgatggaggccataataagcatgaaaaagataaaggaagtcgatatggttgcagttgccactaccaacgttgttgctaaggtgaacccgatgcccccatctggcctcaaccaaatgaatcatccaacctcaaatatggtaggtaaagatttgggaagtacggacgaccccatgatgtgcaaattcaaaatgagcacgccttcccatcatatggcttgcctcccaactatacaccacccaatgtggcatacactctcaatgaaaatctcaataactccactccgatactcattgagaaccaataacctcaatttgatcaggcacatatctctcaaaccatgggggagacaccaccacaatctagctgacttcgagccttggctcggatatgccactgaagggcaagtagttggtggtataccctttgaaaacactttggagagccctcagtttcgcccacaaccacaaccattgcattttgcggtgggaagagcccctcctgctatggccgaaaagggaaaggcggatcatctaaaggaaaggctcagggccattgaaggaggtgaagattatgcctttgctaacctagaaaagttgttcctaatacccaaacatggtcattcccaagttcaaggtgccggactttga

SEQ ID NO: 98406 - DNA, 693 bp, Glycine max
  Peptide Sequence Number=SeqID_215184
atgattcagttccatgagattgagagctttttaaagggtggaatgaatatcttgacggcacacagtcaagagtgggaacaagaattaagttctaactatcaatatgaagaagaaagaactcctaatcttgaaaagctactcaatagaaaactttcacgtgggaccaaagttacaaccttcctatcaaaatgcagcaaaagaggatccaatatggataaattgttgatgcaattcatggaaacaactaaatcaactcaacaagcactccaaagtgtagaaatccaggttggtgagctggcagaagcagtaactcaatttatgtccagacgagaaaaatcctttgtagaggctgaagctcaagagaaaagccctataaaagagcatgaatcaagagaaaaagatgaggagaaagatgatgaacaaacacaacaacaatgggagaagtactcaacagtagaaaaccaacaaggaaatattctccaaagcaataaccttcctcatcaactgattgacaagaaaggaaggcaaggagagcatgaggaaaccttaagtgccatactttctttaataactaacacatttcttgaaatgatttggaatgtccttccagattatatgaagttcatggaatttctagctaaaaggcgaaacttcaaggaagatgtgttctttgtgactttcatgccaccttaa

SEQ ID NO: 98407 - DNA, 1170 bp, Glycine max
  Peptide Sequence Number=SeqID_215185
atgggtagtttgattctgacacgaaaatgtggtttcagggcagcagaacagttggtgggtattgaggcagacaatgctaagttcactccttcgaatacgaggttccatcgtgggagttcaagcattcgccgcaagtacaggacacacgagaccgcggttaccccggtcgtgggtgtttcctatgatgccacacctgtgttggaggaggatgaacttgtagatggtgatttttaccttctggcaaagtcctatttcgattgccgtgagtataagagagctgctcatgttcttcgcgatcaaatgggaaggaaatcggtgttcttgcgctgttatgctctctatctggctggagaaaagcgaaaagacgaagagacgatagaacttgaggggcctttgggtaagagtgatgctatcaatcatgaattggtttctttggagagagagttgtcaacacttcacaagaatggccaagccgatcctttttgtttgtatttatatggtcttgtgctcaaacagaaaggcaatgagagccttgcacgtgttgttcttgtagaatctgtgaatagctacccttggaactggaatgcctggacggagctgcaatccttgtgcaaaaaagttgataccttgaatagtcttaatctcaatagtcattggatgaaggactttttccttgccagtgtttaccaagaattaaggatgtataatgactctctgtccaagtatgaatatctactaggaacctttggttatagtaattacatacaggcacaaattgccaaagcccagtacagtttgagggaatttgatcaagttgaagcaatatttgaagaactgttgaagaatgatccttatagagtggaagacatggacatgtattccaatgtgctatatgctaaggaatgttctgctagtttgagttatcttgcccatagagtattcatgactgataaatacaaacctgagtcttgttgtattattgggaattattacagtttaaaggggcagcatgagaagtcagttgtgtatttcaggagagcccttaaattggacaaaaattatttaactgcttggacactcatgggtcatgagtttgttgagatgaaaaacactcctgctgctgtggatgcctatcgtcgagctgtagatatagattcgcctatgagatga

SEQ ID NO: 98408 - DNA, 228 bp, Glycine max
  Peptide Sequence Number=SeqID_215186
atggcaccgatggggtcctcgtattgtgatggggtgaaccgtgtctacaacgcttggaggaaaccctgcctggagggcgcgcccctccatgtagaaggaggcgatggtaagcctatcgtgctcaggcgtggcgtggtattcgaagaattggttgatcttaaagatccaaccaaggggttcggtgccatcaaaccgggggacatcgagtttcaagcggtgaggggttga

SEQ ID NO: 98409 - DNA, 987 bp, Glycine max
  Peptide Sequence Number=SeqID_215187
atggttcaggcggcagacctggctaggcttcaggaggagaagcttctcgatgcgcattctctaagccgtgctcgacaaccctccacccttgtcgtgccaccccacggcccctatcctgatgaagaagacgcaaccttaaatgaccctacccaattggagcggccgcctggcccacttgataccactaacccgactcaagcccagattacactccactctctttcgggtcatttggcactaacatcatcgccgacgcgctctctcgtacccccctattcatcctcagctacattgttagttttggcggtgccatgtttgacatttttagacgagcttaagaaacatctcatccgtgatccccaattcatccaactccggcgagacattagtgctcaaccagctgattatttggattactccattgcccaggacttgatcatgaaaggggggcgtatatggttgcctcagggatttcaattcatccccactttgttagctgagtatcatttgacagcctccagcggccacatggatgctgctaaaatggtggcacagttaatagaaaatttcacctggcaaggacttcgaaaggatgtggagaacttcgtcaaggcctgtgtggattgtcaacatgccaaatatgaaacaaaaagggtcgtcggcttactttgtcctttaccagttcctcattacccttgggaggatctctcgctggatttcatcaccggcttacctccgttccgaggaaacaccacgattctggtggtggtggatcgcttctctaaaggcatccatttgggcatgttacctatgtctcattcagcccttactgtcgtgatattattcatcgatatcgtcagaaagatacacagaatgcctcggagcttggtgtccgatagggatccgcttttcccgagtcacttttggcaggtgctattccgcttgagtggtacccgcctgaggatgacctcagcatatcacccttaa

SEQ ID NO: 98410 - DNA, 3945 bp, Glycine max
  Peptide Sequence Number=SeqID_215188
atggagaggggaagcatcaacagcgaacagagactacagtcccttgagcgtcgcattgaggagaaggagaagcaactcggctccgttaaacgccaactcggccgcgaaatcgacgccaaagagagggaatacgacgtcgttcggaggagtgtcgaagaacggaaccgagagttggaagccaagaccaaccagttggagtccgtacagaggaggatcagcgaatgcgacagggaactgaggctgaaggaggaagaatgcaactggaaactcgacaggatgcaccgcgtgatcactgagcgccaagagctttaccagaaaacgcagagggacattcaggatactgaccgtgaactcgccgagaaggacgcgcgcctctgtttgatcgtggacttgattagagagcgagagcaagagttgagggccaaggacgccgagttccatcagctttacgacagagttcacatgatgcaagacgatgtcaggactcttaccaacaaagtcgctgaacgcaacgaggagcttaggaccaaagaggaagagcttgatgtggtgcggaggttgattaacgagcaaggcagtgacaccgtcaagtccatgcgtgcgaggattaatcagcttcttcgcgaggttcgatctagcagggaagagattgtttctctcaactgcttcatggagaaaagaagtctggagtttgaaaagaaagagaaggatttcgaggcaaccaggaataagtttgaggagatagtcagggagttgcagtcaaaagataagcaatatgaagtaacagggaaggagcttgagttaaaagaggcacggtttaaagtgcaattgaaggattttgagtctaaagagaagcgctttgaaggacaaatgaaggatcttgggttcaaaatgaagcaatttgaatggaaagaggcacggtttgaagggcaggtgaaggagctcaagtcaaaagagaagtgggttgaagaacaaatgaaggatcttgagttcaaaaggaagcaatttgaagggaaacagaaggagcttgaattgaaagaggcacagtttgaagggcaggtgaaggagctcaagtcaaaagagaagcagtttgaagaacaaatgaaggttcttgaattcaaaatgaaggaatttgtagggaaacagaaggtgtttgaactgaaagaggcacggtttgaagggcaagtgaaggagcttgagtctaaagagaaggggtttgaggaacgagtgatgaatcttgagtcaaaagagaagcaatttgaaggtcaagcaaaggagcttgaatcaaaacagaagcgttatgaaggccaggtaaaggaactccaatcaaaacagaaccaatttgaaggactggtacgtgcacatgagttgaaagagaagcaatttaaaggagaagtctgggagcttggttctagagagaagcaatgtgaaggaagactgaaagagcttgagtcaaatgagaagctgtatgaaagaaaagtcagggagcttggttctagagagaaacaatatgaaagaagagtaaaagagctcgagtcaaatgagaagctgtatgaaagaaaagtcagggagcttggttgtagagagaaacaatatgaaagaagagtaaaagagcttgagtcaaatgagaagcagtgtgaaagaagactgaaagaggttgagtcaaatgagaagcaatatgaaacaaaagtgaaagaacttgtttcaaatgagaagcaatatgaaaaaagagtgcttgagctcaaatcaaatgagaaacggtttgaaatacaagtgaaggggctcgagtcaaaagagaagcaaattgaaggacaaacgatggatcttgagtccaaaaaggatcaatatgaaggacaagtgaaggagcttgagtcaaaagaagcacggtataaagtgctacatgaggagctcgagtcaatacagaagcagattgcagggcaaatgaaggatcttgagtccaaaaagaatcaatttgaaggactagtgaaggagtttgagttaaaagagatacagtttaaaaagcaactgaaggagctcaagcaaaatgagaagccgtttgaaggaaaagtaaaggattctgagtcaaaacagaatcaatctgaatcattaagaaaatcatttgaagaggaacaagtgtcgaaacagaagtccaatgaccaacaacagttcacagatgccaacagttcaaacaacagtgcaaatctctttaaccaacaacatcttacagatgcagataatagcaagaatttacttttgttcattaatcttttggaaaagtatgagttgatgtgtagtcaagtctctaatgctctccaaacatttgctaaccctactaagctggtgctagatacaataaaaggtttttacgcttctcattcaaggcaagaacttattgaatatggtgccagtatctcaaggagaatctgtaatcttttaatggatgaattaaagaaatcttcgccagtgattgggattcgtgttaagcaagaagcaaagaaattggcaagtcactggaaggcaaacttagttgtgggtgataaggattgtttggaggttctggacttttttaagtttgttgctacttatgagattggttcatctttcgatgcaattgagcttcagaggcttctagatataatttccctgcaatatcaaactctgcatgcccttggtaaaactgaagaacctccagataatcaatcgagtcccaccattgatggaagaaatttgcagtttccctatattgagcacacaaatgagtttattagcgccaacatgttagttgatctccatccatcatcagatccagcaaaagttgttttggatatgattcagatccctattggttcagagaaaaagggaggcgaaggtgttattatcattgatgagagccacatctttctgttggaacagttgatgagaatctcaccacgggtcaaaccccatgtaagagaggaggcgcagaagatagcattcaatttggaagcgaacatcagagaaagtgctgaaaactctttgacaattctgggctttctatatctattgtccatttatggattggtttctcattttaacaaagatggactcttaaagctctttgaatctgctgctcagcacaagcaagctgtagagctgtttcggactcttggttttgtggataaaatctttgattttgttcagaatcttattatgaagcagcagcacatagtagctgttagattcatttgtgcatataagttggccgacaagatccaaccagttgatctcttgcgacaacatatggagaaagtaaagtcggtcaccaagaggtttgtttgcaaaaaaaagtccatcgaacaaaagcttaaggccagggatgaagaaattgctagtctgggaactgttctaaagtgcatttcagagaacaacctagaatctcaggatctagttaaagagattaatgaacgcattgttgatctagagcagcagaaggaaaatattgttcgttcagcctcaggaccttcctccaaagttgaagtgcagcaacctgaagaaaagacatgtgctggagaagcagtcacccaattgcaaaaggctggagaaaagcaatgtgacaaggaagcagtgaccgtaaccgtgcacaaacctgaagaaaagaaacgtgatactggggtactcctccccattaataatcagtggggcaacatcagcaaacgtcctcggacagctgtaactcaccctcggttcactccttctccccaataccagcgtgtgtttatgcctgtgcccggtgccccgcagtttggtttacccgcagcctactttgttcctgctaattctatgggtgtggctcggtctggaaacactggaacacattactgtgtttttgctgcaaagctgtgcatatggaattcatttatcggaagcatctccaaccgtgcttatctcatggtggagtttgcttaa

SEQ ID NO: 98411 - DNA, 984 bp, Glycine max
  Peptide Sequence Number=SeqID_215189
atgaattttaacaatgtgaatgtcccaaaggttcctggtggcggagtcgctgctttgcttaaagttagcattattggtgggcttgttgtttatggggctgcaaacagcttgtacaatgttgagggaggtcatcgagccattgtcttcaatcgtgttgtcggtgtcaaggataaggtttatcctgaagggacacatattatgattcctttgttcgagaggcctgtgatctacgacgtacgtgcacgacctcatttagtagagagtacatcagggagccgtgatctccaaatggtgaaaattggactcagagtccttacgcgccctgttcctgaccagttaccgacagtttatcgaaccctgggtgagaattataatgaaagggtcctgccttctattatacacgaaactctcaaagctgtagttgcacagtataatgccagccagctcattactcagagagagaatgttagtcgagaaataaggaagatattgactcagagggcgtcccaatttaacattgctttggatgatgtgtcaatcacaagtttgacgtttgggaaggaatttacagcagctattgaagccaagcaggttgctgctcaagaagctgagagagctaaatttgttgtagaaaaagctgaacaagacaaacaaagtgctgttattagagctcagggtgaagctaagagtgcccagttgattggtcaagctattgccaataatcctgcgtttatcaccttaaggaaaattgaagctgcaagggaaatcgctcagacgatttcaaattctgccaacaagctaaacgacgtcgtggtggagatgttcttctggaggggaagcagtaaccagcttcaatctactccttcttggtacgtgaatgatgatcaagacattcgcaagtactttgctgccttccacctgtatgatgcattgcctgcagctgttcttattgatgatttcggagatttctttgacgacaagtga

SEQ ID NO: 98412 - DNA, 603 bp, Glycine max
  Peptide Sequence Number=SeqID_215190
atggctgccgctgataacaccaacccaaaggattattacaaagtgctggaggttgaatatgatgcaaccgatgaaaatatcaaattaaattaccgaagactcgcgttgaaatggcatcctgacaagcacggaggtgatagtgctgttactgcaaaatttcaagagattattgaagcttacaatggtaaaaaaattccatacttttgcttttttcttgattgtcgacttgcctacttgagcattgctggcaaactcaaaattgattctgtaatggaaattactttaaactttataaataggtctgtaagtggtacttcttgtggattattttactccttagcaccacaagtattaagtgatcctgccaagcgtttggactatgatttaactgggatatgtgagattgaaaaatatagcttgcaggaatatcttgccagatttaaaagcatgattcttacctgcaatggacttggtatcaatcagacagacagatggatgcaactcgacgtagatgtgctcaaggagtatgataattttggtcgccacagctttgatgtgatactttgtaatcaatctcagatccgaaccaccttgaacagttga

SEQ ID NO: 98413 - DNA, 369 bp, Glycine max
  Peptide Sequence Number=SeqID_215191
atgcttgatgatgcaataaagtgttacaaaagggcagtaaattgtaatgacagagaagcaattgctctgcatcagctagcaaagctgcactcggagctagggcacactgaagaggctgcattttactacaaaaaggatttagagaggatggaatctgaagatagagaagaacctacaatgattgaggctttgctctatcttgcaaaatattacagagaacagcaaaaatttgaagaagcggatgtttactgtacacgtcttgtggactatactggcccggagagagaaacagcaaaaagtttacttagaggaatgcaattaacacaatcaagtttcccttccatggatgttgagcactttcctccctaa

SEQ ID NO: 98414 - DNA, 855 bp, Glycine max
  Peptide Sequence Number=SeqID_215192
atgaggatctatagagttctttctcaagaactggatcttcaacatgaagattttaagggatcttttattgctgctacgatatgctgggggattggaaagcctataacggtggaagagatacaagtagacccaccaaaagcaaccgaagttcgtgttaagatgctctgtgccagtatatgccacacagatatctcaagcaccgaaggattcccacatggcaagtttcctctagcacttggacacgaaggagttggagttatagagagtgttggtgatcaagtcaagaatctgaaagaaggggatgtgaactgtgtttcagaaaaaaccaatttgtgtctgaaatatcctgtaatgtggaccggtctaatgccagataacacttcaagaatgtccatccgaggagagaggatataccatattacaagttgtgctacatggtcagagtacatggttagtgatgccaactatattctcaaagttgatccaaccattgatcgagcccatgccagtttcatctcatgtggcttttcaactggctttggagctgcttggaaggaagccaatgttgaaagtggatccactgtagctgttttcggtcttggtgctgttggattaggggctgtaattggagccaaattgcagggagcaagtaggataattggaattgacacaaatgagaacaagagagaaaaaggagaagcttttggaataactgactttataaatccgggtgattctgataattctgcttcagaattggttaaggaactaactggtggaatgggtgtggactattcctttgagtgtactggagtttccactgtactcactgaatccttggaagccacaaaaatt

SEQ ID NO: 98415 - DNA, 210 bp, Glycine max
  Peptide Sequence Number=SeqID_215193
atgaaacttggggttaccattcaatttggaaatcctgcacaagacgccattgaaccactgatggaggctttggaggaagattataaagatggaaatgggatgaatgaatcacaacagtttattgaaggagtaatggatcttgaagagagaatcaatagatcggagacaatgactaagaaattaaagatagcaaaatttggtccctattga

SEQ ID NO: 98416 - DNA, 219 bp, Glycine max
  Peptide Sequence Number=SeqID_215194
atggaacaaactgggctagtagcctacaagcttcgtctaccagagggatcccgcattcatttcatcttccactactccttgctaaagccctttcatggagctctaagcggcgatcctcagttaccattgtcggacaccgccatagataatcaacctcttattactcttctgaccattgtggactctagatgcttgttggattcctctacaccaaaatag

SEQ ID NO: 98417 - DNA, 180 bp, Glycine max
  Peptide Sequence Number=SeqID_215195
atgaagatgcaagcaagtagtacacacgtagcagaaagtacacaagtgctcaaggttaggaaggtgcagaggtttgggtgcaaagccaaccaattaggggtcttgtgcttagcgcgagcaagctcagacttagcacgtgaagacagagcgcttagcgcaaggtctgcgcttagcggatag

SEQ ID NO: 98418 - DNA, 228 bp, Glycine max
  Peptide Sequence Number=SeqID_215196
aatccattaagtgaaaagaaacaaagacgtgtctggttgacaccgcctttgaagcatgttggagacaacgatggggtcattgtcaggtcggtagttggacccaggaaggaggccgaggaatgcgcacaggagcctgaggagcatccaatggactttgaacaccgtcagtcaaaaaggtatatggaatacatctactcacttatatgttcaaacatggagtacatctaa

SEQ ID NO: 98419 - DNA, 333 bp, Glycine max
  Peptide Sequence Number=SeqID_215197
atgaacaacattacacacttgtctgctcgtttgctacatagtagcagtttcccgttctcatctcttacaattacaggcgtccgccttgttgtactactaaacactgttgtaataatttcatggccaaacctaaaggatgagaaatccacaacggggaagcagggactaggcatcaaggacagacccaagaaagtagatggctgctattttcaggattttgctgataacgattccctggaacaaccagcaaatgatgacataattaaagtagaaaagattattgaaggtgtttggagaatcattgaaactgaaatagctcaaagttcttattga

SEQ ID NO: 98420 - DNA, 310 bp, Glycine max
  Peptide Sequence Number=SeqID_215198
atgaaattgaataaggtgctgctcgccgcgtccgttgtaatggggatgtcctcttttgctcatgctgccgaccaggggcacggcaaagtgactttccacggctctatcattgacgcgccgtgctctatcgacactaaatcaatcgaccagaaaattgaactgggctctatctcaaacgtgctgctggccagcggtggcaccaccacgccggaaccattccagatcctgctgaaagactgctctctggacactgcgaaaactgtgaccaccacctttagcggtatggaagggactgctgctggcacgctgg

SEQ ID NO: 98421 - DNA, 1133 bp, Glycine max
  Peptide Sequence Number=SeqID_215199
ctatcctgagggaaacttcggagggaaccagctactagacggttcgattagtctttcgcccctatacccaagtcagacgaacgatttgcacgtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtctttcatctttccctcgcggtacttgttcgctatcggtctctcgccagtattagccttggacggaattaccgcccgattggggctgcattcccaaacaacccgactcgccgacagcgcctcgtggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacg

SEQ ID NO: 98422 - DNA, 159 bp, Glycine max
  Peptide Sequence Number=SeqID_215200
atgccctgggcacaaaattccacagcacaccacagtgcctatttcgggaatagaactctggaggcagcaagcagagcaacttttgcagagatgcctaggtttttaatgttgtttagtctaagtttagtccaacaagagggatctaaggacaaagcttag

SEQ ID NO: 98423 - DNA, 247 bp, Glycine max
  Peptide Sequence Number=SeqID_215201
gcaccaacatgaccactcttacccgaatgtggatgaacgttgctacttagcaacattctgcccagcgaccaccactctgatcccccctgccaaagtgccagctggtttatgccatcatgacataaaatgtccgtcacccccaacaaggttattagtcacccctattaatagggctttcatcgagaagtattgcacccccaggcaggcgcaggtcgaggcaccacaacagcctggggatgaccagtag

SEQ ID NO: 98424 - DNA, 186 bp, Glycine max
  Peptide Sequence Number=SeqID_215202
atggtcgaccagcaggcgaccaagtccaaagccaaagctcaagacgttaaagaagcgctactaggaggcaacctagaattggctacgaagaagctccccgcgaagtggtccaggaagggcaccattgaagagggttccagtgcggccccacaagccgacataggctttgacaaacaccgatcctag

SEQ ID NO: 98425 - DNA, 399 bp, Glycine max
  Peptide Sequence Number=SeqID_215203
atgggtcaagactcttggtcggtggtccgcaaccatctacttaaagaacttgccaatttctcagaagactgtatcaagctctttggtggcacggagagatttgaggaattaagaatgtcactacttgttgatgggttaaccaaggtgacaacggataagtggatggatataacggacatgagacatgtcattgcatcaaggattgagttaacatttttttcgcatacacaaaaggtttatttaaaagaacgttgtcccttaccgcctgtatcattgttatggtctagcaattgtcatccgcaagcgaagtcgtggccaaatccatatattagcagaatgcagcattacaagagcttcgtgatgttcaagagagactatgttgacataaatgatgattga

SEQ ID NO: 98426 - DNA, 324 bp, Glycine max
  Peptide Sequence Number=SeqID_215204
atgttgtgtcgtgacgactcccgcgggacaccgtctccgggcccccgggagtcgcacttaacagatttgagttccttggcgcacgaagcgccggggtttgtgtttgtcgcgaggacgaggaggccggggcgcacggggcgccgtggtcatcccctccctcccgacggttcagtggacttctcacaacgtcgcgggcagcgaacccgctcacgtcgccgcaatcccgaacacttcaccggaccatttcaatcggtaggagcgacgggcggtgtgtacaaagggcagggacgtagtcaacgcgagctgatgactcgcgcttactag

SEQ ID NO: 98427 - DNA, 629 bp, Glycine max
  Peptide Sequence Number=SeqID_215205
ggctacatgtcctcgccttcagagggctgcacaccctcgccttcagagggctacacgccctcgccttcagagggctgcacgtcctcccctacagagggctacacgccctcaccttgagaggactgcacgtcctcaccttcagagggctacacgtcctcgcctttagagggctacacgtccttccctttagagggctgcacgcccttgccttcagagggctgcacgccctcgccttcagagggctacacgccctcgccttcagagggctacacgtcctcgcctttagagggttacacgtccttgcctttagagggctgcacgccctcgccttcagaggactgcacgtcctcgccttcagagggctacgcaccctcgccttcagagggattgcacatgctcgccttcaggggactgcacgactgcatgccctcgccttcagtgggctacacgccctcactttcagagggctccatatccgcgcctttagggaactcaagttcctgtgccacccccctgatctcggaggaaggtcaactgtgcgagcacaatcagaggaggaggagactagtgctaatcctgcgcaccaacatgaccactcttatgcagatgtggatgatgttgctacttag

SEQ ID NO: 98428 - DNA, 534 bp, Glycine max
  Peptide Sequence Number=SeqID_215206
atgcctctggctttgatgaggaggctatcacccagctgctatgcataccagggcaagacttcgcccggaccgccgttgggagacggggattgcacctacaagacaccctgtggacccggagaagtccaacagggccctggggtttccgctctgattacgggcctctgtcaacttaatggagtgcctgtcgcccccagcaaggtcatccgatcgcctattaatagggccttcattgagaaacactgcacccccaagcaggcgcagggccaagcactgcaacagctagaggaggaccaacacccagctgcagatgcgccaacgccacctcaagaggaggtatcatctctaaggtccatgtccgatcgcctacagagaatagaactccagatgcacagagtccggacaccagtcctttcccttggcccacccccaagaagttcgaggccacagtggcttggcttggggactttcggaggtggagacgaagcccaggaggatgaggacatggctgacatgttggacttcctcctgtga

SEQ ID NO: 98429 - DNA, 141 bp, Glycine max
  Peptide Sequence Number=SeqID_215207
atggatgaagaacgacagagaacgttcatggaattggtcacggaaacgtcacggaagcgttacggaaccaaaataggggaggagcttgccgcccagctcgcccaggtgagctcaggtcgcctcaacgagatggtggcttag

SEQ ID NO: 98430 - DNA, 792 bp, Glycine max
  Peptide Sequence Number=SeqID_215208
atgctgcacgccctcacctttagaggactacacgtcctcgccatcagaggactgcacgacctcaccttcagaggactacacgtcctcgccatcagagggctgcacgccctcaccttaagaagactacatgtcctcgacatcagagggctgcacgccctcacctttagaggactacacgtgctcgccatcagagggttgcacgccctcacctttagaggactagatgtcctcagcctcagagggcaacacgccctcacctttagaggactacacgtcatcgccataagagggtcacacgtcgtcaccttcagaggactacacgtcctcgccatcagagggctggatgcccacacctttagaggactacatgtcctccccatcagaggcctgcacgccctcacctttagaggagtacacgtcctcgcaatcagaatgctgcataccctcacctttagaggactacacgtcctcgccatcagaggactgcacgacctcacctttagaggactacacgtcctcgccatcagagggctgcacgcccacacctttagaggactacatgtcctcaccatcagagggcattacgccctcacctttagaggactacacgtcctcgcaatcagaatgctgcacgccctcacttttagaggactacatgtcctcgacatcagagggctgcacgccctcacctttagaggactacacgtcctcgccatcagagggtcgcacgcctttacctttagaggactagacgtcctcaccctcagagggcaacacaccctcatcttttga

SEQ ID NO: 98431 - DNA, 474 bp, Glycine max
  Peptide Sequence Number=SeqID_215209
atgatgttgtctatgatgatatcgggcccaagacagccaggaaatgacatttatgtttatctaagtctattgattgaagacctcacaaagttgtgggacaagggggttttagtgtttgatggctttcgcaagaagacttttcaaatgcgtgcaatgattttttgtaccattaatgactttccagcatatgggaatctaagcggttacaatgttaaggacatatttgaacaggttcaacccattgatgatgaaggaaacttaccagttggagagaattcctctcttcttcagagaattttggacacgttcgatggtcttcaaacctatgttggtgaaaggtttgatgctttggaattacaagtggacatgcgattcgatgagatggactcaaggatcaccaaggttgaaggagatgtcacgtacatccgcacatgctttgatctaccaccaccaccaccacccccatcatcttag

SEQ ID NO: 98432 - DNA, 207 bp, Glycine max
  Peptide Sequence Number=SeqID_215210
atgacgttagtctctgcatgctatcgtgctctaggtctgatggatagcaaaagtgtttctacggataaccacttgggtatttccgcctgtcccctaacttcacggggccagtgtgacagaaattgcagggcggttgacaaaagcgaggctcttgctcctacgtatcctcaacttatgatgaggaactcagaaaaacgtagttcttga

SEQ ID NO: 98433 - DNA, 261 bp, Glycine max
  Peptide Sequence Number=SeqID_215211
atgggtgccaagtacctcgaagtggtcaaacgagggtcgcatcccaacaacggatggtccccagacgaaattagggcgcagaatgaccataatgtgtctctgcatgtctttggagacgatcgagcttgggtggcaaggcgcagaatgaccataatttgtctctgcgtgccaccagacatgatcgcctctggatggcgaaaaggtgtggggaatgaccataatttgtctccgcccacctctcgacttactgcccctgaatga

SEQ ID NO: 98434 - DNA, 352 bp, Glycine max
  misc_feature (21)..(21): n is a, c, g, or t
  Peptide Sequence Number=SeqID_215212
gctcaaggccattgaagaagncagagatcatgcttttgctaacatggtagagttatacctagtgcctgacgtcgtcatccctctgaagttcaaggtgctagatttcgataaatacaaggggaccacttgccccaagaatcacctaaaattgtactgtcagaagatgggggtgtacatgaaagatgaaaaactactggtgtatttctttcaagagagccttattggggcagtcgtcacatggtacactaatcttaaaacatcccgagtccattcttggagggacctaatggttgccttcattaggaagtatcagtacaattttgatatggctccggataggatgcaactttag

SEQ ID NO: 98435 - DNA, 264 bp, Glycine max
  Peptide Sequence Number=SeqID_215213
atgacggagaaagagatgatcacaatgatagtaggcacgttactggtgttctactatgagaaaatggtgggttacatgccttcaaactttgccgattttgttttcaccgacaaaaggattgaagtgggtttgagaagaggcaaaattgattatcttgctttgatggatgagaaagctagggaaaatgaagagaatgagaaggagggaggaacccatgccgcgactgacgttcctacatggccaaatttcccaccagctcaataa

SEQ ID NO: 98436 - DNA, 237 bp, Glycine max
  Peptide Sequence Number=SeqID_215214
atgatgagagagtacagagctcaactagatgctgaaagggctcggaagctttcccaaggaagaaatcactctagtagtaagtctaaacatgcgaaagcatttttcctgatcccagcttctaatgagactgcacattctaacttgcagataagagggacaaaatttcaaggaagcacagcagcagaaagagaaaggtgctttttaatttctgagacatttatgtttttccagagatga

SEQ ID NO: 98437 - DNA, 982 bp, Glycine max
  Peptide Sequence Number=SeqID_215215
atgttcgacacgcatcagcgcagcgtctttgcaacgggcccgggaagcgaggtctatcagctcatccgctttgcctataccacggaggaagatctgcagagcttcaataacgaaaaccaggtctccaaaaccgtggcgctgggcgactgggcacatcacctgctggccgggtttgactatcagaagctgaactcccaattccactaccggtatgcgacggccacgccgggtatcgatatgcgcgatcctgactattcgcagatccatgaaaacgcgctggggctttataccgcccagaaaaaccgtctgagctatcagcagaacggctattacctgcaggatcaggtcgcgtttggcggcttaaatctgctggccagcctgcgctacgatgattatcgctccgttaccaccaattacctgcagaacggcgacaaggcatgggtatcccaggatcgcgtcactaaacgtctgggcgcgctttacgctttcgataacgggatttcaccgtttatcagctattccgaaggttttgcgccagtgtcgccaaagggaacgctcacggcgaaagaggtgaaaccgaccaccagcaaacaggtggaaggtggggtgaaatacctgctggccgattatgccaccaccctgacggcgtcggtgtttaacatccgtcagaaaaatgtcgtcacctccgatccggggttcctgaattacagccagaccggtgaggtggaatccaaaggggcagagctctcggtcgtcagccgtccgacggataatctgacgctgattgccaactatgcttacacccacgcaatcaataccgaagatgataagtaccagggcaaacgcccgacgcaggtgccggagaatgcttttaacctctggggagattacacctttgaaaacacgccgctgaaagggctgatgctgggtgcgggggcgcgttacactggctccatggagatttcaccagctaacgatgcgg

SEQ ID NO: 98438 - DNA, 339 bp, Glycine max
  Peptide Sequence Number=SeqID_215216
atggagaaggtagcctggccaggaactcaaccttctcttgtgaggaaaggtggaggtcccagtgctcaggtaccacaacaggtagatcatgcatctttagaggccacaatccctgagccatttgtttttaaggaaggagggacacagcagctagcagaccctcctacaccagtgcatgagatgccagcagacccttctactccattattggagattctagaggacctttccacactagtcttgggactgactaccactcctccagccactcctatgctacattttatagatgaggagggcactcaggatcaggatacccagcaggatgaccagtcatag

SEQ ID NO: 98439 - DNA, 447 bp, Glycine max
  Peptide Sequence Number=SeqID_215217
gctcatgagaaccctagggccttcacttgcatctttggcccaatcttcttggagtcttctatccgagaaatgctaggtgcacccagcaatattgcagaccatttcctgcttcttttcttcttccaattcctgctactcctccgtgacaccgcgagccaagcttcttcttcttctccgcaaacgagccttcgagtagaagacgccgaaaaaaatggggaaagggggctcacagtggaggctttcggaagacccgttaggagttcttccgaaacttccggaaacattccggaagaagtgttcttccggaagcaaccaaacgtcttccggaagaacacttcttccggaagtctcccggaacacctcttccggaaactttccggaagaagtagttcttccgaaagtattccggaagaagtgttcttccggaagaagggttcttccggatga

SEQ ID NO: 98440 - DNA, 812 bp, Glycine max
  Peptide Sequence Number=SeqID_215218
ggcgtgtagcccttcttaaggagaggacgtgcattcctctaaatatgaggacgtgtagtcctttgaaggcgagggcgtgcagccctctaaaggcgaggacgaatagtcctcaaaagttgagggcgtgtagccctctgaaggcgatgacgtgtagtcctttgagagcgaagacgtgtagccctctgaaggtgaggatgtgtagtcctctgaaggtgagggcgtgtagccctctcaaggtgaggacgtgtagtcctctaaaggggaggacgtgtagttctcttaagggcgaggacgtgtactcctctgaaggcgagggcatgaagccctccgaaggcgaaggcgtgcagccctctgaaggcgaaggcgtgtaccctctgatggcgagggcaaacaaccctctaaagatgagggcatgtagccctctgaaggcgagggcgtgtagccctctgaaggcgaggacgtgtagtcctctaaatgcgaggacgtgtagtcctctgaacgcgaggacgtgtagtactctaaaggcgacggcgcgtagccctcagatgacgaggacgtctagtcctctgacggggaggacgtgtagtcctatgaaggcgagggcgtgcagccctctgaaggcgaggacgtatagtcctctgaaggcgagggcgttcaaccctcagaagtcgagggcgtgtcaccctctgaaggcgaggatgtgtagtcctctgaaggcaagggcgtgtagccctctgaaggagaggacgtgtagcccattgaaggtgaggacgtgtagtcctctgaaggtgagggcgtgcagccctctaaag

SEQ ID NO: 98441 - DNA, 909 bp, Glycine max
  misc_feature (78)..(78): n is a, c, g, or t
  Peptide Sequence Number=SeqID_215219
atgacattcaaaatcatcatgagcttaagccctttttctctattgtctcttctttctaatatagaaataactaatggncatattgatagccaagatcccataaaagagttttatgtactccccaaaggccctgttccaccagaaggccaatcaaatcatttgcaccgtgttctacctcatccttcatccaactctaatagtgatgcttccaatattaaatttttccaaattcctagacgtgttgtcaacaaccttacaagtaaagggtttcatgtactccccaaaggtcctgtttcaccagaaggccaatcaaatcatttgcacagtgctccacctcatccttcatccaactctaatagagatgcttccaatattaaatcttttcaagttcctagacgtgttttcaacaaccatccaagtaaagggttccatgtactccccaaaggtcctattccaccagaaggccaatcaaatcattcgcaccatgctctacctcatccttcatccaactctaatagtgatgcttccaatattaaatttttccaaattcctagacgtgttgtcaacaaccttacaagtaaaaggtttcatgtactccccaaaggccctattccaccaaaaggccaatcaaatcattcgcacagtgctccacctcatccttcatccaactctaatagtgatgcttccaatattaaatcttttcaagttcctagacgtgttttcaacaaccatccaagtaaagggtttcatgtactccccaaaggccctattccaccagaaggtcaatcaaatcattcgcaccatgttctacctcatccttcatccaactctaatagtaatgcttccaatattaaatttttccaaattcttagacgtgttgtcaacaaccttccaagtaaaggattccat

SEQ ID NO: 98442 - DNA, 532 bp, Glycine max
  Peptide Sequence Number=SeqID_215220
ggtttgtacttttgacgatttactgccatgtatcgagaagatcactcttttgtctgaagaagaggataggatacttgaggcacatgaagatgctcccccttctcagccacaatttgaacatcaacagtttaatatactacgacaaagtgtggagactcgaggcttagcgcgacgtcgggaaactgttgatgcagcaacatatagtttgcctccgatgccagaacgacaacatggaatgtattacacaccgccgacattcacccaagaaccgcctcagatgccgccgatgtattcatacccacatgattttcaactagggtatagttttgcaggcatatttgggtcctctccttcttcaacgggaactccttcatttacccaaagtggtcaagtatcgaccccaaatgccccacttactggtctgtggaatgtacctggagatatacccgacatggacgacttattaggggtcgatttacgtcatgatttctctgccgaggctgaccaagtggatgaaaagggcgaatcctag

SEQ ID NO: 98443 - DNA, 474 bp, Glycine max
  Peptide Sequence Number=SeqID_215221
atggctattatgtattcaaggtgtgctgacattgatgaggcacaagcattgtttgatggggtgagggtcaaagctgtgtctacttataattccatgattggaggattggctttgcataggaagagcattgaagcagttgtgttgtttagtgaaatgcttaaggagagggttaggcgaaatggtataacatttgttggggttttgaatggttgcagccatggagggttggtcgatctgggtggtgaaatatttgaatcaatggaaatgattcgtgggattgaagcagaggaagaacactatggttgcatggttcaaattctcgttgcagtgaaaggcatagcttctggactaggactagaacatgctattgtgcacgaaggaaaaaaagttacaaatttgaatgaggaacctattagacaaagtggatcatcccatgtaatggcaaacttgcatcttgaagacaaacttctatga

SEQ ID NO: 98444 - DNA, 183 bp, Glycine max
  Peptide Sequence Number=SeqID_215222
atgcaaaacggggtgggaaacgcaaaagaatggtgtcctaggagtgaaggatggccaatctcgtgggtgatggcgctcttgagtgaaagggagaagttttggggcctcctcaacgtgcggagccagtcgcgggatgatgatctgctgaccaccaacctaatgcttgctcatactcgtccctga

SEQ ID NO: 98445 - DNA, 214 bp, Glycine max
  Peptide Sequence Number=SeqID_215223
ttttgtccatctgagtttggaaatgatgtggaccggactcatgcagttgaaccagccaagtctgcatttgcaacaaaggccaaagttcgccgagctattgaggctgaaggaattccttcacttatgtgtcaagcaacttctttgctgggaaagattgttaaaactcttgaaagaatctatgttccagaagaacaactcctgaagcaaattgaag

SEQ ID NO: 98446 - DNA, 465 bp, Glycine max
  Peptide Sequence Number=SeqID_215224
atggacctagtcaagtatatatttgaaaagcccgctctcaccggatggatcgctcggtggcagtgctttactaggggcaatccaggtgatttacaaccctttgatcctgaaatagatagaacctttcatagattagttaggcatggtgtgcatcctggtcattctatgcattttgagcattctgagcactctgttgagggtgattctgaatattctgattttgagcattccactactaattttcatactgagaacatggctcaacctccacctcgtgagaggactcttagggagatggctgcacctgatttcacttatgaaagcttgtgcatacaatatcctgatgagggtgttccagatgttctcaagactggactaatacatttgctgccaagtttcatggtcttgcaggtgaagatcctcataagcatcttaaggagttccatattgtttgttccaccatga

SEQ ID NO: 98447 - DNA, 496 bp, Glycine max
  Peptide Sequence Number=SeqID_215225
atgagtcctgcgaaggaagattgggaagtgaagccacaccaagaagaaatgaaaattgtaaacttgggtgttggcgaagaaaggaaagaggtcaaggttggcacgagcatgaccacacatatccaggatgaattggtggatctgctgcgagactaccaagacatcttcgcttggtcataccaagatacgcctgacttaagtcccaacattgtgcaacatagattacctctgaatctcgagtgttccccaataaagcaaaagttgcggaggatgaagcccgagatgtccttgaagataaaagaagaggtaaaaaagcagtttgacgttggcttcttggatgtggctcgatacccgaaatgggttgccaagattgtgccagtccctaagaaagatgggaaggtgcgaatgtgcgtggactatcgggatctaaaccaagcaagtccaaaggatgactttcctctatcgcatatcgatatcctcgtggatgacatggcta

SEQ ID NO: 98448 - DNA, 240 bp, Glycine max
  Peptide Sequence Number=SeqID_215226
atgaataaaagtgagttatcacaaacgagagtcattcgacttaatctgtcagttgaaaatcctttaagaggcactgtgcatgagcctcaagcaaaccttggggcaacaatagatacctcagagccctacactggagcaataagaggcactgtgcatgagcctcaagcaaaccttggggtagataagaagttcttacccggtaggtcgaaaacccaaaagggcagcctaagcaaatattag

SEQ ID NO: 98449 - DNA, 441 bp, Glycine max
  Peptide Sequence Number=SeqID_215227
gtgaaggttggtgttgaggaggttaaagatgcagaggcaatcgttcctgtacccactgatgaggttattttagtggggcaggcactgaacaccttccttgcttggccgatacatctcgtgaagcgtgtatcagaacaggcagttgtgtctccagcaaagcctccagataggccgaatcctgaggtcaatgatcccctgtatctgatgacattgaccatcccacaacttttcttgaagcctctgcaggttatgtgggatgctaccgtgttcagggtgtttaatccatacttcccattgtacatcaagcacgaagatctctccgaaattgcacacggtggtcaatgtctcatcatatctgttatacagttgtggattctgcatctgactgagacaagtatgcgagtggggaattccgatgtgtatggattcctcgagccatag

SEQ ID NO: 98450 - DNA, 1638 bp, Glycine max
  Peptide Sequence Number=SeqID_215228
atgccgtcgcgcagccccacattcggacccgttccgccccgcccacccggcagcggaagccgtcccgcccacgccatcgctgcctccgtacatccggagggtagccagccgccgccgaccagaggatatttacctccaggcggccccccgtcggcgccagcccaagctggcacacgggttgcttattcattcagaccggccacgcatggccggacaacggccgcgcccaagccggccgtcagcatctgcaacggaggagccatgaaggacagatcatcccgtcccgccgcctatgacgaaatgcgcgacagcgccggcggcatacgctcccactaccaggccttcgagcgctggcaccaggagcaatcggccgaagccatggcggcgcggcgcctggaggccgacctgagtttccggcgggtcggcatcactttttcggtggcgggcgacgccgccggcaccgagcgcctgatcccgttcgacatgatcccgcgcatcattcccgccgacgaatggcgccgcctggaggccggcctgaaacagcgcgtgcgggcgctcaacatgttcatccacgacatctatcacggccatgagatcgtgcgcgccggcgtggtgccggccgagcaggtgttcctgaacgcccagtaccgccccgaaatgcaggatgtggacgtggccgaggacatctactgccacatcgccggggtcgacatcgtgcgcgccggcgccggcgagttctacgtgctggaggacaacctgcgggtgccgtccggtgtgtcgtacatgctggagaaccgcaagatgtcgatgcggctgatgcccgacgcgttcagccgcatcaaggtcgaaccggtggcgcactatcccgacctgctgctggacaacctgcgcgaagtggcgccgcacggcggcgatgatcccacggtggtggtgctgacgcccggcatgtacaactcggcctatttcgagcacgccttcctggcgcagcagatgggcgtggaactggtggagggccaggatctttttgtcgagcagaacacggtctacatgcgcaccacgcaggggccgcgcaaggtggacgtgatctaccgccggctggatgacgacttcctggatccgttgtcgttccgcgccgactcggcgctgggcgtgccggggctgctgtcggtgtaccgcgccggccgcgtgacgctggccaatgcgatcggcaccggcatcgccgacgacaagtccacctatctctacgtgcccgacatgatccgcttttatctgggcgaggagccgatcctgtcgaacgtgccgacctggcgctgcggccgtcccgacgagctgtcgcacgtgctggccaacatgcacgacctggtggtcaaggaagtgcatggcgctggcggctacggcatgctggtgggtccgtccgcctcgcgcgccgaggtcgagtcgttcaaggatcgggtgcgcgccaaccccgccaactacatcgcgcagcccacgctggccctgtccacggtgccgacctacgttgaatccggcgtggcgccgcgccacgtcgacctgcgcccctacgtgctgtgcggcaaggacatccgcacggtgccgggcggcctgtgccgcgtggcgctgaccgaaggctcgctggtg

SEQ ID NO: 98451 - DNA, 990 bp, Glycine max
  Peptide Sequence Number=SeqID_215229
atgcctgatttctctcgtttacgtccgcactccagccagggctggctcgcctgggtgctgctggctttcatggtgttcttctcgctggccagcgatcagtttctgacggtgcagaacctgctggatctggcggaaagctatgccgttaccggcattttcgccctcggcctgtttgtagtgctggtgaccggcggtatcgatatctccttcgccgccgtggcgtcggtggtgcaatacctgatcgcctcgctgtttgtgcagttccagtttgataacgcgctgctcagcattctgctggccatcgtctgcggcacgctgtttggcgtgatcaacgccctgctgatcacatcgctgcgcgtggtgtcgatcatcatcaccatcagcatgcagtcgctgctgtttggtctgctgatgtgggttaccggcggcaaaagcctctactcgctgccggactggtggatcaccctgcgcagcgtgctgccgtttagcgtacagggcaacagttttcagattggcttaccgctggcgatcatgctggtgattgccgccctcaccgcgctgctgctcaacaaaaccaatctgggccgtcagctgtatgcggtgggcggcgatgcggaatcggcgcggcgtattggcatccgcgtgggattgattcacgtgtttgcctacggctggctcggagcgatggcggcgattggcgggctggtgcaggtgtaccgcatgggtgaagtagtgccgaacgcgctggtcggcggtgagctggatgtgctggctgcgacggtgctgggcggtgccagcctgatgggcggcaaaggcacggtcagcggcacgctgatgggcgtattcctgatcgccatcctgaaaaacggcctcaatctgatcggcgtctccaactacttcatgaacattgtggtcggcggcacgattatggtggcgattgccgtcacccactacaaaaaacgtaaagaaaccgacgtcagtttcgtctga

SEQ ID NO: 98452 - DNA, 579 bp, Glycine max
  Peptide Sequence Number=SeqID_215230
atgtttcttcatgtcggactcagccaacaagttgtgattgcgaagcataaaggttatgtgagtggtagcttgtcggatgaggggaaggttggacttggaggagattctggtaaatcagaaagttctttggagaaaggcatagttgatcgcagtgacgctttagatgttgatgctaaagtagataacatggcgaggtgtttcagaaccaaccagaggatactggtgagaaaggggaataaagatgaactaggtaaaacaataggaagagaacaggaggaacctcccaagttctctaattggccgaatgagagagaagtattgtcagcagccaaagtttccaaaaagatgaagctaaaatttactaaagaatggattgcatatcttagattgcctcttccaattgatgtttacaaagagattttgaaaccagcttttacaataatagctgatcacgagatgaaatgccttttgttattgattcgtggcacacatagtatcaagtacactttaatagctgttacaggaaatgtacgtggtaccatttcatcaaactatttagcattaaagcttttacaataa

SEQ ID NO: 98453 - DNA, 297 bp, Glycine max
  Peptide Sequence Number=SeqID_215231
atgctcctcaagaagaagggctacgatgggtgcaaggctcttctttctgggtatttgccctttcaagacatcatgaaggacccttggtttcaaattgggatcatgaggcccattgctttttccacgaaggagtctttcgttgaagataacattgatttcaacggggaagatgctcttaatgtgaattgtaataacagcaataacgataataggaaaatgattatggtgcatcattgtgggaaatcgtcttcgataacctgtggcagagtaacgggagagaagaagagaggtagctaa

SEQ ID NO: 98454 - DNA, 201 bp, Glycine max
  Peptide Sequence Number=SeqID_215232
atggttttgatcatggtgggattatactcctttttgtgggacaaaaacaatgagacaatgcgcacggctcaacaaccaattgtagcggctgcagaaatatcaaatgttactgattttcctgctagagcagaatcaattgccacaatagtgacaagttcttcacgtatgaattcaatagttctaaaacttgaaaagtcttga

SEQ ID NO: 98455 - DNA, 180 bp, Glycine max
  Peptide Sequence Number=SeqID_215233
atggagaaccaccgcatagtcctgtacgtgttccacctcaatctcagccataacctagtggtggttagatcccagattatgtaccaggtgttatttacacctgtcagcttagttgaggagcgaccgccgccgaagaaagagaacaaaggtggcagaagaggtggccgcaagggcacttga

SEQ ID NO: 98456 - DNA, 105 bp, Glycine max
  Peptide Sequence Number=SeqID_215234
atgagtttttgtcacacttttcaagttccagctagacctactaaattcataggtgaagaacttagcactactgtggccattgattctgcccgagcaggcaaatga

SEQ ID NO: 98457 - DNA, 543 bp, Glycine max
  Peptide Sequence Number=SeqID_215235
atggagtatgcttctggaggagaactctttgagaggatatgcaatgctggtagattcagtgaggatgaggcaagatttttctttcagcaattggtatcaggagtcagttactgtcattcaatgatattgatagttaaaggaatgtctatgcagcaaatttgtcatagagatctgaagcttgaaaacacacttttagatggaagcactgcaccacgagtcaaaatttgtgactttggttactcaaagtcatcagtattgcattcacaacctaagtctacggtaggaactccagcttacattgcacctgaggttcttacaaggaaagaatatgatggaaaggttgcagatgtttggtcttgtggagtcaccttatatgtgatgttagttggggcttatccttttgaagaccctgaagatccaagaaacttcaaaaaaaccattggtaagatacttagtgtccagtactcggtccccgattatgtacgagtttccatggaatgtagacatcttctatcacaaatatttgtggcaagtcctgaaaag

SEQ ID NO: 98458 - DNA, 1782 bp, Glycine max
  Peptide Sequence Number=SeqID_215236
atgcatacaaaagccgaaacacgtaaaattgttactgattttgttgcatatgttgaaactcaatttgatagtagagttaaaattttacgaagcgataatggtgccgaattcctcatgaatgatttttatgctcgcaaaggcattattcaccaaaccacttgtgtcgaaacacctgagcagaatggtattgccgagagaaagcaccagcatctcttaaatgtcacacgagcacttttatatcaagcacaactcccacttcatttttggtgttttgcattactccatgctacatacctcataaatcgtatacccactccgtttttgaaaaatatatctccttatgagaaactatatgcacaaccctgcgatatttctaatatccgtgtctttgggtgcttatgttacattagtacactccagaatcatcgacagaaacttgacccccgtgctcatccttgcatatttcttggttttaaaccccatacaaaagggtatctcgtttataatcttcactctcataacataactgcttctcgtaatattattttttatgagaatcactttcccatactacatgaacctcaccaaaccgataatactcttactcatatctcgcctattcctttctctaacaacaccccagtatacccagtcaatcctaatgatactacccaaaccacgatatcacctatcaactcctctacttctacacaagacaactcatctcccacatccccttatacatccacacccagcttacaccgttctatgcgaacaagacatccgcccacatatttacaagactttcatcgcgctctcacttcacatactgatacttcctccaccaaggttagattgtctcactctcataaacactttatcatgtctataaccaccgtagctgaaccccgttcatatgctgaggcttctagccatgactgttggattaaagccatgcaggtcgagttaaaagctctccaacagaaccacacttggattctcactccccttcccccacacaaaaaggccattggatgtcgctgggtttacaaagtcaagcataatgcggatggaaccattgaaagatacaaagcgcgcctcgttgccaaagggtacactcaacaggaaggattagattatctcgatactttttcccccgtggccaagctcaccactgtacgcatgcttctagctcttgctgctcttcgtaaatggcaccttagacaactcgacgtcaataatgctttccttcacggggatctcaatgaagaagtctatatgaaaccaccacctggattgattatggataaccccaacctcgtttgtcatcttcagcgctccctttatggacttaagcaagcaagtaggcaatggttcacacggctttcctcgttccttctctcccaaggcttttgtcaatcttcagctgaccactcacttttcttatactctcacattgataacactgtaacagctatccttgtttatgttgatgatatcatcttagcaggagacaatctcgagtatattacccatgttaccaagcttcttgatcaaaccttcagcattaaggaccttggtcttctaaaattcttcctcggtctcgaggttgctcgtacaagtcacggcattcacttatgccagcgtaaatatgttctagacattatctcagactcaggcatgcttagttcccaacctgcctctactcccatggaatactctaccaggttaagtgcctccatgggcacgccattatccgaaacttctgcttcttcttactga

SEQ ID NO: 98459 - DNA, 294 bp, Glycine max
  Peptide Sequence Number=SeqID_215237
atggaaggtggaagctggcaaatgaatgatgtaaataatccatcacaaagtgttgaggaagtcctgtctattatacaagaggcaagaaaatctcttaatgttcccaaggttggaggccttcttattgggggcagcatggacctagatgacttggatgctgatgaagatcttgaagatctacaaacaagtggtgaatttgttttgtttccttatgttcattttgccctctcccccatcacacatgtggatgtcctcagatttaggaacttccaaaaccatgtgccgttttcctag

SEQ ID NO: 98460 - DNA, 312 bp, Glycine max
  Peptide Sequence Number=SeqID_215238
atggtgtctaaagtggaagaagcaaagaagaggaatagaataaagaagcagattcagtgcaacaaagggaaaattggcatgttcaagaggagcagctccaatatggaagaagatggtgcttcttttgccattctcttacttgcttgcatagctttgtgtaccttccaacctgctaatacatgccccattacttgtgaatcatctggacatggttctgctcatgcatccaataacgtcacttatctcttgcatgctctgtggctgtctgttacgcagaataaatactcggatctatacagcttcatcggatag

SEQ ID NO: 98461 - DNA, 603 bp, Glycine max
  Peptide Sequence Number=SeqID_215239
atgaatggaaaagctccatcttcagttataacagatggtgatgtcgcaatgaacaatgcaattagacgtgttttcccaaatgcatttcaccggcattgtgcatggcatttgataaggaatgcacaaagtcatttgaagaacactgacattttgcctttcttgaaaagactaatgttaattgaacttgaggcgtctgaatttgaacaaaaatggaatgaaatggtgtccaggtttgggctgcaggataatacttggttgaatgagttatatgtcaaaaggaggatgtggtctcctgcgcatatttgtgggaatttctttgccggtattaggatggcatcacgttgtgaagccttacatgaccacattggaaaatatgttgattcaagaactaacttgattgattttgtggagcaatttcataggtgtttgacctttttccgataccgagagattgaagttgattattttgattatggggatgttattgtagaaacaaatttccattccatggagaggagtgctgatatagaaccaaagatacccgtccctgtaaattcaaacacttttaagacttatcaattcagacttgatcaatacgcataa

SEQ ID NO: 98462 - DNA, 372 bp, Glycine max
  Peptide Sequence Number=SeqID_215240
atggctacacctgttactggtggtggtggtggtggtgaccccaatccaccgcacagcggtgctgcgccacctgtgcatcctgctccagtgaacaccaatctaaatcacatcattactgaaaagcttgattcgacaaattatctgttttggaagtcgcaggtggaacctataattcatggttataatttgcttcattttattcatgaggttcagattccgcaaaggtttgccaccattgaagatgcaaatgctggcagagtcactgaagtgttcagactttgggatcaacaagatcaattattgctttcctggttgcattccacaatttcagcacctattcttctaatgttcgtcaaatgcaagtctttatag

SEQ ID NO: 98463 - DNA, 273 bp, Glycine max
  Peptide Sequence Number=SeqID_215241
atgaaccaaaaagctaagccatattacatgactctggatttaaagttcaatttacatttttcttatcttggcttctacattcatgacagcatggaaacaatcattgagcgctttaacaagcaaaacaataatcatcatcggctaatggatgctacttcagcaatcaagattttggatttgattcttatgtatttcatttttcttgtattggttgaactaaactggttcatcaattcaactgtaaaatccattggtcatgccgattcaaattga

SEQ ID NO: 98464 - DNA, 840 bp, Glycine max
  Peptide Sequence Number=SeqID_215242
atggaaagtgatttttggagcaatgttccccagcgattgcgaacaaagaggaagagtaaattcaatggcaaggaagcactttctacacccaaggtagtgctttctaaatcgaaggaaacaatttctagatccaataaagcactttctacactcaaggaagctctttctagacccaataaagcactttctacacctaaggaagtgctttctacactgaaggaagcactttctagacccaaagaaaagctaaacagtggagattttgatatttacttgaagaaaatatggaagattttctcaggagataggttgaggcactttacatgctttgacagcttatggtttagtctttacagggccgctccatctaaagacaaggtgcttacttggattaaaaaggaacctattttctccaagtcatatgtttttgttcctatagtctgctggggtcattggagccttttgatcctgtgccattttggtgaaagcttggaatcaaccaccaaatcacgatgcatgttgttgctggattctcttgaaatgaccaatcctagacggctcgaacccgagattagaagatttgtattagatatttataaaacagaggacagacctgaggctaagcatcttgtatctcaaattccttttttggtgcccaaggtgccacaacaaagagatggtaatgaatgtggatttttcatcctctatttcattaatttgtttttggagcatgcacctgataattttagcatggagggatatccttactttatgaaaaaagattggtttagctttgaagacctggatagattttatgagagacttgattcactgaattag

SEQ ID NO: 98465 - DNA, 683 bp, Glycine max
  Peptide Sequence Number=SeqID_215243
atggcggcggcagcggtggcggaggtgaggaaggccccacggccgggcaagggcgggtacgaagcgcacggcctgagcgaggaggaggcgcgagtgcgcgccatcgcggagatcgtcagctccatggtggacctctctcacaaaggccagaacgtggacctcaacgcgctcaagtccgcggcgtgccgcaagtacgggctctcacgcgcgcccaagctcgtggagatgatcgcggcgctccccgacgccgagcgcgagacgctcctccccaagctccgcgccaagcccgtccgcaccgcctccggaatcgccgtcgtcgcggtcatgtcgaagccgcaccggtgcccgcacatcgccaccaccggcaacatctgcgtctactgccccgggggacctgactccgatttcgagtacagtactcagtcttacactggttacgaaccaaccagcatgcgcgcaattcgtgcgaggatagatcagcttaagcgtttgggtcatagtgtagacaaggttgagtttatcttaatgggaggtaccttcatgtcacttccggctgattaccgtgattactttataagaaatcttcatgatgctttgtctggacacacatctgctaatgtggaagaggctgtggcatactctgagcatggggcaaccaagtgtattggtatgacgattgaaac

SEQ ID NO: 98466 - DNA, 831 bp, Glycine max
  Peptide Sequence Number=SeqID_215244
atggaggagggtttagggaagagagaattggaaggtgaggtagttagcagggttgccgaagtgatttcggctataaagaatgcgaagcacgtcgatcaagtcatttgcgcgcttcattccttagccactattcttttcccctttgacccttctctcctctcagatagcattgatcagagttacggagacaaggtccaagttccttctgcggaaaaacgacatgcttggtggcgtgtgttttatcgaggagctgcttttcctacattggctaggtttctattacttgatgttgcctcgaactggttgggttgttttcccttctcggcacagaagtacgtttatgatgttttctttgttcgtggattggtcactgaggtgctgcagattttggttccttttctccagctgagttcgagtgatggtcttgatgttaatgctgtcctctctaattctgaaagcatttattacagattgcttgtactgtgcttgcttgaaaataatggggcgctccagttggcgagagagtttggtggttcttctaaattgaaaagcgttacagatgtacagatcaagatggatgtatctatggtggcacagattgttgcatctattcctgataaagcaaggatgaactccatggcttcattgtcatcacaagtgtttagtgtgttcttcaagcagattgttgtccaactactctccctggcagaagaaagagagacaattttgctagacaatgtagacatggatgaaatggacaaaaatggtgcactgttatttgtaggggaaatgttttctcgcatttgtcgccgtggctctgctggtaactag

SEQ ID NO: 98467 - DNA, 207 bp, Glycine max
  Peptide Sequence Number=SeqID_215245
atgcaatgccgcattgttgctggagaaaggtgggctttcgttggagagaagagtggggtttcagtgtttgtgcaagttaagttacggtgggaaatagggtttctgactctacatatctgctgccctaggcctttctctggagacaatgtcgaaggaggaattggatgggatgaagaatgccatgcactttatccttcaaggagttag

SEQ ID NO: 98468 - DNA, 738 bp, Glycine max
  Peptide Sequence Number=SeqID_215246
atgggggttgaagatttgtgctttgaaggcctggagacgtgttatctacttgactttattcctccgaaggaattccttttcgacctttctcgtaaatcaaaatgcaagattgttgggtttgatcatcggaaatcggtacttggacatattccccctgccaatgattgccctgagaatattatgattaatgtaaatcttgagaagagtagctccagtgttgtttatgagtactttgccggcaaatgtgaggatgctaatatttctaatgtaatatctcatacagcaatgactgaaattgaaatatgcctgaatttcattaagggtgaggctccatgtttggtggactcaaaagacaaaggccgagtggagttgatgcttaagtacattgaggatggagatcttcgccgatggagcttgcctggcattagggcctttaatattggactgagtgaatggcggtcaagttatcatgtctttgctgaatttgttctgttctttgaaaaatcttcatggcagttgctgaaattaagtgctgaagatttaattactaaaggaaattcatgtgtgtcatctcgccagaatgctgcaagcaaattgctggaaaaggctttcagggttcgactgggtagaggattttatggagagtgcctgggagttcgggcagatgggaactccaacttaagtgatgaaatcggcaagcttcttagtgtaaaaagtgctgctactggtcttaggtga

SEQ ID NO: 98469 - DNA, 1404 bp, Glycine max
  Peptide Sequence Number=SeqID_215247
atgaagcaagtagaaatgagaattgaggaaggtgtaaggtactacaatgatctatttgtatttgaccttgatcaatttaagtggcaagaaataaagcctaagcctggagcaatgtggccaactgcacgtagtggttttcaattatttgtttaccaagatgacatttttttgtatggtggctattcaaaagaagtttcatctgataagagcaactctgagaaaggaattgttcattcagatatgtggtcccttgatcctaaaacttgggaatggaacaaggttaagaaaagtggaatgcctcctggtcctcgtgctgggttttccatgtgtgttcataagagaagggctctgctatttggtggtgttgtggatatagaagttgaaggtgatgtaatgatgagcttgtttttgaatgagctttatggatttcagttagacaccaatcgctggtatcctctggagttaagaaaggagaagtcgactaaagataagctaaaaaaaattgaacaaaattgtcctgatgatgtcaacaagataaatccagcatgtacaacaagagaagaaactgaggagtcagaggatgaagaaaacaacatcgacgatatatccaagaatatagcatcaaacatgtctatcgatgatggtgaaacacttaccaaatccgaaggaaaggccgaggaatccagtgctaaattggacattcaaagttctttgcctgaggtagtgaagccctgtggacgtattaatgcttgcatggccgttggaagagatacattatacatatatggtggcatgatggagattaaagatcaagaaatcactcttgatgatttgtattctttgaaccttagcaaacttgatgaatggaaatgcattataccggcatctgaatctgaatgggtggaagcttcagatgatgatgaagaaaatgaagatgatgatgaagatgaatccgatggtgatagtctgactgatgaggatgaagatgacgaggaagaggaggaggaagaggctcagaatgcatccgttcaggtgggagatgccgttgctttaatcaaaggggtgggaaagaatttgcggaggaaagaaaggagggtacggatagagcagattagagctagtcttggcttgtcagattcacagagaacaccctcgccaggagaatccttgaaggatttctacaggcgtacaaatatgtattggcaaatggcagcccatgaacatactcaacacactggaaaagaactccgcaaggatggttttgatcttgctgaagctcggtacagggagctaaaacctattcttgatgagctggctctattagaagctgagcagaaagcagaggaggccgaaggaccagaaactagtgcaaagaaaagaggaaagaagaaaactagaaattga

SEQ ID NO: 98470 - DNA, 1560 bp, Glycine max
  Peptide Sequence Number=SeqID_215248
atgcttaaatcaaccttcactcccattttctgggtacttacccccaaacccaaacctccaaaacttcccccccaggcaatcaccaacaccttcttcacaagcagcacgacacatgttcgacacaatgcccctctcaaccccaccaccccaccacccccttcttcagcctacattcacctccctttctgccgcaaacgctgccactactgcgacttccccatcgtcgcccttggctccgcctcgacccaaaccaacgacgaccctcgtgtctccaactacatccactggctctgccgggaaatcagtgccaccaatgtggaccaacctgctgatgccagcaccatcacaccccttaaaacggtctactttggaggcgggacaccctcgctggtgcctcctaggatggttgcctcggttttggacactctgaggttgaagtttgggcttcgtgaggacgccgaaatatcgatggaaatggacccgggcacgtttgatgctgagaagatgcgagagatggtggtgctgggagtgaatagagtgtccttgggagttcaggcgtttcaggaggagctgttgagagcttgtgggagggcacatgggctgaaagaggttcatgaggctattgatgttgtcaagttgtgtggagttgagaattggagtattgatcttatatcttcattgcctcatcagacgagtgagatgtgggaggaaagtctaaggctcgccatcgagtcacaaccaactcatgtctcggtttatgacttgcaaattgagcaaggcacgaaatttggacgattctgtaactacggttgcagagaccccaaaaacctttacattgcagcagcaatcacagttgctgagaccctaaaaatcttgatgttgcaggcacaattgtggtactccccaggggaattcccaatgccttctgaaacacaatcagctgagttctataagatggcttcaagaatgctttctgatgcaaattacaaccattatgaaatcagcagctactgcaagagtggatatgagtgcaaacacaactttatctattggaagaacaagcctttctatggctttggccttggctctactagctttgttggtgggttgaggttttcaagaccaagaaaggtgaacgattacattaattttgtgcagaatctagaaaatggattagtaaatagctctgttaaaggccacattagtggcaaggacacaatcatggatgtggtgatgctgtccctaagaactgcacaaggcatagacttaaagagtttccaagaatcgtttggcagctctgttgttttgtctttgcttgaggcttataaaccttatgttgagagtggacttgtggtttgcttggacgagcataggagaaccattagaatagatgaccttaattcttctttgagcaaaactaatgcagagggaagggtggcttatataaggctaagtgatccagaaggtttccttttatcaaatgagttgatagcccttgcttttggggttattgactcttggaaggatatgcctccgtacaaggaagcagaagctacttga

SEQ ID NO: 98471 - DNA, 648 bp, Glycine max
  Peptide Sequence Number=SeqID_215249
atggggaagaagacgaagaaacccggcaaaggcaaagagaaaaccgagagaaaaaccgcgagagccgaagagaagaaagctcgcagggaaaccaagaagctctctcccgaagacgacatcgacgccattttgttgagcattcaaaaagaggaagctaagaagaaggaggttcacgtcgacgacaacgttcccgcgccttctcctcgctccaactgctccctcaccgtcaatccattgaaggagaccgagttgattctctacggcggcgaattctacaacgggaacaagacatttgtgtacggcgatctctaccggtatgatgtggagaagctggaatggaaattggtttcaagtccgaatagtcctcctcctcgcagtgctcatcaagccgttgcgtggaagaattatgtttatatttttggtggtgagtttacgtctccaaaccaagagcggtttcatcactacaaggatttttggatgttggacctgaaaacaaatcagtgggagcagcttaatttgaaagggtgccccagtccacgttcaggacatcgaatggtattgtacaagcacaagattattctttttggtggcttctatgacactcttagagaagtgaggttgttaatgctgcttgattttttttgttga

SEQ ID NO: 98472 - DNA, 558 bp, Glycine max
  Peptide Sequence Number=SeqID_215250
atggctaattgcgaatctaaggatagtttaaccttaggtagaaccatgaagtttgtatcatgtatggtaacatttttagctggacagtcaactaatagtttaagtaacaaaatcaatagcaaatgtatgcttcaaaaccttggtgatttgaagcttggtcactacatgaagatccctcctaggtcaatgtttttagttcagaaggaagtcactggacatgtccaagtgaccgtgttttcttggacgcatcagtcatcaatagggccaacactagtttggatattgcacaagacattccccaagcagtcatggattcccttgatcaatcttccggtccttcagggggcaactggaatgatgccaccagcaacaccactgaactacaatgcctggattataattggaacaattttcaacttctttatctttcgctacagcaagaagtggtgccagagatacaactatgttctatcggcagcacttgatgcaggggttgcttttatgcctggaaaacacaagtctcaaaagggtttttttctttgcgcacctaccaaatga

SEQ ID NO: 98473 - DNA, 153 bp, Glycine max
  Peptide Sequence Number=SeqID_215251
atggagcaccggtgtaagtaccacaaatacctagagcatacattgacaatagcaaagaagggtgagataagagggctgaacaagatgcctgcaaaaatctgcgctcatctttctcctgcaaagctttgcatatcaagttatcaacaaggttaa

SEQ ID NO: 98474 - DNA, 399 bp, Glycine max
  Peptide Sequence Number=SeqID_215252
atggcggaagtgaagagtgaagacccagaaaatgcaaataagagagaaaaagaagaagaggagtctccaatagaggaagaggggctaacagtgaagaacaccgacgacccgacccagccggtatggaccttccggatgtggttcccggggctgctctcgtgctccctcctgtccttcctcaaccagttcttcgcctaccgaacggagcctctcttcatcactcagatcaccgtgcagctttgggtccgcctcgtcctacgcggtggggattgttaccattgtcaaggcgttgtatggaatgaagatatcgttggttgcttcatggcttctcatcatcacggggaattcgagtacaataaacaccaaaaagatttacagacacgagagaatttaacttaa

SEQ ID NO: 98475 - DNA, 492 bp, Glycine max
  Peptide Sequence Number=SeqID_215253
atgggggagttcatccctgtgacagaagaagaagtgttagcgagtatcaatttctttttcccgctgttgatttttcactggcaagtgcttagacttcaaatgcctgaatgcttgtgtctcttcaagtttttgtttcagttagatagtgatgaggatacctggtggaaggccaatgttagagagacaaaggaagaacttgcagctagggggatgaagttccttaactggttgtggacacgaaaagagaaggagatagcaattgtgacacatagtggattcttgtttcatactctgaatgcctttggaagtgattgccaccccttggtaaagaaagaaatatccaagcactttgctaattgtgaacttcgctccatggtcattgtggatagaggtatgataggattggaacaatcaaccactaactatccaggcaagataccttcagggctggacctccctagtgatgttgcagatgagaagtctgagaaataa

SEQ ID NO: 98476 - DNA, 395 bp, Glycine max
  Peptide Sequence Number=SeqID_215254
agttgccaaaggagattaaggactctgacatatctaatcaagatgatgagagccactttaaaactgcaccccctctctcctgtgtggtgaccaatgataatgataatgtttcccttaaattgcccgaatacctgcctttgactcgcagggtaaaaccattcacgcataagaagatggtagtgttacttcgggattcacagatgagattgtggcctgtcttttaccatgaacaacctcggttactgacacatggatggttagattttagcagagctaataacattcaacctgaagatgagtgtatttttgaggttgagcctgaccctgagagcaggtatcaacgtatcttagcttacatcctaggctcctataccacaatgacttcgcggcaatga

SEQ ID NO: 98477 - DNA, 1575 bp, Glycine max
  Peptide Sequence Number=SeqID_215255
atgggaagagatctttgtgcaagtgggaaaatggaagggttgagaagctcatggtcccaaatggagaaagccttcaacgaagctgtttcaaagagctttgttggaaggtatttcaagttggaagcaaggaagagttgtttcacgagggagcttcgcgctgccacagccactttcctgaccatggcctacatcatcacagttaacgccaccatcattggggtctccggcggaacctgcaccacaaaagactgctcgtctatggactgtaaggtgaaatctgacattgagtaccagagttgtctggcaaagacaaagaatgaccttgttgtggccacggctgtttcaggccttgttgggtctgttgccatgggcctattcgccaacctccctttgggcctggccccgggaatggggcccaacgcgtacttcgcttttaacttggttggttttcatggtactgggccgctctcataccagactgcactggctgtgatttgtgttgaggggattgtttttcttttggtctcagcccttgggctgagggggaagcttgccaagctcattcctcattcagtgaggcttggttgtgctgctgggatcgggcttttcatcgccttcacgggcctgcaggccggcctcggtgtcgggcttattgggcctgatgctgctaatctggttaccatcactgcctgcaaagttgtggacccggaaactggggcttgcgtgggtgggaaactgcaaagcccaaagttctggctgggccttgttggcttcatcatcacaagttatgggttgatgaagaatgtcaagggaagcatgatttatggcattctgtttgtgactttggtgtcttggtttaggcatactgaagtgacttattttccaaacaccccacttggtgatgcaaattataattacttcaagcaagtgattggctttcacaacattgaatccactgctggggttcttagctttagtggttttaacaaaagggaagtttgggtggccttggctaccttgttatatgttgatgtgcttgccatcactggcactatgtacaccatggcagagattggtgggtatgtggacgagaaaggacaatttgaaggtagcaccattgtgggttctgcattaggtgtgtcaaccacagcaacatttgtggagtcatcagctggtatgagagaaggtggtcgcacaggactaacagcatttttcattgggtttttcttctttctgtcactgtttttcactcctctattggctagtgttcctccttgggctataggaccctcacttgtgatggttggggtgatgatgatgaaggtggtgaaggacatagattggaccaacacaaaggatgcagtgcctgcttttgccaccatgctcctcatgcctctcacttactccattgcaaacgggatcattggtggggttggactctacattgctcttagcctctatgactatgctgcaagcatcgtaaattggttgaggaagatgaggagaatggtggccaaggaacaaaaccaagtttctgctactgcaggtgttgactcggcagtggaaatgatatga

SEQ ID NO: 98478 - DNA, 270 bp, Glycine max
  Peptide Sequence Number=SeqID_215256
atggattacagtgctggttcgagtctgtttccgttgcaccgttgcaaaaccattcacctggtgaggcacgcgcaggggattcacaatgtggagggtgacaaaaactacaaagcctacatgaaccccgattacttcgatgctcatctcactcccttgggatggcaacaggttgacaatttgcgtaagcatgttcgcgactctggccttatcaacaccattgatctagtcattgcatctcctttgatgaggtttttctctctaattacataa

SEQ ID NO: 98479 - DNA, 243 bp, Glycine max
  Peptide Sequence Number=SeqID_215257
atgtcttcaatgattctgatggcatcagcaaggggctttagcatgaggccaaaagaaaagaaggttcaagtagatgatgtctcgctaagtgtggcagatccgcttagcgagtggcatccgctaagcgagacatccagctcgcttagcatgttgggaaatcctagaagaggatcagtcaaagatgtgctcgcccaatgcgccgcaagcccgcccagcgaggtcgttgtcccttctagcacttag

SEQ ID NO: 98480 - DNA, 1299 bp, Glycine max
  Peptide Sequence Number=SeqID_215258
atgggttctgatctttatatccctcctgcttttagtagtactgtgtcagacttggttaataagaaaattgctctcaatgattcaagtgagcggcaatggaatgtaaaagtatcagggtttaatggttcttttgctttcatggaaggatggagtactttttcattgaatcatggggttaaagttggatatcttctggtattcaattacgttaaggatttgcactttgatgtcaagatctatgatccatctgcttgtgaaaagcttaattttcctaaaacaagaaatcagaagaaaagaagtagggggagaagtggctctccagttagagattgtatgttggttggtcaagaatccaatgccttagttgtcacccaacattatgtgccgaaaatgaaaagccagcgcagtgaggttgacttagtagtacgaaaaaatggtgaagagagtggccaacttatgtgcatatcagaactccatgaagacccatgttattcgacaagcctagaatttgaccagagccatggtgttaatgggaccatgaaaattgtgaatggagatttaaaagtttctaatgttgattacggatctcacatatttgaaaatgatgcaatcgtatgtagtaaagatactatgtttgaagggatattcagtatggcagctgccttagatatatctgaatttgaaatgtctgggagaagtacttctctaggtgaggcagacaaaagcacacatgacaagacttcaactttgaatattgaagaaaacaaagagagcaaagccatcatgtacagcggggaagctcaagagtgccaattttccaatgtcttagaaagtgatcaggctgcaatatccaaaaaggaacctgctttgcatattgatggttcttgcaataccaaaaacaagttcaatgagatctcaaatcacttagatacttatatccacaatggtgaaatgaagaaattgcctgtggacaagactcccaaactgtacagttccgtggataaattgaatgtaacagggttgccaaaggagactaagggaaagttggatcactattctgacccatttaatcaagataatgagagtcactttaaaactgcacctcctctcatgtccaacggggaagctcaagagtgccaattttctgagggcttagatttggctttttattatttttacttcacattggcttattttcagaaagtgatcaagcagcaatatccaaaaaagaacctgctttgcatatttgtggttttagtgacaccaaacagaacttcgatggaatctcaaatgacttag

SEQ ID NO: 98481 - DNA, 144 bp, Glycine max
  Peptide Sequence Number=SeqID_215259
gttaaagcagcaatatctgcaattagatatactgaccagtttcctagacttcctgctggatttaaaatatctggacaaagggatgcagacatgtttgatcttttggaatttgtgttcggtttccagcctctaacattcaaatga

SEQ ID NO: 98482 - DNA, 462 bp, Glycine max
  Peptide Sequence Number=SeqID_215260
atgaagttaaaggcagaaaacgaaaatgaaactaaaggcagaagaaggaacagaaacgaaattgcactcagaaacagaaaatggaaaaatgcattcacatcaacagtggatgaattggacaaagcaatttttatagcctctaaagatccttctttatatggcattgatgaagtggaggttgaaaaccagaggaagtggaccagtgatactcgcaccctggtgagcacaacaaagaaagcagtgcaagctggaaaaggcttgaacaatgttagtctaaaagggatgcacaaggaattaatgaggcttcctagaatgattgatatcaaaaagtgttgtagaatgattgagcttactcaaggctgttaccacatgacatgcgggcttactaaacagaaagtgctaagcaaagggacttgcagacaagtggatgaggacttgaacggtaaagttgtgccttgttga

SEQ ID NO: 98483 - DNA, 495 bp, Glycine max
  Peptide Sequence Number=SeqID_215261
atggctaattccttagtaagttatgttggtttttctcctcaatctaagttgctttcttcatcgtatcgtccatcattgttatcgtcacttatcattatcgcttcagacggaaatcttagcaaggccttttcacaacccattatgctaattaccaacatgtactcaccgaaaattcaaaagtatcaaaaaatacctctgccattatacttgtcctgtgcttggctacattactccttgttggtagaaacaaagaagtatagtctaggatcttcttcatcaatggattcctttgcttctgggaagatgaatggagcggaatggagaaggaagagagagaggagacgccacttcaaggagaagatgagtctagaagaagctcaccaccatagaaggtcatggataagagcttggaagaagaaggagatgaatgaagggagaggaagagaagagcacaaaattttatgctctaaaagagctctgaaatctgaagtttaa

SEQ ID NO: 98484 - DNA, 135 bp, Glycine max
  Peptide Sequence Number=SeqID_215262
atggggaatctggcctcacacgacaaatggggaattctaggccataggaaaagattggaaggttacactagggaatcctttcttactacagatgaaaatgagtggttgagtctaaacctatctccttctgagtaa

SEQ ID NO: 98485 - DNA, 1245 bp, Glycine max
  Peptide Sequence Number=SeqID_215263
atgggagttaggactgtggctgcagtcggagagctcgttgaagttgatgacgaagtcgaagagctgaggaggttggacagggcgagagtcctccttagaactccatggaaaccgttgatccatcatacggtggaggcgacgatcaatggtgagacttaccagatagtcatcgtggaagaaagggaggctgacggtggaatgcgaaatcagtgggcacgcaaacacacatactcgtcggaggacattgactttgacgacattgatgacgactccgtgcatgcgggaatgttgaaaaaccacgacttcctgcacccacggaatgggatcgacgatgagggatggcctgacgaggcccacaaccactgtgggtctttacccgcaggaccgacactgtttgagtgcccaccgggtattgaccagcggacaacggcaccactcctgagaattcaaattgcaaagcggcctgaagagtaccaacaaccatctgcaggatatgcctctgcagatgctgacccaaagactagggggcttttgtcaggggcagaagatagcatgcgtgactcacagaagaagaatctaaacaggattagggggtttttgtcaggggcagagagcatagaccaaggtcaaacggaagatgacctcgtatttacgagtggacccaaaaatgaaccaaaaatgccacataatatcctaataaatatgaaaaagtcagtgtgtgaagcgggcccatccaaacaatccccagccagcccaaatcagcaatggaactttagagggtccctattgttactaaaaaatgcatatgaacaacaagccacctcatttgggcttccaattgaaatgacccttactaaggacaccagtgcctgcagcaagcaacaaacaaacaataagtcctgccaaaaaacaagtgcggttagtgaatggaaggtgtttgttaggaagaagcgaagctgccacaagcaggcccaacacagtggcgagcaatccacacagtgtgaggtaccattatcggccgcgaccttacctccagcagctattgggagtccagaagccattggaactacgaggaaaccagaagaaggagacatccaagaggcagtgtcacaatgggaattagcaaaaagcatgggagtgcatactgaattagaccaggcagcaatcatcaacaggataactgaaatggagaatagagataagaaggaggctgctcagatgggaaacagacaaagtgcatcatga

SEQ ID NO: 98486 - DNA, 1623 bp, Glycine max
  Peptide Sequence Number=SeqID_215264
atgtcttccttcatttttgactctgccataggcatgggtggtagtgacttcagggaggagactcattgtggggcttttgatagaaaatcatcttcttcagagaggttaagggtttcgcttcgtcaaggaggagtggtgttggagacgttaaggcatccccctgccattgctggctttgaatgggtgggggacaatgttttgaaatatcggtcttccattacctctgtggcgagtgtcgccgctatacaacaccaattgttcaagtttgactcaaacgtatttcgccacttcaaggaccatttcttcaaggtcctagctattgacatcgtggatgatggcttgtttaagtcttttgacgagaatttgttgacccttgtggaaaaggtcaacaaagctatattggagcaacttttggcctcgctggatgcacgggccattttgtctcttccttcgatggacgatccttttgctgccttggatggtattatgggtgactttgcttggaggccccttgtgaagcaagccagacctgttggtgggactatgccaccttgtactattgctgtttctattagagaaagaggtcaaccttccgttgaagttagccctaatactggtgttgttgaggtctctcccgacgttctttcctctgttttggctaagaggaagcaagatgacgatgatggggtgtcaggccataagaagtcgagggccccttctagccttcgagctatgagggaagctgttaggttgacgcttggttcgggttgccctttaagtttgcaagatccgcctccatcttcatcgatcatccaggcttttgttcttgttgctgctgttattgccactcctgctcctccaccttctcctgctatgtttgctctggagatttctacttctccttgggctgaagttagtgcactggccactttggctagcactgttgatgctcctttgtttattgttgtcgtgcccttgttgagcactggtgtggcgactacaagtgcttccatggtgcctcattcttcatctccactagttccctccttggccgtgttggtgtcaacgtcaccttccacctcatctcaacctagcatttctttggatcacatctacacttcctgtgatgttttttctctatggggggtagaatgctacggattctacctaggtcttcctccaatgaagtttggtgatcttggaagagaacgagaaaaggcaccaagaggcgctaagaaaggtggtgtccttagagtccgaagagtggagtgccttaaggtagctaatgctatcgtcgccttcgttgaagctgtgaagtcgaaccaccaactgtcttccaaggttgatagtgttcttgccaagttgttgtgcacaagattagatagtgatgagctatttgaacgctgcaagcgcttgcacaaggagaagaatgaattggttgaagaggtggagggcattgcgtcaaagaaagatgagtttaccaaggaccttgacttgggcctttttgatcctttcaaggacatgaaggacggtgttttgcttgacgaggaagatattgctactgaggaagaggccagcgaggagcaggatgctgaggaccaaggcgatgatgtcaatgtttag

SEQ ID NO: 98487 - DNA, 966 bp, Glycine max
  Peptide Sequence Number=SeqID_215265
atgtctagcacgcggtcttgcctcaagcacaaaactcttttcgaaggcttcaatcctcctccaacattgatgacggataccgatgccctccaacaacttcagaaccacattgcaaagatggagcgacaccatgaggaggagcttagaaagctaaaagcttaccacgatcagctggaggcttgtgtcaaatgcccccagggggacaagcactccgttcacacattgcctgggtacactcaaggggaatcacacccccgacacacattcaaaactcaaaatgattcaagtctctcccacatacaccatcctatagggcagactactcatcgataccccttcgttgatcgaatcatggaaactgacttaaccctaggttggaaaccactcaacctagagtggtacaacggaaccattgatccatatgaacatctgggcgctttcctcagccaggaaaatctatacaccaatgacaatgcattcttgtgtcatgtcttcccaatgtccctcaaagggacgacattaacttggtatgatggacttcctccaaaatccatcgagagctttgacactcttgtctatcaaacaccccagaccaacagtcagatggaggcaaccaacaaattcatccttaatgccctacacactagactcgacaagtctaagggtctatggaaagaggaattcccaagctcgtcaaacccaagttctgcccttggtgagtctcacttctccaaaggcttgtcaaacccaaggttcgcccttaatgagtctcacatcaccaaaggctcgtcaaacccaaggtctgtccttggtgagtctcgtttctccaaaggctcgtcaaacccaaggtccgccttcggtgaattcttctatagaaatctaaggaatacaagtctacaggaacatcaaaaacccaaggaccaccttgggtacacactcttacaaaaaccaaaggcacgcccttag

SEQ ID NO: 98488 - DNA, 675 bp, Glycine max
  Peptide Sequence Number=SeqID_215266
atgatcttatgtcaagtcttccctacgtcccttaagggggcgacattgacatggtacggaggactccctcatcagtctatagacagcttcgacacccttgtcgaatgcttcaattctcaatatgcaacgagccagttacactgcctgacttctactgctaaggctagtttacatcaggtagacgatgagccacttcgtaagtttattgacaagtttggtcaaatcgctgtccaaattaggaatctcaatcctgaggtggtgttacactccatgctgcttgtcttgcgacctggttcagaaacaaagtacgataggctagaaaaaagcatgagaaaggaaaaagtagcgcaggaactaactcacataagtcggacaagcaacacaaaccagacaagtgtcaacctcttccgagggtaccaagaagctttcaatgccgagatacccatacaattaccccccacacctcatcctagacttggactgaacataaccaagcattgcaaataccctcacaaccacgaccataatactgaagactgttggaccctcaaggacaaaatcgaggaactcacacatgtaggatacccaacccagtttgtaaagaagcttgatgacaacagaactagaggcaagtatgaggggcaccatgaggactatccgaagcataaatgctga

SEQ ID NO: 98489 - DNA, 732 bp, Glycine max
  Peptide Sequence Number=SeqID_215267
atggtcatcgccaacttgatggtatctaaagtctttatcgaccaagacagttccacagagagtggaaacaagaggttatgtagacctaatgatcacctttggttagggaacacattaaatgagctagcagttatagtctctacaccacaccttagagatgaagctccataccttgacgggagaaattgtaattgtcaaggccgattagaagcaagcccgacagtagatctagacaagcttcatcccccctttggtggtagcaatagtcaaatcatgagcgtggatgaagaattccaaataaagaccttggccatttatggaacaactaggggttatcaagacgacgcattcgacgtggatctttgtgatgacactatcgataaatgcccaaaaccaattgaagagcttgtcaagttacaacttggactcaaacttgggcaatacactcagctcagtagggacctcaccagtcacgaggaagagattgacaagatgctcaaagcccagtttatcagagtggtcagatactcaacatggttggcaaacattgtcatggtaaagaaagccaatgggaaatggtgcatgtgcactgactacaccaacctcaacaaagcgtgccccaaggaagcatatcccttgcccaacattgacaagattttggatgatgcgagcggattgcctgatacaggctacagagatttggatgatgccacttccagtgaagaaagataa

SEQ ID NO: 98490 - DNA, 1179 bp, Glycine max
  Peptide Sequence Number=SeqID_215268
atggctatcatggcttgcatggaagacaagttcccattcataggcgctgctccaggctatccacccttcttctacatctattgttgcatattcgaggttctgaacctgactcttcctcttaacacatttcaatgtgccttgctaaggcgcttgaacgtggctccttcccaacttcaccgcaatagttgggtgatgttgatcgggaagattggttgggtgtcgttgaacaacttgtccaagttctactcgaacatgtttcgaagattcaaggaccatttcttcaaggtcaaggcaatcagtgccattgatgacaggttaccattgatgcatgctgggaaaggggaacctcgcttccccttttacaggaaatcggaccccataaggttcaagtccttcgatgagtgtctaatgtcttcaggggagagggttggacctgctggagatgatatgcctcctccttccaccatcattcctgagccttctaccagggaaggaggtcacactgtagccagagtcgacctatctcaatcttttgacactactgaggatgaagttttcgaggttacgcccaacgtgccttctctttcagcgaacaagaggaagcgcaacgaaagggctggggagtccggggctggggcagcttctacaccttcttccattgtgttagccatgtcaacttcgggttccactacacttgctcattcttcttttgttgtagtgccactattgagtattggtgtgacaacaataggccctgagcaagattatttctttggagatgaggttgccaaatggagagccactgctcgaataatatggcgaatgaagcgccccaaaatggctaatgctactatcgcccttgccaaagccatcaggtccaatcatcagttttcatccagggtcgatgatgtctttactaagttagtgagcacaagactggacgagtctgagctcaaagtgatgaaggagaagaaggtgaataaggagctggagaaggaactcttaatgtttaaaaagaaggccgtggagcagcatgagaagggatttttcaagattgttcttgacctaagcctctttgactcgttgaaggatgtaaaggatgggcaactgcttgacgaggacgagattgttgtcggggaggagaatgatgacgaaggagaccatgaggccaatgtttaa

SEQ ID NO: 98491 - DNA, 216 bp, Glycine max
  Peptide Sequence Number=SeqID_215269
atggtaggagttccggagaatgaaagctctggtccagacgaggagagttcgacgagacgactggtggcaatcaggcgcgattctggcctcgggaaggcggcgcgtggcggtcacgcgccggtgtttggcaagcactggagcggcacgtggctgcccttctggtcaagcgatcagttaggctgggttgcgctcttcgaggcgcacagaaccctgtag

SEQ ID NO: 98492 - DNA, 357 bp, Glycine max
  Peptide Sequence Number=SeqID_215270
atgaaggtcatagccctcaagcaaaccagtcacgacatgattgcacacaaaggtaaagctcgggctgcagtggaagagttgaagaggttccttgtggttgattcgctagaggaagtgaatagaaagttggataagttctatatggttcttatcttgaagagtctacattcagactttgattatgtgcgtgatcaagttcttgctggagatcaagtttcatcgatggattctttcatcactaggctgcttcgtgtgcctcatgcgctaaaagaagaaaatccagctaatacgatggaaacgtcaaccatggttgcacctcaaacatggcacgggtcgactgattggagaagggcgtga

SEQ ID NO: 98493 - DNA, 495 bp, Glycine max
  Peptide Sequence Number=SeqID_215271
gccatctggagcattgaggctattttctgcactgcctcagggcctaggtggctacatctaccgcttttgacaacactggagagaaatagcaatagttctgacaattcattctatttccggatataccttcttgttcttggtgtttatgctgctatacgtctattccttggattgttgctcaaatttccagcttgtcatgcactttcagaaatgtccgatcagtcattctttcagttttttaagtggatttatcaagaacgctactatgttggacgtggtctttatgagaggatgagtgattactgcagttgccaagagaatggacggagactgactggagatgataaagggggtgaagtgaaggtggctcctagacccatgacctatgccacaaccacaagatgcctgcctagtgcctgtgatgacacttttttgtggatgatgcaatgtgacagtgtcgtgatagcagatcagctggaatgtgcaaggcaatag

SEQ ID NO: 98494 - DNA, 237 bp, Glycine max
  Peptide Sequence Number=SeqID_215272
atgataactgataacagtgataacagtggtgatcatgttggtaacaacaacagtgatcatgacgatgatcaacacgatggtagtagcgaaagcagtgagggtcatgttggtagcattgacgatgatcatagcgacaatcatgatggtagtagcagcaattatgttggtggcgacaatgatggttatgatgatgatgatcatggaggtagttgtgataacaattttaacataaattaa

SEQ ID NO: 98495 - DNA, 1857 bp, Glycine max
  Peptide Sequence Number=SeqID_215273
atggaatgcggaaactcctttgcagtgataaccgccgaagaacctaccggagaaccaccgttcctaggcggaggagggggaggaagaggataccatatagaaatctcagagagaattcgaaatgatcctgaacttgctaaaggtgctgcaaaagctgtacatgacctgtatgaagttgttactcatgaactggtatcttcagatttaagtgaagagttgatcttgattttgctctcaattctgatattagttttcatgcctatgcttttgtatgacatttgtcctactgtaacaggggagaatcttgatacatggaacattttagctagagctagggatgagggacgccttttttctaagatagtatggcctaatgatcctgaaattaaagagcttgtaaagaggttgcatcttcttcttactgtaaaggactctgctgctaatgttccaaaaaatcttgaagccaggagaagattagagtttttctcaaattcattatttatggatatgccttcagcaaagcctgttagtgaaatgttgccattcagtgttttcactccatactatagtgaaactgtgctttatagtacttccgaattgcaaaaagagaacgaagatggcatatctattcttttctatcttcaaaagatatttccagatgaatgggaaaactttcttgaaagaattggtcgaggagcatccactggggacgcagaacttcaagaaagttccagtgactctttggagcttcgattttgggcttcttatcgagggcagactcttgcgaggacaggtaacaagttcttagcagctttctggagagcagatcactgggaggtagttgcatatgaacattttgcattgcagtttgtgattctgattttcattctaatgaagtttgacatggatatttgctggcaatctgttgtgtcaatagtggacaattattctcaaaacaacttcattacaagtcaagattttgaatcatctcgtgaagcacgggcacaggcagatttgaagtttacttatgttgtatcgtgccaaatttatggtcaacaaaagcagcggaaggcaccagaagctgctgatattgctttattgttgcagagcctcaagggtggtgatttagcctcatattgtggtggagggatttgggtagaattcattgggaatgaggcgctccgggttgctttcattcatgttgatgaaagtacaactgatgtaaatacttcaaaagtgttttattcaaagcttgtcaaagctgatataaatggaaaagatcaggaaatatattctattaaacttcctggagatcctaagcttggggaaggaaagcctgaaaaccaaaaccatgccatcatcttcactcgtggtgaagctgttcaaactattgacatgaatcaggacaattatcttgaagaagcaatgaaaatgaggaatcttctggaggagttccatgcgaatcatggccttcgccctccaagcattcttggagtgagggaacatgtttttacaggaagtgtctcttccttggcttggtttatgtcaaatcaagaaactagctttgtaaccttggcccaacgagttttagcaaatcctctcaaaatcgcaccagtgtcgctggtgttaaccggagttgcatcaatattggtggaagccatggaaatggatcagagtgctctggataccatagtctatcctagattcattgttgggccacctgcatttgccacgcttaaggttggaagttttgggcatgaggaggagtgttggaaagctgccttacttgcagcctccattgttgggttcaccgagcctgccttagttgcagcctctttgggggttgccttgccttaa

SEQ ID NO: 98496 - DNA, 207 bp, Glycine max
  Peptide Sequence Number=SeqID_215274
atgcagctattaacggagacgcgaagcttacctcgatggtggaagagcaaaacggagctgcaggtcctcaatgctgacaacaaaccacccaatgcacggcaaatgaacctccaaggaaagcaaacggctccaggaggagaagaagctagaacatcgtcgcaaaaacaagcaaacggcacaaggaagaggaatgtacgggatgcgtga

SEQ ID NO: 98497 - DNA, 303 bp, Glycine max
  Peptide Sequence Number=SeqID_215275
atgctgggttccgaacacgagggtgaaggaattgcgaaaggaacgcgagaggaatcggaatcgagaaaccctagaaagaacaatgggaagaagaagaagctgaaagagttcaatggcagtgtggaagaagaaaaaggagttggatttgttgaggaagtgagaaatgaaaaaagagccaaaagttgttgcagcacggtggtttgttggtgccgtggtggcttgtgttgtgcctgtgtggaggaagaaacgggtgaggaactgaggaaggggcacgcaaacacgggtcggggcgcatgttactaa

SEQ ID NO: 98498 - DNA, 462 bp, Glycine max
  Peptide Sequence Number=SeqID_215276
atggaagacggcaagtccgagaatggcggcgaccaagtcgagtctcgcttcttcgagttctgcaagaatgggctagcattggaagagaaaagctgtaaagaagcagcgaatctgtttggagaaaccaagcatattctactgtcaaatttttcatcaatgggaaacggaacgtctgaagaagcagagaggtattggtttgcttttattttgtactctgtcaaaaaattgatccagaaaaatgacgagggtgagaaggaagacactgagaacattgggcttagcttgtgtcgtatattgagagcagcaaagcttaacattgcagattttttcaaagaacttccacagtttgttgttaaggctggtccaactttaagtaatctatatggcacagattgggaaaacaggcttgaggcgaaggagatgcatgccaatgctattcacttgaagattcttagcaagtga

SEQ ID NO: 98499 - DNA, 420 bp, Glycine max
  Peptide Sequence Number=SeqID_215277
atgccacccgtctttttatacgacgacaatgactgtgacctaaaatcacctctgaagaaacccgattccgcatccacccccagtcccaccgcgtgcggcgtcaaagaggatttctccgtgctcaccaacgacgaagaagaagaagatgtaattgccggtatccgaaatgatttcacagagttagtagcaagttcaagaacgggatcttcaaaatctgcgaggctcactgtaactcctaacttcccagattgtcatcttcctcttcagtcatctacttttcctcttttctctccgatgattgttggaactcaaagagcttctttgatggaacagtacgaaaaggttgagaagatagggtcgcgaccgcgtcaccaacgagaccatcgcgttgaagaagattcgcctcgagcaggaggatga

SEQ ID NO: 98500 - DNA, 324 bp, Glycine max
  Peptide Sequence Number=SeqID_215278
atggctgagactatggctgagactctttttaaattctttggctttcattttctgcacacatgcatcaacagagtcgtcgctggacggggtcgtcggagtcgtaggacggagtcgccggagtcacaggtcgaggttgcagttgcagcgcagcttcaatggagaaatcgagaaagggtttctcgagcagtttggagaatagatcggggagggagcttcaatgcacgcgaagttttgcgtcgagatcccgccccgcgccgcgccgccgctttagcggccgcgacggccactactctgaaccgccccgcttctcctgccttcgtcgcg

SEQ ID NO: 98501 - DNA, 819 bp, Glycine max
  Peptide Sequence Number=SeqID_215279
atgtcttcattagctactggttccagtgccaatattgtttcaatggtcttagaatttctcactgagttgcttggtgctcaattcccttttgtgaatagtcttcggaggacaggaaaattggaagcgggagcaagaagacgtgtgcatggggaagagaaagagaggtcacgtattatagaccaagtagtgatccagaccatcaaatgtgttcaagagtttccaaaaagacctggtgattccgaatgcagctatttcttaaaaaccggacattccaggttcaaatctaattgtaaatttcaccatccaaaggattggattgcaacattacctccatgcaacctcaatgacaagggtgtacctttgagaccacttaagataggtggagacttgagtcagttatctagcttttatgttccaccaccctcaactatagcaagacttgatcaaaagctcgtgaacacaaactcagcagctagtgctgatgtggctgaaaatggaggaggtgaagcagaggttgtcgagttaggtgattgcacacgacacgcagctaaagcattggtcattggtgaggtcatcgcaacacttgaagagatcatagaagacgttgaaggaggcagggatagtgaagttgttgtggttggcaaaggcaacagagttgacaagggaggtgcgaagcgagttgacggtgttttcgtaagtgaaactcaacatgaacttgggttgagagcagacttgcacgatagtgatagggttttttggggcatttcgcaaaaaattaacaccattagtaatggtgactattcaagagagacaaaataa

SEQ ID NO: 98502 - DNA, 3373 bp, Glycine max
  Peptide Sequence Number=SeqID_215280
atggtgggagtttgtgagggaaacggcgaggttttggcatggctgaaatcgatgccggtggcgccggagtacaggccgagcgcggccgagttccaggatccaatcgggtacatattcaagatcgagaaggaagcttcaaagtacggaatctgcaaaatcatccctcccttcccaccttcttccaggaaaaccgcaatcgccaacctcaaccgctcactcgcggaagccggctccacattcaccacgcgccaacagcagatcgggttctgcccccgcaggcccaggccagtccagcgtcccgtctggcagagcggcgatcgctacaccttcagcgagttcgagtccaaggccaagtccttcgagaagacatacctcaaacgccactccaagaagggctcgggctccggctcgggcctgggcccgttggagacggaaacactgttctggaaagccacgctggacaaacccttctccgtggaatacgctaatgacatgcctggctcggcgttttctccgaaatgccggcgcacaggggatcccagctcactggcggacactccgtggaacatgagagcggtttcaagggccaaaggttcgctcttacagttcatgaaagaggagattccgggcgttacttcccctatggtctatgttgccatgctcttcagctggttcgcgtggcacgtcgaggaccatgacttgcacagcttgaattacctccacatgggcgccggcaagacctggtacggcatcccccgcgacgccgccgtcgctttcgaggaagtcgttagggttcacggctacggcggagagatcaacccgctcgaggctgcgaacattgcaacacctgagtggctgaggtttgctaaagatgctgctattcggagggcttcactaaattatcctcccatggtttcacatttccagttactttatgaccttgccttagctttgtgttctagaattcctgcgggcatcagtgctgaacctcgtagttctcgtcttaaagataagaagaagggtgaaggagaaactgtaattaaagaactatttgtccaggatgtcctacagaacaatgatctgcttcattttcttgggcaaggatcagctgtagtacttcttcctcgtagctctgttgacatttctgtttgctcaaaattacgtgttggatcccagcaatctattaatgtaagcaattctgagggaatgcattcttcaaaaggttttgtttctgatgatctggcattcaacaggagtcatggaatcaagcaaggaaaaagtttctattctgtgaaagacaagtttagtacgttgtgtgaaagggacaggatttcctcttttgatgtaaatgataacataagcatttcaagttctaatccacttcaaagagacactgaaagagaaacttgtcaaggagatgggttgtcagatcagagactgttttcatgtgtcacatgtggaatattaagcttttcctgtgttgctattgtacagcctagagaaccagcagctagatatcttgtgtcagctgattgcagtttctttaatgattcggttgttggatggatgaaaaagaatgtccaagatggtatacatgatgttccttttcaatcttctcaggttgctttaaatatggtaagtgaaaatggcaatacagctcttgcattattggcttcagcatatggaaattcttctgactctgaggaagatcagattgcggttgacagtcatgaatcaaatgtgataaactctgcttcagaaagtttactttcttacactcgagattcccatgctagtcccatgactgcacttgataggggagattatattccttcaaagagttccagctatgaggattttatacatcgtagattagagtgttttgaaaacacaaggacggtggctaattccacctctaattgttcccaagatgctcataatgctgaaaggtcattgtctaacaatgctatgatggttccctttgataataaaaaagcttcgatggtgctacaatctgatgaagactcatccagaatgcatgttttttgtcttgagcatgctgcagaagcagagcagcaacttcgcccaattggtggagccaacctattgctcctatgtcatccagactatcccaagatagaggctgaggcaaaaatggtggcagaagatttgggtattgattacatgtggaagaatattgaatacagtcatgcttccaaggaggatgaggagaagatccagtcagctctggatagtgaggaagctattcctgggaatggtgactgggctgtaaagctaggaatcaatctcttttatagcgcaaatcttagccgttctcctctttatagtaagcagatgccttacaattctgttatatactctgcatttggttgtagctctccagcaagctcacctgtagagccaaaggtctaccaaagaagggtcaacaggcagaaaaagattgttgctgggaaatggtgtggtaaagtttggatgtccaatcaggtccatccccttttagcgaaaagagattttgaagatattgaggatgagaaactcttaatagggttgatattacctgatgataaaattgaaagatcagaaagtacacccaaaagcgaagctactagcagaaaatcaggtaagaaaaggaaaaagacagcagagaatggacggttcaggaaaggaagttatgctaacaaaaatctactttcagataattccactgaagataaacccaacttgcttccaaggagcattcttcgaagtaagaaagtcaggcatgttgagagagactgtgctgctttgaaagggggttattctcctccatatcatcatagaaaaccttcaaacaaccaaacaaacttcactgaaagttatgcagtttctgatgattcgcttgatgatgatgatcacatgcagcaaaggaggaatgttaaaattgaaaaggctaaatttatggacaatgatgtggtttcaaatgatacgatggacaatgattctgattggcagcagagggaagacgttagcagcaagcaagttgaagatacggagggagatgcaatttcagaggattctttggatgttggttctcttcagctgcaaaggaagacttccaaaggcaagcatccaaaatacattggtgaagaagatataatttctgatgaccaaatggagagtcattttcaaaagaggcaaaagagaattcctgaaagcaggcagggcaaataccttactggaaaagatataatatctgatgaccaactagagctgaaaatgaagaagcagcaacggaggaatcctaaaagcaggcaagccaaatacctcaatgaagaggatattgcatcagatgaccaattggagggccattatc

SEQ ID NO: 98503 - DNA, 1694 bp, Glycine max
  Peptide Sequence Number=SeqID_215281
gttttaattgcggagaggcagcaaacattgcaacaccggagtggttgaggtttgctaaagatgctgctattcggagggcttcattaaattatcctcccatggtttcacatttccagttactttatgaccttgccttagctttatgttctagtattcctgcgagcatcagtgctgaacctcgtagttctcgtcttaaagataagaagaagggtgaaggagaaactgtaattaaagaactatttgtccaagatgtgttacaaaacaatgatctgcttcatatacttgggaaaggatcagatgtagtacttcttcctcatagctcagttgacatttttgtttgcccaaaattacgtgttggattccaacaatccatcaatgtaagaaattctgagggaatgcattcctctaaaggttttgtttcagatgatgtggtattcagcaggagtcaaggaatcaagcaagaaaaaagtttctattctgtgaaagacaactttactacattgtttgaaaggaacaggatttcctcttttgatgtaaatggtaacataagggcttcaagttctaatccacttcaaagagacaatgatagagaaactggtcaaggagattcgttatcagatcagagactgttttcatgtgtaacatgtggaatactatgcttttcctgtgttgctattgtacagcctagagaaccagcagctagatatcttatgtcagctgattgcagcttctttaatgattgggttgttggctctggagtatctagcaataaatttactattgcccttgaagaagcaactattgctgagccaaacatgtatacaggcagatttgtgagccatgtccagaatgctggtttacatcctgtagtacttactttagtataccagggaaatggaaaacaggaacatgcactagtgagtagtgccctatacgaagcttttatgttgtgcatatggaagcacaacttaggatggatgaaaaaaaatgtccaagatggtatacatgatgtttctgttcaatcttctcgggaggctttaaatactgaaagtgaaaatggcaatacagctcttgcattattggcttcagcatatggaaattcatctgactctgaggaagatcagattgcagatgagagtcacgaatcaaatgtgataaactctgcttcggaatgtttactttctcatactcaagattcctatgctagtcccatgactgcacttgacaaaggagatgattttccttcaacgagtgccagttgtgaggatgtgcatcgtagatttgagtgtaatttgagtcatcagtctttagaccactctttaaagaaacaggattataatatcacatcaggggttacatttgaaaatacaaggacagtgcctaattccacctctaattgttcccaacaagctcataatgctgacaggtcattgtctaacaagtctatggttgcctttgataataaaaatacttcgatggtgctacaagctgatgaagactcatccagaatgcatgttttttgtctagagcatgctgcagaagcagaacagcaacttcgcccaataggtggagcccacatattgctcctttgtcatccagattcagagtttaaactggttaagaaacaagggaaccatggttataaaaccatgagtcttgtgatgggaattatgtcagtttatgttgcaaagtaa

SEQ ID NO: 98504 - DNA, 778 bp, Glycine max
  Peptide Sequence Number=SeqID_215282
atggtgggagtttgtgagggaaacggcgaggttttgtcatggctgaaatcgatgccggtggcgccggagtacaggccgagcgcggccgagttccaggatccaatcgggtacatattcaagatcgagaaggaagcttcaaagtacggaatctgcaaaatcatccctcccttcccaccttcttccaggaaaaccgcaatcgccaacctcaaccgctcactctcggaagccggctccacattcaccacgcgccagcagcagatcggagcggcgatcgctacacctcagcgagttcgagtccaaagccaagtccttcgagaagacatacctcaaacgcactccaagaagggctccggctccggctcgggcctgggcccgctggagacggagaccctgttctggaaggccacgctggacaaacccttctccgtggaatacgctaatgacatgcctggctcggcgttttccccgaaatgccggcacgcaggggatcccagctcactggcggatactccgtggaacatgagagcggtttcgagggccaaaggttcgctcttacagttcatgaaagaggagattccgggcgttacttcccctatggtctatgttgccatgctcttcagctggttcgcgtggcacgtcgaggaccacgacttgcacagcttgaattacctccacatgggcgccggcaagacctggtacggcgtcccccgcgacgccgccgtcgctttcgaggaagtcgttagggttcacggctacggcggggagatcaacccgctcg

SEQ ID NO: 98505 - DNA, 219 bp, Glycine max
  Peptide Sequence Number=SeqID_215283
atgtctcttcccctgttttttccagagaaaataaggtatgaagcagagcaggggttagtagaattaacaagtagaatgtgcccttttctgccgcttgctggttttttggttattctacttttacccccacaaaggtttaatattttcggattgggttcggtcgtgatgtcacggttgatgatgggtctcttgcgtctcaagcggagtcaaagacgatga

SEQ ID NO: 98506 - DNA, 273 bp, Glycine max
  Peptide Sequence Number=SeqID_215284
atggcaaaacctaccctgaagttgttgctatgcttggattgccacccattgttaaaaattgaatccattgcatctcaattagctgatagtatggagcatgctccagggggaagctggtggatgcctacagatttctgcatgaagataaggacatggagcgaggtttctcatggtctggaaacccagtgggaaggtttctatggaagtgatcattgtccagttaccttggagctctctcctagttctaactctcaaaatgaggatccaatataa

SEQ ID NO: 98507 - DNA, 276 bp, Glycine max
  Peptide Sequence Number=SeqID_215285
atgcagcactggcaagatccattcgacctctactacgtaatggtgctgcaaaagcaggctttatgtgtctccccactagaaattcatgggcacggagctaaaaaagaggccgttattttgaacactcctagccaggacgatccaatccaacagcagcccgctgtcctggccagagtagacatttacaatgaattttgttatgtcctgaagacccgaaccctgggggagcgaaggatacaatgtgaacactcagtataccagcccaaccgttcttaa

SEQ ID NO: 98508 - DNA, 444 bp, Glycine max
  Peptide Sequence Number=SeqID_215286
atgaaacggtttttcaaagtggtggagaaagattcagatgggtctgtgaagaagccaagagagaatgattcggaggctgaagaaagtaatgagaagaaggagccgttgaagtttatgacttggaatgccaacagctttctccttcgagtcaaaaacaactggcccgacttcaccaacctcatcaccacttttgatcctgatctcattgccatacaggaagtgcggatgcctgctgctggtgccaagggcgcgtctaaaattcagggagaaataaaagacgatacaagcgcggccagggaagaaaagaaggactggactcattgctggagtgcacctagcttggctgggggtggagatgggtacttgcaaggcactccgtactcaagttggtgcgtaataaatgtggttagagtgtttaggctaaaagttgggagatatgggtga

SEQ ID NO: 98509 - DNA, 2217 bp, Glycine max
  Peptide Sequence Number=SeqID_215287
atggaaaacaatgtattcgtgatggctgcgaagtccagtacaagtgtagtgcagtgcatgcgcgtggtactgttgaagaagaacgcgtttggaaaaatcgtgatgttgttcgaggggtttctgaccgatggacagagagagattctgaaaatagcgagtcagaatgtggagaatttgtcttcctcgccgaaatctccatcctccttgcttgctgaacatcatcatcacgtgagggctccttcagggggtggtaaggcacagactgctgggcatgctgccaggaatgtgcgccggtcgcactccggaaagtatgggagggcgaagaaggacggtgctggtggtaagggcacttgggggaaattgcttgatacagatggtgaatcccgtatagacaagaacgatccaaactatgatagcggcgaggaaccttatcaactggtgggatctactgttactgatcctttagatgacttcaagaaagccgtagtatccatcatagaggaatatttcagtaatggggatgtcgacttggccgcatctgatctcagagaacttggatcaaataaatattatccatacttcattaagcgtcttgtatccatggccatggataggcatgataaagagaaagagatggcttcagttctgctttcagcattgtatgctgatgtcatcagtcctgcacagattagagatgggttttttatgcttattgaatctgctgatgatcttgcagtggacatactggatgcagttgacatccttgctttatttctggcacgtgctgttgtggatgacatcattcctccagcctttcttgccagggccaagaaggctcttccagaaccttctaagggagttcaagtaatccagactgctgaaaaaagttatctctcagctccacaccatgcagaacttgtggagaggcgatggggtggtagcactcacatcactgttgaagatgtgaagaagaggattgctgatttactaagagaatatgtggatagtggtgacacattagaagcctgtaggtgcatacgggaattgggggtttcattctttcatcatgaggtcgtgaagagggccttggtacttgccatggagatccattcggcagaacctcaactgttgaagctattaaaagaagcagctgaagagggacttattagttccagccaaatggtgaaaggattttctcgtttggaagaagtcctagatgatcttgctcttgatattccatcagctaaaactcagtttcagtcattggtgcctaaggcaatatcagaagggtggcttgatgcctcatttttgaaaccatctagtgaagatggggatatagtagttgaagatgaaaaggtgaggaagtataaaaaagaggttgtaactataattcatgaatattttctttctgatgacattcctgaactcattcgaagtcttgaagatcttggggcacctgagtataacccaatatttttgaagaagctaataactcttgccatggacagaaagaacaaggaaaaggaaatggcatcagtactgctatctgctcttcatatagagatcttctcaacagaggatatagttaatggttttgtcatgcttctggaaagtgcagaagatacagcactagatatattggatgcatcaaatgagcttgctcttttcttagcacgagctgtgattgatgatgtattggctcctctgaatttagaggaaattagcagcaagttgcctccaaaatgcagtggtagtgaaactgtacggatggctagatcacttgttgctgctcgtcatgctggtgagagactattgagatgttggggtggtgggactggatgggctgttgaagatgccaaggacaaaatcatgaagctcttggaggagtacgagagtggaggtgttgtgagtgaagcatgccagtgtatccgtgacctgggaatgcctttcttcaaccacgaggttgtcaagaaagctttggttatggccatggagaagaagaatgataggatgctggatctgctgcaggaatgtttcagtgaaggtctaataaccatcaatcagatgaccaaagggttcaccagaatcaaggacggtcttgatgatctcgctctggacattccaaacgctaacgagaaattcagcttctatttggagcatgccctgaagaagggctggctcctaccatcatttgattccactgccacagatgtctaa

SEQ ID NO: 98510 - DNA, 1200 bp, Glycine max
  Peptide Sequence Number=SeqID_215288
atggcggcacaaagcaacgcgtttcttgctccttcttttcctcattcgattgcacataagcttgatgatttgactttccttttatggcgtcaacaagttgagccagtcatcaaatcacattgtcttcaatgtttcgttgtcaatcctcagattcctctccgttttctttctgaagaagatcatgaagctggcatagagagccctgtgtatgaagtatggcatcagcaggatcaagtgctgcttacttggctgcaatcgacgctttcaacgtcgatcgcatcacgtcaactgcgaactcagttacaggctacaaatcttggtggaaaatcgatgcacgagttcttgtcgcaaattaaagctcttttagatgctcttgcttccttcggaagtttgattatgcttcaggaacatgttgactccattcttgaaggcctaccatcagactatcactccatcattgcgattattgaaagtttgaacctctcccgatcgactctgtccgattcaccttccatcaactattcacaagcacatcgcaagtctctagcggttagctctaatgactattccatgccaaacaagacaaatccagagagtttcttggcttttcgtggtggatctggctgtggtggtggtggtggtcacggccgtggtggtggccgttttgctaacttccagtgccagtactatcaaccaaactcaaccttggtacttcatgatcctttgagtccaaattattctcaggccacctccactcaatctcaaaaaattacaacaattattcacagaatagtaacaattatggccaaaattctggtgatactagacctactaatgtttgaactaataacaattacaaatctgccagtaacaatcatcagtccaatcctagtgctttgctcacaaatgctcaacctcaatccaattccactaattggattccagattctagtgcttcatttcatgttacttgagaatcacaaaacgtccaacaactatagcctttctgaaggtcctgatccagtgttgtcaaatggtggttatggcggcgccatggcggtattgtgtggcggtttttttgaaaaaacgcctccaaatagcggtggtgttgcgggtttcaaatggcggtgccatggtggccgccgtaggcttaacgatggtggcagaatggcggttatgatggaagaaacttttttttaa

SEQ ID NO: 98511 - DNA, 234 bp, Glycine max
  Peptide Sequence Number=SeqID_215289
atggaaacggaaatccgaatcccgtgcttagctcggatctcgagcgaagacaggaggagggagtggatttgggaatcggaggaggcgaagaagagaaacgaaatggatgagaatatgaaaggaaaaggggccccaacaagtcaggcttttatatataaggatggtaccaacacgtcactctatccacgtgtcagcgccatgtgccctgtctttaaccgccacctgcctcgctaa

SEQ ID NO: 98512 - DNA, 1561 bp, Glycine max
  Peptide Sequence Number=SeqID_215290
atggcggagaagttgggagcagcagaagagagctctaattcaaaggcttttcaccatacggcgacgaagctcgtcgttttggcagacctcaacgtcgatcctcccgaagccgaagccgaagaagtggattcttctcttgtccctcctccaccaattaccattttgggaaatgatgaaaacagtcaagataaaagttcgttgtctaaagacactgatagcattgaaggtgaaagtaaaaagttgaacaaactgagcaaatcccgctccagaaagacagattcttctcttgattgtgtagctgatgtggatggcgatcaacatgttcaagggcctccttcatctcgggaggaaaaagttagcagtgtgaagactggcttggttcatgttgcaaggaagatgcccaaaaatgctcacgctcattttatactcggcttgatgtaccaaagattaagccaacctcaaaaggctgtgttagcttatgagaaggcagaagagatcttgctgaggcctgaggctgagattgacaggccagagttgctttctttagttcagattcaccatgcacagtgcctgatactagaaagttcatcagaaaatagttcagataaagaacttgaacctcatgaacttgaagagattctttttaagctgaaacagtcagtgaggtcagatatcagacagacagctgtatggaacacactgggttttatccttcttaaaactggtcgtatgcagagtgctatctcagttttgtcatcattgttgtccattgcacctgagaattatgattgcctaggaaatcttgggatagcttatcttcaaattgggaatttggaattatctgcaaaatgttttcaagaattgattttaaaagatcaaaaccatcctgcagctttggtcaattatgctgctcttcttttgtgtaaatatgcttcggttgtagcaggtcctggtgcaattgctgctgaaggtgccttgactgatcagatcatggctgctaatgttgctaaggaatgtttgttggctgcagttaaagcagatagcaaatcggcccatgtctgggcaaatcttgcctatgcattttctattagtggtgatcatcgaagttccagcaaatgcttggagaaggcagccaaactggaacccaattgcatgtctactcgatatgctgttgctatccatcgaataaaggaggcagaaagatctcaagatcctactgaactgctttcttgtgctggaaatgagatggcttctataataagagacagtgattcatccctggttgagattccaatagtatggtccgggcttgccatggttcacaaggctcagcatgagatagcggcagcatatgaaagtgaacagaatgggctaagagaagttgaagagcgtgctgtttgcagtttaaagcaggctatagctgaagatccaaatgatgctgtgcagtggcaccaacttggcgttcatagtctctgtgctaggcaattcaaaacatcacaaaagtaccttaaagctgctgttgcctgtgacaaggattgcagctatgcatggtctaacctag

SEQ ID NO: 98513 - DNA, 300 bp, Glycine max
  Peptide Sequence Number=SeqID_215291
atgaagcaagttgaagttaggagatccttgcactcaaggttgggattaccgtatgatcgtccccttctaagaatttctaatgccttggatttttcaaaattgaagaacaatgatatggtctctctacagaaaggttcaactttgctcagagatgtacacattgggattccaagtagcggggttactgggggaactgtttcccttgttcaaggttcatatgaatacttccattatcttcacaatggttataatgattcggcagttgcaaattatggtttggatatgggaaaagtcatttga

SEQ ID NO: 98514 - DNA, 2772 bp, Glycine max
  Peptide Sequence Number=SeqID_215292
atggatgggcggcggcattcagttgatattccaatttccaaaactcttgtggcactgaggagggtcaggtcattgagggatccaactactaattccatgagcaaactctcttctttggttgataatgtgcactgggaaaacggttctgccaatgaaatttccctccggttttcggatgccactcggctgtgtgattccgatgacaatgctgctttcagatcaaggaatttaggtttcaagggacatagggaaccggatgatgctgattttgtattgaatcatggcttgttgaactcaaggttgaagcctagtgggatgtcttgtaaggatgatcaacgagatgatgaactagtttactcaaagcctaatctgcagtgtacttctggagataaatcaccaagtgaaagctgtggtagcaaccatgggggtaaaggattggacttggcttgtattgtgcttccaagtaataatttcaaggatggggattcatgctatgtaggaactgctagatcatctcaattagggagaatagattgctccaagtcagccaaaaagtctctacgcaagaatcaagtgaacccatcggagttagcgggaagtattgctagcaatgaaggtagtccatgtccttctggttatgatgctttttcgccatattgtgcttcagtaggtataaatcaagatgttgatgttttagataataatgataatggatgtggaataagctgctgttggtcaaaatcaccaaggtttagagaatcaaatctatatggcgagatcgaagaccgtcccttgataactcaccgtgttgatgagacagatcttcatgcacacagaagcatgagacacaatggtggtggtgggattagtccaactttggaaactcctagaagtttatcgatgaaattcaggcctaaatcatttagtgatttggtgggacaaaatgtggtagtaaggtctcttttgggtgccatctccagaggaaggataacatcattttatctcttctatggtccacgtggcactggcaagacatctgcgtctaggatgtttgctgctgcactgaattgcctctctgttgtggagcaaaggccatgtggtctatgcagagaatgtgttttgttattttctggaagaagtaaagatgttaaggaagtggattctgtgagaatcaatcgtgcagaccaggttaaatcccttattaagaatgcaagcatccctccggtttcctcacgttttaaggttttctttattgatgagtgccagttattgaatggggagacatgggcaagcatttcaaatagcctagagaacctttctcaatatgtggtttttgtgatgatcactcctgatttggataagcttcctccaagtgcagtttcccgggctcagaggtatcactttccgaaggttaaagatgccgacattgtatgcagactagaaaaaatttgcgccgaagaaggtcttgaatttgaacaggatgctttggacttcattgctgcaaaatcctgtggttctgttagggatgcagaaatgatgcttgatcagatgagcttgcttggtaaaaagatcaatatttctttagcttatgagctgactgggatcgtatcggatgatgagttgcttgatttgctggatctggctttgtcatctgacacttcgaatacagttataagagctcgggagctcatgagatcaaggatagatcctttgcaacttgtatctcagttggcaaatctcattatggacatccttgcagggaaatgtgaaaatggtggttctgaagtgagaagtagattttctaggagatacagctcggaagctgatctgcagaaactgaacaacgcattgaaagtactttctgatactgagaagcacttaagattttcgaagaatcaaacaacgtggttcaccgtagccctcctacagttaagctctgtagattgtcaatctgtggatgcaaatgataccaagctgagccttagaggtgcatgcaatggagggcaaagcttggaacattttgacacaggtctgtgtgataacaagtcatacagattagaagtgccagaggatcacaaaggaacattggattccatttggtataaagctacggagatgtgtcattctggtcagctcaaaaattttctcaggaagaaggggaagttgtcttcacttcatgttgatcgcagtacagcttgtcttgctattgctgagttggagttccaccatcgccaccatgtatctaaggctgagaagtcatggaaagcgattgcaagttccatgcagttcatactgggttgcaacattgagttgaggatcacttatgcaccgtgtgcttctgatcctaaaagtccttatcatctaaatgaacgagggagtgaatcagattacgctgacaacaactcagaaaatcccaagaaggatagaacatctacctctgattgcggaatggatgctgcaacagctttgagaagtagtgaagggaatttgctcagctcaggagaaagatttttgaataggtcatttcaagagactaagaggacatcatttgccaaagtggatttctctaaggaagagggatacaattgtgcacatcttgatccatcaatgcttgattcagataataatcactctaactgttttcctaaaactctttggcttcaaaagaagttccgttcttcatattcatccaagttgacttttcagggtattctaccacagaaagattttgttgtatctgtcccgaagaagtgtacatgttctgggacatag

SEQ ID NO: 98515 - DNA, 243 bp, Glycine max
  Peptide Sequence Number=SeqID_215293
atgattcttgaaatggatttatctccaacagatcaagatacaaatgcaagtatagaagggatgcctcttgcacaaggttccctacttgtaaaggtggggattgtacaagattccttacctgcaaagatagggaaccttgtgcaaaaagctgcccttttcaaattaaaaacattaaataaaaataactccatttcaagaatctcagtaggcaacatcaaggatatgaaagataacttagcataa

SEQ ID NO: 98516 - DNA, 1071 bp, Glycine max
  Peptide Sequence Number=SeqID_215294
atggcggatgatagcaaccgcagcgtgagactgctatgccgcccgaagcagctcaacacaaaaggatccgacccgggaatccatttctggcttatcggatccccattcttcccgccactcaccgtcgcctccttcctccgccgcatccacacgctcccctcctccgcttcccccgatttgcccaaagaatctgaggaccttcgaacactcatccccaaaggcttcgaagtcgttggagccctagcttctggggacgatacccacgctcgcacggccgttgacgccgcgcgtgcattgatgaaccttctctacggcgacggaacagatcgaccggttatcggagcggtttgcggctcggattccggcgagctgcggtttgttgtgtcagagagtgaaaatgccacgggactcgaatctgtttcgtcggtaatagaggaaagggattcggagaagtttgtgtgggagaatggttgcttgcttcactgcgagcttccaattaagttgccactctattatagtctcaagaatccaactgatgttgagaaatcatatgcacaggttactgaatctgttattgccaagttaagagaccctcaggctgtgtacatgttagaaatgtcaaacaaagcctcccgggatatatctcctcctgtcataattcgaggtgtacaattagactttagcacagacctctccaagatcaagcctttggctgaggatgatgatggcttcaatgcaagctcactatcatgttcatacttttccatcagcagtaaagcaggctcaccagttttttctgcagagggtcatcatcagcttctactgtgcctgttgcagaatactttccagcttctcgtaattgaaattgaattattgatttcagtccaggaagaaactagactccttgttgtggatatcaagctagatgtactctgctattcttccagggagcttccactgaaatatgcagtttcaaatttaatcatacctggcttagttgaccaattaaatgtagtgcagaagttgatgttgcctaaccttttggcacaacaccctcgggtgaggcaatag

SEQ ID NO: 98517 - DNA, 789 bp, Glycine max
  Peptide Sequence Number=SeqID_215295
atgacgctaggttgcagacttgggaggttgaactccatagccgaaatagatgaccaaaaggaaacttggaagattgttgttcgagtgataaacatgtggattataccaagatcgcctaagtttattgttgagctaaatttagttcacaaaaagacttatgttattcataactttgaagtagaaaagaataatggtcattataaagcaacacgtcatggctttaaaattaattttgtgaaggcaactaaagtcacacctcacaaaatactagaaatacttgaaacaatgtacaacttcacaatgtttgatgacattgtaagtggttcaaccaacactgacttttcaatagatgttattggtgaggttgttgagattgtgcagtggaatctgcatggcaagccaaagaaagttgtatttacaatgaaagatggatggtttcgcatggatgtcatagttggtcaacctcatgagtctgcaatttttacactatgggatcgtgaatgttatgctctgataaaggagactgcagctgagattaagcagaaaatgattgataaggatgaagttttgccttctatatcaatgatgaacgagattaatgatgctagtgagagtcaatgtttctcggccactactgagtctgatccaactctactgggatccatcacactggctaagcacattttgccactgtctcatagtcaactggatgaaatatcattcgaagatttatcatccatacaactatccttaactaggctggacaaaaagcatatcaagactgaatga

SEQ ID NO: 98518 - DNA, 384 bp, Glycine max
  Peptide Sequence Number=SeqID_215296
atgacaagccaaaagaaccagcttagtgttactgacaatgtgtctctgtcggcgaggaggaagatcaacgcgatttgtcataggacaacgattctgtgtgattgtctgacaatgtcgcacttctttatgaaggagagaatggtggcattggatggggaatatagtgcaggggagcggatcgagaagacgtcaaatttaaaggagcatgatgataaacttgaaggtcagatcaagaaggaactagaggaggacctagtaacaaaagatatcaacaagggtgatgagggagagatggtggtgagaaagatagtcgtcgacggtaaggttggtgaggagtctcgaccaacgagccctttttcagaaactaaggagtggcagggctag

SEQ ID NO: 98519 - DNA, 522 bp, Glycine max
  Peptide Sequence Number=SeqID_215297
atgacgcggccaacacgaaaaccaccacagagggtggcgcgctgcccgtggcaccattggtgcaaagtccagcagcacgagcccggcccagggtcggcggcggcactacagcaatggtggcggaggtttgacggtggccgggtaggcctcgccgacgaccatggtggagtcaccacaaagggtggcgcggtggttcgaaaagaagaagaagaagaaggaggggaagaagaagagacagaaaaaaaaaacaaagagaagaggaggaaacatgagagtgaaagagtgaggaataaggggttacttgatgagaagaggaggaaacatgagagtgagagagtgaggaatgaaggattacctaatggcccctcttcttctctgacaaaactcatcaaattgcaccactggattggttcctttttcttcttgggatcagtgcctcactcctctgtgtcttttgctgagactttcctctttttccttttatgcaatctgctctctcttgacctaatgggctctctttaa

SEQ ID NO: 98520 - DNA, 414 bp, Glycine max
  Peptide Sequence Number=SeqID_215298
atggatggctatatgcatgacatttttaaaacttgtgcaaggcaaaatatactagattcactactggtgaccaagttaaaagaaatgcttgatgaacacaatgtgtttgctaagtcctttaggatggccaaagataggtatgattactttcagatagagaatcttaacctgctattgataacagacgggaaaaaggatggaagaatctataatttgcccatagttttagaggtggctgcagttattgttggtgacgcaaatcaatctatcaatcgagacattatacttgaaagacaaagtggacatttacaaagaatcaatgagcttcatccaagttatcttggattgcaatatcctttcttgtttccttatggtgaagatggaactgcagtgatatcaaacatagagatatag

SEQ ID NO: 98521 - DNA, 510 bp, Glycine max
  Peptide Sequence Number=SeqID_215299
atgatgacaaaggtgatgacaaaaagctcaaaggtcaatcaaaggatgagttcaagatgttcaagaaggaatcaagaacaattcaagactcaagaggaaaagttgaagaacacttcaagattcaagaagaaggatgaattcaagaatcaagattcaaggatcaagcttcaagaatcaagatcaagattcaagattgaagactcaagaatcaagagaagacttaatcaagataaagggtacatctacttgggtttgactgagaacaagagagggtacatctcttgtggatcagttctagtggagggtacatccactaggttcaaagagaacaagggagggtacatcccttgtggatctttgcttgcaaagtattatgaattggcaaaaataatgatgcagatcacaagaactgaagagatgttcaacaccattattgcaaaggatcagacttacggtgaagtcagtaggccgtttgttgttagatggaaggaccagctagaacatcactag

SEQ ID NO: 98522 - DNA, 1527 bp, Glycine max
  Peptide Sequence Number=SeqID_215300
atgggcgtcattctctctcagaagaatcatccaattgccttcttcagtaagttgttctgccccactcttctttgcgcatccacatatgtcagggagttagccgctattaccaccgccgaacttcagaaggagctcaatgctaatcctttattcttggaatatcgccgacgcattcaagacaaccccagtgagcatccagactgcactattactcagaatttcatcttgcagaagtgtcgcctatggctacccaaagactcaccaattatctccacaatcttgaccaaatttcatagcactcccactgggggtcacatgggcctagccaaaaccctggctcgagttggagagaatttcatttggacatcaatgatgaaggacatcaagctcttcatcgccacatgtctcgtgttccaacagaccaaaaatgatcactgcaagagtgtcggcttactctgcccattgcctgtacagacaagaccctgggaggacctctccctcgatttcatagtgggccttcccccataccagggccattcaaccatcctgttaatctttgatcggttttctaaaggcatgcatctcggattactgccagcccattacactgccttcgaagttgccaaagtgttcatggaaatctccggtaagctccacagcacaccgcggagcctcgtctctaatagggacccgctattcatcagtcatttttggcaggaattatttaagctcaatggcacgactctcaggatgagtaccattcaccatccaaaaatggataggcagacggaggtaatgaatcgagtgatcgagcaatacctcagagctttcgttcatgacaaattgacgatgtgggaccatttcctcatgtgggttgaatggtcttacaacacttccacacacttagccacaggaatgtcaccttacgagatcacattcggaaagaaaccaccaaccctccctcaatacttggcgggggattcaaatgtggacgtagtggatacctggattggtcccgtagcttacaagcttgccttgccacccacatcccgcatccatccggtttttcactgttcgatcctccgaccatatcgcccaccattgtcatccacagaaacccccatcttgctccctagttcagccgaagacaatcaaccaattattacccccctcaccatactgaccacaaaatggcaaggctctggaagtcttcgacaattactggtgttagtccaatggtctggcctcctcccagaagacacttcgtgggagccatggttgaccctcaaggaaacttacatccttgaggacaaggttgttttcgatgcacacgggaatgttatagccaaagacatagaacaccaacatccagaacaagaatcaagcaagaagcaccaagaggcagaaacagagccagaatcagaagcaatccaggtgtggcatggaatgctcagcactgcagcaagtggcaatgcagcaaatgatcctgaattccttttgtcggctaaggtggcacctttctgttag

SEQ ID NO: 98523 - DNA, 201 bp, Glycine max
  Peptide Sequence Number=SeqID_215301
atgaggcacaatgttatagccaaagacatagaacaccaacatgcagaacaagaatcaagcaagaagcaccaagaggcaaaaacagagccagaatcagaagcaatccaggtgtggcatggaatgctcagcactgcagcaagtggcaatgcagcaaatgatcctgaattccttttgtcagctaaggtggcacctttctattag

SEQ ID NO: 98524 - DNA, 159 bp, Glycine max
  Peptide Sequence Number=SeqID_215302
atggggagatccttgagtcctaatccatcaattagatattgcatcttgcatgtgcaccagaaagaaactgaggttgagaaagaatgcaacaagacaaggagggagcaattaacaccaggtgatttgagacctcttccaccaaaggccaaagccaactaa

SEQ ID NO: 98525 - DNA, 621 bp, Glycine max
  Peptide Sequence Number=SeqID_215303
atggcggaagcaacgagaatgaaggatttggtcgctgacctcaaacaagttactgatattgtctcgaagcatgactcagcaacaacaccgcacgactcagcaacaattgatacgcatcgaggatattctagcatccttccaatgcacactcaatactatcacccgttccgtggattgtcttaccacaaacaccctgattggagctttgttgtcaagaacccaatcgtgaccggtgaatggttattccgtgcggagcaattttcctcatattatgaaacttccgatgcgcaaaagctcaccattgttgcggtgcattttgaaggtccagtggtgccgtggtttcagatgttgcaaaaagccaatctgattcctacatgggccgctcttgcgcaagcaattgagaaacaatttggcccatcccaatttgatagcccaagggcccagttgttcaaattatcccaaaccaattctgtggcggattactacaccaaattcatgacacttgctaatcgggtcgagggattgactgaaccggccttgcttgattgttttattagtgggttgcgggaccccattcgacgtgacgtcattgcccaatctcctcccaccctattgcgggca

SEQ ID NO: 98526 - DNA, 294 bp, Glycine max
  Peptide Sequence Number=SeqID_215304
atggccatgaccatgacagcgagtaataacaacccaactgtattctttaacccaacaacttctaagtatttggcaggaaaacaaagggtagttggattggacactgaatggatccctgtcgaaaagaccaagaagaaagttgcaattttgcaactatgtattgagaacaagtgcctaatcattcaattgttccatatggacaatattccccaatccctaaggagctttttgatggactctaactttgaatttgttggggttggagtgatgaaggatcttatgatgcttaattaa

SEQ ID NO: 98527 - DNA, 2871 bp, Glycine max
  Peptide Sequence Number=SeqID_215305
atggctcctccaagtcctgttgtagagagtgattctactgctttacttcaccatctttcgttacaggcttatcaaggttctcctagttgtgccaccatccgctttaagggtttcattgcaggaaaattggtgcaagtacttttggacggaggtagctcaaatagttttattcaatctcgtttggcccacaaccttcagcttcctatggaacctaccgcagatgtgaaagtgatggtggggaaagagcattatttacatgcggaaggagttgtccgcgacttacctctcattattagtggtcagaccattcgtttcccggcatatgttttgcctgtattaggtgcagtggtggttcttggagcatcttggcttgccacattaggggcccacattgcagattacagctctactagtattaagttctatttggatgatgcttttgtgaccttacagggagacacttcctactgccattctgttgcgcaatttcaccatcttaagcgttattctgctactcatgctattgctgagttatatactttatcttgctccccacatgattcatcggttactcattccatggacttgccagctgacttacatcctgacttggtggctatcatacgtcaatttttcatggtttttgatgttccaaagggtctcccaccaccacgcactcaggatcattctattcctttacaagatggccttatccagccaagtactagtcctttttcagcttcagttatcttaattcgcaaaaaggatggttcatggtgtttttgtactgactacagggctcttaatgttgtaacggtgaaggattcctttcctattccaacagtagacgaattacttgatgaacttaagggctctaagtttttttcaaagttggatttacgttttgggtatcaccaaattttggtcagacctgaagattgccacaaaatagctttcaggactcacaatggacattatgagtggttggtcatgccctttggtttgactaatgcaccggttaccttccaggcattgatgaatgatcacttagctatagtgttggattgtctccgccaacatcagctatttgctaaattgtcaaaatgttcatttggacaacacaagctggagtacttgggtcatattgtttctgaccaaggggttgaaatggacccttctaaggtccaagctgtccaagattggccttgtctcgccatagtaactcagttgaaggcttttcttggtctcaccagatactattgtcgattcattaatcgttatgcatctattgcgggacccctcactgatcttttgcaaaaagatgattttcgttggacttcagaagcggataatggccatccaattgcttttttctttaagaagctttcttctcgtatgcagaagcaatcagcttatgttcgtgagttgtatgcaattactgaagcagtggctaagttttgtcattacctttttggtcattattccattatctggacagaccaacgtagtctcaagcacattacggaccaaatcattcaaacaccagagcaagagtccttgttacctaagcttcttgacttcaacttctcgattgagtataaacctggacccactaatcaagttgctgatgctttatcatggtctttctatatggctctttccaaccctcaagcaaaccttctaaatgacatcaagggtgtggttgcatcatccccaaccatgcaacaattgatccaacaattccagtatgatcctgcttccatgccgcaacataaattgaggaatgggttgctatttttgcatcactgtgtaatcatacccattgaagcacgtgaacttatcacacgtatattacttgaatttcattcctctccgattggtggtcatgttggatttcttcgcacttatgctcgattggctacttattttttttggcatgatatgcgtaaggatatcttttgggaagatgtggctatggattttatcactggtttaccactatcaaaggggtattatgttattttggtagttattgattgcttgtctaagtttgctcactttgcttcattacggtccaattttacagcacaacaggtagcagaggtgtttcttcagaatgtgggcacttctttgaggataagctctgtttatcatcctcaaacggatgggcaatctgaagccttgaacaagtgccttgaaatgtacttacgttgttttgtctctgaaaaccctcatttgtgggtttcttttctaccatgggctgaattatggtataatagctccttccaaacttcaataggcatgactccattcaatattttatatggtagagaccctccaaccatcattcctagtgttgtccgtgatgatacaccattcgatgttcatgttcagttgcgaactgaggttgtgttccaagttggtgattttgtttttgtgaagttgcaaccttaccagcagcattctgtgcgtcttcaacgccaccaaaaattgtccatacactattttgatccctttaaggttttagaacggattggtaatgtggcatataaattagagctcccttcagacgccaaaattcatcctgttttccatgtttcattgttgaagttgtgtcagggtgatcctgtatctcaatatattcccctgcctcctatctcatcatctggagggtcacaactgcaacctatagttgtgcttgatactcacaaggtccttttcgatggggagggtaatgttatgattaaaaatgctgaaggtgtgacatcaaaggaacacatggagggtgatccaagtagaaaagataatgtgcacaattctgttagaaggagcaaccgcatgcgcaatgtgcctgcacgttttaggaactaa

SEQ ID NO: 98528 - DNA, 246 bp, Glycine max
  Peptide Sequence Number=SeqID_215306
atgggagaactagagtatgcagagcttagacaaggagggactaaacaactaaatattcagtttttcaagaccatacaagcacgaatgagagatccaaattaccagttctcaccggatgtaaaattgaaaccaaagagtaaactagttcgagaaaaatatggcaaaaggcagagttcagaaggagaaaagtacgaaaaagataacattgaagcagaagttaggctaataatgttattctgtctttaa

SEQ ID NO: 98529 - DNA, 303 bp, Glycine max
  Peptide Sequence Number=SeqID_215307
atggattcccctgcagtttcctctatccactttcacaacgcccatgtcttacccgaaccagacctttttatgcacactcccggtggcttcggcatccccagttttagaaaacgtcattgcgtccaaccgagtcgtcaaaatccacggcgttcccgacggcgccgtcacggccttcgtagcgttcctctactcctccaggaattaatagggtgcgcgcaggtgcacggaggaggacatggacaagtacggaatccaccttctagcattgtcgcacgtgtattcggtgccgcagctgaagcagag

SEQ ID NO: 98530 - DNA, 1918 bp, Glycine max
  Peptide Sequence Number=SeqID_215308
atgtggttgcggaatctgctaaacgtgtggccattcagagtggacgagctgagagattcgaaacaactggtgaagaaactgagcgtccccgaagacacgaagcaattcgtgttcgcggtgcgcgatccccaaacccaaaccctaatttacatcctctccgtcctcaacttatcggagcgatcagcctccgacgccacgtgtctcatcagggagatcaaacccgacgccgttttggtgcaagccgccgccgccgctgccgccgctgtttcccccttctctcagcttcagtccgaagaagaagaacaacaacacttcgttccgttaccgacctcatctttcggggtactcaaacgttgccttgttgatacaattggtacggacaagtacgagactgttgcagggaacttcgtgctgagggagattttcgggaccagttttcatggtcccttgttggcggctaagagggctgctgaggatgttggatcgtcgttttttgttatagagtctccctctccctctccctcttgttggggcaataatagtaataataatagtgatagtgattgcaataatggtggtggagttgttgacagtggtagccattttcgaagtcttgttaattgtttggttcctcagcagcatgctgcttcttgggctccttcggctttgaaaaggttttctcttgataaggaacttaggatgatgttggctaaggctttgtcgtggaattcgggtccacttttgcttagtagttctgttttggagaggggtagtattgaggaaattcggccttcaagtagttacgagaccccgggttttgccaggtctatttatcctttgcttgaggatttgtatagtatatttggtgatcttccgtcactcgggaaggcactggcacatgtgcagaagatgttgttggatgtgaatagaggggaggttcttgataaaagtaccgtttctgaggtctatactttccggattgctgttgaggggcttagaattgctctgaataataaggggttgaggcctgttaacgggaaaggtgctgcaaagtcggataagattgagttctcggatcttcccattgatgacaagtcacacgcgctcttcgcacaggctatccggagccaggctgttaagtttaagaccattgtggtggtggttgacgctagtgccttggctggtcttaggaaacattgggatactcctctccctgttgaagtcaaagagctgattggagaactaatcacaaattctgaaggtaaaggggttatgttgaatcataatgagaagaagcggctattaacagataaatctatggtggcagtaggtgccggagcaacagcagttttgggagcttcatcgctgaccaaagtagtccctgcgtcaacactggtgaaggttgtcactttcaaaattccaacttcactcaaaatcggtctcagccagatgcagaaagtgctggcttttgcctttggcccttctaaagttgtggctccagggattgcaacttcaggagcaaaaacgtctggcatcatgaaggcagcagtatctaccgaaaagattcgaggagttgctcacagtgttatagcctctgcccaaaaaaacagtatttcagtcatgagaacagctttctatgaaataatgaggaagcgaaaggtgcagcatgttgggttcttgccttgggctacatttgccggcagtattggaacttgttcaggcttgcttttttatggtgatgggattgagtgtgctgttgagtctctccctgcagccccctccattgccagtttgggtcgtgggattcagcatctacgtgaggcatctcaagcagtgatgcaaacagaaggaagtcctgaactttcaccacctagtcctgctagatgcaattcgagtcttgctaactgctgtaaaagag

SEQ ID NO: 98531 - DNA, 885 bp, Glycine max
  Peptide Sequence Number=SeqID_215309
atggatccaatgcctgcaatatcaaaaaaattcttgtatgtggcgcaacaggaacatcaactatcaggtaacacttctttaaatctcagccttgaacctaaagagaattcaatcaacgccgtgaagactgtttgtgacttctgtggacgagttaggcacacgaaaaatgtttgttacagcaaacatggcattccttccaattacgacgggaagaacaaaggaaacaacacgaggagtggaaagacgtgcactcattgtgggaaaaacggccacaccgttgatatctgctataggaagcatggcttccccctaggatacaagttctataatgggaagacaactgcaaacaatatagtggcagtggatagtagagccacagattatcaaattcaacatcaagagtctcaagaagcaatttgtttctctcttgagcaatacaaagcattgcttgccttaatccaacaaccatcttttgggaacacagcttttaccaaacctcaggatacgaacactcaagcgaggattggtacagttgaagtgagacacgacctttatcaactcacaccagaccatataataccacataccatatgttccaccactgttcgtcctcaatgtaatatcattcccatagatctttggcactttcgaatgggtcatccatcctctgaaagattacaatgcatgcagtcttattatccctttttgcaaaacaacaaaaacttcacatgtaacacatgtcattatgctaagcataaaaggttacccttttcttccagcaattcacacgcatctaatagctttgatcttttgcacatagatatatgggggccatgttcaaagatttccatgcatggccatcgttatttttttaactattgttga

SEQ ID NO: 98532 - DNA, 484 bp, Glycine max
  Peptide Sequence Number=SeqID_215310
atgggttgccaccataggaggatcaaacacaaagcttcacacatttcttcaatggcggactgggagggggttgagaaagaatgcataggagttgatgtgatgcaagatagaggaaacacatctctaggttgcaaaaggttgtttggagggggttcagacctacaaagctccttcactaacatggaaagagggctagatatgtactatcacatacctatagcaaagaatggggagacaagaaattcaaaatgcaacttaggtaaagatatagccgttgcgaaccgaattgggcctggggaggtgtacgacgaggaactcctttccatgggaacgacgctgcgacaacgtgcttctggcgacgaccatgtttttcaaccaccacctctgacacccaaacaggatgacacccttgcttcaaaaaaccaaccaggcgacaatgacgaggcaaaaagcttacgagtacgggatttccacaaccaagaag

SEQ ID NO: 98533 - DNA, 342 bp, Glycine max
  Peptide Sequence Number=SeqID_215311
atggcactcagagaattgtcaagagataggatgtgtgcttgtgttgctcaaaattgtcagttaggtgccgacccagaagctgtgacacataatttttgtgtcgtgcatgctatctgttgttattgtatgcttcaaggatcatctttctcttgcatgctgatcacgctatcagagattaaggagttgaggtggtggagtggaggagatagttatcatttgactccagactctggcatgacgtccttgcttgttgcaaaggattacagtagcgtaatgcatcgggcaccaccaattttttctagaattagcgtttattatgttggcttttggatgaagtattag

SEQ ID NO: 98534 - DNA, 1218 bp, Glycine max
  Peptide Sequence Number=SeqID_215312
atggcaatgaagaagctcttgtgggttgtcctgtctctatctttggttcttggagtggccaatagctttgattttcacgacaaggatttggcgtccgaggaaagcttttgggacttgtacgagagatggaggagtcaccacacggtttcgcgaagcctcggtgacaagcacaagcggtttaacgtgtttaaagcaaatgtgatgcatgtccataacactaacaagatggataagccttacaagctgaaactaaacaagtttgctgacatgaccaaccatgaatttaggagtacctatgctggctcaaaggttaatcaccacagaatgttccaaggcacgccacgtgggaacgggaccttcatgtatgagaaggttggtagtgttcctccttctgtggattggaggaagaatggtgctgtcactggtgtaaaagatcaaggccaatgtggtatgggggagggatgttgtacgcagccttacccttgcatatgcaaagaggctgtttccggattcgaacccatgaccaacaggtcaccaaggcacaactttaccgctgcaccagggctcgccctcttatgtagttgttgggcgttttcaactgttgtagctgttgaaggcattaaccaaatcaagacaaataagctagtctccttgtctgaacaagagctggtggactgtgacaccaaaaaaaatgcaggatgcaatggtgggttaatggaatctgcttttgagttcatcaagcagaagggaggcataacaacagaaagcaattacccttacacagcacaagatggaacctgcgatgcatcaaaggcaaatgacctagctgtatcaattgatggccatgagaatgtccctgctaacgacgaaaatgcattgctcaaagctgttgccaaccaacctgtctctgtagccatagatgctgggggatctgattttcaattctactctgagggagtatttactggtgattgtagcacggagctaaatcacggtgtagcgattgtagggtatggaacaactgttgatgggactaattactggacagtgaggaactcttggggaccagaatggggagaacagggttacatcagaatgcaaaggagcatatctaagaaggagggactttgtggcatagctatgatggcttcctacccaatcaaaaactcctccaataatccaacaggaccctcatcatctcctaaagatgaactttga

SEQ ID NO: 98535 - DNA, 330 bp, Glycine max
  Peptide Sequence Number=SeqID_215313
atgaatttaactgaccaatcacatctttatacgtctagtggatcgtttgttatgcatgatgcacaggacaggaccaacacggtatacagttattacttattagacccaacttcagtttcggtatcatgggtcgggaacaagccaaacatgcgtgcatcagtgacagttaaccttgctgttttggctgaatgtgacaggcaaattcgattaaaaatggagcaagagaacatgaaagatgacgcaaggtggaaactactggtgaggaaggtggcctcggccaaagccttgtcttccttggcgctgccaaagaggaaattagatcagagctag

SEQ ID NO: 98536 - DNA, 1050 bp, Glycine max
  Peptide Sequence Number=SeqID_215314
atgcaagctgagttacaagctcttcaactgaacaacacttggactcttactactctccctcctcacaaaactgtcattggctgtcgctgggtatacaaaatcaaatatcaggttgacggatccattgaaaggtataaagcccgcttagtcgcgaaaggttatacacaaatggaaggcttagattatctggatacattctcccccgtagcaaagctcactactgttcacctactactcgccttagctgcacttcataattggcatttacatcaacaagtctatatgcatgttcctccgggtctttcagttgacaaaccacaccttgtttgtcgtcttcaacggtcttgtacgggctcaagcaagccagcaggcaatggtttactcgcctctcttcgttccttgtttcccatgattttcaacaatcttccgttgatcattccctcttcctgtgcttcaatggatcttggcaacttaaagtttttccttgggcttgaaatcgctcgctcttctcgtggaattcacttatgtcaacgtaaatatacacttgacattctctctgactcaggcatgtttggttctcatcccacttcgactcctatggattactccacatgtttacaagcttcatcgggcactccactgtcaagtgaatcttcctcttcgtatcaccgtctgggtgtcgggattctagatgctccatcactaggttttctgtttatctcggtgcctcccacatctcctggaaatcaaagaagcaatccacagtctctcgcagcttttccgaagctgaatgtctccaccatacaaatagcttccaatcttgtgttccacaaacgaactaaaaacatcgaagttgactgtcatattatccgtcacaagattaacatcaacctcatcaagcttcttcctgtctcttcctccatgcaactcgccgacatctttaccgaagctttatctccagctatctttcaaggtctttgttccaagctgggaatgatgaacctccattcccagcttgcggggagctctcaacagcaattagttaattag

SEQ ID NO: 98537 - DNA, 328 bp, Glycine max
  Peptide Sequence Number=SeqID_215315
atgggaggatttggatgtggaaaaaggccgatgcggcaagagtttagaccatgcgctttacttgttgagctgaaatgtccaaagagagcattaaagctaatctggggagggatactaggaagtgttttggagcttaggtcaaggggggttgacaaagggtctattgcgagtgacacatcgacgatccttgattttgtcttcctgaaacttaatgattgccaccacttgggactagaaatgaagcaattgaaaggaatgtgggaggccaacaatttgattagcgaggcattcaatatcaatgaggtactcgatcactatgctacgctag

SEQ ID NO: 98538 - DNA, 561 bp, Glycine max
  Peptide Sequence Number=SeqID_215316
atggatattctgaatcaaatctttcatcctgatgacatctctgttgttattcacactcttgttgcggctgtgaattttgaggacaagcttattggctccaagagtcaagctgatgttatggagggctaccttctagaagcaacatggggatgcgaggagtccaatggttccaacaatgtaggaactcaaggtcacaaacaaaaccatcgtggacctcgaggaggtggatcaaattcctactctactgtcaatgttgcaaactcttcccatggtgacaaccaacaagatattggtatatcatcatcatccaactcctcacatgggatttctaaagaacaacctcaacaaattgctcatgcactatccatgatgaatgcaactggtaatatgatgcttatgcaaatgttgcagactcgcgacaagatcgatatttctccaactaataagcgtgagcattatcatcaactattgaggatcaagcctcctatgtgttccttcgaatgcaacatggacgcaacattgtttgaagaatctaaccgcattgcactactacaaataatg

SEQ ID NO: 98539 - DNA, 186 bp, Glycine max
  Peptide Sequence Number=SeqID_215317
atgggtgaaatccaagatgacgtcatttcgctcaagttggctacgaagctgagccgagccgtgttcgttgggcttgggccactggtcccaattcccaagttggctcggagaatcctactatttttatttctagctacaaaaatatgttctctcacattgtacggacggattggagatggttcatga

SEQ ID NO: 98540 - DNA, 1905 bp, Glycine max
  Peptide Sequence Number=SeqID_215318
atggtgctactgaattacatgtctagctatgcatggcatgcgaaagttgtgttaaccttagctgcctttgctgttatttttggagagttttggcttgttgctcagttgagtgctgaaaacacacttgccaagtctgtggccctacttaagcaactacctgacattgctgagaatttcatgtccctgaagccccattttgaggcactcattaggctcgtgaaggcggcaatggatgtaaccatgtgcattgttgaattcaaggagctaccatctgaatacatttcagaggatactcctcccatgtctgttgcaagtactcacattcctattgcttcctattgggtcatcagaagtattgtggcttgttcctcacaaattgctagtctcgtaggcatgagaaatgaatccatttcatcaaccacagaggcatgggaattatctagtctggctcacaaagttagcagtatatatgagcacctcaagaaccaactggttctttgctaccaatatatagatgacaagaggcatatagaggccttccataatctgatacgtcttttcgagacagtccatgtagacaacatgaaaattctcagagcactgatatatgcaaaggatgatgttcttccacttgtagatggaactacaaaatcaagggttagtctcgaggtactaaggagaaaacatgtgttgctgctcatatcagatcttgatctttcacaagaagagatcctggtacttgataatttgtacaaagatgcccgagcgaggggtgatacgcactatgagatggtatggatcccagttgtggacaaagcaacctggaatgagacgagcaaacagaagtttgagtatttgcaatcattgatggcatggtacagtgtctatgatcctttcatcattgaaccatcagcaattaagtacatcaaagaagtgtggaatttctcaaagacagctattctagtggcccttgatccacaaggcaaattgtcctcccctaatgttgtccatatgttatggatttggggaaatttggccttccccttcacaagtgagaaagaagaatccttgtggaagcaagagatttggagccttgagctgcttgttgatggcattgatcctacagttttagaatggatgacagatggaaaactcatatgcctgtatggaggcgaagacctggagtggattgaaaaattcacaaccacagcaataagtgttgcaaaagctggcaagttcgagctagagatggcgtacgtgggaaagagcaacgcgaaggagcgtatgcagaagatgatcaagaccttcaccacaagaaagttcagttacttctggcccaacgtgacatccatatggttcttctggacgaggctagagagcatgctgtactccaagctgcagcacgggaggacggtagagaacgatgacatcatgagccaagtcatgaccgtgctcagcttcgatggcagcgatcgaggctgggcgatcttctgcagaggcgccaccgagatggccagagccaagggtgacagtgctctgatatgcttgcaggactttgataagtggaaggacagaattgaggaagatggtgtggtgcaagcaatgaatgattatctcaacaaaaacaaaccaccacatcactgcaatcgcttgatccttcctggtagcactggtggcataccgcagaaggttgtttgtgctgagtgtggacgccaaatggagaagtacttcatgtatcgctgttgtgtggataaggctgcgagtcctggtgtagcggtaaagttgtgccttggtgatttgttggtcatgggttcgaatccgaaaacagtctctttgcatatgcaagagtgtatccctcccccataccttcgcatagcgaagagcctctgggcgatggggtactaa

SEQ ID NO: 98541 - DNA, 1173 bp, Glycine max
  Peptide Sequence Number=SeqID_215319
atggggttgcagcaacctcatttcccacaaagccaagataatgggtctgtggggcattatgggtattcacctcagagctatggtggtggtcgtgctccagaacaaggaaagagcttggataggaagtattcaaggataggtgatgattataagagcttggaccaggtaactgatgctctggcaaaagctggcttagagtcttcaaatctgattgttgggattgattttacgaagagcaatgagtggacaggtggaaggtcatttcaaaggagatgcctgcatcacattggtcatgaacaaaatccatatgaacaagctatatctatcattgggaaaacattgtcttcctttgatgaggataacttaattccctgttttggttttggagatgcatcaacacatgaccaggaagtttttagtttctatccggatgagagattttgtcgtggatttgaagaagtgttggaacggtacagggagttggtccctcaattaaagcttgcaggaccaacatcatttgccccagtcattgagatggcaatcaccatagttgagcaaagtggaggccaataccatgtgttagtgattatagctgatgggcaggtgacgagaagtgttgacactgagcatgggcagttgagtgcacaagaaaagaaaactgtagaagctattgtgaaagctaggcatgtatcttctgttaaaaaattgtcagttagttgtgctgagcatgaaataatgtcaaagaacatggatcggtccagaaaggaaacggagtttgcactcgctgccttgatggaaataccctcccagtacaaggcaacactagagcttaatatattgggtgcttgtagagggaaagatatagaccggattcctctcccaccgcctctatatggtgcagcatctttcaattcccccaaaacttcccgtcaatatagttctcgtcccagtgcaccatctagcagacatgatgttagcacaaaccctcctgcaacttctgcttctgataatcaggtttgtcccatttgcctcaccgatcctaaggatatggccttcggttgcgggcatcagataggtaggacttgcgggttaatttctcacaccattgacataacattgaaattttcatgtaattgtgttagtgttgggaacgtgaacgaaggtactggctga

SEQ ID NO: 98542 - DNA, 2205 bp, Glycine max
  Peptide Sequence Number=SeqID_215320
atgatgatcacggcggcgccgactgtgaatgacgagtgccttacggtgaggggcagggcggttttgacccatgtccccggaaacattgttgtttctccggttggaacagagtccgctttcttgggtgcaacttcaagcatttcaagttcacgtcatgtttttgttcttggaattcttcagggatataagttgctatctttgttcagagttaaaatctggtggatgataccacgtatagggagatctgcaagtgatgttccaatggaaactcaatttctgctccttgaagcaagagaagagtctgcccttgaggatgagctttcttctgactctgaagagccaactacagagaacagttgctacattctcttcttgcctgttttggatggacagtttcgcgcaactttgcagggaactcaatcaaatgagctccagttctgcattgaaagtggagatgctcatgttcaaacttcccaatcactagaagcagtatttgtaaattcaggggacaatccatttgagttaatcagggattctatcaagatgttggagaaacacaaaggaactttctgtcgtcttgaaaacaagaggattcctgcacatcttgactggtttggatggtgcacttgggatgctttttacactgaagtgagtccaaatggaataagagagggccttcagagtttctcaaatggaggttgttcaccgaagtttatcatcattgatgatggatggcaagagaccctgaacacttttcacaaagaaggtgaaccagtgattgagggaacccagtttgcaaccagactgatagacattaaagaaaacaaaaagttcaccgatgcaggctcctacaattcttgcgacaatctccacaattttgttgattccattaaacagaatatgaatgtaaaatacgtttacatgtggcatgctttagctggttattggggaggtttacttccatcatcagatacaatgaagaaatataatccaaagattgtatatccaattcagtcacctggtaccacagggaaccttagagatatagccatggatagcttggaaaaatatggagtgggagtcattgacccagaaaaactatatgacttttacaatgattaccacagttaccttgccagttgtggtgtggatggagtcaaagtagatgtccaaaatttgatagaaacgttgggttctgggtacggtggtcgcgtttcgttgagcaaacggtatcaagaagcactagagcaatctgtaacaaggaactttaaggacaacaatctgatttgttgcatgtgtcacaactctgattcaatttacagctcaaagaatagtgcagcagtaagagcatctgaggatttcatgccaagagaaccaacattgcagaccttacacatcgcctctgtcgcgtttaacagtcttcttctgggagagatatttgtgccagactgggacatgttccatagcaagcacgagacagccgagttccatgctgcagcaagagcagtaggtggatgtgcagtatatgtcagtgacaagcctggaaatcatgattttaaaatcctcgagaagctagtgctggctgatggatcagtcttgagagcaagatatgccggccgccctactcgagattgtttatttgaagaccctgtaatggatggtaaaagtctgctgaaaatttggaatttgaatgttctgaccggggtggtaggcgtcttcaattgccaaggagcaggatgctggccactgaaatcattggaagccgcacccttgcgcataaccatttcagggaaagtgagaccccttgatgttgaatttcttgaagaggttgcaggcttgctttccaagatatcttgcagaggaaaacttgaagtgtccctggagactctccattgtgaaatatatacagtatctccaataagggtgtttggtcatgatgtgctattcgcaccaataggattgcttgacatgtacaattcaggaggagcagtagaagccttggactgcaccatggatgttgcacaatgcataatcaaaatcaaaggcagaggatgtggtcgttttggagcctactccaacgttagaccgaaactttgtgtagtggacatgaaggaggaagagttcttctacaaccgtgaagatggattattgactattacacttgctggtgaaggcaactccaaggacatagaatttgtatactga

SEQ ID NO: 98543 - DNA, 729 bp, Glycine max
  Peptide Sequence Number=SeqID_215321
atgggtgccaataaagaagaggagtataaggaccttgttgatgttttactagaggtgcagagaaatggctcggatgagatgcctctcaccactgataatatccaggcaatcatcttggacatgtttgctgcaggaactgatacaaccttcataactcttgattgggcaatgacagagctactaatgaatccacaggccatggaaaaagcacaaaaggaagtacgaagcatcttgggagaaagacgagttgtcgcagagagtgatctgcatcaattggagtacatgagagctgttatcaaagagatatttcggttgcatcctcaagttccagtattagtcccaagagaatccatggaagatgttgtgatagaggggtacagaattccagctaaaacaagattttttgtcaatgcttgggcaataggtagggacccagaaagttgggaggatcctaatgcatttaagccagagaggtttttagggagtgatattgactacagagggcaggattttgagctaataccatttggagcaggtagaagaggttgtccagctattacttttgccactgcagttgttgagcttgctctagctcaactcctctacattttcgtttgggagcttcctcctggtattactgctaaagacttggacctcactgaagtctttggcatctcaatgcacaggagagaacatcttcatgtggttgctaagccatactttccatga

SEQ ID NO: 98544 - DNA, 932 bp, Glycine max
  Peptide Sequence Number=SeqID_215322
atggtgtatgacttgaatgatatttttgtttcgctgcctaataagcggacttgttttaaaaagcacgatcttgaaatgggaaagttagatatgaatgcaaagtttgatatcggagaagctacgaaggtgaagacgaaggttatgtcaacagtagcgacgagatggcggcaatttaagtccacattgactagcaaatttgtgtttgctaagagtgaaggtcaacaaacacaggatgttgtgacaaaatatggactagatcctgaagcatggaaacaatttgaagaaacccggctcacacctaactgggagggtattaggaaacgagcacaatcaattcaaaaacacaatgactgcccccacgtactttcatgtgggggatatgatttgctggagaagaaattgttagaccagaaacgaaaaaggatacaagaggaagcattgttgagtgaaaatgcagcaagccttgatgaacccccatctccaataaaaagacatgttaagtggaagattgctcggaccagggctgttggcaatatgacatctgagtccgcacaggaaattgcagataaaatagactccttagaagagcaggtaacgcagggctcgtttgtaccccatggtcggcaagacattctgaacactgcgattggccgacctgagcatgggggtcgcgttcgggcagcaggctcaggtgtcactattactcagtactacggaagggcatcaaggacatgcagcagctcatccacatccatcagccaacaacaactagatgaagttgttgtaaggcttagggaagacatgactgggcagattagggaagaattgaggactcaaattaaggaagaattgaggactcagctagaagaggaaaataagaggagcttggaaataatgaccaatgcattgaaagaggctattaaaaaagagtt

SEQ ID NO: 98545 - DNA, 247 bp, Glycine max
  Peptide Sequence Number=SeqID_215323
gccagacaactatcttaaaggaataattattaggtcagtgttgtttttcaatacatttgcattagcattactcagcaacatcaatattttaaggttccttgtattcaatagtgctttgaaaggacttgacgatactccacaacctaaatccaaggctggtgctaggtggattgctgttaaatattttagtgatgttagaccattggaagcagagagattgaaggtgtttcgcatccagtgggcatag

SEQ ID NO: 98546 - DNA, 246 bp, Glycine max
  Peptide Sequence Number=SeqID_215324
atggcgggactgtccacgttggcacgtcccgccagcaccaatggcggtaccccctcctctctcctactcagcctatctcgccagcaccaatggcggtacctcctctctcctagtcagcctgtcccgctgctacgaatagtggcaccccttatcccgccattgtcattgacggttcaagcttcccgccagtgtcaatggcggcacccacgaaagcagcaggaagcattggagcatagacaaaaatga

SEQ ID NO: 98547 - DNA, 618 bp, Glycine max
  Peptide Sequence Number=SeqID_215325
aatatcctcttggtttatgtatgtgaaatgattattgatattatcaagcattcattcattgctaaattcaatgacattaagcctattgcatactccgagtttcttgaagatctatgtaaacagactctaaatatgcaaactgagtgtgcaaagaaaaacctgacttttgtcccccttgctccagcatgcgtgatgtgcaccttttccttttataactcgttcttaggttattcgagttctcactccagtatatactgcaaaccttcctcccaatccccttccatggaggcttttctggattctgcttttttcagcaatgacctatgtcatgctcacaagcctcaaggttctcattggcatgggactacagaagcatgccacatgactctattcaatatacatataggcacttctccacattctttctcaagtagtgttggttctgagtacattgctcgtgctcaacgagttccaatggagaaagagaattgcatgaaaatgaataatagaattggaaagtggtttgatattctatacgctgacaacaatgcagtggagacgaagagatttggtggtggagagaagacgattagtctttccacaatgaggagtcaatga

SEQ ID NO: 98548 - DNA, 852 bp, Glycine max
  Peptide Sequence Number=SeqID_215326
atggtggtgaacttcgtcttgactcatcttcttcttgaagtggcatctccaatcatctttcttccatctacaattccactaccattaaacttcaagaagcaaaagactccattgatgaagaagattcaaggcctacaagctccacatggagctacatcaaccatcatcctttgtatcatcttcctcttttccgacgtcgacgagggtgagggttctaatgacgttggttcggatgctctcaactttgtgggactcacaccagtcgatgttggggcggtccgtgacgctagcgacattgaagacgtgagtgggcttgagctaggctatgtcggcttggagggaggtttggttctggaggcggccagagttgtattggaaggggatgtcctgggcacgatagagggtgccgccaatccagcccgtgcggccgtagatgaggaagttgaggggatgggacgaggaggttctgttggttgggaagtccaacagaatagtgtgatgtcgggtttttcgggttttatggctggccatgtggtgacatatgcattgcttatggtgggtgaggatctagacaaaaatgttgatgtaaagaacattcttgttgagatgggaacatactttcaaataggtacagatattgaagatttcaagtgctcgtggttaattgtgaaagccgtggaacttagtaatgaacaacaaaagaaagttctacaagagaactatggtgtatttgaggagtacgagagtgggagctatgcgaaggttgtatcctccattgaagctcatcctagcaaagcagttcaagctgtattgaagtcctttttggctaaaatttacaagaggcagaagtag

SEQ ID NO: 98549 - DNA, 543 bp, Glycine max
  Peptide Sequence Number=SeqID_215327
atgttgaaaaccataagtaatacactcagatcaaacagggaagagaaaaaaaataattttcacagaaacccactttccatagaaactggaacagaaaaacaatcggggaataaaggaactaaaaattccaatgatgtggatttttcaaactacgacgaagagtggagacaaaagaagaacacatgtgtggttgagcctctgagccagaaaaaggtgcggtcttttcgctccatccaagaagaggttgttgcggagctggttgaaggtgtacgtgaagcatgtggtagtgaaagagaaagaccatgtgtgaatctgactgagatgctgattgcggcttcgaacaacattgtatctagatgtgttcatggacggaagtgtgatgatagaattggtggtggtggtggtagcagttgcagctttggagttctcggaagaaagttgggttgggttgattctctcactggcctaattcctgaaatgaaggccatgtctgtcacaatagatgctttctttgacgaggtcattgcagaacatgaagaatga

SEQ ID NO: 98550 - DNA, 1215 bp, Glycine max
  Peptide Sequence Number=SeqID_215328
atggccctgcgaaacggcggcagaaaaatctccttcgaggtccttagcgtcgaggacgaatcggatccaacggaacgcaaccgcaagaagcgcaggcaccgcgcttcgaaaaagaagaagaagcttctcgatcgggccgattccgattccgcggatccgcgttcggcgccgttggagaatggaggagcctgtaacggattcgagctcgacgctagcaggtactgcggcggcggcggcggaggaggaggaagcgttgtcgtgtgcgaggaggttcgcgaggcggagagtgtgtgcgcggttgcggaggcgcgtggggcggagagtgaggaagcaaccgccgtgcgcggtggcatcgaggggtttaatttcggggaattgaggcagaggaacgtgaattgtgggagttcggaggatttagcggcttcggtggtggtgcgagatgagaaggaggatggcggtgtgaatgcaagtccggtggagaaagcaacgaacgagcctgataggaatgtggttaagaaattggagacggtggaatcgttggactggaagcgtatcatggcggaagatccgaatttggagaagtctcctgtatcatactttttggaggaaatgcacaatggaaattctttacgcagcacaacaactcttgggaatgaaaaagaacgagagagagtttatgacactatcttccgcctgccatggagatgtgaattgcttatagatgttggcttctttgtctgcttcgattcatttctttcgttgttaactgttatgccagcgaggatcatgatgaccatttggaggcttctaaagacaaggcagttcaagaggttgtctacaatggaagtttctgattttggctgttttcttattttgagtagtggtgttgttcttttgcaacaaacagctcaggcaatcactttatcaacctgtatagttgctcacaacaacgcattgtttgctttactggtgtcaaataattttgctgagatcaaaagcaatgtgtttaagcgatacagcaaggataatgttcacagtttagtttactttgtttcagcatcccttgcatctaccctagcatttaggcttaaggcctatctcaactccacaatactgccttattgcacttgggcagtcctcaccttattagccggttccctaagtccaaatgttaagattgattgttggctgaatccaccattgctattatgttaa

SEQ ID NO: 98551 - DNA, 645 bp, Glycine max
  Peptide Sequence Number=SeqID_215329
atgccgacattcctgatggccgctcattccttggtgttccatgatattgttgatggattttgccccaaagatcagtctcttggtactattaagaaagtagtggacgaatttgagatgttcaggggaggacttgtatcaaaaacacttgatggccgtgcttactatgatttctcaccagtgcctgaatatagatttgtagttctggatggctatgacatcagtgccattggttggccaaaagatcatcctaaaagattggaggccttgaaaatcttaagggagaagaatccaaatgaagataagaacaatccagtaaatatggaggggcttgaaagaaggcaacaaaatttaaacagaaagtggttatctgttgccatctatctgcctcttgatcctggcgcggcaagtgagaagggacttgtgtggaattatgatgaaataatgaatttgatacacaaatacaattgtgttaaggtatgtcttgctggacatcatcatagaggtggatgctccattgattctcgtgggatacaccatagagttcttgaagctgctttggaatgtcctccaggaaccaaccagtatgtgctcaacatgctccttccttttgagagagggaaggatgcaacacgcagcattgcttaa

SEQ ID NO: 98552 - DNA, 291 bp, Glycine max
  Peptide Sequence Number=SeqID_215330
atgaaatatcgtatatttggaaaatacccagtagtactctactctcttggaagaaggagaagccggctatcatacattcgtggtcatgttcagaattttatccgttatgctaaggtgattgtagggaaggagcatattggagtgagtttagggctaaatattactaatttcagtagagggtccaatctgcatcacatagaagctaatactagtagcttttgcatgttagatgtgctttcacagataaagatgcaaaatctacaactagaaaacttcaatccggatgtgtaa

SEQ ID NO: 98553 - DNA, 2496 bp, Glycine max
  Peptide Sequence Number=SeqID_215331
atgaaattagatgtaccaaggttcaatggtattgaccctcttggttggatctttaagatcaaccaattttttgagtatcatggtaccctagagcatgatcacctcacaattgcttcattttatatagagggcagagctcttgcctggtttcagtggatgaccagtaatggtcaattcacctcatggccaggttcagttgcacaatacttgtccaattttgaagatttggtgaacaaaattatcgggcttcctccgccgttcctcctgagttgttttatttctgggctcaccttggaaatccggtgtgaggtccaggcgttgcagcccctgaccttggttcaagcggctagccttacacgccttcaagaggagaagcttcttgatggatgggtgctacctcaagggaggcccccacccaccgctcctgtggagattgcttcacgctatgaacacggtctatgcttcaattgcaacgagaaataccatagaggccattgttacccgctcgacaatcctgacccgttccaggcccaaattagcttcaactctttggcggatcatttgtccccagaaacactccgtttattgggcaccatctccaaccaccaagttgtggtcctcatggatggtggaaacacccataatttcattcaggaggagctagtgaccaagctcaggttttcttcgcgtgaaacaagcccattgtgggtcatggttggtaataggcaacatttggagtgcacacgccggtgtgaagcagtcaccattgaaattcagacaactaagttcatcattgacctctacgtgttacccatttcgagagcaaatattgtgttgggggtcgaatatcttaggcacattgtttctcaagggggggtggaactaatggctgccaaggcaactacaacagagcctttccagtggacggacctagcgcagtttgcttttgagcaacttaagcgagctctcttagatgctctcgtgttggccctactggacttccaattatccttcactgtggaaacatatacttctggtgtgggaatggagctatttgcgattatggcggctgttatccaaactccaaagcaacacatgtatctcgcgcacttaatgggatatgattatcaaatccagtatcggtctggtgcaaacaatcaagtgactgatgctttatccagacttcctgagcagaatgcttccacactattgattctttcaataccttgtctaactttcatgggggaccttcaccagcaattagcaaatctccctaaacgtatttggcttcctcgtggattaccaataattcctacactgcttacggaataccactccacgccgacagggggtcatatgggagtcacgaagacactagctcatctgtcagaaaatttttgttggcctgcaatgcgaacaaatgtaactcagtttgtggcaagttgtcttgattgccagcacacgaagtatgagactaaaagacttgctggcctattatgcccacttccagtacctcaccgcccttgggaggacctctcgctggacttcattattggtcttccaccataccacaggcacactgttatcttggttgttgtggactgtttttctaaaggaacccatctgggaatgctttcttcttcgcatatgactcatgcagttgcttgtttattcatagatatcatggcaaagctccatggtcttcctcgaagcttagtttccgatcgtgacccatttttcgtcagtcatttctggcaagagctatttcgtttaagtggtacccagttgtgcatgagttcagcttaccatccgcaaagtgatggccaaaccgaagtcttgaatcacgttgtggaacagtatctccgagcttttgttcatcaacgaccaaggacatgggggaagttgcttccttgggtcgagtggtctcataatacttcgtggaatgtcggaactagtactacgccatgtgagataacttttggccgcaagtcatttaattttccagaatatataatagggacttcaaacattgatgtcgttgatgacttattggtcaacagggaagaaaccttccacttcattcgaaagaagctgctcaaggctcaggctttaatgaagcaacatgctgatactagacgcaaagaagacaaattcggcaagctcgctaaacgtttctatggacccttccaagttatagagcgcattggccagggcactctgacgatagcagatactatggaattgccgaagaagttcatcaacgcgcaacccatcatcacccctctcacaattttggaccatcgacatagttcttctacaggaaagccacgctgggaagattatcaccttgaggacaaggtgatcttgcaagggccgagggatgatagtagaacacaaggtacaaagataagtacaaagaagaatgcaggggtgcagatagaaggaaggggtaagagggcaatcacaaaaccagcttacctaagggactacgtatga

SEQ ID NO: 98554 - DNA, 1908 bp, Glycine max
  Peptide Sequence Number=SeqID_215332
atgtatagttttaaaaacattgaaattcctgatttgaatgatattgagaaaattttgcaagtcttgccattcggttctgttccactaaaaacctatcttcctgatggagatgttgacttgacaactctcattcatgaagatgcagaggatgatttggcacaagcaatctgcaatgtacttaaaagtggagatgactctgaataccaagtccggcttgtgaaatgcacagtgaaaaatatagcagttgatatctctttcaatcagatggccggaatctatactctacgctttttggagcaggttgatcaacttgttggaaagaatcatattttcaaacgcagtattatcttaatcaaaggttggtgctactatgatagtcgacttcttggtggacaccatggtctgttatcaacatatgcagtagaaatattagtcttgtatatcatcaatcgttttcattcatcagtgcgtggtcctctagaggtgctatacatatttttggactactatggctcatttgattgggaccataattatattagtatatggggtccaaaatccttatcctctcttccagaaattgctgaggcaccagaatgtgatcagggagaattcttgctccaaaaagagtttctcggaaattacaagaatatgtgctcttatccagcaggggcatctgaaactttgacccatgaatttcctgttaagttcatgaacatcttggatcctttaagaaatgacaacaacttgggtcgtagtgtaagcatagctagtctacatcgattaagatttgctttttcctacggcgttcaaaagcttaagcaaatcttcacacttcccggagaaaacatgggtgcagcacttgagaagtttttctccagcactttgaacaggaatgggaaaggagaaagggctgatgttagcgttccggttgctccatttggcactggaagattcgaagagcctgtcctctatggagattgtgaaaattactgtggtggcttacaatatgttcagttgtatcataattatgccatgcctgtaattgtagattcaaattctccagcatcacctgatgatatccttgcaccaacgcagcaaaactggagtctgttttatcaaggtgctaccgatgtatatatcccggcccagaaactctatcatccaacttacagccttgaaggaggaggcaaatcacgtggaacaggcacatacattcctgacttgaactataattcctactgggatatgcgcaccaaggcatctaggccaaggagatttgcttcatcaaagtacaatgcatttcccagatcacctctgaaaaagcaacaagtggaagaggttcactctgagatagacataattaatgctaattcagattcaaggttgtttgagttctcaagtgaagatttccccgttcgtccatgcaattccaatgctataccgccaacacaagcccaagagtctacaccattagaaaagtttcattttgagacagacatggatggtacttcccgatctttggagttctcaaatgaagatttcccccttcttccaaaggtttgttctgagacacacatggagggtaattcaaggtcatttgggctctcaaagaaagagttccctcttcttcaaagcgcttgcaagaccgtcttgtctgggtctgctaagttaactaagcaagcaaagagtttcccatcctttaaagagtctaaactgaaaaatattgagtttggaactttcaagaaatcacaatcactgacagaaccaggtttgtcaacaaaggatgagagagaagattccgatatttcactaactcaaaaaactgtgttggtatttcctaaggtggcgatagagaggaaagatgaatctcctgaaagcaatgagaagatggatcaacagtgttaa

SEQ ID NO: 98555 - DNA, 201 bp, Glycine max
  Peptide Sequence Number=SeqID_215333
atgggagctccagtgatggatcctttggaccaacccggccaagtggaggctttgggccatgttcagcctatggatgttgttgagcctatggagcctgtccaggttgttgagcaagtggagcgtactagccaccaggagccaaaagcacttgttgtcttccctggtggccctaaggacacgtcactactaacctcttgttga

SEQ ID NO: 98556 - DNA, 1115 bp, Glycine max
  Peptide Sequence Number=SeqID_215334
gctatcgtattggtgaaatacttgatggccgatatgaagtcactgctgcacatgggaggggtgtcttttcaacagttgttcgcggaaagaatctaaagatgggaaatggtgagccagaagaagtagccataaaaattattcgtagtaatgacaccatgtacaaggctggtatggatgaattggtcatattgaagaaattagtaggtgcagatccagatgataagcgtcattgtgttcgtttcctttcaagttttagatacaggaatcatctttgtttagtttttgaatctctaaatatgaatctgcgagaggttttaaagaagtttggtcgcaatattggccttaggctaacagctgtgagagcatacgcaaaacagctttttattgctctgaagcatctccggaactgtggtgttcttcattgtgatataaagccagataatatgttggtaaatgagtctaaaaatgttttgaagctttgtgactttggcaatgccatgtttgctggtaaaaatgaagttacaccatatcttgtgagtcgtttttatcgtgccccggaaataatacttggcttgccatatgatcatccattggatatttggtctgtaggttgttgtttgtatgagttgtatatagggaaggttcttttcccaggtcttacaaacaatgacatgctacggcttcacatggaactgaagggtccttttccaaagaagatgctgcgtaagggagcatttactgaacagcattttgatcaggatctgaattttcttgctactgaggaggatcctgtaacaaaaaagaccataaagcggctgatactcaacattaagccaaaagatattgggacactcattactggctctcctggggaggatccaaaaatgttagccaactttaaggatcttctggaaaaagtttttgtcttggatccagacaagaggctgacagtgtcacaagctctgaaccacccattcatcactggcaagggatggttagcccagtctaggtttgggatagagccttacaggggacttgcaaataacccacctccggattcaaaactcaattcttttggtagccttcagtgttcatcatgggcagagggtgacaag

SEQ ID NO: 98557 - DNA, 1983 bp, Glycine max
  Peptide Sequence Number=SeqID_215335
atggccaccgatgcccgtgactcgcgtcgcaagcatcaccgatcttcctctccagaggacgtggacagatcctcgaagcgtcacaagcaccgccataacagccatcgccaccgccacgggagcaaaaagcgcgacgaagaggttgaattcgatgatcgaacaattgctgcggttccttctccaacttcgcacagatatctccatgacgacgatgtggaggagggagagatccttgaagatgaggctctcgacggtgaggttggaaaaaaggagacggaatctgatgttgaacccggtgaaatcaaggtgacaggagatcgagatgttcgatctgataatcaaaattcgtattttaggtgtttcagtgtatctcacttcctcttggtgaccaagcagagcactgtgattctttgttttcggacggaacccctcactaaaatttcagaaactagaaatgaagacattagggatgataaatttattagtcctgcaattgatgcacaagatgatgtctctcctaatcgttcaagttctgagactcgagatggaaagcatgctcaagctcgtacagatggtgtgggcaatggttatttggatcctaaatcttccaaaggggataagtggcagaatggggaacttggacattttaaaggtaatgagaaactaaaaggtgactttcatgacccaacactggaggctaacgtgaggaaagcacattaccataggaattcatcctccgaaagtggaggggaaaagtatagaatgtcaggaagttctccttctcatggtagatatagaagtcgatcaagatcaattggtcatactagagacaggtctcgctctcgtagtatcatagacgaatatcctcattctaagagaaggcgctttgactatgaccatgatgaggaaagagtgagggcacgtggaagggagcatggtcatggcagtgtggtagatgatagaagggaatacggtatcagatatcacaatcgagaggccagggatagagatgtggatagagacttgcacggagaaaagaagcaagaggaaactagcaggggtaaagagattgagtgggaacacaaaaggggaaaggaacgtgaaaggagccgtgataggtatagaagggatatagaaaaagataggagcagggagagggaggaggatagggacaggagacaagaaaaggaaagagataggagctgggatacagtgatggagagggataggagaagggaaaaggaaagagatagaagtagggacagaataagaggtggcaagagagataaagacccagagaatgaaagggatgataagcatcgggcaagagataatattaagaagagggaaagacatgatgataaatataggcacaaagatagagacactgctaatggtaagaataggcatctgcatcatgaggatggtgacgacaatggagatagatatagaaaacattcaaggcatgaagaaaatgaatatcgttgggaaagaaaaagaaattctgataatcctgtaaaggtttatagctcaatgggaagtactgcagaagtgggtgaaagcaaactaacaagcagtgaggttgaaccagatgacttagaggaggatacattacaattacctgagcaagaagaggaagatctcaacaggatcaaagaagagagtagaagaagaagggaagcaataatggagaaatacaagaagcagcatcagcaagtagaagaagcggttggaaatgaaggaaacgacaagaaggcagccattcctaatgacatctctgaagctcgtgatggtaaaaatgatgatgctgattatttggagccatcatttgctgttgggaaatctcctgaaaatgtgaatgttgcttctaagaagatgtctcctgctggaggtctgggagagggtactccaaagagtgaaaggtcagaggacaagttttgtgatgatatatttggtgagacgccaacgggagttcggaaatca

SEQ ID NO: 98558 - DNA, 135 bp, Glycine max
  Peptide Sequence Number=SeqID_215336
atggcagaggagcgaacggttgtagcacgcgcggaggtttcgtatgggatcagattcaaggccggaccggacctgacctacaagtacaactacggaatatcgcacgtgccttacaagcgtgcccacataatttaa

SEQ ID NO: 98559 - DNA, 180 bp, Glycine max
  Peptide Sequence Number=SeqID_215337
atgggctcagaaatctaccctgaggatcatgagaaccctagggccttctttagtagctctagcccaatcctcttggggggtcccccctcttgtccttttaacaaaggctgctctcagtccgacgtgcgagatcttagagcctaccttggccacgtccaccctgacgagggacaactctag

SEQ ID NO: 98560 - DNA, 291 bp, Glycine max
  Peptide Sequence Number=SeqID_215338
atgaagatgaaagcaaacaaaacaagaaatgaattgaaagtctcagattcgaacacttactggttgaagaatgaagaacgaatgaagaacgaacgaagaacgatgaagaacgaaggaaaatcttcacagatttgctcacggaaacgtttcgaaagcgttacggaagcatttcgacttgatttttcttcacggaataaattttacggaagcattacggaagtctcggaagccccggaaactagttttcaacaaaacatggaggagcttgccgcccagttacttcctccttaa

SEQ ID NO: 98561 - DNA, 471 bp, Glycine max
  Peptide Sequence Number=SeqID_215339
atggttgacaagctacaagagtctaccattattcaggatctcaaagaggttagatttcaatacctcgaggaggactttgttatgatttcaggggtaaatgaggataacgtacaagaagaaatgttagaggaaggggatggttgggcaaatatgtttgagtgtattgtcaaatggaagaaggggcagaattttgggagcagattagtatgggtaaacatctatgggataccaatgaaactgtggaatgaggcttgtttgaggagcgtgattagtgaactggggaaccttgtctctaacaatgaagctacacagaacttggactgtggggatcgtgcaagggtgttactcaaagcattgttgattaccttggccaaactgataaaaatggttaaaatcaatggccatgtatatcaagttagggtggaagaggaagatggagcttggaagaatggatgcaagtgcaaggattag

SEQ ID NO: 98562 - DNA, 180 bp, Glycine max
  Peptide Sequence Number=SeqID_215340
atggatgacggtggctactactcaacaacaacctctttgagcagttcaatcgggcaagtgatgagccccaaatcaccattgtttggccttgttgattttcatgggaagcggaagcaaatggttaagattcaggttttggagagagagattggtttgtttcagtttgattttaaattttaa

SEQ ID NO: 98563 - DNA, 1686 bp, Glycine max
  Peptide Sequence Number=SeqID_215341
atgaataaccagcagcaatcagagagaatgcccgcgagagtggggtcattcagacacagtttcttggagaaaagcaaagagaggctcctctctaagaaggattgtaaagactttgacgatgacgacaatgccgcccccaagcgttccttcctcgacgcgctctctgatggcgtcattagcttccacaactggtccagagacgttgcctccaaattgtacgagatgggtcgctctgaccgacgcaaagttatcttcgctgtcaaagctggcttatccttagccattgtctcgcttgtcatttacatcgaggaggaacaatttagcaagtactctgtctgggcaatcctcactgttgtcgttgttttcgaattcagcataggtgcaacccttaacaaaggttttaatcgtgctttgggaacaatttctgctggagtgcttgctctgggtattgcacagttatccgtgttggttggtcgagcttttgaggggcttattattgttgtctcaatttttattgctggattttgtgcgagctacgtgaagttgtaccctgcgatgaagcaatatgaatacggctttcgtgtattcttgttgacattttgcattgtgttagtgtctgggagaaccgagttgcaatttttcagcacagctttttacagatcggttctaattggcattggtgctggtgtaagtttgtctgtgaatatttgcatttatcccatttggtctggggaggatctacacaaattggtggtgaaaaatttcataggagttgccacatctttagaaggttgtgtaaatgggtacctacaatgcgttgcatatgagaggatcccatccaaaatacttgtttatcaagcctctgatgaccctctttaccgtggttatagaacagcagtgcaatcgtcaactcaagaggagactctggtagactttgcattatgggaaccacctcatggtccatacaagatgttcaattatccttggagaagctacgtcaaagtcagtggagcattgaggcattgtgctttcatggtcatggcaatgcatggatgcatactttcagaaatacagtcgcctccggaaaagaggctggttttctatgatgaacttcagaaggttggcattgaaggagctaaagtattgcgtacacttggaagcaaagtggaaagaatggaaaaactaagcaccggtgacattctcttagatgttcacgaggcagctgagcaattgcagatgaagattgaccaattgtcatttctcctagtgaattatgagagctgggaagctgcaagagagcataaggaaaaagaacaacctgagaatttgattgatgttaaagacaatgagaacaagccaccggagatcacttccctcgatgaaataggggatggtccaaaacttagtgtaagaatagagccttctatgccagaatccaatcttcttccacagactgcgtccaagagctttcttgggaagtcacatctttcttttttcgcagatggtatagtaaatgagccagaatccaaagtgtatgaaagtgcaagttccttgtctttgggaacatttgcttcaaatttaatcgagtttgttgcgaggcttcaaaatcttgtggatgaattccaagatcttagtgagaaggccaaatttaaagaccccttgaacaaactttgctcaagtagctag

SEQ ID NO: 98564 - DNA, 882 bp, Glycine max
  Peptide Sequence Number=SeqID_215342
atggctactctcacctcaaatctaaaccttaggccacaacaatacactgttcccaaagactatccaccacatggttctgtagttgaggaaatacaaggccttattagagtacacaaagatggatacgtggaacgaccgcaagttgttccatgtgtcactgctagtacaatgagtccagaactaaatgtgacatctcgtgacatggtgatcgaaagattctgtgttggatcagcagcatggagttgctaccatgatttccttgcaaggctatctaccaaagttgggtgtgtgattatgtcagtgaactatcgattggccccagagaaccctcttccagcaccctatgatgatggattaaaggccatcatgtggctacatcaacaacacaacaacaagggtagtggtactgaatggtggacttcaaagtgcaacttctctagtgttttcttaggtggggacagtgctggtgctaacatagcctacaacgttgccactaggctatgtgcatgtgatggtgcggctttaactttaagacccatgaatttgaagggtcttattttgatacaacctttttttggtggggaagtgagaacagattccgagaaaggcatggctcaatcacctggttctgctttgaacttggcagcttctgatagttattggcgcttggcgttaccgtgtggtgcgaaacgtgaccatccatggtgcaacccttttggtgaagttggaggagttgaagctcatgcgtaccttgggaaaagggttgagtatggggtgtttagaggtgttggacatgcgtttcagattctgagcaagtctcaggtagcaaagagtagaaccaaggaaatgatggctcgtgttaagtccttcatggctctctga

SEQ ID NO: 98565 - DNA, 1371 bp, Glycine max
  Peptide Sequence Number=SeqID_215343
atgcaaagcttcaacacaaccgaatcagaatcgacctcacctctatattcccattctcccttctatcaccggggaaatgaccccagccgaaatccaacgcgtttctcggatcttcagcattcttttcggcaacacgatgccgttgatttaagctcaagttctgtgtttggtgcaaagtcgagcaatgtggctgttgttgcaagcaacttgcagtgtgggacattcaacacgaaccttgggtgtgcagaatttggttcgatagagcagcgaggcatgtttcagagaggaaccaatagcgccaccaccgtgtccatggggaaccggcacgttgagaactgggcagaagatagccaacacactgaagatacttgcacagatatagacaccgatgataaaaaccaatgtttctcaactgtgtcttggtgcaatggagttggggacggggcacttgtagttgtagactcacaggatcaaagtaagactaaggttaaagctgaagaccagaagaccgtacgtaggctagctcagaatcgtgaggctgctaggaagagtcggttgaggaaaaaggcatatgtgcaacagttggagaccagtcgagttagacttgcgcaattagagcaagaacttcaacgggcacgtcagcagggtgcatttattgcaactggaaaccagggggatcgcagtcattctgctgttggaaatggtgccctagcatttgacatggactatgcccgttggtttgatgagcatcaacggctgatcaatgatataagatcagctataaattctcaaatggatgagaatgaactgcaccttcttgtagatggagtgatggcacattatgatgaattatttaggttgaagagcataggggcaaaggctgatgtatttcacatactttctgggatgtggaagacacctgcagaaagatgcttcatatggctcggtggttttcgatcttcggaacttctcaagatagttagaaaccagcttgagccgttaaccgaacagcagttgatgggcatttacaatctgcagcagtcttcccagcaggctgaggatgcattatcacaaggcatggatgcattgcagcagtctctttcagagacactttcttcctcctctttagggccctctggttctggaaatgttgctgagtacatgggccaaatggcaattgcactgggcaagctggccacactagagaatttccttcatcaggctgacctattgaggcaacaaactctgcaacagatgcgtcgaattttgaccactttccaagctgctcgtgcgctacttgtgataaatgattacgtttcacggcttagagctcttaattcattatggttagcgtgtcctagagagtactag

SEQ ID NO: 98566 - DNA, 1782 bp, Glycine max
  Peptide Sequence Number=SeqID_215344
aagatgttgtcgagaattacaagaaggcaaaaatcccacttgatgtgatctggaatgatgatgatcacatggatggccacaaggacttcacactcaatccagttaactaccctcattccaagcttttagacttcctggacagaatacatagcattggcatgaaatacattgtaatcattgatccaggaattgctgttaactccagttatggtgtatatcaaaggggtatcgctgatgatgtttttatcaagtatgaaggtgaacctttcttggctcaagtttggccaggagcagtatattttcctgattttctcaatccaaaaacagtttcctggtgggttgacgagattcgtcgcttccatgaactagtgcctgttgatggcctatggattgacatgaatgaagcttcaaatttctgctctggaaagtgcacaattcccaagggaaaagtgtgccctagtgggacaggacctgggtggatatgttgcttagattgcaagaacatcacaagcacacggtgggatgatcctccctacaaaattaatgcttctggagtacaggctcctataggcttcaaaactatagccactagtgcagttcactatgatggtgttttggagtatgatgctcacagcatttatggtttctctcaagcaattgcaactcacaaggcccttcaagggcttaaaggaaaacgacctttcatattgtcccgctccacttatgtaggttcaggcaaatatgctgcacattggactggtgacaataagggcacgtgggaggacttaaggtactcaatatccacaatgctcaattttggaatatttggggttccaatggttggttcagacatatgtggtttctatccagcaccaactgaagagctttgcaataggtggattgaagttggtgccttctaccctttctcaagggaccatgcaaacttctactcccctagacaggaactttaccaatgggaatcagtagctgagtcagctagaaatgctttaggtatgaggtataagctcctcccgtatctttacaccttgaactatgaggctcatgttagtggagcaccaattgcaaggcctcttttcttctcatttccaacttatactgaatgttatggcctcagcactcagttcttactagggagcagtctaatgatttctcctgtgcttgagcaaggaaaaacacaagttacagcactcttccttcctggaacctggtacaatttgtttgatttaacacagaccattgtgtcaaaagatggtaactatgttacccttgacgcacctttgcatgtggtcaatgtacatttgtatcagaatagcattcttccaatgcaacagggtggaatgatatctaaggatgctagaatgacacccttcagcctcattgtgaccttccccgctggtgcaactgacggagaagccaaagggaatctattccttgatgatgatgagctgccagaaatgaagcttgtaaatggctattcaacctacattgatttccatgcaactatcaaagaaggaacagtgaaaatttggtcagaagtccaagagggcaagtttgctttagataaaggttgggttattgacacgataaatgtgttgggattaaaccgaaatggagcactacctaaaattgagattgatggagaaccactaatgagtttgtcaaatgtgcaagtcagcacaactcaacataagtacttgtacgggcagggagatggagataaaatattgatggtaggattgaagggtttgaatatccctgtag

SEQ ID NO: 98567 - DNA, 1632 bp, Glycine max
  Peptide Sequence Number=SeqID_215345
atgatctcccacttcatatcctccctccgtcccccacgcttccctagaaacggaatcccatgtacggcttcgccggagattcgccgcccctccgatcgcttctacggctcctctccatcgacgtctcgcccggaggacctgaacctcttcctggagctgctccctctgacgttgcggagggaactaaaacctctggcacggttcccttccggtgattgggtcatctccgaacaacccattgcgcaagaggatttacgccatgccatttcaaaggttggtgagttttctgatgacaacaggtcaggtattgataggtctttgcatcggataagtgcgattcggaatcggaaaatgcaaatcattgggcttacttgtcgtgtgggtcgagctgtgggtggcagtgctgaaatcatccgtgatttggttgaggatggaggttctatcttggtcattggacctcctggagtcggtaaaacaaccttaatcagagagattgctaggatgctggctgatgagttcaggaagcgtgttgtaatagtggatacctctaatgaaattggaggtgatggagatgttcctcatgcaggaataggcagggccaggaggacgcaagttccaaatgtgaatatgcagcatggtgttatgattgaagcaattgaaaatcacatgcctgaaaccattattattgatgaaattggaacggagcttgaggcattggcagccagtactattgctcaaagaggagttcaattggttggaacggcacatggaatgaccattgaaaacataataaaaaatccttatcttcagattcttgttggtggcatagagagcgtgacccttggagaaacttctgatttaactaacaatgatatcacgagttctgaaattgaatctagtaaggatgataaagaccatccacgtacttggtccacgaactggagtaccagtgtacctgtgatgacgaggagttcacgaatgcaagtttatacttataagattcttgaagctgatctactacaagttgcaaaggtaatggggcttgaagatgtaatagatgtgactgatgacattggaactgctgaagcaattctagcatccagttctgagatccgacaaaacccatggatccgtggtgtggcaaaattccatcacgtacctgtatttgttatcaagtccaataccatggcacaagtggtcaaggcagtgcgcatgatccttgggctagaattctttggccctacaccaaagaaggcattaaatgaatgtttggatattgaaatcgaggatgatgaacctaaacgaaaaccatctttggaagagattgatgccttggaggaggtcaggcttgcaatagagtacattgtgattcctggtggagaacctgtggaacttcttcctagacgctctgaaattattgcccggcagcttgaactcgttcaaagttatcagttggctgctgaaaagtcaggtagcgatcagaatcccaggttgcaaattcttcccttgaggctaaatacaaaaaaaccctctaaatctactattggccgtaagaaaacaagtcctacctcaatgtctactggtgacagcggcaatggcatcagtgtcaccaaggcttcctatttttcctga

SEQ ID NO: 98568 - DNA, 436 bp, Glycine max
  Peptide Sequence Number=SeqID_215346
atggacctgggggctgaggggaaggggttcaacacccttggtattcagatttcacttaaaattattgaggagaagaagaaaaaaaaaaggagaaaatcaaggccgaggagcttccgtaacgcttccgtgaccaatttcgtgaaccttctactccgttcttcgtcgttcttcatcatttgtcgatcttcaaccaggagttttgaccgatcgtttaagccgagacttcagcctgaaggaactagctcgcctgggcaagccagttacttcaggcatgaatgggagctggggaaggggtgccagcattcaatagtgaaggaaattgggagaataaggaaagaagaagaaagaaaaagaaacgaggtcgaggcgctaccaaatcgcgattgtgatcaacctctacatcgttccttgtttggtgttcttcgtgctaccatcg

SEQ ID NO: 98569 - DNA, 243 bp, Glycine max
  Peptide Sequence Number=SeqID_215347
atggctgcgaaggaagagaatcgaatatttgttggaggtttatcctgggacgttacggagcgtcaactcgagcatgcctttgctcgttacggcaaaattctcgaatgccagaatggtttcttcgtggctgaagctcatttttttcaattttctgataaaatgatagcttgtggtagtaactgtagagctagagctggagatttgtgtggtttggatatgtggaatttggtgcaaggaaggtag

SEQ ID NO: 98570 - DNA, 282 bp, Glycine max
  Peptide Sequence Number=SeqID_215348
atggaaaagtttttcatcccctcttacacaagcaaggacaaaaagatcacccccaagggcattgattcaacactgtcaacatcatatgcatacaagcaactgaaggatgaatataatgagagattaagtgtaggcacatgtttgtctaaacataacaatccactcacgttgactgtttatattgaatttggctgtcatcctacaatgatatctgagaagctaaactcttccctccaacaacagcagcagaagtgcacaatgcttgtcccctatgaaaagtaa

SEQ ID NO: 98571 - DNA, 141 bp, Glycine max
  Peptide Sequence Number=SeqID_215349
atgccgggccggatccagaggcagagaccaatcaagggatggacgcaagtagaggctaggatcatgatcgatagatcgtcgtcccatgcccagctctggacaagcggaaaggcagttgggaggcagcctagtatcctttaa

SEQ ID NO: 98572 - DNA, 396 bp, Glycine max
  Peptide Sequence Number=SeqID_215350
atggatcctgcaactgggaaagttgatggtccccacaaaaagaagttaacaacatatttggggatcttcgctcgcaataaggtggatgtgacacacgagaattggaaacaagtccttgctgcccagaaggatttgatatgggaggatattcatgccaaatttgatatccttgaagcatctgatttgaggatgaaaaagaaaatacttcagaccatgggggagtggtggagaccatttaagtctgatttgacatcgaaatgggcacatgcagccgacaaggacggtgtcgatgacactgtttgcgaaaagtatgacattagcaaagaacccaattttgttagagccgcagagacccttcctgggaggatgtgcaaaagaaggcatatgccattctga

SEQ ID NO: 98573 - DNA, 477 bp, Glycine max
  Peptide Sequence Number=SeqID_215351
atggatcgaagttggatgaacgaaactcatatgagccctgcgtatgaggaaggcgtggaagagttcttgcaatttgcttccaaaagaagtcgaccagatgaggatggaaattttttttgtcctttggtgttaagtctagttaatatgaaggccagatatgggtggagtgacaaaagttttagttcactgcttcaagtagtgcaggatatgcttatagagaaaaacacgttgccaaaaagttactatcaggacaagaagatattgtgtccaatgggtatggagtattcgaagattcatgcttgcactaatgattgcatactgtacatacatgagtttgaagaaatgcacaaatgccctaagtttggggtatcacggtacaaaattaaggatgataacaagtgtagtagtaacgaaaaaatcaaagaagggcctcccagcgaaggtgttgtggtatcttctaatcattccaaggtttaa

SEQ ID NO: 98574 - DNA, 99 bp, Glycine max
  Peptide Sequence Number=SeqID_215352
gcacaatggtgtcctctatggaatttctcctctcaagtgaaacagagacctcgttgccgcggtggtaagcaatctcctccagggatagttgcttcaagg

SEQ ID NO: 98575 - DNA, 297 bp, Glycine max
  Peptide Sequence Number=SeqID_215353
atggtgattgtcaagaatcttttcttcctgcaagaaggccaaactggcggcctgtaccaaggtcactggttgataggcttgcacctccctacgtatctttggtgtgagactagatacgaagcaactgagaaggaaaagggagggaatacctataatgcggttggcgaggtcctcaaacttggaaaggtactgggccacggtgcctttctgagtgagcttgcaaagtgctccgatagggtcatcgtattgagacagagtgaaacgagtgcgcagagcttggaggaacatcggccatga

SEQ ID NO: 98576 - DNA, 444 bp, Glycine max
  Peptide Sequence Number=SeqID_215354
atgtgggtaagtactggccctcgaagccagccaactgcacccctatcaattggtgctctcattgcctcaatgtctgaatcctcgaagaacatggggtcctcagatcgccttgaggaagcccttattcgcctcaccaaccaaaacatgtacctaggtgagtctgtgaactctgtgactctgaaaatcgatgaactgattcaacgccttggtcctgccctgtcaaccccatcacctactccaccgcctttgcctccacctttccctatacgtgcagtcacacacaagatgaggttagacgtaccaaggtttgatggcacagagcctctcggttggatctttaagatcaaccaattttttgagtaccacggtactccagagcaggacaaacttgccattgcttccttctacatggaagctgcgccctcgcatggttctagtggataa

SEQ ID NO: 98577 - DNA, 1093 bp, Glycine max
  Peptide Sequence Number=SeqID_215355
aaaaaaaagacgagaaagggcaaacggtggtgcagcgggtgcagcatcaccgctatttgctgccggagtcgcttcaggtgcagggggcaccgaatgtggaagtgcgcaagttgggcatttatcagacgcaggtttaccaggggccgctgaacttcaaggtgcgtttcggccagccggagctggcggatttgcaacgcgccaacgtgaccgtcggccagccgttcctgctggtggcgctgagcgactctcgcggcatcaagagcatttccccgctggcaacgccgcagccggggatccacgcaccgctgacgctggcggcgctgcaacaaaaagcggggctgagcgccgacttcaccctgacgctggcgggcaccagcagcctgtcactggtgccgctggggcgcagcagcgagctgcagctgcaaagcaactggccgcacccgaatttcctcggcaacttcctgccggacgaacgcaaggtgacggagcaaggtgcgttccattacgacgatggcattatcgacgaggacaagctgccggccttcagcgccagcctggtcgaaccggtcgatcactatcagttgaccgagcgcgcagtcaaatacgcgctgctgtttatcgggctgacatttatggcgtttttcctgttcgaaaccctgaccgggctgcgggtgcacccgattcaatacctgctggtcggcgcggcgctggtgttgttctacctgattctgctggccttctccgaacacctgggattcgctctcgcttacctggcggccagcatcgcctgcagcggactgatcggcttctacctgagcgccgtgctgcgcggcaagctgcgcggtgcgctgttcgccgcgagcctattgctgttgtacggcgtgctctatttgctgctgcagtcggaggacaatgcgttggtgctgggggcggggctgctgttcgccattctggcgggcattatgctgttgacgcgcaagttggactggtatcaggtggccgatccggcgcgtctggcaaaggagacgccggccggcgaagacgagccacgcttccgtctgtggaaataagcgggggaaatcgggcgcgttga

SEQ ID NO: 98578 - DNA, 186 bp, Glycine max
  Peptide Sequence Number=SeqID_215356
atggatgacggtggctactactcaacaacaacctctttgagcggttcaatcgggcaagtgatgaggcccaaatcaccattgtctggccttgttgattttcatgggaagcagaagcaaatggttaagattcaggttttggagagagagattggtttgcttcagcatatcaaagcttcaaaaagttga

SEQ ID NO: 98579 - DNA, 324 bp, Glycine max
  Peptide Sequence Number=SeqID_215357
atggccaagtttgacccagacatagtcctcgaattttatgccaatgcttggcctacagaggagggcgtgcgagatatgcgatcctgggtgaggggtcagtggatcccgttcgatgcagatgctttcagtcagttcttgggatatcctctagtgctggaggagcgtcaggagtgcgagtatggccagaggaggaaccgggccgatgggtttgatgaggaggccatcacccaatttatcatttcggtttcttaccaagtaaaagggatcatttttaaggtccaacgccttgaaatgatcacctttcaagtaaaaagaatcgcttga

SEQ ID NO: 98580 - DNA, 359 bp, Glycine max
  Peptide Sequence Number=SeqID_215358
tattgcacgcagagacaagcccagggtaatgctccgcaggccgcagatgcgccgccacctcatcaggctggcccaactggatcatttgatacggagcagtatttacggcatttggttcgccaacaggcggccaaccaccgggcgcatgtacagacccatgactgcctttaccagttgagccttagcctgcagagccagggttttacttcttttccatgccctactccggatcagttcggggcagaggtcgcatggcccggagattggcctgaggcccgggcaggaggggcaccagcagaggcacccgcagaggctcccgacgaggcagatgaggcccgcgaggacgaggagatgaccaa

SEQ ID NO: 98581 - DNA, 303 bp, Glycine max
  Peptide Sequence Number=SeqID_215359
atgagggacaaagatatcaacttcatccatttcattgtaactgtggtttacaataatggatttacacgtgattctcctcaaatttcagccagcccgcatcaattagaccttgcaccttacgcttcaagcccctacaatgctcaatggaatgccacggggcttctccatgacaaacacacattgcgttcgagtcgtattcttggagaaatggaggttgatgaaccttggttggggttatggctaccattgaattatcaagtagatatgggagcaagtcagcataggacactggaattggggtga

SEQ ID NO: 98582 - DNA, 360 bp, Glycine max
  Peptide Sequence Number=SeqID_215360
atgggaaagttggatcatctaaaggagaggctcagggccattgaaggaagtgaagattatgcctttgctaacctggaagagttgttcctagtacccaatatcatcacccctcccaagttcaaggtgctggactttgacaagtacaaggggattacttgccccaagaaccatctaaagatgtattgtcggaagatgggggcatacgcaaaggatgaggaattgttgatacattccttccaagaaagtcttactggggtagttgttacctggtacactaacttggaaccttcccgagtccattcctgggagaacctaatggttgccttcgttaggcagtgtcggtataatggcttcggatag

SEQ ID NO: 98583 - DNA, 1563 bp, Glycine max
  Peptide Sequence Number=SeqID_215361
atggcaatcaccggtgttcatggatggggagacatcaagagtctcagcgtccaagtgatcaccggtcgatggttcgtcgtattcgcctcttttctaatcatggcagccgccggagcaacctacatgttcggtctctattccagcgacatcaaaaccaccctcggttacgaccaatccactctcgacctcctcagtttcttcaaggacttgggtagcaatgttggcatcctctcaggtctaatcaacgagctcactccaccctgggtggttctagccattggtgccatccttaacttctttggctacttcatgatttggctttccgtcactaaaaaaatagccaaacccaaagtgtggcagatgtgtctctacatctgcataggtgctaattctcagtccttcgccaacacaggttctcttgtcacgtgtgtcaagaactttccagaaagccgtggggctgtgttgggaatccttaaaggctacgtgggtcttagcggtgcaatcatcacgcaactctaccatgctatttactatgacgacaccaggtctttgattttgctcattgggtggctcccagctgctatttcctttgctttccttcgaaccattcgctacatgaagcccgttaggaagcctaacgagctcaaggttttctacaactttctctatgtttctcttggccttgctgggtttcttatggtcatgatcattgtagagaacaaagtcaacttcactcagagtgagtttggtgtcagcgctgctattatgctcttcttgctcttcctcccacttactattgtttctatagaagaatataaggtctggcagggtaaaagactcgctttggttgacccctccccagtgaaagtagtaaccgatcagggtgaaaaggtgaaaccgaatgagactattaatggtagcaacaataattcagtttcttccaatgacaccaagtggtgggaaaatgtctttagtccaccggcaagaggtgaggactatacaatacttcaggcgctgttcagcgtcgacatgctaatacttttcatgacttgcatatgtggtgttgggggcacgttgaccgccatagataatcttggtcagataggaacctcgcttagatacccaaagaaaactagaagcactttcgtgtccctagtaagcatttggaattatctgggaagggttttctctgggtttgtgtctgaacattttctacaaaagtacaagttccctcgtcctcttatgcttactttgactctgctcttatcatgtgttggtcaccttctgattgcctttgatgtgccaaatggcctttacgtggcttcggtgattattgggttttgttttggtgctcagtggcctttactttttgccatcatatccgagctttttggacttaaatattatgcaactttgtacaattttggaagcgtagcaagtccactgggactatatgtgcttaatgtgaagatgactgggtatctgtacgacaaagaagccaagaagcaacttgcagcgtcggggcttacaagagaggaagggcatgaattgaattgtgttggg

SEQ ID NO: 98584 - DNA, 288 bp, Glycine max
  Peptide Sequence Number=SeqID_215362
atgaacaatttagtcttgtcagacattaacaagcccgagaatacttctcgatggatcaagcctgtttgctgctggcactttaaagtccaatattggtgcatctgttttcatcaaatccatggtgcgcgctttttgtatgggagcatgtctttgaaatgcagatggagaatttgtagctacaagctaggacatcttttcaagctggagttattcctagtgtcgaagctgaagcagcatcgttactggcagctgttaattggattattgatacgaggcttcaaaatgtga

SEQ ID NO: 98585 - DNA, 561 bp, Glycine max
  Peptide Sequence Number=SeqID_215363
atggaagtgtttattccatatcatggtaagatctcttgtattagagcagctgacgtcgtgtcatacagatatgcagaaggaatcatgtggcatcgaaccaatcatggttgggtgaagatgaatgttgatggagttgatagtggagtatctcatgggttgcgtaggagttatgcacttatgcgagaccacctgggtaactttgtttctgccttttcagttcgtattgaaacctgttctatcactgaagtggatccatggttgagacagcaaggtttccaaaggattatcatggagtcagattccttgaatgtcattggcttctccattgttaactgtatcaagcagcttgcttctcttggagaggggaatcaagtggcagataaattagccaaggataacttcacaatgtccattcctcaacagatttttcatgtggttttcaagtctagttaccggcacttaagtagtgttttagcctcccaggcatcgaaaaatctcattgagaagggttgttcatcgagcaggaaaaatgcgtatggaggatccaaatcacatccatga

SEQ ID NO: 98586 - DNA, 165 bp, Glycine max
  Peptide Sequence Number=SeqID_215364
atgcttcatcagctcgatgcgggtaaggaacggaccgttgaaggcttgaagcaaccagaaacagggctttgggcattgatgaagcacgttcgtaattttaaagcaggaaagctactttttattatttaccgtaatttattaagagggggtgataaacataattaa

SEQ ID NO: 98587 - DNA, 5345 bp, Glycine max
  Peptide Sequence Number=SeqID_215365
cagcctggctaggtcatccagattatgaagatattgtcaagaaggcctggcagattattcgaggggatgtcctttctaagcttcaaggggtgaaggaatcaaagaaagatcttcaattgcagtacaatccagtgttggaccaagaggaaattctctgcgccaaaaccacgctattcatcgatgtgaagcgaagaagaaatgtcggcgatggagaagcacgtcgtgcagatcttcgagcgaaagaagcgaatcatcgaccaatcacgacaacagtgccatctctgggagcaacaccttttccccaaactccgcctcaacggaattccccctccgccatggctcttcaactcttcccttcaggcaaatccacaagggagctagtttcaattagcaattctgttgtagttatgtatgagccgcaacgtctcggccaattttcctttgcgaaatttgatcctaatttggtgataatgtactctttctctgcagggttaagcaaagatgatctcgtttccgaagttctaatttcgcaaccacagtatatagttcctttccctggtctgtacagtaatctagatgccgtgtcctgtggtgttcactatccaattggtttgcataatgaaggtcgtgctttagaaaaggagtgtaacacgggagatggggtttcgaatttgccagattgttctgtcaactatgctgtatctgcctcaagtggtcctccagaattggattcaggtgctgtatcaccacctcagaatcagattgaagcaagagcctctgacagtcaccacgacccagctccgtctctcgcaaagttgcaaaggtcaaagccgaggcagaaggctctggagctacgtaatagtgcaaaagcacccagacgattgtcaagagaagatgataatgccagtgtctgtgctggcacagttacaggttctgcaccctcaagtcaagaggcagaacatgcaatggagtcggatgtagtcaaagattttcattccaacatccaaagttgttccatggaagaaacaaaagcatgtgattgtgtaactaagtactctggccggatgacaagatctaaaagttcattccagaaattcaactctttgaatgttgccagtccttctgtagcgaaggaagatggccctccgcctaataatttgaatgagtcatttgagatagtcaaccaaccttgttttgcaaatggaagttgtggcgtcaatgaagcaaacaaaggggattatcagagcaacgaagctggaaaaagtgtgcatgatgagagattaacaaaatctagaagttctagccaggccagatgtaacagtgaactgttgaagcttgacagcaccttgggcagtggcaaaggagttggattctgtgatcacaggcaaccaattacacatgctgaactaacagaattaagcaaagtcgctgattgtaacaatggaagtggtaggaatacagttaaagatggaaattcctgcctcagcaaacaagaaagtaacattcatggtatgataaaattacttagaagttcctgcccatcaccagggcatgatcttttgatgactagtggttctgtaaggtctattgataaatcagtgccattacctcaacctttaattccacagaattcacaggatcctgtggtgtctgttgttgggaccttaagtactcaaaaggatcctgacttttctgcactaaaaccaaaagatcatttgagtagaagtggttctgaaacgattgaaaaagtccaaagtaagaagttttggaatatacagcctaccaaactggatgctacaaggttatcttcaagtccaaagtattccaaattagatatagaaattggcaggaattctgcagtcaaggagaacgttgcagcactagctacctctggaaatatgagggctgtggctacttctgcaaatgaaggatcattaaggccagtgagttcttccaatttttatggtgggtctttacatgcagaatcagtaaatgttgaagcagtggtggatgagaaagtcttggatgcccaagaaaatataccatatgatgcccttcccactgataatgttgagcacagatttgctgcaattgttgatgaagttgatgctgactctgatggattagttgaaaaagatccttcttgtgttatccctaaggttaggcagaatgtatcagtcatgaagctgcccgctgattttatcatgtctgtgatgcctatgcaacttgattttgatgatgtagaggagacaagtgtgagtggaatttgtagttctgatttgaaagaggggcaacagggagtgtcaccagaagaacctctgaactcgttggaacctgtaaaattacttgaagaggaaacttcttctgtatgccaaattaaatgtaactcttcgggggagatgcctttgctgcaaatgcgggaagtaccaatcagagaaggggagccttatatggaatattgcgcaagccacttcaaggaggaagatatagctagggcaacactaagtgccgtgccaccaaacaaagagatacctatggttcagaatgaattctgtattcgtacttcttcgttgatgtatcattcaagtccttcacaagttgctggtgaaaattcatcaagaagtttgtcaaaagaagttatgccatcaaaatttgtttcagtaaacagtaaactagaaaatgttgaatgtagtactaagttggcaaatttttcttctgaagcagttatgggaaatgatctgcataaatccacagatgaaagtgttacaaatttcactattgggttcccattttctgctcctatggatgatgttaatgttggtttggcacaacagccccccaatagcattaccttgtgtaaagatggtgaggtgttgcataagacattgcacagtgatggaaaaattaccagcttttcaactgatttccagattttcagaatttcccccaaaagtttcacttatgatgtggaacattcttgtcctcagcataaaagaaggaagattgacattgaaacagagagatttcgatccgcctcttcaaacctcttggaaaagccatgtgattctattgaccaagggcctgtgagtagaagcttgagtattgaagaagacagccgggaggttgccctagaagttcaacatttgccatctgatccagaggatgatacaggacatcaatctattagtaacatcccaacggacgaaaagcaatacaacggggaatgccaaacaatggaagactcctcacttaaagtgagaaaagaagaggaagaccagatcagagagcgtaacagaaactatttagaattcggagaagtgaaaatgctgagggatacagaacaaagaaacagagagaagagtaagagctgtatcttggatggaagagacagaagtgaagacacccttgtgttggcagtggcaaaaacatcaggttttagtattgacccaacgatgggatgcaccatggatgagaaggtggagttgtggcatcatcaggttagttgtggacaggaatgtgcagaacatcttgaacgaagcacttcaagtagaaaagtttgtccaggaggaaatgctaaattctcaaatggaatgcctgcttctccaggaatgcaatgcttggatttggttggtacaggtgagactatagcagagcttgaagggcttattatgcaagcagataatgcacagccatgcattgctggagatcaaatagatttggaagagatagatcttccaagtaactcaatagattatacatcccttggtaaatctaggttcatgcattcttcatcgtacaattctttaaccccttataagttgcataacataccagagccctatcagtctttacctaatggactactggagggcttaggtataaggacttccctttctctaagcgatggaagcccgaggtccctttctgattgccaaccaaattgcaagggtcagtacacttcttcagttcaaactctttgggatcgaattaattcaaacttaggcagttcaggaaagcgtaagagtttaaaattagaccttccctgcattactgaagaaaatgaaaatgtggatgagattgctggtacatgccaaatgggcattgattccaaagaaatggctggctcaaatataagagaacccctagctgagattgtagataatgtaaacccctctgcatcagttttacaagatgatatattaacaggtggacgtgaagatattttaagcacagagtttaacctcagtgggacttgcaataaggcaaaacataagcttgacaagcaggatggcaataggaaaagattcacaagaaaggggaaggagaaccataatatatcgcttggagcgaatggtgtcaagaggactgctgaatcagtttgcaaaaggcccagtaggggaaagttatcaggaaaagatagtatgaaacaaggctcctttaacaatattgtatccaacgtttcatcctttattccattagttcaacaaaaacaagcggcagcagttgttacaggcaagagagacatcaaagtgaaggccctggaagcagctgaggctgccaagcgtatggctgaaaaaaaagaaaacgagcgcaagatgaagaaagaggtgttgcgaattgagcgggaaaggttggagctggagctgcagaagaaaaagaaagaggaagaacgaaagaaaaaggaggcacaaatggcagcaaagaagcggcagagggaagatgaagaaaaaaaggagaaagaaaaaaaaaggaagcgagttaatgacatgaagaagcagcagcaagagcatgagaagatactggccaagaaggaagaaataaaaatacaacgccgagctacgggtgaagtcctagaaaataagaaaattatggatgaaagagaaaattataagaatttgccagtgcaagacaaaagagaatgcaatatggagaaaatttctgaaaccgaaccgttggccatgagggattcggcaaatgataaaacaaaagaaccacatcctgaatattcggaatctgtgaatgattgtgctaataatggacaggtaatggacaatttgattaaagccgctgaagatgatgacttgatcataaaagactcacttcaagagcagtcatatgagatctctccatatagaggttcagatgatgaagatgaagacgaggatgacctgccaaataataagtttatcccttcatgggcaagcaagcatagcctgtctctgattgtttcttcccagaaaatggacccagaaacgatatttcctccgcaaagtttttgtaatatagcagaagcttcagctacagtagccgagcatagtgattttagtaacacgggattgtgttaa

SEQ ID NO: 98588 - DNA, 1095 bp, Glycine max
  Peptide Sequence Number=SeqID_215366
atgggagtgcagaaagcaacaggcgtgagttggaaatggtctaaactgaaaggcccaatgatgccaaagggcccaaggaaattatcagttatttctgaggccaaaccagaatcctcaaaggttgaaaatgttgttcacatggatcgtgtgtcaaatttgcactatcttttgcagttatgtgcgaaaacaggatcatccatgggaggaagagcatgccatgctcagattattcgcatcggcttggaaatggacatattaacgtcaactatgctgattaacatgtactcaaaatgttctttagtccacagtactcgcaaaaagattggagcactgacccagaatgcagaggatcggaaagctctaaaacttttgattcgaatgcaaagagagtgctcttcaataaaagatgcaagtcagatgtttgagagtatgcctgaaaagaacgctgttacgtggagttcaatgatggcgggatatgtgcaaaatggttttcatgatgaggccttgctactttttcacaatgctcagttgatgggctttgatcaggacccatttaatatatcatctgctgttagtgcttgtgcaggcctggcaactttggttgaagggaagcaagtacatgccatgtcacataagtctggatttggttcaaacatttatgttgcttcctcccttatagacatgtatgccaaatgtggctgcataagagaagcttaccttgtgtttgaaggtttcgtggaggttaggagcattgttttatggaatgcgatgatttctgggtttgctagacatgctcttgcacaggaggctatgatcttatttgaaaaaatgcagcaaagaggcttctttcctgatgatgtaacatatgtatctgtactaaatgcatgcagtcatatgggtttgcatgaagaaggacagaagtattttgatcttatggtcagacagcacaatctttcaccgagtgtccttcactactcatgtatgatcgatattcttggtcgagcaggactggttcaaaaggcttatgacttgataggaagaatgtcatttaatgcaactagttctatgtggggttctgttagaggactaagctaa

SEQ ID NO: 98589 - DNA, 1005 bp, Glycine max
  Peptide Sequence Number=SeqID_215367
atggcttcttctattcgcttagttactctctgtctctcttaccttcttcttacttggcttctacatgtaaccgctgaagaggctactagctcctctaacaaaattggcctgggctaccgtctaatctccatcaaagatgcccctgatggttcccttgtagggctcctccaagttaagcagaacaacaatgtctatggccctgaccttccccttttacgcttctatgtcaagcacgagactgagaaccgtttgagggtacacatcactgacgcaaagaaacaaaggtgggaggttccttacaaccttttgccaagggagcaaccaccggctctgaatcaatacatcgtatggtcgaggaagaagaacctagtatcagtgtccgagtactctggctctggctctgaccttgtcttcagctacatttcagacccgtttagtttttctgtcaaaagaaagtcaaatggggataccctttttgactccaattctaatgagttcaactcattggtcttcaaggaccagtaccttgaaatttctaccaaattgcccaaagatgcatctttgtatggtttgggagagaacacacagccacacgggatcaagctgtacccaaatgacccgtccactttgtataccactgatgtatcagccattaatctcaacactgatttatacgggtcacaccctgtgtacatggatctcagaaatgaaggtggcaagccttatgcacatggtgttcttttgttgaatagcaatggaatggatgtgttctatagaggaacctctctcacgtacaagattattggaggggtgctcgatttttacttctttgctggacccacccctctcaatgttgtggatcagtacacttccttaattggcagacctgctccaatgccttattgggcttttgtatgcatttgcattagtcatttgggtgccacagaaccattcccatttgtagaggaattattaattgacaaaactggggcttgctatttgtga

SEQ ID NO: 98590 - DNA, 234 bp, Glycine max
  Peptide Sequence Number=SeqID_215368
atgtcacgaaaccttacggattacgcaatcgtcccctctttggcttccgaaatgttatggaactttacggattgcgcattaacacttcctttcaactcccgacatgtcgcagaacttcacggatcgcctaacgatgggtgtcaagtacctcgaagtggtcaagcgaaggtcgcatcccaccaaacagatggttcccggacgaaattagggtatgacacctctaaagaagtatga

SEQ ID NO: 98591 - DNA, 309 bp, Glycine max
  Peptide Sequence Number=SeqID_215369
atggagaatttgcgaacagcgctagggcaatcaatttgcggggctcaagactcgttggtgggaggatgcatgaatgacaatcaattcatggggctccgaataaaagtggagaatggagaattggcgaacagcgctaggcaatcaattcgcggggctccagactcgttgggctcaagactcgttggtggaggatgcatgaatgacaatcaattcatggggctccgaataaaagtggagaatggagaattggcgaacagcgctaggcaatcaattcgcgcagctccagactcgttggtggaggatgcatga

SEQ ID NO: 98592 - DNA, 360 bp, Glycine max
  Peptide Sequence Number=SeqID_215370
atgcaaacaccatgtgtgaaagagtctcgggaagttttgaggaaccaacccagtgtttgtgcaatgagcgatgatagcaaaccaagtgacaagatcgaagggatacatgagtcaacaaaagttgtgatggtaagaaccaagaatcagtcttatgaagaacctccctctaataagaggaagcaatttgaaactagtacttcttccatacctcaacaaactcagatgcaacataagcctatcgacgatactaacaagttctttaataagtatgatgaggcaagatattatgttagccttaagagggaagtttatactaagaggaaggtgcaacttaaggaagaggagttcaatgttatttaa

SEQ ID NO: 98593 - DNA, 330 bp, Glycine max
  Peptide Sequence Number=SeqID_215371
atgatgttgaaccccttcccctcagcccctcacacctatttatcggaaaataaggggagaaggttgcatagcagctcgcccaggggctggaaaatgtccccaaagttaccattttgctcccattttgagtattttgcacatttccttccaaaacatcacaaaaccctacaaattgggcgacaactaacgttaagcagctcacttcggccgagaacttgcgatacgaatgatcggttaaaacttactttaccagaagaaaagcgattaccgatgataggagaaggatatgaagatgtacaaaacaagaaagaggaccctaaaggtgcatag

SEQ ID NO: 98594 - DNA, 1164 bp, Glycine max
  Peptide Sequence Number=SeqID_215372
atgacaaagtgtttgctgatgctcctctggattctaatcattagtgggaattatgttttcggaggttgcatgtttctaacaattgagattttcctaaatgctttatatgacccaaatttggagttttatttcaacaaatgcgtcaatgcttcatcctttagtcaagtggatttcgtgatctgtttctgccatcctctggtttctgaagtgaagaaaaatatagaaactgttcagggtgcagatgtctatcctgctgcacagcaaatgctaattcatcaagggaaagttcttagggatgcttctaccttggaggagaataaagtagttgaaaatactttcattgtaattatgctatcaaagagtaagagcccatccggtgaaggatctactacttcaactgctccatcaaccaaggccccacagacaagtacagttcctgcttcaacccctccagcgtcagtagttcctcaagcttctgctcctgctcctgctcctgctcctgctgcaactggggcactgcctgcatcagttactgcacctatatcttcaccttctcctgctccagccccaactcctgctcctatatcttcaggaactgctgtggaagggtctgatatctatgggcaggctgcatccaatctggttgctggaagcaacttggagggaacaattcagcaaattcttgatatgggtggagggagctgggacagggataccgttgtccgtgctcttcgagctgcctacaacaaccctgagagagctgttgaatatttgtatacaggtatccccgagcaagctgaagctccacttgtagcccaagtgcctgcaagtgctcaacctacaaatcctcctgctgatgctccacaaacagcacaacctgctccagttacctcagctggacctaatgctaatccattagacctttttccccagggtctccctaacgtgggttctggtgctgctggtgctggttcattagactttttacgcaatagtcaacaattccaagccttgcgagctatggtgcaggctaatccacaaatattgcagcctatgctacaagagcttggcaaacaaaatccccatctaatgagattgattcgagaccatcaagctgacttccttcgcctgataaatgaacctgcagaaggtgctgaagggtaa

SEQ ID NO: 98595 - DNA, 132 bp, Glycine max
  Peptide Sequence Number=SeqID_215373
atgcctttttcccttgaagcaatgggttttgatcgtgcaatcgtattggaggtgtacttcgcttgtaacaaaaatgaggaattggctgccaactaccttttggatcacatgcatgagttcgaggaacaatag

SEQ ID NO: 98596 - DNA, 1481 bp, Glycine max
  Peptide Sequence Number=SeqID_215374
tcgacacgctgccggaaggcatcgccgctgccggtggtgacctggccaagttcgccctgcagcagaagctggtgacctcactgaagacccgcgaggaattcgaggatctgatgatcgagcgtggcgtggccgacgacgatgccgacggtggtttccgcaacgtcgacttcggcacctacctgggccagcttgatgcgcgccgcaacccggtcgacaaccgtccgcaggtggcggtggtggtggccgccggcgaaatcagcggcggcgatctcccggccggccgcatcggtggcgaatcgacctcggcgctgctgcgtgccgcgcgtgacgatgagaacgtgaagtccgtggtgctgcgtgtcaattcgccgggtggtgaagtgttcgcctccgagcagatccgccgtgaagtggtggccctgcaggccgccggcaagccggtggtggtgtcgatgggcgacctggccgcctccggtggctactggatcagcatgaacgccgatcgcatctatgccgatccgtcgaccatcaccggttcgatcggcatcttcggcatggtgccgaacttcagccgcgcgctggacaagatcggcgtgcacaccgatggtgtcggcaccacccgtttcgccggggcgttcgatgtcacccgcccgatggatccggctgtgggccaggtcatccagtcggtgatcaacaagggttacgccgacttcaccggtcgcgtcgccgacgcccgcaagaagccggtcgaggccgtcgacgaagtggcccgtggccgcgtgtggagcggtgcgcaggcaaaggaacgtggcctggtcgatgccttcggtggcttgaaggatgccgtggccgatgccgccagccgcgccaagctgggcaaggccgatgcctatcgcgtgcgctacatcgagaaggcggcaacgccgttcgcgcagttcgtcagcggtttcgccggcagccgtgccggtgcctggatgctgtccgactcgggcatggcgcggatggtgctggcgcgcacgatgccggaagtggatacgcagctgcgctttgtcgagaacgcggcccgcgagaagggcaacggcacgccgccttgcccttgcgctcgctcgcagcagcgtcatcgacggttttctgcacgcgcttggcgcggtccagtggctgctggatcgcacgggccatggcctgcggttccggcggcttctccggattgggcgtgggcgggcgttggcaagcggacagcagcacggtggccagcagggacgtggacaggatcaggatgcgcatggcggcaatccgtgatgggcgtgcgggcagtgtcgcatcctcggcagggggcggccgtgagcgcgtatccttgccgcatcgaaacacagcgggcgcggccccggagagcacatgacccagcaacggtggcgcctggacggccagaccgccctgatcaccggcgccagcgccggcatcggccttgccatcgcgcatga

SEQ ID NO: 98597 - DNA, 556 bp, Glycine max
  Peptide Sequence Number=SeqID_215375
ggtgatcaaattcatgctatttgtaaatcggaccacctcaagtcttggaaagctgatttgaaagagaattgcacttatgttatgcataatttcaaagttgttaagaatgatggtcaatttagagtgtgcgaacatgagtacaagttattttttattggagtgacggttgttagagaagctgatttgcatgaactgccttttaaggaatttagatttgttgaatttgcaaatgttgttgctggcaattttgtgtctggccttggtgaaattttgtcttgcacactttgggagaattactgtgctcagttcctatcctatttgaatgaacgtggggatgatgggccaatggttattatattgacgcatgccagaataaaagatgcacagggaagttatccagcttcagtgagcaattccttcaaggcgtcaaaactattgattaatgatcctatattagaaattcaagaatttaaagagaggcttttagatttaggtgttgaggtgagtcgagttttgctacctggcgatcaagcaagctcacaagtttcagggggaa

SEQ ID NO: 98598 - DNA, 1401 bp, Glycine max
  Peptide Sequence Number=SeqID_215376
atgcccctgggaaattggacttctcttggtaaacttgatttgtcatacaatcaacttgaaggaaacattccaacttctttgggaaatctgacttctcttgttgaacttgatttgtcatatagtcaacttgaaggaaacattccaacttcattgggaaatttgacttctcttgttaaacttgatttgtcatacaatcaacttgaaggaaacattccaacttctttgggaaatttgacttctcttgttgaacttgatttgtcatatagtcaacttgaaggaaacattccaacttcattgggaaatttgacttctcttgttgaacttgatttatcaggtaatcaacttgaaggaaacattccaacttctttgggaaatttgacttctcttgttgaacttgatttgtcatatagtcaacttgaaggaaccattccaacttctttgggtaatctctgcaacttaagggtgatagatttatcatatctcaaactcaaccaacaggttaatgaacttttagaaattctagctccttgtatttcccatgaactcacaaatcttgcagttcagagttcacgactttcaggcaatctgacagatcatgttggggcatttaaaaatattgagcggctagatttttccaacaacttaattggtggtgctcttcctaaatcatttggaaaactttcatcattaagatatctcgatctgtctattaataagttcagtggaaatccatttgaaagtcttggatcactctctaaattgtcatctcttcatattgatggcaatctttttcacagagttgtcaaggaagatgatcttgcaaatcttacaagcttgacggagtttggtgcatcggggaacaatttcactttaaaagtgggtcccaattggattcccaattttcaacttacctatttggaagtgacatcatggccgttaggtcccagctttccattgtggattcagtcacaaaacaaacttgaatatgttggactatctaacacggggattttcgattctatttccacacagatgtgggaagcactttctcaggttttgtatttaaacctctctcgtaatcatatccatggtgagattgggactacattaaagaatccaatatctatcccaactattgatctaagctcaaatcacttgtgtggtaaattaccctatctttcaagtaatgtgcttcagttggatctttcaagcaattcattctccgaatccatgaatgactttttatgtaacgatcaggacgagccaatgcaattagaatttctgaatcttgcatcaaataatttgtcaggagagatacctgattgctggatggattggacatctcttgtggatgtaaatttacaaagcaaccattttgttgggaacttaccccaatccatg

SEQ ID NO: 98599 - DNA, 494 bp, Glycine max
  Peptide Sequence Number=SeqID_215377
cgaggaagcggaagagcgcccaatacgcaaaccgcctctccccgcgcgttggccgattcattaatgcagctggcacgacaggtttcccgactggaaagcgggcacttattctcatgaaagctggaggtcgcttaacctacgctggcccacttgggaagcactcaagtagggtcattgaatactttgagagtataccaggagtgccaaagattaaagacaactataatccatcaacatggatgctagaagttacttcaagatctgcagaagctgaactcggaatagacttcgcccaaatttatagggagtcaaccttatatgatcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 98600 - DNA, 477 bp, Glycine max
  Peptide Sequence Number=SeqID_215378
atggttaagcttgccccacttgaaaagcctcttttgaatggtgactctaatgtaagcaacaattatgttcccattaaggctagaggaaatgaaaatttaacctggtattcaaatgttggatttttcagcattcttactttctcatggatgattcctttaataactctagggaatgagaagactttagagcatgaggatctcccacatcttgctactgatgacagtgtggatgggattttgccaacttttacaaacaaacttgagtcagagtgtggagtgagcaacgaaggtcgttcaacacaagggtggggtgagcgccacagcgacgatgacgagctgagggtggctatgcgagacttagtgtcggggggacgacggcctgagggtgcctttgcgagagtgagcgtagggggtcagggagaagcaagagtttgggagagactgatgagtgcgagaagagagaaagcttttcagttt

SEQ ID NO: 98601 - DNA, 330 bp, Glycine max
  Peptide Sequence Number=SeqID_215379
atgcaacatatcaccaaagatgttgagtctaaggtcaaggctaagggtgttatacttgacgttgaggctaagggtgctatgcccgaggttgagcctaagggtgctatacctgaggtcaaggctgagggtgtctctgaggacgtagctttgaaggttgagtcaaaagactcaaagatagaggaggatccagaggaggatttggattggatggatgagtacctcaaggaggctcttagcgatgaccttcccaaaggttttgtttcgataatgtgtttgttctttgctagtttagcttgtagatctagttgtggggatgtacaaatgcattga

SEQ ID NO: 98602 - DNA, 732 bp, Glycine max
  Peptide Sequence Number=SeqID_215380
atgccctttacttcagaggactacatgtcctctccttcagaggactacacgtcctcggcttcagaggactacacgtccttgccttcagaggactacccgacctcaccttcagagggctacacgacttcaccttcagagggcttcaagtcctcaccttcagacgactacacgtcctcgccttcagaggactacaagtccttaccttcagttgactacatagggttacacactctcgcctttagagagttgcacgctgtcgccttcataaggctacacgccctttccttcagaggactacatgtcctcgccttcagaggactacacgtcctcggcttcagaggactacacgtccttgccttcagaggactacccgacctcaccttcagaggactaaacgacttcgccttcagagggcttcacgtcctctccttcagaggactacacgtccctgcctttagagggctacaagccctcgcctttagaggactacatgtcctcactttcagaggactacacgccctcaccttgagtgggctaaagaccctcaccttcagaggactacacgtcctcgtcttcagagggttacacgccatcgccttcaaaggagaacattttcatgccttcagagggctacatgccctcgccttcagaggactgcacaccctcgccttcagagggctacatgtcctcaccttcagatggctacatgtcctcgccttcagaggactgcat

SEQ ID NO: 98603 - DNA, 480 bp, Glycine max
  Peptide Sequence Number=SeqID_215381
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgaattgggttcaagcttttccccagccccttctcatcaatggactcctgacgtatacgaaggagtgcggttcgttcgataaattcctatctcttttatctatttctgagatgtttggattttttcaaaactccatggacatgcagaagagaaatgctattcccactcggaccaagacataa

SEQ ID NO: 98604 - DNA, 264 bp, Glycine max
  Peptide Sequence Number=SeqID_215382
atgacaacggggcgggtctggattgagttttgtttacctcaccccattcccaaaactgaatgggttacatctcatcctcgtccccgatggagttggcgggacgagtttggggacgcgttcatggcggataatgagaatcctatccccgaatccgaatttggctatcggagaaaatccgatcccgatcaactcagatttttttcgtcaaaatcagagtgggtccggggcgaaccccacatgttcgagtctcattgtcatgcctag

SEQ ID NO: 98605 - DNA, 312 bp, Glycine max
  Peptide Sequence Number=SeqID_215383
atgcggggttaccttatggttatcgacccctttcgtaaaccaggggcaaacgagcccgttgacgcggggagactaacatcgtcttctataccttttgtcatcctgaccatgaagtcaggtgacatgtggggttacattatcgttacccgcacctttcgtcaaccaggggaaaacgagcccgttgacgcgcgaagactaacatcgtcttctgcaccttttgtcgtcctgacccgtgaagtcagggttaccttatggttacccacacctttcgtcaaccgggggaaaacgagcccgttgacgcgcaaagactaa

SEQ ID NO: 98606 - DNA, 137 bp, Glycine max
  Peptide Sequence Number=SeqID_215384
aaaatctaatgagggtgttaatgccgatgctttattcccttttctgaaggccattcgacagggagactcggaagttgcggagtcttggtttaatcaagccgctgaatattggaaacaagctatagccctaacccctg

SEQ ID NO: 98607 - DNA, 398 bp, Glycine max
  Peptide Sequence Number=SeqID_215385
atggcatcgctttctgataagcttttgcgtaattctcaacatcgaatggggaacaagatgcggattaaagccttactgggtctctcggcagcgatgctgctggcgggttgcagccccactcatgaactgaccgctgcgggtcagcagatcaagttcaccgacagcaagccggcggcggaatgccagcttctgggggaagtgaccggcacccagagcaactggctgtccggcaacggcggtgaaggcagctccatgtgtggggctgccaacgatctgcgcaacaaggcggcggccatgggcggcaacgtgatctacggcgccaacagcccgaaccagaacctgctctccagcttcgcacctctggacagcaaaatggtcggccaggtttacaagtgccc

SEQ ID NO: 98608 - DNA, 126 bp, Glycine max
  Peptide Sequence Number=SeqID_215386
atgttcgtggcagcattgcagagtgcaaggatgagccagaaccttgagcaacataagcttgaggataagaatcctggtgcaccaaacaatcattgtagcaagccaaaagtgaagaaacaacattga

SEQ ID NO: 98609 - DNA, 377 bp, Glycine max
  Peptide Sequence Number=SeqID_215387
atggaatctcaggtgataatatgggaggatattcaggcaaaatttgaaatccctgaagcttctgatagtaggacaaagaagaaagttcttcagacgccgacaaggacggtgtggacaacagtgtctgtgaaaaatacggcattagcatggagaaatgggcccaattttgtcagacccgccgagatccctcgtgggaggatgtgcggaaaaaagcacaagccatccagaaaacagaagctgatggttgagaagacaaagaaaaaactagaggaagctgctcagtctggaagcactgagggcgtcattaatcctccatctcccatcaggcgacacgtgaagtggaagatggcccgcaccaagaaaactgggcagatgat

SEQ ID NO: 98610 - DNA, 1530 bp, Glycine max
  Peptide Sequence Number=SeqID_215388
atggggaccgaaatgggccaacatgccaaggaagtatggcacccttctgagcaaggcaaagattttccaatagatgtgaaaaaggacaagagccttgggaaggacatctatcacaatgttgtcttgactaatgtccttgaggcttatggaataataaggaagttcttgtatgagactcctaaagaaactcctctagtggatggttccattctttctaaaattcaccagaaatttggactcaacactggacctgatgaccaattggacgcagtttgggagaaagttgttgaggaggattacaaggttgctcctacaccgcaatgtccacctccaactcgagtttctcccaaggcaatagatgcaatggcccatgtatcaagaagggtatcacctaagaagcaacaaccatcatccactatagagcgcttaagagagcttaataagactgataatgatgaagatggcttggtgtttaggaaatgtaaagctgcacccactttagttgagacccatacacctcatgtgaagaaggtgaaacctacacaagcttctcttcctcctacacaaccttgcaccaacaagcgagagaagagaggcgctcaaagaactaagcatccagcgaagagtaagctactattgatgttgctaatgatctttaacctgctgagattcctcccattcgagaatagacctcaattttccatattaagcacctccatcaccatccaccttgactacttcgaacatctaggaccgctcgccatcgaccccaacctcacagccaaagacattacaaggctattttttcatatggcctttctcgttgagaatgcttgcaacattaaaaggagactagacatggaatttcgacctaccactaattggacacaactacctcttgatgttgaggaggagattgtcacatgccctccatccatgcacaaagaccatgaagttgcaccatcttctattgcattgaatcaatctaaagggattaaagtccttcctccaccaacttggaagcgtcttcaccctaagatatctaagccttcatcctcaacagccctatgcaagagtgtttataagattccatctagggcctccagagaagtgccaccattcctatgtcctaagcacatccaactcttcgctccaatgttacagttcatttccttggtctatggccatcaagccattcctttgactaaggacgacatcttcaatgttgggatgattatgatgcattgtgatctcactaaccaatggctaaggtaccccttaggtatccatatccgcccaaccgcaaccatcaagttcatgccagatagagttgcttcaagggatgtagtaatgaaaactttcactttgaagctagatgttgagtttgaccagaatgacgccatgctctgttacttcaaagacatgtatgaaaactcatatcttgcgtccaccttagagtacgacaagaaagacatatccaatcacaagcatggtgcagatcttgcatccaacaaagatctacagatttaa

SEQ ID NO: 98611 - DNA, 489 bp, Glycine max
  Peptide Sequence Number=SeqID_215389
atgggttcaaagagaaaaaggaaaggatgtgacaatcaactgtcaacagatagagagggagggttcgatggtggtgactttagtggtgaaggcggaggcgcaagcctaggatttatagtggatgtaggtgtaggaattatagctagaggtggcaacggtggtaggacggtgggaggcagcctctgttgcatgagcatgttcacattgaatagtatagaatcattgaaggatttgagcgaagctttcaaagtgtttttgatcagcatattgatcttcatgcgttcagcaaggaaccttttctcagttgtttctttcaggctggcctgttatagggttatgatcaagatagaaaaggtgttctttgagtttagggtggtgtgtccaagcaatgacaatggctcatcacatagcagcttcatgataccggtgaaagttgaaaatgaagcaagtgcaaattggaggggtgtcatgaatgaggcgcaagtataa

SEQ ID NO: 98612 - DNA, 312 bp, Glycine max
  Peptide Sequence Number=SeqID_215390
atgaaagtggatgaccatgatggtctctgcatgccatcggacttgattgtctttggatggcaaaggagactaaaaatagtcttgaaaacaacgaaagctgatgaccatgatggtctccacatgccaacggacttgattgtctctagacggaaaaaaggaaggcaaagggagactgcaatagtcttgaaaacaatgaaagcggatgaacatgagggtcttcgcataccatcggacttgattgtttctggatggcaaaagagactaaatagtcttggtcaaaagacattgaagtcttcgaaaagggacagatga

SEQ ID NO: 98613 - DNA, 133 bp, Glycine max
  Peptide Sequence Number=SeqID_215391
atgcctttcatcacacggggttttagtgaccccaacgcgagggtacttcgaggagtccgtaaggcatgggatgcggtccaaaggaaggacaaagagcttaggggaaacggtaatgggatcatcaaccgctatc

SEQ ID NO: 98614 - DNA, 176 bp, Glycine max
  Peptide Sequence Number=SeqID_215392
catcctcttcaagcttcttatccaaggcaattcttggtggtgaagctccttcttccttggcttattccctagtggatgcctccatagaagctccacaagcaagcttccatcacaaggtcaccgctcgtgcgccgaaaaaggaaaggcgaattgggaccaactcatggctagcatag

SEQ ID NO: 98615 - DNA, 234 bp, Glycine max
  Peptide Sequence Number=SeqID_215393
atgccccgtactcatgacgcgatcctgtattacaacgggaaatggaacatgccaccgcagaacaaatttgttggatgcgcgttcataggaaaaaatcctaagaaatttcaaattccttcaacatgtaccatcgatgaactgaagaatttaataaagcaagttgcacctaaagggattccccctcttggaattcacgaatcacaaacggtgttatttgatggaaccagggaatga

SEQ ID NO: 98616 - DNA, 297 bp, Glycine max
  Peptide Sequence Number=SeqID_215394
atgccacataagtctgtcatgcaggaaatctccaagctgcagtctagcctggaagagattactcatcagctacgcagaggcaattatctctctatggacgagaacgctgagttggcagcgatgcgcaaaagaatagaaagttatcagtccatggtcatgaaggcacgcgccgaagcgaaagagtcagatggtgtgatgtcggacctaaaagaagaaattgagcgtctgagaagagtcaacactcaagcaccggtgccaggaaatgaagatcctgcgctacaaaaagaaattcattaa

SEQ ID NO: 98617 - DNA, 285 bp, Glycine max
  Peptide Sequence Number=SeqID_215395
atgaaactagaagcaaaaaccttgattgagttagatcgtgagcggcagcgtgcggcaaaaattgaaggggatctcaagcaaaccataaaagcagccactaaagcacaaagttcattcatgactcagactgctaagagccagaagctaatcaacgaactaagggaaaacataggtcttctgaaaggtcagttgaaatcccgtcataagaaaaatgccgtgttaaaaggcaatgttactaggtctccaaattcaaaagctgatttaccaagtgagcgaaatctataa

SEQ ID NO: 98618 - DNA, 258 bp, Glycine max
  Peptide Sequence Number=SeqID_215396
atggggtgtacccatgtgcccgaaatctaccctaaggcccatgagaaccccagggccttctcttgcatctttgtcccaatcttcttggagtcttctgtccaatgccgttggggggagcattttagtgaaattaatgagaagaaggagaaagaagaagcaaaaacgaggttgaggcacttcttaatcgcttccgtgatcgattcctacgtcgttcttcaccattcttcattcgttcttcgttcatcgaccgggatgtga

SEQ ID NO: 98619 - DNA, 234 bp, Glycine max
  Peptide Sequence Number=SeqID_215397
atgggttttgaaagtgaaaaagggggtggtggtggtttggatggtggtgggtggtggtggaatatcagagtgagtaggtggtggcgaaagtgtttggggaatggttgtttgtggttgtgggtcaaggctaagtgtttgggtttgggtaagggttggaagagtgggtggaatacttattggtggttaaggttgaataggaggaagcggtattggggaaacaacaacattgaatag

SEQ ID NO: 98620 - DNA, 492 bp, Glycine max
  Peptide Sequence Number=SeqID_215398
atgtgcaacttggaagatcagcctggaaaaaaagccaagcaaaaggttgattcaaaaactagatgcacaactgctatcatgagaaaggttgaagcagaagctgagaagacacgacccaacaagttggtttccaaacccattactgtaactgctaaagcaccaaaaatggttgagtccactctagtcataattgttgagaagccaaaaaaagatacggaaaatgaggccccaactaaatcaacctcacatgaagccacatctaaagacgcaactgctgtcattgtccacactaacacctctggacccaatccaatcaattctgctcctctagaagtagtgactaaagctgaagtaaaggagatgattggacttgttatggactactttactgagaagcaaaggactgagaatgaagagttcatacacaacatgcaacaaacaatttccactcaatttagtagtcttggtgaatctctcattctgaatctgtaa

SEQ ID NO: 98621 - DNA, 249 bp, Glycine max
  Peptide Sequence Number=SeqID_215399
atgatatacacgacaggtggatgcactactcggatcatatcgttccagcaggtgaggtatgcgctgtgccaggaagtttgtgatgacattgctgagaggttggagcgtcatctgagtctaggggtggtcacaccaagttcatcgacacatgaggtgatcgaagaatgcctcaagatggacaggagtgtgacacaggaccatctagtatatgttaggtctagacgcaggcgacgcacggatcaggcgtag

SEQ ID NO: 98622 - DNA, 246 bp, Glycine max
  Peptide Sequence Number=SeqID_215400
atggcctctggtaatcgattaccaaggagtaacagggcactggtaatcgattaccagttatgtgtaatcgattacacagtgtatattgcaggtttccatattctgaagctgtgtaactcgagtttggcctctggtaatcgattaccaatgctgtgtaatcgattaccagagaagaaaacccttgaggcataccttttaactacatgtagtggttatgggacgcattgtgttgttacccgtagttag

SEQ ID NO: 98623 - DNA, 333 bp, Glycine max
  Peptide Sequence Number=SeqID_215401
gagcttcacccagagctaaaaagaatggtcgaacaagaagaccgagaaatgaagccacaccaagaagagacgaaaatcgtaaacttagactaccaagacatcttcgcttggtcatgccaaaatattcccggcttgaacctcgacattgtgcagaataggttgcctttgaatcccggttgttccccgatgaaacaaaaactaaggatgaaacccgagatgtccttaaagataaaagaagaggtgaaaaagcaatttgacggcggcttcttggcagtcgctcgatacccagaatgggttgccaacattgtgccagtccctaagaaagatgggaag

SEQ ID NO: 98624 - DNA, 246 bp, Glycine max
  Peptide Sequence Number=SeqID_215402
atgttgcaagtaggtccacctgagaagagcacccatattgatgtcaacaagctgcttttgtgtccctggccagccaaagccaccgccaaggccaacaaaacccacgcagcgacgtcgttgaaggctgcagccgccatggcggtttctcccacacgtgtggtcagcagtttgagctccgctaagatgcgcgcgagcacagggaaagccgtgatggacagagatacccctaagaacacgaagtgctga

SEQ ID NO: 98625 - DNA, 1392 bp, Glycine max
  Peptide Sequence Number=SeqID_215403
atgaaggttgtctctcgtaagggcgaaaacgacgccgttgacgagatttatgtctgtttaacgttggcgggggtgctggcgtgcggtttcgtaactgaccttatagggattcattctatattcggggcttttgtgttcgggttaacggttccgaagaatgggagcttcgcgaggaggttgatggagaggatcgaggattttgtgttgggcttgttgctgccgttatactttgcctctagcgggttgaagactgatgtaactacgattcgtggcggtgcggcgtgggggcttctttgtctggtgatattcacggcgtgtgctgggaagattctagggactttcgtggtggccatgttttgcatgatccccgccagagaatcgctcacgcttgccgtgctcatgaacaccaaaggactcgtagagcttatcgtactcaacattggcaaagagaaaaaggttttgaacgatgaaatgttcgcaatcttagtactcatggctctattcaccactttcatgacaactccaatagtgatgagcatctacaaagcagcgaagacccaacggaagctaggagacattaattccttgagttccaaggtaaatgagttccgagtcttggcatgtatccacggcccaaacaacatcccttccataatcagtttcatcgaatcatctcgcagcaccgccaagtcccttctgaagctgttcatggtgcatctcgttgagctctcagagcgctcttcctccatcacaatggttcaacgcgcacacaagaacggtttccctttcttcagccggtcccaccgtgacacgtggcaggatcgcctcgctggcgcgtttcagggctacggtcaactgggccaagtcaaagtccggtcaaccaccgccatctcttctctctccacgatgaatgaggacatttgccacgtggcggaggataagagggtgaccatgatcatcttgccgtttcacaaacagtggaggatggaaatggatgaggataataataatgagaactgtcgtgtgttggagaatgtgggccacgaatggagactggtgaaccaaagggtgcttaagaatgcgccttgttcggtggcggtgcttgtggaccgtggatgtggcaatctgcctcagactccaagcccaattgtggcccaacgcgtatgcatcatcttctttggtgggcccgatgatcgtgaagccctagagctggggaagaaaatgattgaacacccagcagttaaagtacgtgttgtgaggtttgttgaaaaggatgacctgatgaatggaaatgacactgtgttaagcttctcacatgacgaaaatggtgacaagagttacagcttctccactgctaaaatgaaccaccagaaagaaaaggtaaagctctaa

SEQ ID NO: 98626 - DNA, 1011 bp, Glycine max
  Peptide Sequence Number=SeqID_215404
ctaccccgtaccacacaccacattgtcggcgaaaccgtggtggaagcgatcaaacaaggcgtcgcgctggaggcattgagtctggcgcagtttaagcagtttagcgcggcgatcggggaagatgtttatccggtgctgtcgctgcagtcttgtctcgataagcgtaacgcgcgcggcggcgtggcaccacagcaggttcctgtcaccttcgattccgcctcggtgaatgacggcggttttattgtcgatggcgagatcacccgcgatacgcgccctgcgctgaacggctatgccggccgtggcgtcacgcttgagtgttaccataacggcgagttagtgggcagcacgctcagcgatgctcagaccggctacttcagttttacgctgcctgccacgctggcgggcgggagtcatcagttcatggcacaggtggcggcaatgccgcagagcgcaagcgcacccttcacgctgatcgtggaggatgccggttttgtaccggtcacgctaaccgccatgcacagcggcacgcagtttatctggccggaagagagcactacgcaaacccagccgaccttttccggtaaaggccagcccggcagccggattgagctgtttgataacgatgagccgctcggcagtgcgctggtcgatagcgatcacaaatggacctttacgccgtctcatgcgctggccgctggcgagcatcagatcgtggtgacatgcggcgcagggaatgtcagtgcgccggtcagcctgatcgttgcggatgatgttacgggagatgtggcccggccggaggcgctcagcggcctgcatctgcacgacctgctggccagcgtgccggttaacctgttccaggacgcggagcttaacccggacacgcagcagtatgagctggtgctgaataatgacgatctgcagcaggagctgacgcagtccggtatcgttggccactccctggtgctgacggagcaggatttgcagcagttgctgggtgatgtgccactgtga

SEQ ID NO: 98627 - DNA, 1004 bp, Glycine max
  Peptide Sequence Number=SeqID_215405
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcctctattaagctcattcaggcttctgccgttttggatttaaccgaagatgatttcgattttctgacgagtaacaaagtttggattgctactgaccgctctcgtgctcgtcgctgcgttgaggcttgcgtttatggtacgctggactttgtgggataccctcgctttcctgctcctgttgagtttattgctgccgtcattgcttattatgttcatcccgtcaacattcaaacggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 98628 - DNA, 513 bp, Glycine max
  Peptide Sequence Number=SeqID_215406
atggccacaatgataaaggccatgatgagcatgaagaagataatggaggtcaatgcggctatagttgcctctagcagtgtcgttgctgaggtggacccgactcccccatctggtctcaaccaaataaatcatcccatctcggatatggtagggcagagaggaaaagaattgggaagtacgggcggcccccattttgtgcaagttcaaaacaagcatgccatcttgccatttggcttgcctcccaattatacaccacccaatgtggtgcacactcccattgagaatgtcaatgactccacacccatactcattgagagccaacaacctcaatctgatcatgcacctatccctcaacccatgggggggacacatgaaataccccaccacaatctagccaactttaagccttgcctcgaatatgccactgaagggcaagcagttggtggtgtacccctgccaaacactttggagggccctcagttttgcccacaaccacaacccttgcattttaag

SEQ ID NO: 98629 - DNA, 1008 bp, Glycine max
  Peptide Sequence Number=SeqID_215407
aaattcacgggttgtgcaacaatgctttcttttgacttccgacatgccacggaacttcacgaattgcccaacgatggtgccaagtacctcgaagtagtcaaacgagggtcgcatcccaacaatggatggtccccggacgaaattagggatagcccaaacgtaaagacaaatgcttttgccaatcatgggggatcgacgattaatgcagtggaggagtgtggacctcagaggccaaagcaaatgaaggatgtggtgacctctaggaggtttatattggaggcgctgcgcgaggcaagcatgatttcctttgactggtataggggagattcttgtttggtatactcgggggcaacgcatgacgtggaaacatgctcgacaacagaggagctgttacaaggaatgatggacaagggcatgggtgttgccatgcacaagccccgaggcttccagcctatcacggttaagaagcctactctttttccctataagagtgacaagatggtcccatggaagtacgcccctcgaaggcacgatggaaggaagaaagattctatcatagaggatctatctgtcaccaaggtcacaaacatctctggcacgagcggcgtaactcgtagcgggggaatctttgcggcacccgagctcccggtgcgagctatagacctaaaggggaaggcaaaggactttagcaaaaaaggaatatccgttgatgaagcaactgagttcctacgcatcatccagcagagtgagttcaaggtaattgaacaactcaataaaacccctgctaggatctccctgggaaagaatggtgttgcaagaggatttttggataagcttgtgatgctagaaggaggggaagaaatcaaggatgaggtggatagcacttttcttatcactccatttttggagctagagatcaaggaagcagtttggagttgtgatggtgataaaagtcttggccttgatgggtttgattttcaattctcaaggcgtgttgggaattcttaa

SEQ ID NO: 98630 - DNA, 468 bp, Glycine max
  Peptide Sequence Number=SeqID_215408
atggaaaaaatttctcacacttggggagtaaaaaatataatttaccgttcttcatcgttcttcgttcgttcttcgtcgttcttcagtcttcaactgttttttcgacgttttcctcaaataaacgttggtggcgactccgcgcatttttctttcatggaagacgcacctgtgagtctcgcatcaccctccctccgaagggtaggttgcgacaaaggtgtttgttgcagatcctccaacattgtgtatccacattcctcccatgggttgaaaatgaaatccacaactatgcaacttgtcgcaacctaccctttggcgggagggcgaggcgaaaagaaagggcgcgtcttccgaaaaggagaatgcgcgggagtcaccaccaacgtttatttgagaaaaatgttagaaaaaacaaaaagaaaaaggcctgtaaattttgaaaataagggttcaggagttgtttatgcgtag

SEQ ID NO: 98631 - DNA, 528 bp, Glycine max
  Peptide Sequence Number=SeqID_215409
atggcacacaatcaagggtgggagcaggagttaggtctttacaatcaatatgaagaagaaagaacttctaatcttgaaactaaatcaactcaacaagcactccaaagtgtagaaatccaggttggtgagctagcagatgtagtaactcaatttatgtccagacgagaaaaatcctttgtagaggctgaagctcaagagaaaagccctataaaagagcatgagtcaagagaaaaagatgaggagaaagatgaggaacaagcacaacaacaatgggataagtactcaatagtagaaaaccaacaagaaaatattctccccagcaataaccttcctcatcaactaattgacaagaaaggaagccaaggagagcatgaggaaaccttaagtgacattctttctttaataactaacacctttcttgaaatgatttggaatgtccttccaaattatatgaagttcatggaatttttagctaaaaggcgaaacttcaaggaagatgtgttctttgtgactttcatgccaccttga

SEQ ID NO: 98632 - DNA, 336 bp, Glycine max
  Peptide Sequence Number=SeqID_215410
atggacgaagatcagtggatgtatgaaggtataatgcctgaagaagtggatatggattatgaaaatgaagaagaatgtggtgtgaatgaaccacatgttgattgttcgaatccgttcaatacttctcaggaaactgaaattatctggatcgtaattgtaaggtctaacacaaacacaggtagtaaaggaagggcttcgtttgtgttaattggttgtgaaatgagtgacgagtataggtgtaggaagaaagaatttgttagaagagacactgggactaggaaatgtgagtgtcccttcaagcttcgtggcaagccagtggttggaagacaagactga

SEQ ID NO: 98633 - DNA, 324 bp, Glycine max
  Peptide Sequence Number=SeqID_215411
atgcccagggcacaaaattccacagacaccatagtgcctattttggggaaagagctctggaggcatcaagatgagcagcttttgcagagatacctaggttttattaatgccacttgtagaaggcgtaatcaagagagagttagaaaatttttgcaggatttagaagcaacagcaattccagaggaagaacctcaatcttttgaggcatcttctagttttcctattgtaggacattctcatttagatcatatcgaagaccacatcatggatgaagagccaagaagagtcaccctggaagattattcaagttctaatgtgccataa

SEQ ID NO: 98634 - DNA, 510 bp, Glycine max
  Peptide Sequence Number=SeqID_215412
atggaaaacaatgacgatgaagggtggtatcacgatccaagatctgtgaaggtggcattgcttcgagaatcccgtcaagttgctcttcattgccactttaggattccacttgcactacattctttcctccagcgtgtcaccctccacctagcattacaacctcttcctgatgagaatcccaaagctgcccaaatacagggacctacgaccagggtaaggaccaaacagtcagaggatatccttcaacaaatggtagcagccatacttgacaaggcccaagtagagaaggacgaaggcccagagcttctctctgagttcattgtcgaaccaattccaaacttatcaaggttgaacccttgcggcgtctaccttgacttatcttccatctctggaagtggcgtcaacagatttcgtgacctgtatcaagggtgcggcgacaagagtggagtagtgaaggatgtttcgttgctgaagggaaaaagagggagagggaaggctttttgggattag

SEQ ID NO: 98635 - DNA, 222 bp, Glycine max
  Peptide Sequence Number=SeqID_215413
atgaggcccagctcaacatgcgcgcttagcgcgcgtcacgcgctaagtgtgcaaggcaagacaggcgctaagcgaggcgttaagcatgaagatgtaggattcgttacgcgcgctaagcgcgagccacgcactaagcgcgcgatccaacagaaacacacgctaagcctgcagcaggcgctaagcgcacgatctgaatgcactaagcgcgcggtgtcgcgctaa

SEQ ID NO: 98636 - DNA, 118 bp, Glycine max
  Peptide Sequence Number=SeqID_215414
gggggaagagccttctagagccgctattgaggatcctacagttgatgaagatctcattgctaacttggctggagctgattggggcccatgggcagacttgggcggaggcagcacctga

SEQ ID NO: 98637 - DNA, 159 bp, Glycine max
  Peptide Sequence Number=SeqID_215415
atgagggccatcacctgctcaagagccatgcataaattgtctaaaggcaggcaacaaagcagtccatgttacctagaagataggacgtgcttctttgcctactttattcaatcagcaccaccaaacttatcaggcggccacatcaagaggaaaacttag

SEQ ID NO: 98638 - DNA, 1542 bp, Glycine max
  Peptide Sequence Number=SeqID_215416
atggaaagagagatactgacgaagacggtgagaaatagagatgcttctttctcatcctatctcagaccagataacaaggcaacaccaattactactgctgcacctattgaagatgccactactgagcttagcatattcgatgctcgcaaatacttcaatgatgatgacagcagcaacaacaacaacaacaatgctaacaatattcaaaaggttagcatcagcagagtctctcccatggagagaattccagagaggggtgatgccatcatcacagaagcaaccagatactcctctgcttcatcctctgtggacagctatgcccaaatcagaaactacagagcccaatcgttccacacggcaactccaacggcttcctcagaagccagctggaacagccagacagggttgctatctcaccctccaggggcaatccctgtctcaatgcaaaaccctcaaaaccctaaaaacctcccaaaccccaaattctccaaatcaatttggctcctaaggcggaaatgtccttgcacggggaaaaaatcagttcgagtcaaagaatcaacacaagaatccaaatctcagatatcgcaacaagaaagagattacgaacatcacaacaacaacaacgttcgtaatcacatcacaccgaataattggattctgaatcaaaccccagcaccaataccagcattagcaccagcaaccgcaacaattgtcgctgcaaaatcgcaacaatttaataattctaactctcacagagttgttagctctgtgagagtaccgttcactgatggattcactttccctgtgctacaccctaacaattcaatctcgaaactaaaactcgcgaacgttaacagcgtcgtcgaggaagatccgccgcgtgaatccctggaggttttccgtccgccggacgagccgtctccgaatccgtcgccgaagcagctcaacttcccgttcccggcgaaggcaaacgtcgtggaagacgacgccgcgagcgacgcgagctccgatctcttcgagatcgagagcttctccaccgcgacgcagtcgacctaccccgccgcgtaccgccgcaacagcagagactcgttcgacgaagcctccgccaccgcctccgcttccgcctcgacctccaccaccgccaccgccacctccaccgcgacaggattcttctacggcagaagaagcatggacgaaggttcaaccactccaacgataaccgaatgctacgagccgagcgaggcgagcatcgagtggagcgtgaccaccgcggagggacacgacgacgccgtttccaacggcgtcgtcgtcgaagaaaagtggaagcggaaaggtggaaacggtttgttggtgagctgtcggagccagaaggcggttagcgtggggccgcaaccggtgaaatgtggatcagagggacaaagaaatgccacgtcatcgttatcatcacatgtgaacgtgattgggagtgtaaataagccaccacttgctcatgctaggggtcaccgcaacgcacctcgcgtgtcgcttgctttcgcgacatag

SEQ ID NO: 98639 - DNA, 222 bp, Glycine max
  Peptide Sequence Number=SeqID_215417
atgaggtccaaaagaggtgtccattttcacgatgatccaacggttaacaagtccaggatcgtagttttactgggacaagattgggtgtatgcaagaaaagagaaaactcaatgcgagggaaatttcttccaccatatacattatctcgaaaatcccaaaggtttgagtgtatgtgggaaaaataatggattttggaaaatgaagaagggaaaacggatttga

SEQ ID NO: 98640 - DNA, 132 bp, Glycine max
  Peptide Sequence Number=SeqID_215418
atggcctcaaagatagaagttgctcttggtgccattccctttgatagtcccaccatatttgacaagatcatcaataaggaaattccttctattgtggtttatgaggatgataaggtgttgttaaatgcttga

SEQ ID NO: 98641 - DNA, 258 bp, Glycine max
  Peptide Sequence Number=SeqID_215419
atggctcgtaacgaggagaaggcgcagtcgatgctcaaccgcttcatcacgatgaaggcggaggagaagaagaagccgaaggagcgccgccccttccccacctcggagtgccgcgatctctcggaggcggacaaattttccaagacaaagttctctcagattggtccatcattcacctccatgactttatccggtaaaaactgtcacaaattgcaaacctcacacaccgccacacctctccctccttcgttcttgtga

SEQ ID NO: 98642 - DNA, 291 bp, Glycine max
  Peptide Sequence Number=SeqID_215420
atgtactttgcgtggtggcgcggtggtgggccgaggctgtgccgctgtggtttagtgctttctgtcgggggattcgtttccttcgtggtgacgggaagcattgcagcgctaaggtttgggatagtgttagttggtgtccatttggctctaagcgtttcaagcctcagggcaaacaaaaaaggacacacaaccttcttctttaatgctcaaaggccaaaccgcaatagcaactatattgtttttgccggagataaagattgctacctgcagaggttagatcattttatttaa

SEQ ID NO: 98643 - DNA, 948 bp, Glycine max
  Peptide Sequence Number=SeqID_215421
atgtccattttttgctccaacaaatctgattcttcttcttgttcttcttgtttagcaagaagcttcaaaaactctgcatggagcatgagttctctcgtgactgctctgcaagaatctccctccaccatttgcagccactcccattattcacaccatgccactgagttctccactccaagagaccagagttttggcatcgccacttccaaagttgacgactacaacaacaacaataacttgtcgacttgcctctcagatattgatgaatggttggaacatgccaataagttctgcaaatcctctatccatcttacagaatctgttcattcggggcaaaatggaagccaagaagaagaagactcgagactctcagcaatatgcaacacctaccttgcagctcaagaacatgaacttcacaacataacattaccctgtgttagagaagagagtccatttttccaaggccaaacccgccatgcctgcacatataaacccccaaaatgtgaaggctatgaacacacaaaaatgatggatgatatcgtaaggaggaaacaggaagaagatgaaagagatgcacgtaagaaggccaagcatgttgaacttatgctcaagttgagaaggaaggaaaacgctataaatgattgggaattgcagcaaacaagaaaagctatggacaagatggataaaattcaggcatttataataacctttgagaagataaaggaacaaactacaaagcacaagcaattcaagcataatgagcttgagagaaaacaatttagggcttcagccaggacccagaagaaaatatgcctagtgaggcaaaaggcagagaagcagaagctgaacttgaggcgatcaacaatgaaaagatttcaacagatgcaaacatctgagactcactccccttcacaaatttcttgggcttcacacctaccattatgttaa

SEQ ID NO: 98644 - DNA, 3273 bp, Glycine max
  Peptide Sequence Number=SeqID_215422
gctccggggtcagaggttcaggacaaaatattatttattattaataatgtttcggctgctaatgttgaagctaaagcaaaagagttcactgaaattttgaaagagcagtactatccttggtttgcacagtatatggttatgaaaagagcaagcattgagccaaatttccatgacttgtacttgaaattcctggataaagttaattcaaaggctttgaacaaagagattgtccaggcaacttatgaaaattgcaaggttctcttaggatcagagctcataaaatcaagttcagaggaacgctctttgcttaaaaatttggggagctggcttggaaagttaacaattggccggaatcaggttttgagggctcgtgaaatagacccaaagtctttgattatggaggcatatgagaaggggctaatgattgctgttattccatttacgtcaaaggtccttgaaccatgcctaaacagtcttgcatatcaacctcctaatccttggactatgggcattttgggattgcttgctgagatttattcaatgccaaacttgaaaatgaacctcaagtttgacatagaggttttattcaaaaatctgggtgttgatatgaaggatgtcacaccaacctctctcctgaaggatagaaaaagagaatttgaaggaaatcctgatttctctaataaagatgttgggggatctcaatcacaaatgattactgatataaaatctggcctcgtacctccagtaaatcaagtggaattaccacttgaagtcaccaatccatccaacacgggggctcatccacatatactctctcagtatgccgggcctcttcatatttcctcgggagcattgatggaagatgaaaaggttacacctctgggattgtctgattcacttccctctgctcaaggactgttacaagcaaatcctggcccagttcctttttctattagccagattccaacacagatacctaatattgggactcacgttattatcaatcaaaagctcagtggttttgggctgcaaatgcattttcagagagctgtaccaattgcaatggatagagctatcaaagagatagtgtctagtattgtgcagcgtagtgtttccatagcaacacaaacaaccaaggagcttgttttaaaggactatgccatggaatctgatgagacacgcatattaaatgcggcacacttgatggtcgctagtctggctggaagtttggctcatgttacgtgcaaagaaccattacgggcatcaatatctggccaactgaggacttcacttcagaacttaaatattgctaatgaaattttggagcaagctgtgcaacttgtcaccaatgataatcttgatctaggctgtgcagtcattgaacaggctgctaccgataaggcaataaacaccattgatacagagattggtcaacaactctctttgagaaggaagcatcgagaaggtatgggttctacattttttgatgcaaatttgtatcctcaaggttctatgggtggtgttccagagcctcttcgccccaagcctggtcagttgtccctctcacaacaacgtgtctatgaggactttgttcggcttccctggcaaagccagtctagcccgagctcacattctatgtcttctggtgttgctgttcaatctggcactggtcttactggcaccaatggttctgtatcagggcagagtaaccctggataccctgtcaccacaggttatgaaggagtatctcgaccattagatgatatgacagaatcaaatttggctccacattttagtgcttcctcaattaacattagagcagctgacagtgtttcccagcatagtttggagaaagactctgttgcctcatttccttcagctgcttccacccctgaattgcatgcagtagattcttctgaagtgaaagaatctggaacttcttcacagccactggttacatcaggtgctgtggagcgccttggaagtagttttttggagccttctctcacaacaagagatgccctagataaattccaaattgttgcacaaaagttggaagctatggtcagcaatgattccagggatggagaaatacagggtgtcatttctgaggttcctgagatcatacttagatgtgttagtcgagacgaggcagctttagctgtggctcaaaaggttttcaggggtttgtatgataatgcatcaaacaacattcatgtcactgctcatcttgctatcctaactgccattcgtgatgtttgcaagcttgctgtcaaggagcttactagttgggtaatttactcggaagaagaaaggaaatataacaaagaaattactgttggcctcatccgtagcgaattgctaaatcttactgagtacaatgttcatatggccaaacttattgatggaggaaggaacaaggctgcaatggaattttccatttcccttcttcaaactctggttgttgaggaacctaaagttatttcagaacttcacaatcttgttgatgctttggcaaagcttgctacaaagcctggatgccctgagtcattaccacagcttcttgaaatgatcaagaatcctggtgctatatcctctagtaatgctggaaaggaggataaggcaagacaatcaagagacattaaggtgcctggtctgttacctgcaaatagggaagagttcaacagcattgattctattgaaccagatcctgctgggttccgggagcaggtttccatgttgtttacagaatggtataggatatgtgaacttcctggtgccaatgatacagcttttgcccactttatcttacaattgcatcagaatggactacttaagggagatgatcttacggatcgctttttccgactattgacggaactagctgttgcacattgcttatccactgagatgattaattcagggtcactgcaatctcaaccgcagcagacaatgtcatttcttgcaattgatatttatgcaaagcttgtcttctcaatcttgaagggatcaaacaaactctttcttctttccaagattctggcagttactgtcagattcattataaaagatgcagaggagaagaaggcctcttttaatccaaggccacttttcagattattcatcaactggcttctggatcttggttcacttgagcctgttactgatggtgcaaaccttcagattttaactggttttgccaatgcatttcatgctttgcagcccctcaaagttcctgcattcaggttaggattttctacttgtgattcatag

SEQ ID NO: 98645 - DNA, 2413 bp, Glycine max
  Peptide Sequence Number=SeqID_215423
atggctcaaattgaggaattgtgtgccaaccccggttatctgagtttccatgagcaaattcacaatgttatcatgttcctaaagcagtctgagggtctttccaagcacgtggattcctttatgcagatattgtcacttgtgcagttcaaagacacaccaccttttgtcttgactccattgcttcctgatgagatgcatgaggctgattttttaaggtggaatatggagttgttccatgacagtggagaaaatgattttgatgctattttggctgacatacagaaggaaatgaacatgggtgatatcgtgaaggaactaggctatggatgcacggtggatgtctcacagtgcaaggaaatattttcactcttcttacctttaactgaaaatacactctctaaattgcttggtgctattgcttgtacccatattgggctggaggacaaccaaaacacatacttaacttttcgtgcagcccatggatacaatgtgcctgagttgccaccgctgaactcttggaatattgatgtcttgattgatacacttaagcatcttgcacctcatactaattgggtacgtgttattgaaaaccttgatcatgaagggttttttcttcctagtgaagaagcgttctcttttctcatgtctgtatataagcatgcctgtaaggaaccatttcctctccatgccatctgtgggccagtctggaagaatactgagggtcagctgtctttccttaaatatgctgtatcagcaccaccggaaatttttacctttgcacactcgggaaggcagctggcatatgttgatgcaattaatggccacaagcttcaaaatggacatgcaaatcatgcatggctgtgtcttgatcttttagatgtcctctgccagctagctgaaaagggtcatgccagtattgttcgatcaatctttgattatccccttaaacactgtcctgaagttttgcttcttgggctggcacatattaatactgcctacaacctcttgcagcaggaagtatctctgattgtttttctcatgattgtaaaaagtggtgtaggcagtgggatgattctacacctttggcatgttaatcccaatctggtattgagagggtttgttgattctcaaaacaatgatgcagacagcattgtaagaattgtggacatctgccaggagctaaagattctatcatctgtggtggaaatcatgccctcttattatagtataaggttagcagctgtagcatcaagaaaagaatttcttgaccttgagaagtggttgagtagcaacttaactacatacaaggaagccttttttgaggagtgcctcaagttcttaaaggattcccattttggtggatcacagaacctttctggcaaatcgtttcatcagtctggtgctattctgagtctatatgctgaggcagctgctaccatcttgaaggttcttaaatctcacaccgacttggttgcttctagacaactttctgaggagttggagagactgcacgtatctattatagatacgaatccaaggcttcaaaatggtgggacagctgattcatctacttctgatggatatgcggatgacattgaagctgaagcaaactcttacttccatcaaatgttttctgatcagttaaccattaatgcaatggtacagatgctcgctcgattcaaggaatcttcagtgaagagggagaaatcaatttttgaatgcatgattgcaaacttgtttgaggagtatagatttttcccaaagtatcctgaaaggcaactcaaaattgctgcagttctctttggttctgtgatcaagcatcagcttgtaactcatctatctttggggattgctcttcgttatgttcttgatgcattgcgcaagcctgcagattcgaaaatgtttttgtttggaagtctggcattggaacagtttgtggatcgtcttattgagtggcctcagtattgcaatcatattcttcaaatttctcatttgcgcagtacacattcagaaatagtttctttcattgagcaggctctcgccaggatttcctctggtcatttggatgttgatggggcgagtcatgcttctgttattagtaaccatcattctgcacaggctacaataggacatgtggagctcagtggctctagtgttatacaacctgggcagcaacatttgtcactgcagcttcaacagagacgtgaaaatcccttggatgatcgtcacaaagcttctgttggttcatctactgatgtaaagccattgttatcttctctagggaaatcttcagtactaacacctaccgatgcttctagtaccaataagttacatagcacagttagcacttcgtcaatgctatcttcatcttctcctggttttgttcgtccttcccgtggaactacttctgcca

SEQ ID NO: 98646 - DNA, 165 bp, Glycine max
  Peptide Sequence Number=SeqID_215424
atgttggattgtgttttaaatcacacacatgctttagccttagtaagagttgtggagatcgtggtggaaaatgccaccaagttcgtgaagggcaaaaatgggctcattgtgttggatgtgaggttgaatggaaccacttgtgttgaatgcttaggacatgcataa

SEQ ID NO: 98647 - DNA, 306 bp, Glycine max
  Peptide Sequence Number=SeqID_215425
atggaggttgatactgaccctttcattactcaggccaattacgttgaacttgtacatatccttatggttgatgttgttctagaggataattgtgttcaacctactccaatcttcgtggccaacgttgttccaaaggtaggtgataaaaaaaaatcttctcattctaaagaaaatcttgatagattgtcggaggaattagaaatggagaatactgaaatttattttgaggctagagatacattgactaagtttctgataggaaagaaagatgttgatcaaaaggtaccaggcatgccaatttgttga

SEQ ID NO: 98648 - DNA, 2328 bp, Glycine max
  Peptide Sequence Number=SeqID_215426
aactcaatgatagaagctgacagagaacaggaagtcattaaaactcaggatctgaaggagttgcttggggaattagagatggacgcaagcattgagccaaattttcatgacttgtacctgaaattcctggataaagttaattcaaaggctttgaacaaagagattatccaggcaacttatgaaaattgcaaggttcttttaggatcagagctcataaaatcaagttcagaggaacgctctttgcttaaaaatttgggcagctggcttggaaagttaacaattggccggaatcaggttttgaaggctcgtgaaatagacccaaaatctttgattatagaggcatatgagaaggggctaatgattgctgttattccatttatatcaaagatcctcaaatcatgccaaagcagtattgcatatgaaccttctaatccttggactaagggcattttgagattgcttgttgaaatttattcaatgccaaacctgaaaatgaacctcatgtttgacatagaggttttgttaaaacatcttggtgtagatatgatggatgtcacaccaacttccctcctgctgaaggatagaaaaagagaaatggaaggaaatcctgatttctctaataaagatgtcggggcatcatcaaaaatgattattgatctaaaatgtggccctgtacctccagtaaatgaagctgaattaccacttgtagtcaccaatccatccaatacgggggctcatccacatgtagtgtctcagtatgctggtcctcttcatatttcctcgggagcattgatggaagatgaaaagtttacacctctgggattgtctgatcaactttcctctgctcaagtactgttacaagcaactcctgcctcagctcctatttctattagccggcttccaatacagatacctgatattgggactcgtgctattatcaacgaaaaacttggtggttttgggttgcaaatgtattttaatagggcgagccctggtgcagcggtaaagttgtgccttggtgatttgttggtcatgggttcgaatccggaaacagcctctttgcatatgcaaggtcaactgaggaattcacttcaaaacttaaatattactaatgaaattttggaacaagctatgcaacttgtcaccaatgataatattgatctgggatttgcagtcattgaacaggttgctgctgataaggcaaaaaacaccattgatacagagattactcaacaactctttttgagaaggaagcatcgagaaggtttcagttctacatttttttatgcaaacaaggaagaattcaaaggggtagattctgttgaaccagatccttctgggttctgcaagcaggttgccgtgttgtttaaagaatggtacaggatatgtgaatttcctggtgccaatgatacagcttcagcccacttcatcttacaattgcatcagaatgggctgcttaaaggggatgatgttacagatcactttttccgacaattgatggaactagctattgcacattgcttatccactgaggtgattaatttggggtcactgcaatctcaaccaccgacaatgtcatttcttgcaattgatatttatgcaaagcttgtcttctcaatcttgaagggatcaaacgaacttgttcttctttccaagattatggcagttactgtccgattcattataaaagatgcagaggagaagaatgccttgtttaatccaaggccagttttcagattattcatcaactggcttctagatcttggtttgctagagcctgttactgatggtgcaaatctccagattttgactgtttttgccaatgcatttcatgctttacagccgcttaaagttcctgcattcaggagcttcatgccaaaaatgttgactggtaatggtcaaaaaggttggccttatatccaaaggttgcttgtagatctgttccaatttatggagccttttctgaggcatgctgaactaggagaaccggttcgtgtcctctataaaggcacacttagggtgctcttagtgctacttcatgacttcccggagtttctctgtgattatcactttaccttttgtgatgttattccttcaagttgcatacagatgaggaatatcattctaagtgcatgtccgcgtagtatgaggctgccagacccatctactcctaaattgaagattgatttgcttcaagaaataaaccaatcgccgagcattctgtcggaggttgatgcagcacttaaagcaaagcagataaagacccatgtagatgaataccttaaggcctgtccccatccctctttgaattggtttgttattaattga

SEQ ID NO: 98649 - DNA, 1617 bp, Glycine max
  Peptide Sequence Number=SeqID_215427
atggagttgttacatgacagtggagaaaatgattttgatgctattttagcagacatacagaaggaaattaacataggagatatcgtgaaggaactaggctatggttgcacggttgatgtctcagggtgcaaggagatactctcgctcttcttacctttaactgataatgcgctatctaaattgcttggcgctattgcttatagtaatactgggctggaggacaaccagaacacatacttaacatttcgtgcagcccatggatacaatgtgtctgagttgccgcttctgaactcttggaatattgatgtcttgatagatacagtgaagcaactagcaccacaaaccaattggatacgcgttatagaaaatcttgaccatgaagggtttttccttccttgtgaagaagcattcttttttctcatgtcagtatacaaacatgcctgtaaggaaccttttcctctccatgccatatgtggatctgtttggaagaacactgagggtcaactgtctttccttaaatatgctgtatcagcactaccagaaatgtttacctttgcacgctcaggaagacagctggcatatgttgatgcagttaattaccacaagcatcaaaatgaacatgcaaataatgcatggctgtgtcttgaccttttagatgtcctctgcctgctagctgagaagggtcacaccagcattgttcgatccatccttgattatccccttaaacactgtcctgaagtcttgcttcttgggatggcacatataaatactgcctacaacctcttgcaacgggaagtatctctgattgtgtttcccatgatagtaaaaagtcctgcaggcagtgggatcattctgcagctttggcatgttaaccccaatctggtcttgagagggcttatggattctcaaaacaatgatgcagacagcattataagaattgtggacatctgccaggagctaaagattctatcatccgtggtggaaattattccctcttattatagtataaggttagcagcttttgcatcaagaaaagaattccttgaccttgagaaatggttgagtagaaacttaaccacatacaaggatgtcttttttgaggagtgcctcgggttcttaaaggatgcccattttggtggatcacagaacctttctggaaaatcttttcatcagtctggtgctgttctgagtctctgtgttgagacaactgctacctttttgaaggttcttaaatctcatactgacttagttacctctagacaacattctgaggagttggagaggctgcatatatctataatagattgttctcagttacatagcgcagtcagcacctcctcaatgccttcgtctcgtggatttgtttgtccttcccgtggagctacttcaatcaggtttggatctgccttgaacattgaaacgttggctgctgctgctgagaaaagagaaactcctattgaggctccagggtcagaggttcaggacaagatatcacttatgattaataatacttttgcggctaacattgattctaaagcaaaagagttcactgaaattttgaaagagcagtattatccttggtttgcacaatatatggttatgaaaaggttagcatga

SEQ ID NO: 98650 - DNA, 453 bp, Glycine max
  Peptide Sequence Number=SeqID_215428
atgcatccagcggttccaaattctgtgaactgtcagcagaagaaagaacacatcaataaccaatccaatcagagtgacaatacaaagaagattccaaatatgaatcaattaaaaaataaagagcaacccgaagcaaatctaataaggtctctggcgaaaccaataatttgcctggtattagaaattagggtaattcaaagggtagcaaaacacaaaaacagagcactgaacaagacaggatatgaacaaagatgcaagtccataaagcatggagaaaaagagttggcggaaaacggagtcaaagttgacttcgttcaaagaactgaggagaaagcgaatctggttggaggagaagttggccatggtggtgggcgaggaattacgaagaacaagagtcatcacagggaaagaaagctgaaattggtagagaagaagaacaagaaaaaagaatga

SEQ ID NO: 98651 - DNA, 141 bp, Glycine max
  Peptide Sequence Number=SeqID_215429
atggacactcatctccgtgtgattggtgatcccatgaatgaagttcaacggggaaaaggtcacaaaccactatttaaggatttacctagtgagtgtggtggtgaagccgccactgtgagatatgggctaatctctaagtga

SEQ ID NO: 98652 - DNA, 210 bp, Glycine max
  Peptide Sequence Number=SeqID_215430
atgtcacgtgcaagtcccacgctctcattggctctttgtatggtgttgtcatcaccaatgacgtgtctcgcccatggaaggagcggtgaggtggaggcagtctcgctaatgggaggggtgaggcaggctgatgtgatggtgtcgtcagtgcttgtgacaatacatgaagaaggaaactggcttagttttgcattttttttatttttttaa

SEQ ID NO: 98653 - DNA, 2688 bp, Glycine max
  Peptide Sequence Number=SeqID_215431
atggtgggtaatgaccaatatcttgaatgccaatccatatgtgacgccattttcatcaatatccagaaccatagcttcctcgtcgacctccacgtgcttcctatttccggcgccaatgttgtcttgggagtccagtggctcaagtctctcgggcccgtgttaacagactacactaccttgagcatgcaattcatctatcagggtcaattaatcaagttgcagggtgatcctgaggccaatctgagttccatttcctcttcccaatttcgccgtttatgtcaaacccaacaccaggggctctatttccacattactgttcttgctgacaccccttcttcttccatggaagacttaccccccccccagctccaagttctacttgaccaatacgctatattgttccaacctccccagaccttaccaccaccgagaaccaccgaccaccatatccacatcttaccacaatcaaccccggtgaatgtccaaccctatcggtatcctcattttcagaagcgtgagatcgaattacaagttgaatctatgcttcaaaagggcttaattcgaccaagtaatagtcccttctcttccccggtattattggtcaagaagtacgatggaacctggcgcttctgcgtagactaccgcgccttgaactcacttaccattaaagatagattccctattcccaccatagatgaactgcttgatgaactcggaggtgcccaatgtttttcgaagcttgaccttcttcaaggttatcaccagattcgcatgaactcagcagacattcccaagacggctttcagaactcatcatggccattatgagttccgagtcatgccgttcggactctgcaatgctccatcatcgtttcaggctaccatgaacttcatcttcaggccctttctttgccgttttgtcatcgtcttcttcgatgacattctcatttatagcagtgttgagcccatgcctgacaagatagctgccattattaactggcctcaacctcattctgcgaaggctgttcgcagctttttgggccttgccagtttttaccgcaaatttattcacggttatgctatgatcgttgatcctttggtcaaagccacgatcaccgagccactgcagtggacccctcagactgagcacgcatttcagactcttaaagttgccttatctacggcccctgttcttgccctgccaaattttcaggaaccctttacggtggagaccgacgcttccagcaatggcatgggtgtcgtcttgtctcagcgtgaccatcccattgcctatttcagcaaaccattcaccaagaagctactcacagcatctacttacgaattacatcaacaggtggccaacgatcctcagtattgtcagcaccgacaagatatcattaactcccctgccacgtatccagacttcacgattcgtcagaacctcattcttcagaaaggcagaatttggttaccccgtaaccttcctctcattcgcaccctcttgcttgagtatcattccacgccgattgggggtcacatgggtgtcgcgaagacgattgctaggttatcggaaaacttcatctggtcagggcttcgttctgacgtcacaacctttgtagccaattgcgctaaatgtcaattcactaagtatgaaaccaaacgcaccgccggattactttgtccacttccagttcctttccagccatgggaggatctctcccttgattttatcaccggccttccaccatttcagggcaaaagcgtgcttctcgttgttgtggatcgtttttctaaaggcattcatctgggcattctacccccttcacatacggcacacatggtagcttccttattcatcgacattgttgttaagcatcatggcattccacggagcttagtttctgaccgcgaccctatgttcatcagcggtttctggcaggagctttttaagctcagtggtactcaccttcgcatgagctcagcctaccacccacagagcgatggtcaaactgaggtcatgaataggattacctttggacacaagcctttttcatttccagaatacatcatgggaacttcgaaacttgatgctgtggacgattttttgaaacaccgtgaagaagtgtttaactgcattcgtcagaagttactaaaggctcagtcaaacatgaagagtactgctgatgccaaaagacgtgacgtcaattatgaagtcggcaattgggtacttttaaaattgcgtccctatcggcagcaatccgctaaggcgactccgatcagctccggcaagcttgcgaaacgtctctatgggccctttcgaatcctggaacgagttggcaaggttgcctaccacttgcaattacctgaaggcgcccgcatccatcccgtatttcattgtagcctcctcaagccctttcatggcgatcccaatgcagatattactcctcccctccctgagcacttccttaatgatcagccaatcatctctcccttagctattctcgattgtcgtcgttcttcctcggaagctgacgcaccatgggaggttttggtccaatggagaggattatctccggatgaaacttcgtgggaggattgggagcagctgaagcaggatcatcaccttgaggacaaggtgattctccaagggccgagggaaattgatagcagcagagaaacactcacatga

SEQ ID NO: 98654 - DNA, 423 bp, Glycine max
  Peptide Sequence Number=SeqID_215432
atgtctaagtttgatcccgagatagtcatggagttttatgctaatgcctggcctacagaagaaggagtcagggatatgcgctcttgggttaggggtcagtggataccttttgatggggacgccatcaaccagttcctagggcatccactagttttggaggaagaccagcagtgtgagtatagccaaaggaggagccaggcctcgggcttcgatgaggaggctattgggattgcacctacgagacacctagtggacccgaagaaatccaacagggcactgggatttcctgctctgattacaggcctctgtcaattctatggagtgctggtcgcccccagcaagctcatccggcctcctattaatagggctttcatcgagaagtactgcatgcctaggaagacacagggccaggtgccacagtag

SEQ ID NO: 98655 - DNA, 201 bp, Glycine max
  Peptide Sequence Number=SeqID_215433
atgagtggtgaaagaatatcctctctccaatggttatcactggtgacaaaaaccattggccgttgttggaattatcgacaactgaacaaccatgccactgctttcttacttaagatgtatgctgcggattgctgtacctgcaatgatgtttctgctgaagcacgagtggtggcattctctgctaggagtataggagattaa

SEQ ID NO: 98656 - DNA, 728 bp, Glycine max
  Peptide Sequence Number=SeqID_215434
ggccgggtcatccttatcagaaatgaggagaaaaaacctcgaggcgcaacgatgccctcgatggaatttctcctcacagttgaagcaaagtcccctctctctgcgggaggcaatctcctccggggacaagcgcttccaagtgtgcgatggtgggcgattaggtggtggaaggaggggggtaaggttggtgagggtggaggattagggtttttgaaagggggtgaaaggggtggggttgataatggtggtagcagagtggggggaagggcgaggccgagaaggttggcacatgtcggagaacttctcctcctggagacgtgcgaggcccgcggcctagaccagagtggctggttgatgggcctggacctcccttcgaatcttcggtatcaaaccggagatgaagcaactaaggagaaaggtagagggcaagccagcagtgcggttggcgagatcctcgaagtccgaaagatactgggccacggtgcccgtctgggaacaggttgtggaggtggtagaggtggcggggttggtggtgtcgaggagaaagcgggggagacgcgttggaggagctcatcgattttcatggcgactgagggcatcctcaagcttgtcgggggagaaggaggctcgatcggaatccgccatggaaaggagcaacgagagcaccaaattgataggagtgctcgtgctctgcaactggcttcgagggccaggacctctgagaaagg

SEQ ID NO: 98657 - DNA, 549 bp, Glycine max
  Peptide Sequence Number=SeqID_215435
atgaatacagaggtacacatagcaacatcaaaagaagaagacacaacaaacacaaatgcagaggtacaaatagtgaaagccaaaagaagaaccattagacccacaggtcctggccctcgaagccagttgcagagcacgagcactcctatcaatttggtgctctcgttgctcctttccatggcggattccgatcgagcctccttctcccccgacaagcttgaggatgccctcagtcgccttgccaagcagcaactctaccttggcgagtcagtcaatgctatgaccatgaaaatcgatgagctcctccaacgcgtctcccccgctttctcctcgacaccaccaaccccgccacctctaccacctccacaacctgttcctacaccaatacacaaattaaagttagacgtgccaaggttcgatggatccgatcctctcggctggatttacaaaataaatcaatttttcgagtaccatcgtactccagattcagacaaaattaccattgcttcttttcatatggagggccgtgctcttgcgtggtttcaatga

SEQ ID NO: 98658 - DNA, 888 bp, Glycine max
  Peptide Sequence Number=SeqID_215436
ggtcgagaaaatgttgcggcagatgctttatctagacttgattcccctgagatcatggcattacaggttcatcagcccgattctagcatgctatctaggatccaacagtcctggcagacatatcctagcttacatcagcttccccaattgagacaggacattctctcttggattcatgcttcaggttgtagtttccatttaggtagagatgctaccttgcaaaagatgaaaaatatggactgctttaacccttacctattcctgagcatgtatggcagcacatcaccatggacttcattgaaggtcttcctctttcttttggtaaacagtgactctccagcacagtggtccaagtggttgcctcttgctgaaaggtggtacaattccacttaccacagtactattaaagcaagtccctatgagatagtgtatggccaagctcctcctaaacgtgaggaaatgttaaagttactcaaatttcacatgaagagggcccatgacagaatgaaacaacttgcagataaagtgcaggacagatccaatgcaaagttggcccctaagtactatggtccatttctagtagaaggcaagattggtgttgttgcatataagcttaaatcgcctcttggatctatggtctataatgtcttccatgtttctcagttgaagaagtttactggtactgccacttctgggaactttagtccttcacctttattggatacttctcagaaggaacctgcagctatcattgacagaatgatagtcaagaggggaaatcgtgctgtaaccaaagttttggttcaatggaaacatcaattacctgaagatgtaacttgggaattcttctatgacttgaagcagaagtttcctcactttaatccttga

SEQ ID NO: 98659 - DNA, 645 bp, Glycine max
  Peptide Sequence Number=SeqID_215437
atgaggctggtgagtgtgcttcatgaggaagggtttaagcctgattgctttgtttacaacaccattatgaaagggtattgtctgttgagtagagggagtgaggtgatcgaggtttataataagatgaaggaggaaggtgtggagcctgatcttgttacttataacactttgattttcgggctttcgaagtcggggagggtgaccgaggcgaagaagctgcttcgtgtgatggcggagaaaggctattttcccgatgaggtcacttatacttcgctgatgaatgggttgtgcaggaagggggatgcgctcggggcactggcgttgttgggggagatggaggccaaagggtgtagtcctaatgagtgcacgtataacacgctgctgcacggcttgtgtaaggcgaggttggtggagaaggcagtggagttctacggggtgatcagggcgggtggtctgaagcttgatacggcctcttatgggacgtttgtcagggctctgtgtagggaagggagaattgccgagaagtatgaggtgtttgattatgcagtcgagagcgagagcttgacggacgctgctgcttactctacattggagagcactcttaagtggctcaggaaggcgaaagaacaagggctcactgtttaa

SEQ ID NO: 98660 - DNA, 852 bp, Glycine max
  Peptide Sequence Number=SeqID_215438
atggcagagaacacacgcagtcaagcttcccttcgtgaaatggaagaacgtctcagcagcaaaatggaatcaagatttgttgagctcgctgcttccatgcaacaagcaatccacctagaggtgagagatctagcccctattcctgtggcactcgattggctagggaaagcacttcagtggcatagtgcttacataaaatctataggattggagaatttaccctcttggaatgaatatcggatcttgttacttgatcgttttggagatgtttgtgaagatcctatggcgaatttaatgaaacttaggcagataggatccatcatagagtatcatgaggagtttgactcaattgtatcaagagtagatctttctgaggaacatcaacttcactgctttttaggaggattaaaacaagaggttcagatgattgttcgaatgtttcagccaaattctgttcgaaaggcttattcccttgcaaaaatgtatgcatcttccttctccaatacacaagccaaactatttgtcaagaaccagaaatcttcctttgttcctaaaccaccccttcttccaaacccttctagatcaaccaatcccttaaccatcaattcctctactaaaccacaaacacctaagcacctaactcctgcctacatggctgaaagaagatcaaatggcctatgctacttttatgaagaggaaggctctggacctcaagaaattgatgctaatgtggactatttgaagtcaggaattatacagaatagcgatagtccttatccaagtccagtagtgttggtgggaaagaaagatggggcctggagactttgtgttgattatagggatcttaataag

SEQ ID NO: 98661 - DNA, 645 bp, Glycine max
  Peptide Sequence Number=SeqID_215439
atgggcaaaatccctccttcattccgctccgctatagcaaaccccaactcttcactcttccgtccccaaccccctcacttcccaaacaaacaacaacaacctcgaaaaccaaaaccctctaaacaacaacaaaacccttcttcttcatctcttcctctcttcaaatccccaaacctccaagacgccaaaaaactcttcaactccgacccccgcttccccaactccctcctccactcctacgctaaactcgcccaaactccttccgactccgtcaatttcttcaaccacatcaccaaaaccctatcttctttctcccccgatcgctccactttccacatcctcctctcccattcctccaattccctctccccaatccaccaaaccctaaatttaatgctcgccgccgggatcacccccgacaccaccaccgcggacgtcgcggtccgctccctctgctcggccgcccgccttgacctcgccgttgaactgatcaaagaattcgcctccaaacactgcccacctgacacctacaccttcaacttcctcgtcaagcacctctgtaagtcccgcaccgtagccactgtctatgatttcatcgacgaaatgcgcgaaaaattcgacataaaacccgatctattcacttag

SEQ ID NO: 98662 - DNA, 123 bp, Glycine max
  Peptide Sequence Number=SeqID_215440
atgcgagataatgatgactttgacatcgatagtgatgacgataatgagaatgtgtggtggaattatggtgttggtggtggtatgatgataatgggccttagcttaattgaaggggcggagtga

SEQ ID NO: 98663 - DNA, 186 bp, Glycine max
  Peptide Sequence Number=SeqID_215441
atggcctcagtgcataccgtcattcctcctggcgggacatgcctacgtgggcagtcccgccattggagctggcgggataggcttcactattttttgatgcaacctgatgggactgaagcatgggctagagttctacttcacatgcacccagttgttgctttagaggatacaagggcactgtattag

SEQ ID NO: 98664 - DNA, 1518 bp, Glycine max
  Peptide Sequence Number=SeqID_215442
atgtctccacaaagtgtagctcttccatttttcatcaccatgtttgtctcatttggggtttgttttggctctttcctagaggacacatatcatcttactaattatcaacgttactccatgaagccaaataatgaacattttggtatcatgacaagggcttatggatctaccccatctacaaggtctcaaagaaggattaatattgatgactatggagccaaagctagtgatggaagagatgacactgaggcatttgagaaggcatgggatgaggcatgttctacagggggaattcttgtagttcctgaagaaaagatatatcacttaaagccaataactttttcaggaccttgcctaaccaatactgccttcagggtctatggaacaatcaaagcatggcctaaaatgtcaacataccaaaatgatagactacactggattaagtttgaaaatgtcacaaatctcagagttgatgggggtggcactatcaatggcaatgggagaaaatggtgggaaaactcttgcaaaaggaatgaaaaccttccatgcaaacctgcgccaacttgctctatttttatttatgaagcaccgacactgacacggacaccggacacgacacgaacacagacactgacacagacacgtgaacacctgtcaaatacatcaaattcaacccggacacgggtgtcggtatcgtgtcggtgtcggtgtcagtgtcgtgtcgaacaccggacacgacaagagactgaggctgtgactttctatcaatgcaacaacttgagagtgacaaacctgaggttcaaaaatgcacagcaaatgcatataaggtttcaaaaatgcaacaatgttacagcttcgaatttgatcgtgagagcaccggggaacagccccaacactgatggaattcacgtcacagagacacgaaatattctcataagcaatagtatcattgggacaggtgatgactgtatttccatagtaagtgggtcccaaaatgtacgagccatagatgtcaagtgtggaccagggcatggaatcagcattggaagtttaggagctggtgactctaaagctcaagtgtccaacgtgttagtgaacagagccacctttacaggaacgactaatggagttagaataaagacttggcagggaggttctggctatgcgaaaaatgtaaaatttgtgaatataacaatgcgaaatgtgacgaatcccataattgttgatcaaaactactgtgaccaggacaagccatgccatgagaaggactcagcagtgaaattgagcaacattgtataccaaaacatcagaggaacaagtgcttcagaagtggcaatcaagtttgactgcagcaaaactgttccatgcaaaggaatatacttgcaagatgtgattttaacaccagaagaccatggtggtggtggtagtagcaccattgctacatgtgaaaatttaatggagggcccgagggggaaagaagtaaaatgctgtggaaaagtaggcataaaacagagatga

SEQ ID NO: 98665 - DNA, 234 bp, Glycine max
  Peptide Sequence Number=SeqID_215443
atgacattgcttgtgcgaaacgttgattctctagtagtacaagatgaaggaaactcgttggtgaagataaaacatacaaaaaacgagttgagcatatcaaaatcacaaattccatcgaagtctagaaagagagaatctccgatcactatcgccacaaatgtggaggaagaggtggattatgttgaagttatccctttcaacataccgttttcaaaacacttagtggagctctag

SEQ ID NO: 98666 - DNA, 288 bp, Glycine max
  Peptide Sequence Number=SeqID_215444
atggctcacttgttggaggaattcagggtccatttccaccatcctgctactttgtattgtgataataagtctgctctccacattgctgtcaatcctgtcttccatgagagaaccaaacacattgaaattgattgtcatatagttcgagagaaggtgatgattgggcttgtgaaactgcttcatgtctcctctgcaaatcagcttgcagatatctacaccaaagctctcatgcctggtgcttttcagtttttgtattccaagctaggaatgtctgacatccattcctag

SEQ ID NO: 98667 - DNA, 402 bp, Glycine max
  Peptide Sequence Number=SeqID_215445
atggattcactcaaaccaacttgtgatcctgttccattgctatgtgcaaccattcagaatcatcctcagttgttcaaacttccagctgcaactgtagcagtttcttcagaaacttgtagcctggcccatcatagggtgaaagcccttgaagataaaaacttagctgggagagaaaaggctttgagaaggccattcgacaagttacatacattttttggcttttctaagacttttcagcttgatattgataaagatgtttataatggggaacttaagccctttgctgagattaagggctatgatacccttgttgctgctaccatcctcgttcaggtcgtaggagctgaagtcgaacgatcccaagtgccttctactccaactatgaccggtgcggtggtgtga

SEQ ID NO: 98668 - DNA, 1668 bp, Glycine max
  Peptide Sequence Number=SeqID_215446
atggttttactccaaattatgtttccaaaggaggaagaaataatcaaaagtggctcaggcagagggagttctagtggaagaggaagcaagatatgcacacattgtggtttcaccaaccacactgttgatgagtgttacgaaaagcatggatatcctcctggacacaagctctataagcctcaaggctcaaacatcaacaatatcaatgctgtgaaagaagagagtgatggtattgtcctagaaaggaatcaagaggcacaaagtgatgaagtagagttgacctctcaacagtataaggctttgatgatagtgctacaacaacaaaattcaattcacaacaattcacatgtgaatcaaattagtggttccaatggttctagcaacatacacaaaggatatgcagaacctgcagaggattggactggtacagttggtatggtgggaggtctttataggcttaagatgcttcctcttggtgattgcaaagagcataaatccagtttcacaacagattttatcccccccaatgtatcagctttctcatgtaatagaatgtccatagatttgtggcattttagacttggccacccatcatttgaaagcaccctaactggaaatggaaagaagcttgatccaagagctgcaacttctgtttttctaggatttaaacctaatacaaagggttacatcactttagatctcaaaaccagagctgtttctgtttctaggaatatgaatccaataagtatcactaattctactccttctacctcacagcaaatcactcaaactcctagaagatctttgagacagtcatatggtcaagcctgtaaagatcctcactgggttgaagccatgaatgcaaagattaaagcattagagctcaatgatacttgggctgccatcaatcactggcaccttaaacaactggatgtgaataatgctttcttacatggtgatttgaatgaagaagtgtacataatccttcctgaaggaatgcaagcagataaaccaggagaggcttgtgaacttcagaggtccttatatggcctgaaacaagcaagcagacagtggtatgctagactatcttcctttctgatttcacatggatataagcaatgtgcctctgattattttttgtttctcaagcatggatccaagacaattactgttttactagtttatgtagatgacattgtattgtccggtaatgacttggctgagattcagcatattacacatctgttagataatgccttcaaaataaaagatttaagtgatttgaggttttttctgggctttgtggtagccaggacaccctctggtattaatctttctcgaagaaagtatgctttggatattcttactaacagtgggatgcttggttccaaaccactgactactccttttgattacaccaccagattacacaaacattcaggatctcctctttccactaaggatgcatcctcctacagaaggttaattggaagattgatctatttgactgatacaaggcctgatattacttttgttgtacagcatttgagtccatttgttgctgaacccactacagctcatcaacaggcagcatccagaattcttagatacatcaaaggatcaccaagtgcagggattcttttatctgctaacagtgaagttcattga

SEQ ID NO: 98669 - DNA, 240 bp, Glycine max
  Peptide Sequence Number=SeqID_215447
atgttggttcttacttcaggttttgaagagagatttcagaaggaatctagccaaagttcatctgctattcgacctaccctagtaaagcctccagaatacatgccagaaaatttaaccatgaattctgcatgggtgggaggtgccatacttgccaaagtagtatttcctcaaaatcagcatgtaaccaaggcagattatgatgaaactgggccttccattgtgcaccggaaatgcttttga

SEQ ID NO: 98670 - DNA, 279 bp, Glycine max
  Peptide Sequence Number=SeqID_215448
atgggaatggctgggagcacttctagaaaacagtatcaccgattgggtccaatgttccaactccttccttcgaagattcaggcattgataaagcatattgagaaaaatattccccaaaagatgaaagacccagggagttttacactcccttgcaagataagagagtcttattttgagggattcttgtgtgatttgggggcaagcattaacttgaagccttactctatctttaagaagataggcataagaaatgcagaacccaccaacataaccctttag

SEQ ID NO: 98671 - DNA, 1911 bp, Glycine max
  Peptide Sequence Number=SeqID_215449
atggggaagataagaacatacaaggtcacagctctgagagcagcaaaaaatcttgattcaatgtccatagaagaattggttggaacattgaaagtttatgaacaacaactacaacaagatgagagaatcaaaaaggggaaatctctggccctaagtgcacaaaagaccaaaaagtcatcaacatccaaggatttctcttctaggtcaatgtccaagaaagccttcaatgcatatacatcctttgacaatgcatctaataaacaagaattaaatgaagatgatcaactagccttcatatccaaaatgataaggaagatgtggagaaaaagggcgaatccaactggaagggcccatccaagaaaactaggacatttcaagtttgaatgtccagacctagataagacaaatgacaacaagaactacttcaagacgaaagacaagaaggtgcttataagcacatgggaaaacctagacaacacattgtatgatgaagaaattgaagaagaagaaaacttctgcctgatgcttgggaagaatgatggtctcaaggaacaatctcaagatgtagcaacacttcatcaagagattgaatccttaagagagttcttttccaaatttgttggaagcactaaaaatcttgacaaactattaagatacagtagatgcccttctgatagatctggacatggatatgagggaaatggtgatggccctaacaagttcgagggtagcaagtttgtcaagccccccagcctagacaagtgttgtccaggttgctttgtttggggtgctcatgcttgttgttctgtagttattccaatcggcgacttctgttcgaaggagatacactatgaaacttttgacgacgagtcctcttcctccgagaggttggtggacccacgtcatgtcggttggggtacctctcatcctcgtatgagggtaaaaccttatggtgctcctttagacaaagagcatgtccttgttaccacgatccttccttgttaccaaggacgagagaaggaagagcttgttgcgatggtggctgagtctgctaaggtgattgctgacctccaggcccagttgaaggagtcaaagtccaagctggagaagtctgagctcaaggcattgaaagaaagagagaccagtaaagagcttgaagaagagttgctggcgttcaagaaggaagcaatggagcaacatgagaagggattttataaggccatcattctttttgatccatttaaggacgtgaaagaccatgaactgcttgatgaggaagaaatagctaccaccgaggaaggcgttggcgaggagcaagatgttggggccaacgttcccatgaagatgaaacttgacaacaaagagactcaccaagggcaagaccttgggtttgacaaacctttggagattcgtcgaggcccaccaagggtagaccttgggtttcacaagtctttggaaattcatcgaggctcaccaaggacggaccttgggtttgaaaagcctttggagattcgtcgaggcttaccaagggtggaccttgggtttgacaagcctttggagattcgtcgaggctcatcaaggggaaaaccttgggttttacaagcctttggagattcgtctagggacgtgccgtcattggtgcaactcgacctccatgatacggttgacaaaagggtgttgacgagttattcgcccttcatggtggtgtatgtgcgagaggttgggattgtcttgggtgtttatggtttatcggggagtgttcatcgccctggaggtgtctcacacgagcctctaattggtcatgtgtcgttgtttgtcatggttgttgggagagggttggagcttcctaggggtggctcatgtatgaggttagactatgtgctaaccattagtgaaaagaggccacagtga

SEQ ID NO: 98672 - DNA, 825 bp, Glycine max
  Peptide Sequence Number=SeqID_215450
gctaacaaggaacagttagtgcaactaatgtttgaaacattcaacatatcagggttttatgcctccgaacaagcagtgttgtcactatatgctgtaggacgtatctctggatgcacagttgacattggtcatggaaaaatagttaatttgattattcctcctcgttatctcacagaggatgatcgtgttgctggtcgtatcaaccctgattatgaagcatgggaggttcaagatcaaacgctcctgacttggtggatatccttgacatggtgtatttggcaccatagaaacagaatcattttctcaaatgacagctttaatgcctacaaattgatggaggacgctgtattcctatgttggacatggtttaagaatttggaaaaaggatttcatactccattccacttctggtccagcaatattagggaagatattgcaccagtgattgagggtgctgttaaccacattgcctcaagaagatttgagtttggaggtgttgatctaactaatttcctggctcaagaacttggcaaatccaatccgctagtgaatatcagcatctctgatgttgagaaaataaaacagcaatactcttgctgtgctgaagatgaattagcttatcagaagaccaaaggttcctgccctgtggagacacatacccttcctgatggacagggttctgagagatttgttgtcaccatacctgttttccgaaggaatgatgtggtgaatgagatgggaaacatagaggtggtgtacgaagttattggtttcctacttgttgaatgttatcatagaggtggtggaaaggccatgaacctttga

SEQ ID NO: 98673 - DNA, 207 bp, Glycine max
  Peptide Sequence Number=SeqID_215451
atgttcaaatgcaagctaagcattcgagccccacgtaaaactatccttgcagagaaaggtggtcctctagtactatttgaaaatgaggatatcatcgaaaaatacggggatgaattgacaaaggggcattgcataggccaaacgacatcattggctaggtcgttagttaaaggatgggttgggaaagtagaggcaacttggaggtga

SEQ ID NO: 98674 - DNA, 561 bp, Glycine max
  Peptide Sequence Number=SeqID_215452
atgaaactcatttacctaagcttgatgagtcaaagactcaaggacagtaggaacaagcttggaagaagaagaagcaaagcagaactctcctccctcaaggtagaactcgtgcaaaaatgttggtttataattagcaatgtcactttttgggtaggctgcagcttctcgcttctcagttcagtgcccagagtagaggctagagctcccctcagaaaatcgaacacctcggtagggttagggttttcgttttggtgcagagccatggaagccgcagtggtcgacccgggttccagcctcctcaaagccggttttgcgattcccgatcaagctcccgccatgataattcccacccagatgaaacgaatgctcgatgatgggtcaatgaccgataacttgacattcgatgacattgctgtcgatccggtgtgccgaggttatgtcagagattgggatgccttggaggatttgctgcattatgtattgtatactggccttggatgggaaatgggcaatgaaggacagatactgttcacggatcctctttgtactccaaaggtttga

SEQ ID NO: 98675 - DNA, 440 bp, Glycine max
  Peptide Sequence Number=SeqID_215453
ggcaacctggcccaacccttgattatccaacaaggttggaaaaccctagttgcctcacccaaaaatggcacgaccaaagggaaccaccaccacaaagggtggcgcacctccctagcgccactggtgatgcaatcctacccccaaagatattggacagaagactccaagaagattgggctagagctgctaaagaaggtcctagggttctcacgaaccttagggagatgagcttagctattaaaggggacctcattgaagctcaaagatctagcctccatagaagcctcacaagtaagcttccatcaactggtgcaggcggtgtgacgcaaggccgccaggaggagaacgatggagaagaagaagaagaagagaacacgggagaggaagaagaagagaggaagggggagaagagggaagaacgtgagagagtgagggaatga

SEQ ID NO: 98676 - DNA, 531 bp, Glycine max
  Peptide Sequence Number=SeqID_215454
atggatcatttccatccaattgcaatattgctgaaaatccatttaaccaatctaagaataacaaatcaatctaagatcactgacctgattccaagagctgaaaaaggctgggcatcactctcttgtgcaggcagcaaaaagacagagaacaacaaaacaagcagtgataatacaaggttctggaaacatgaatgggacaaacatggcacttgctctgacttaatccttgatcaacatgcatattttgaagctactttgaacctcaaggaccgtgtagacctccttcaaatccttcaatataatggaatcaaaccagatggaaacctttacagcattgtcaacataacaaaagcaataacacaagcaattgggttagaacctggcataacatgcaacactgatccatctggtaatcgccagcttaatgagatatatctttgtgccgataaatatgcctccagcttcattgaatgtccaatactaccaagtagaaaaagttgtacagacatggtggagtttcccatcttctag

SEQ ID NO: 98677 - DNA, 982 bp, Glycine max
  Peptide Sequence Number=SeqID_215455
atgatgttttggtacacggggttacttctacagaggtgtatgaacaagcatccactaatcaaatcttaccctgacataggtgaggttgcatttgggctaagaggaagagctatgatctctacattcatatacatagaattgtttttagtggccgttgagcttctgatattggaaggcgacaatctagaaaaattgtttcctcatatgaacttcaaaattggtagccttagaattgaaggtaaaagtggttttgtggtgctagctgctttggtcatactaccaacaacatggttgagaagtttgggagctttggcttatgtttctcttggtggggtaatggtttctattgttttgattggttgtgttgtgtgggtgggtgaaattgatggtgttgggtttcatgaaagtggccaattagtaaattgggagggattgactactgctgtgagcctttttgcattctgttactgtgcacatggagtgatgcccacattgatcaactctatgaacgatagaagccagtttggcaaggttttgattgtttgctttgtagcaagcactattatctatggaaccattgctgttttaggctacgcaatgtttggagattatttgatgtctcaaataaccttaaatctaccatcaaagaaaataagtactaaattagctatttatagcacaataatcaatcctttcactaagtatgctgtactaatcaccccaatagctaatgctattgaggaaaaatggcttctctgcaaaagaaagcctattgccattttggttagaacaaccattttggtcagcaccgtgcttatggcactattcatgccgtttttcggttatgttatggcatttattggtgcattttttagcgtgacaatctcattgttgttcccttgcatctgttacttgaagatgaacaaagctgctcggcaatttgggttggagttgatcgtcataattgtaattctcttcgtag

SEQ ID NO: 98678 - DNA, 282 bp, Glycine max
  Peptide Sequence Number=SeqID_215456
atggggttttatatcctggaaccacatctggcaacaagtatgcgtcaacaggcaatgggatctcgacttggaactcatagggaagaccgaggaagccatggagttgcgattctcagtggcgagaacccgcgggataatgcaaagattcttcctgaatttgaggttaagggagaggatcttggtggtggagccaaggtggtagagctagtaatcaaggagaagacagctcagcgagcgtcttctccgtctcatggacggtgcggctgcaatagaggagcttga

SEQ ID NO: 98679 - DNA, 195 bp, Glycine max
  Peptide Sequence Number=SeqID_215457
atgactaacttccgtaggcttgcaagaacaacagctccacactttgcccttggcagaaacagagaattgcaaggtctggctcgtgctatggtgaagctgtgggaaacaagtgctattgcaaaattgccatcaaacgaggtgttcctaatacatgaaatgacaggatggctgaagaactcagggtatttctcataa

SEQ ID NO: 98680 - DNA, 753 bp, Glycine max
  Peptide Sequence Number=SeqID_215458
atgggaggatatatggaagaagagtgggagtggaactttttgtggaggaggccattgtttgacaatgagatatcaaaggctataaatttcttacaacatgttgaaagtaaggttatccaaatacaaagaagagatgattgggtgtggacactagatccaagtgggcaatatacggcgaaaagtgcttacaggatgatgatggggggagcaacacatgggacacaggatagggattttgaggaattgtggaagatgaaggttccaaccaaatttgcagtgttcgcttggagactgcttagagacaggttgccaagtaaaacaaatcttcaagggagacaagtagagatcgatgataggacctgcctattttgcaaaaacgcggaggaggaagcgggacacttgttctttcattgcactaaaatcatccctatgtggtgggaattcttgtcttgggtgaacaatgtgggagttttcccgcaagatccaagacaacatttcctccaacatgaatctatagtggttgatggactaaggactaatagatggaaatgctggtggttggccgtcacttggactatttggaagaaaaggaatgacataatcttctccaatgactccttcgacatcaacaacatgatggaagaggcaactttcctcacctggacatggcttaggaatttggagaaggactttgtaattcattttaatcaatggtctagtaacctaagagaagaagggtttgtgtatcactag

SEQ ID NO: 98681 - DNA, 1284 bp, Glycine max
  Peptide Sequence Number=SeqID_215459
atggccactctaagcttcaaccctgttagaataaaatccccaacgttcaaacattccaaactcaccactccatcaaaacgcatcacaattccatgcaccactccctccaacagccaccccaaactgctccacttccgaccccgttcggtgtccgaaagcacccagaaagaagcacccgaagcggttctcggagaagaagaagaagaagaagaagatgatgatgatgacccatctgcggaactgagctacgtggacccagtaactgaccctgagagcatcacggagtgggagctggacttctgctccaggcccattctcgacgccagagggaagaaggtttgggagttagttgtgtgcgacaagacgctatcgttgcagtacaccaagtatttcccgaacaacgtcattaacagcattacgctgaaggatgctattgttgccgttagtgaccagttgggtgtcccgttgcccagaaacattcgcttctttaggtcgcagatgcagacaattattacaaatgcgtgtaatgagcttcgcataaggcctgttcctagtaaacgggtgctgataataggtttcataccacggaatgtgacatatgaaagggaggaggaagtagttgttagtgtttgctttacactggaatctaatgatatccatgtcagaggtgccccagcatatattttatgtggttcatctgatccttttcagtgcgtgtcaataattctatggctagaggagcgctatgagaccgtatataaaaaacatcctggatttcaagaaggatccaaacctcttttggcacttgataatccttttcccacggaacttcctgacattctttatggggaaagatgggcatttgtccaattaccttactcagctgttcgagaggagatatcgacctttgagagaggagtttgtggttctgggctagatcttgatttattgggtcttgacattgatgacaagacattgatcccaggactgtctgttgcgtcttctaattctacagcattggcagctttgataaatggattggaggtttgcgcggtggaagcggatactgctcgtgctcgcctgattctttctagtggaatttctactcggtatatatattccacctataagaaaactcctgagacaactagtgaagctgaagcttgggaagctgctaagaaagcttgtggaggtttgcatttccttgcagttcaaccagacttggattctgaagattgtgttggcttctttcttttactagacttgccatttccacctgtatga

SEQ ID NO: 98682 - DNA, 1140 bp, Glycine max
  Peptide Sequence Number=SeqID_215460
atggggaagaagtctgagccagtgataaccaaatgcaaagttggtgagaactggactaaggtgaccttcaagcctgacttagaaaaatttaagatggactatcttgaagaagacgtcgttgctttgatgaaaaagcgtgtggtggacatggctgggtgtcttggaaagactgttaaggttgaactcaatgggcaagtgatccgtatgaaatcatttcgtgactatgctgatctttacctcaaatcagcagagaaatccagaccagtgcctcttccaaggattcatgcaaaagtaggtgaaaggtgggagatttgcgtgagtctaagtgacgggcagtttcaacaggtcagctttgttaattccattgctacaatcaagggtgggactcatgttgattacgtcaccaatcagattacaaactttgtgatgaataaagtaaataagaagaaaaaggatgccaatgtcaaagctcacaacgtgaagaatcatttgtgggtttttgtcaattcacttattgacaaccctgcttttgattctcaaactaaggaaactctcacgactagacaggctagttttggttccaaatgtgatattcctgaatcgatgctgaaggaagttgccaattctggtatagtggacaccctgctatcgtgggcagattttaagcaaagcaaagatctgaaaaaatctgatgggacaaaaactcagaggcttcgcggcattgtgaagctagaagatgccaatgatgcaggtggaaggaactcagagaagtgcaccttgatattaacagagggagattctgctaaggcccttgctatggctggcctctctgttgtgggtcgagatcattatggggtgtttccattgaggggaaaattgctgaatgtacgggaagccagcagtaaacagataatggataatgaagaaattcaaaatataaagaagattcttggactgcagcaaaacaaagagtacacaagtgtgaagtctttgagatatggtcatttgatgattatggctgatcaggatcacgatggttcccacatcaaagggctattgataaacttcattcattcgttctggccatcactactaaaagttccatcttttatggttgaatttaccactcccataataagg

SEQ ID NO: 98683 - DNA, 444 bp, Glycine max
  Peptide Sequence Number=SeqID_215461
atgtaccttgaattcaaggacaagggacctccttactacactaaagaaagctatgctgttgtccaacattcacgaaagtcacgcataatcctcagggttttactcaagaatacttttgcaccaaaaactattgcacatatgtccagtcatttagttgacaagcatcgacaaatttactgttcagggtcccctttacaaactatttacgtaaaggggtcccttttcagacaattgacggagtgggtctgttttgaaggtggtgccgccagtagaataggcggcaaaagtgttctacctcccatctcgccattccttctggtgatacaacctatcccgccatttgtgttggcgagacatccctcagaggccatgccgccatacgtgctggcgatacaccccttcccatttcgctattcaaattggcgggacatgagttggcaatga

SEQ ID NO: 98684 - DNA, 1509 bp, Glycine max
  Peptide Sequence Number=SeqID_215462
atggcaccaaagagaagtgaagctactgtgatttcaggaatcaacatcaaggaacatgccaataacacaactttccttgacaacttcagttcacgacattatgcaaccatcgttgttgcacctggatgtgttgaagagtgtttagtgtttgataaagattgggagaaggacataacccaaaagactgtggatatcatgctctatggtagtccatgtcctatcacagacgataagaaggtgatgattgattttctcataactaccaaccaggcctacatgtgcagattgattcatagttttatgttcaacatggagattcctaaactgggtcatgagactataccttcaaagacaaattcaaccccaagcccttccacctcagtcaccatctttttaactcatcacactcaacctaaacatgccctctccctcatcagaagaaaagaagttgtagcctttgctaaggctaagaagaggtctctggccgaagaggagcacaagaggaatttggatgcagatgccaagcttgctaccttagcaagcaagttatctgaagatattttggatggagttattctggaatctctgaatacactgtctgttgagaaagaaaagaggcacagtgttgagaaggctaacatgatggagatagatgttattgaagcatctcttgtggaagttggagatgatatcatagagactgaccccgaaattgttcctattcgtccaagcaaccaaacattcaagtgcatcttatcttgcacaccagattgtatcatgggttctaaggaaacagagttctggaaagacagacttgaaaaagtctgggaaaaaaggggtgacattggaacacatattcttcacttagagatgcaaaaagtgaagttggaaaagctcaatctcacaaatatctggaaaataggtttttcaagtattggtcatttttcttactcatcttggtatatcttgcctgaagaagaagtgtacgcacttggcgtatatggagataggaaaccagagatcaaggagttccctttatggcagattgttgctctcaatcctaataaggttgagcatgatgaaattattttctctactcctttggatattcaacaattgatgggtctcatttgtgtcgtcaatgttgtccttccttgggatcactcaaagtctgaaaagacttttcagattcaagaaatccttatgggagcacctgtagaaatagagtctaatgttgaagttgaatcttcttccatggtcgttcaagtatatgatccttcattctctcgtgcatatgtttgtatgatcgaggatgaacttgtcaaaacaagggaagcacttgctcaagcattaaaggattgtgctcatatcacttattggaaacctcctcgtccttctacgcctccaggtagtcctattcacttctcattcgattctgatgactccagtgatgagtttcaacagaagcttgatgaagaagtttccgaacaaaaaagggagaaaaagtaa

SEQ ID NO: 98685 - DNA, 354 bp, Glycine max
  Peptide Sequence Number=SeqID_215463
atggcgaatgtgtgtatccctattttcattatgttgagtgattttgatgtgagggagttggaggatataagcttagtcgccaacaacaatgagcatgttcgggatgatggtgatggaaatgaaattgaggttgggtatgaaagtgtgcaggcaaatgcatttgagagtgaaccttgcattgaaaatgaagataatgaggaagatgataatgagcatgttgaatatgtggatggtgacaacgacatgatatttgaacactattttgctaaaatagttcatgaagagtgtaacgacataaatagctttgttgatgtgtatatagttgacatggacaatgtaacattgatgttttag

SEQ ID NO: 98686 - DNA, 414 bp, Glycine max
  Peptide Sequence Number=SeqID_215464
atggagtgcacaatgcttacaggacataggaaactgacaatgtcggtcattgataaagtacaaattgaaaattttaagaaggttgacattagacctcctaaatgtgaccttgatgtggttggatttgaagagaaatggtatccacatttgctttggaggataatgtttggattagataattgtatgagaaaaaggagaatgtggtcacctactcatattcgagttgattgcaagatatgcaatgttagtgcatctttcaagagaagtctgacaaatagttatggagttgctaatgaaagtgaagaaattgagacaaaggagattattgatattgttttagatcctcctcttattagtcataaagattgtgggccaaaagaaaatagacatgttgggagacatcggaggacataa

SEQ ID NO: 98687 - DNA, 171 bp, Glycine max
  Peptide Sequence Number=SeqID_215465
atgctcctcttggaaacaaacctccgatggcagctcgcgacggctggtggggtgcaatggattatggaaaatcttgtggtggcggatattgtgatagtgttggcagatcttgatgaagcaaaaagttacaagcaaacacgtaagccaacgcgtgaggcgtatagatcctga

SEQ ID NO: 98688 - DNA, 192 bp, Glycine max
  Peptide Sequence Number=SeqID_215466
atgattaaggcaaaggggttggtggacaaggttaacaaagacgtcgtcagagttgatggttgtggtagcaaaagggaaggagtggggggaagtgagttaggaagtcaggttgtggagggagaaagaagcaaagtggttgctgtagaagaagttggggatgaggtgaaggatggttttactggtggcaaataa

SEQ ID NO: 98689 - DNA, 1988 bp, Glycine max
  Peptide Sequence Number=SeqID_215467
atggaggccaaaaacttgtggcgcttccttgttctttcaatcggtgtggtactagttttacttgtcactcggcttcccaacaaggaggctctagactgcaacctttactctggatggtgcacctcaaagaaccgcttctactcttcagcacatcctaataacccgattaagaaaccatcatcattttccacatatcatcacaaccaacaccatgatgaatctgagattcctgaacaccctcttgaccctctaaccatccaagagttcaacaaggtccgcaccatcctatccaaccaccccctcttcaagtcctcatccacctacactctcaactcagttgtccttgaagagccagacaaaaagctagtcctcaaatggaaaaagggtgatccacccttgcctaggaaggcttccgtggttgcatatgtgaaaggagactctcatgtgctcactgtggacctcgaaaccggccaggtggcgagccacaaaaccaccggctcagtctcggggtaccccaccatgaccatggaagacatggtgggggtactagaggttcccctcaagagcactgagttcaaccgctcgatcactaaacgcggtgtcaatttagcagacctggcttgcttgccaatctcttcagggtggtatgggaccccagtggaggagaacagaaggttgattaaggtgcagtgctattccaaagaaggcactgtgaacttctacatgaaaccaattgagggtgtcactgccttggttgacatggatagaaaagaggtgcttgcaatttcagataatggccaaaacatccctgtggcgaatggaattaacactgactaccgttactccattcagaagctgaatggagagttgaggctactgaatccaatatccttggagcaaccaaaaggtccaagcttcacaattgaagggcacttggtgaaatgggcaaactgggaattccatctgagaccagacccaagagctgggaccataatttctcaagccaaggtgagggaccctgacacatcaaagctgagaagtgtcatgtacaaagggttcacctctgagctatttgtgccttacatggatcccacagaagggtggtactttaagacatacatggatgctggtgagtatggatttgggttgcaggcaatgccactagaccccttgaatgattgcccacggaatgcttactacatggatggtgtgtttgcctcttctgatggaacaccatatctccaacccaacatgatttgcatttttgagagttatgctggtgacattgcgtggcgacatgccgagtgccccatcactgacctcaaggttacagaagtgaggccaaaggtgacactagtggttaggatggcagcagcagtagcaaactatgactatatcgtggattgggaatttcaaactgatgggctaatcagagcaaaggttggactgagtggtatcttgatggtgaaaggaactaccaatgagaatatggaccaagtccctaaccaagaatatctttatggaacccttttgagtgaaaacattattggtgtaatccatgaccattttatcacatattacctagatatggacgttgatggctctgacaattcatttgttaaggtaaacataaagaagcaagagacctctcggggagaatcacccagaaagagttatctaaaagctgttaaaaaagtggcaaagacagagaaagatgctcaaataagacttcaactttatgagccatctgaattccatgtggtgaacccattgaagaagacaagggtagggaaccccgttgggtacaaattggttcccggtgccacagcagctagcctgctggatccagaagatccaccacagaaaagagcagcttttaccaacaaccaattatgggtcactccttacaacaaaagtgagcaatgggctggtggcttatttgtttaccagagcaaaggcgatgatactcttcaagtctggtccaacag

SEQ ID NO: 98690 - DNA, 684 bp, Glycine max
  Peptide Sequence Number=SeqID_215468
atggctaggagaatgaataaggttttggaggggataattaataagagacaaagtgctttctttaatggaagacacttacttcatagtgtgttggtggctaatgaaatggtagattatgcaaaaagaataaagaaaaaatgtttgatcttcaaagtgaactatgagaaagcctatgactcgggttttggcgttggtaaatggttgtcccacgatagagttgatctcgatactcaaaggtttgagataagatcaccctttagctccctccttgttcaatgtggtagcgaagggcttgagaatcgcactcctcattggacaaaaccatctcttccttggatatctcttcaccgcagacccccgatagaatgcgatcttgaatggcatgagatcctcgtcgtcaacaaaatgtcacgtatccttgaagatctcaacggatgtgtcacaacatgcccttttgtgggcgagcgaggcaagactcacgggtgcgctttccaaaggaggaaagatgcgcggagtcgccaccaacgtttatttgtggaaaacgtcggaaaaaccgaaggaaaccggaaggttgacaaaagcggggctcttgctcctacgtaccctccattgaagaggaaatcagacctacgtagttcttttttaagagtgaatcgagcgattcttttttacttgaaaaggtga

SEQ ID NO: 98691 - DNA, 414 bp, Glycine max
  Peptide Sequence Number=SeqID_215469
atgaaggttgaacaacactttggttgccatcatacaattgaggaaaggaaggttccttttgctacccttagctttcaagggtatgccctttattggtggacttacctagttagggaaagaaggattcatggggatcctctagtaaagtattggaatgacttgaaaagtgcccttaggaaaaggcaactcccctcctactatgaaagggagcttatggacaagctccaaaggtttcgacaagggagtatgagtgctgaagagtataggaagcctacttcaaaatcttatggctctcactcttatccaaagaaagaccaaggtcaaggcatcttaggggctgcaccttctaagcccaaatatgataagagggatgaggaagaaaaactagaaaaacaaaagcaaaaagaaggatag

SEQ ID NO: 98692 - DNA, 360 bp, Glycine max
  Peptide Sequence Number=SeqID_215470
atgctctcttcttctccgtctaaggttcgtgttcgcgactctatctcaacatctacagcccttgtgacagtgcatgaccgttacgcctcgccactgtacccagtcaatgtgataagggtttcatctgctgttgttaaggcaagacaagatgggaagacaaaggatttggctattgaagttgttaatgggactactacagtggtccagactgataggaaccctttccattctcaccaaagtggatggttcttcaaggcaatcatgaatgatgaaggagaaagaaattttcttctttgtgctgaagagatggatttgatagatcagcagttgaagccttgcaaatgcggttatgaggtttga

SEQ ID NO: 98693 - DNA, 855 bp, Glycine max
  Peptide Sequence Number=SeqID_215471
atggattccccctctcgcccctccgtcatcatcgtaggtgccggcatctccggtatcgcggcggcgaaggtgttggccgagaacggcatagaggacctggtgatcctggaggcttcggaccgcgtcggcggcaggatccgcaaggagagtttcggcggcgtgtcggtggagctcggtgccggatggatcgcaggcgttgggggcccgcagcccaaccctgtttgggaacttggcgtccaattcggcctccgtacctgcttctccgactacagcaatgcgcgctataacatctacgatcgcagtgggaacatcataccgagtggaatcgctgctgactcgtacaagaaagcggtggactcggcgattgagaagttgaggaaactggaagaagaagaagcaacagcatacggtgatgaccacagtaataatattaaaaataacgaaacgaaaccgccttcgacgccggagacgccaatagagctcgccattgatttcatcctgcatgatttcgaaatggctgaggtagaaccaatatccacctacgtagacttcggggagagagaatattttgttgcggatgaaagagggtacgattacttgctgtacaaaatggctgaagaatttctcttcacatccaagggaagaatcttggacaatcgtctcaaactcaacaaggtcgtccgggaattgcagtattcaaaaagtggtgttacggtgaaaacggaggatggttgcgtttacgagaccaattatgtgattttgtccgttagcattggcgttctccaaagcgacctactagccttcaatccacccttacccagaacagaggaagtaaaaggatttggttgtgcttaa

SEQ ID NO: 98694 - DNA, 495 bp, Glycine max
  Peptide Sequence Number=SeqID_215472
atgacatctaagctctacatggaggtgccagaaggtgccagaggtgcaggaatggaagctagtggtgctggagctggagcaggaggagcagaagaagaagcgttccaacaattcgtccggatatatgccaaattaatggcaaggctcaaggacttaaaagtcaatgaatcaggaacaactccccgggcgatgcatagtgcagtgatgagtgtgaggttagagtatgataaaacactccaagtctgggcaagagtggtgaggtccttccttagaagcttccaaggcgctccctcagtgttcagaacaaatcctcgccctggaatgcagagcttggaagcaagctcctataggtctggatgtgaatggcaaaacctggaatatgtggagtacctctcccctggctccaaaaccacgggggtctccaggaatgtgttgaggggccacatcaatgtgaccatcaggctgcctggtcaaggccttgtgccacctacatag

SEQ ID NO: 98695 - DNA, 273 bp, Glycine max
  Peptide Sequence Number=SeqID_215473
atgaagaataaggaaccgaatgttctatgccatctacgactgcctagcacatgggaagcttctttgagaagcaaggaaggtagattccttgggaagctagaggaagaaagcttccttgagaaactagaaggggctactcatacccctccaatagctaagctcacccccatagcaaaatacatgaaaatacaatgggaagcttccttgagaagcaagaaagatagcttcctggagaagctagacgagggctactcacacccctccaatagctaa

SEQ ID NO: 98696 - DNA, 534 bp, Glycine max
  Peptide Sequence Number=SeqID_215474
atggagaacgcgtatcctggctccaatatcttagtggtgacattgacaaatggggaatcgaaacgtgtggaagctcaacttgatgaagagaccttgagagaagcaatggcagcgctcagggatatgtttggatccaacatccccgatgccattgatatacttgtccctcgctggtggaataacagatttcagcgtggcagctacagtaactatcccattatttccaatcataaagtttttcatgatattaaggcccctgtgggtcgcatttttttcactggagagcacactagtgaaagatttaatggctacgtacacggtggatacctggcaggtattgacaccagcaaagcgttactagaagaaatgaggaaggaaaaagagagccaaactctcttgttagagccattgctagcattgacaggaccattaacaatgtcgaaaccagaaacagtctccaatatccacaagtgcgatattcctacacaattatatctcagtggcaagcttggcatacccgaggccatattatga

SEQ ID NO: 98697 - DNA, 486 bp, Glycine max
  Peptide Sequence Number=SeqID_215475
atgtttgatgtgttgcatcaactgaaaattaatgtgactttcaaggaggctaaggctgccaagaaggcttgtgaggattcaacaaatctaattatcaatggtcgtcgagcgaattgcaatcttgctttcctaggtgctcatcgcccaaagtcttcttcaaatgtttcaccacctccaccgcaaccacaagggggatccaatggtggaatagtgaagaatgttaacaatgcattaggtccaccaccagccattaatcatgtgcagccatatcattatccagtgaggacaactgctctgccattccataatcacactcttcctttctatggttctttgggacaaggtcttcttactagcacttttgttggagaaataatgttcgccattgttgttgcaacccttggattggttcttttcggattgctgattggtaatatgcagaagataatgcctaaagacaaggaccacgatctgcttcctatttag

SEQ ID NO: 98698 - DNA, 462 bp, Glycine max
  Peptide Sequence Number=SeqID_215476
atggctctctactccttcttctctccctctcttttataccctccctcacatattccccgtcgacttttttgtcccaaggcttccttaagctcttcctcccctgaatccaaagcatcgcagagtgtttcttctgcaacttccaccaccacttcccctaccccttcggttgagtctaggccacctgaccccgccttcaactatgcactcaccaaccctaacggcaacccaatcgtaaggattgttcgagccaccgagtcttccattgaaaggaagaaggggataggtgacctgatggtagaaggttctttaacatcgtcatcatatcaagagctatggagaagcattaggaataggaatgggaaggggataggtgacctggtcatttttgatttccgcttcttggcattacttgctgttggagggtccttggcagggtcactcttgtgctttctaaatgtatag

SEQ ID NO: 98699 - DNA, 270 bp, Glycine max
  Peptide Sequence Number=SeqID_215477
atggccatactaaggaatgaaaaagagcattctacatcagtggaattggcatttctacgacggtggacgcgtgtctttaaatctaatgtcattgtagagggtggatgtttctacatcggtcgtaaaaggatcgtcttagaaacacttgacaaacgaagtcgtgcctacaacagcactgatgtagaaagcattgctttctacatcgttgttggcttaagcacgactttgtttctcatgtgttctacgacggtcattttacgaccgatgtag

SEQ ID NO: 98700 - DNA, 285 bp, Glycine max
  Peptide Sequence Number=SeqID_215478
atggcctttttcaggctagagctcccagaggagtatggagttagcaacacatttaacattactgatttgtttccttttgtaagtgtagttgattcacatgatgaggggtctacagatttgaggacaaatcctcttcaagagggaggggacgatgcaatcctcccaaggaggggacccgtcactagagccatggctaggagactccaagaagattgggctagagatgcaggagaaggccctagggttctcatgagccttagggtagattttgggcccatgggctaa

SEQ ID NO: 98701 - DNA, 300 bp, Glycine max
  Peptide Sequence Number=SeqID_215479
atgaagtggatcctagggtacttgccaccgtcgacggtgttgaagatgaggaagcctttggtcgctggcgaagttgttggcggcgtcttccttaccagagatgagttgttcggggtggaagagttgacagtaggtgtcgtagcagacctcatcgatgacgatgggttcaaggtcgacaaagaaagcatgggggacgtgcttgccaaatctagtttcgctgaaggtgttgaaggcgttgtaggctacattaaaggtggagtcagaaggcatcatgccgtcgggctcaataccatgttctag

SEQ ID NO: 98702 - DNA, 1062 bp, Glycine max
  Peptide Sequence Number=SeqID_215480
atggctgttgtaagtgctgcatttgaaagcagtctgagtctgtctgcatatactcagttttctagttatcttgaacttctgagtttaggtacattcaaagtgttagatgatgcagcatcaggtactgtagcacatggtctaggaacctaccgttggcttaaggaagatgtaacacctagtccacttttgatttgtcgtaatccacaaactggttttgttgaagcatctgtggcaaatgctagtcgattggtacatgattttcaagtcaaccagaaagttatctcttacattattgcagaggagcaagttcatcggtaccaatataaagtagagcttaacaatttatcttgttcttttgaagttcgtgagactggccttaaaacaaatgataatgtactggtatttcttcatggttttcttggaactggtgaagactggattaacatcatgaagaccttttctggatcagcaaaatgcatttctgttgaccttcctggtcatggaaaatcaatattacatggtgtaaagggtgctggtgaagaaccattgttgtcactggagacaattgctgatttgttgcataaattaattcatcacattgctccagaaaaagttacactagttgggtattcaatgggcgcaagaattgcattgtatatggcactgaaattttgcactaagacaaagggtgctgtattaatatctgggagtcctggtttgaaagataaattatctagaaaaattcgtactgctaaagatgattctagagcacttgcagtcattgcacatggtttagaactttttgtcagttcctggtatgcaggagagctgtggaaaagcctaagaagtcatccccatttcaatcgaatcattgctagtcgcttgcagcatgatgacatgcagaatcttgcacagatgctgtctggattaagcataggaaggcagccgtggggtcggcgaagtgtgaaaaaagaacaccgcagggaaaataataaagaactgagacctctacacatgaccaaaagagcagtgtttgagatgcatgaacagagggtagactga

SEQ ID NO: 98703 - DNA, 279 bp, Glycine max
  Peptide Sequence Number=SeqID_215481
atggacacagagacgaaccagttgtcattggtggtggaggaggaggatggttttgtctttcatgtagagcatgagcaaaatgttgatctagggctatgtctggttggacgcatccttacaagcaaagcaaatccatttctagattatgaaggagaggatggcaaggttgtggatgctggggagggaagtttatttggcacaaaatcagaggcaacattgattgaggaggagaaaaggatgtttgttgatatgctgacaaagaaagtggttaaggaatag

SEQ ID NO: 98704 - DNA, 627 bp, Glycine max
  Peptide Sequence Number=SeqID_215482
atggctatcctcaatgccattgctgatgcaaaaggctctaacatgctgaacatactctatccctcaataaatgggaacaataaatgtgaaaggtcattaaatgttcagatttgtgcattaattgattcaaatggatctccaactgaagttgctaatgttgctgccaaactaactgaggaaggattttctgcaattaagctgaaggtagcacgtgggggtgatccaatgcatgatgcagcactaatacaagaagtgagaaagaaagttggttgccagataattatccgtgcagatgctaatcgaacctggacttatgaagaagctatgaaatttagttcgttggttaaggattgtaacctacagtatattgaggagcctgttcaggatgaagatgatattctcaagttttgcgaagaaagcggcttacctattgctttagatgaaaccatagacaacattcaagaaaatcccatggaaaagctagccaagtttactcatccagcaatagctgctgttgatagggataattgggatagggtgaggtgtttggttggcaggcttagaagtgttgtttggagtggaattctgtgtgctggtttgaattggtgtgtttattctgagaattag

SEQ ID NO: 98705 - DNA, 177 bp, Glycine max
  Peptide Sequence Number=SeqID_215483
atgacgacaaatcagaattttgcttctactattccttcttttcatccgatttctcggaagttagatgattcaacttcctactatggaggcaacagtcctcagatcccaattcactttctcatagaggcagattgtgaagctggaaatggaaatccagcatacaccgattgggaataa

SEQ ID NO: 98706 - DNA, 975 bp, Glycine max
  Peptide Sequence Number=SeqID_215484
atgtctatgtccgtatccgtgtccggtgtttgtgtcaaagtgcgtgcttcatggactgaaagtgacaggaaactgaaatctaaacagaaaaaggcagaacttaaagaagctatgtgtgtagcacaacatgagcaaatggactgtatggttgaaattgagagttccattaatgccaatgccaatttccacaggattgcacttgaagctccgccaacatcaacatttgttagtgatggttgtaaggaattctatagagaaggatttattttatctttagtgcttgaagagggaagtgttggttatggtgagaatgatcacctttccgtaatgggtagttcaaggtcaaatggcaggcctggatctggtagaggtctgcactggggaaggttgatcatggtctggacctcagctagaggagttggtacaggtgccactgactcgcatccgatgccaatcgtctatcccgagcttcgatcctacaaggggataggtggtgctgattccctggtgttgtatttgggaatcgtttggcagtataacttaggcgctatctacactccgatgtgctcctcttcctccaacgaccttttttggctccaactacagcacttgggcactgctgttcagttgtggttccaagaccaaagccgtgccgatcacttgaccacaaaactgaaggatgttccgactgaaaatcaagctcttaaaaactgttatgatgtgtggaccgaggccaagaaagtttacttcaacgatgtccatcgtgtttacaatttttttaccgctttaacgaacatcaagttggagaatgctgacattgcagacatgccttttaccactgatgtagaaactttttacaaacaacacgatcaatttttcatggtgcttgctttgattggactcccatcaaaccttgatgcagtatgcaatcggatactatcgggtcccattgttcctacctgtgacatggtttag

SEQ ID NO: 98707 - DNA, 1155 bp, Glycine max
  Peptide Sequence Number=SeqID_215485
atggcggttgcactctatagcacgcttgcttcctctggtctccatcgagatgtcccgtcgagaaaccctatttcttcatttctatcatcgtttagctcttccttcttcggttgtcttcaacttggtggttgtgcaatctcaccaagaaaaagcatccagcagacaagcttttttttccctttgttgttatgcatcttggtggttgtgcaatctcaccgggaagaagcatccaacaggcaagctttttttccctttgttgttatgcatgtttgtctctatttgcaaggtcacccacgaagaagcatccagcaggcaagaattatggctcggattcctaacaagataaagggcatcaatggatcaaaagaaacccttaaacttgctgtgaggataactgatctttggtttgtcggaacacctgacaagtctgaacaagctgagatgattatagtggactctgatggtgatcaaattcatgtggtttgtaagcgagaccaactgaagtcttggaagttggatttgaaagagaattgtacttatgtgatgcacaattttaaagtcatcaagaatgatggtcaatacagagtttgtgaccacccatataaattggtattcactggtgttactgttgttagacaaactgatttggacaatgttccttttaaaaaatacaatttcactcaatttgccaatatcattgctggccactttcaacctggcctgttggttggattgtacccaccgtcagtaagtaattctttgaaggcttcaaagttacttattaatcaaccggtggctgaaattcaagaattcaaacacaggctttctgaattaggcattgaggtacactcagttataacgcctcgtggtcaaggcagttcacaactttcaggttctagccaattatcatcaaaggatgcatttttttataagtataaggcaaagagcatttataagattaacaacattacagaagtattggtcttatttatgttttgcattgattcaacacatcaaccagttgatgatcaatccaatcactatgttgtttccaccaggatattgtttgtgttaccgtgggcaccattaccagaattgttatggaaaatcattcatggtgttatccggcttgcatccaatgtcacaaaaaattga

SEQ ID NO: 98708 - DNA, 843 bp, Glycine max
  Peptide Sequence Number=SeqID_215486
atgagagagaaacagggtgagggagagagagacagggtgagggagaaagagagaaacagggtgagggagagaattagggtgagagagcgaaacagggtgagagatacagagacaagggtgagggagcgagtgggagctacagagggcaacagaaggcgaggtcgagagagggagccggagtcaacgcacagaaggagagacaaccaccatcagcgattctcttcacgacgttcttccgctcgaacatggaccaacgaggatgcaggctacaatcatcataacggagtcgaagtgagatggagtacggacaagcaagaggaatacgatcatactaacaatcatggtgtatggcacgaggtgtcacacagacgaaaaaggagattggttgaaatcaggggcagcatggagagcccaaaatggcaggagagaaaggtgacttggagagacaagggagatatcacgacattctatttctctagattcccggagggagtcaaggagggtgatctatggcagatttttcagaaatggggaaaggtatgggaagtctttatccccaagactaagaacagggaagaatgctacatccacacagaaggtggcacatactcacaaaatgcatatggagaatcaggaggaggtgaaaccaaaaggccctgggaccagaccgcgttcgtttgtggaggtggtaagacaggatatgcaaggagacgtagcctcttatcggaagaaggaaccccccctttgtacctcaatggccatgcagagaccagtggtcttgagctcacgtatggagtccaacgaatggctacagaaggcttgggttgggaaactgaagaatag

SEQ ID NO: 98709 - DNA, 225 bp, Glycine max
  Peptide Sequence Number=SeqID_215487
gcatcttctaggatccatattgcactccctgattctagtgatcctcctcaccatgaatctcaatccctgtctagaacagcagatcatgatccacttcttcgactccccttaacaccaacaaagcgacagatatcccaagaatgtgatgatgaagcaagaagctctcagatttcacctgcacaactttcatctaacaaattagggaaacatgttaaaattgaatga

SEQ ID NO: 98710 - DNA, 426 bp, Glycine max
  Peptide Sequence Number=SeqID_215488
atgcaagaagacgacattcctaaaatcgtgtttcgtacccacgagggccactacgaatacttggtcatgccatttggtttggtcaacgctccggccaccttccaattcactacgaacttggtgtttagacctctattacgtcaatgcatgctggttttctttgacgatatcctcatatatagcctagactggccaactcacttatttcaccttgttgaagtattgtccctgcttgcccaacatcatttggtggctaatcggaatatcatctcagccaaaggggtggagatggatccttcaaaggttattatcggcggttcatcggggactaagggtgtcgaagaatgtgatggacaagctggtggggctacagaggcagcttctgtgggggcgaaaactcagaccaaaagaagattgcctaggtga

SEQ ID NO: 98711 - DNA, 231 bp, Glycine max
  Peptide Sequence Number=SeqID_215489
atgataaaggtgcaaaccaagttcaggaattctgctgttttgaagtgttcagctgactcgagcttaataaatgttgtgatggatatgctagctgatgctgagacatcttcaaaaatgaatattccagtttctaattccaatcattctgctcaacatgaatctcaatccctgtctgtgacaacataccatgatccactgcttggactccccttgacgcctacaaagcggtag

SEQ ID NO: 98712 - DNA, 372 bp, Glycine max
  Peptide Sequence Number=SeqID_215490
atggaagggagtaaaaaatacttaccagtaagaagaaagaaggaagctgcgggaagagtgtttgctgcaagtgaagaagtgagcgaacaacatacattttcactttataaatgggaaaagagtaaggagtattgcttcaggaggtttggcgcaacacactcctcacatgcgtatttgcaccctgtgcagcacctgcgcagtacgccctaccctgtgtctatgttgaccaaaagtggttgcgccactgtatgtgtaacaacccattgcgcaaagtttttggcacaacaaattcatgccacttgtcagctcccggttgaattgtgtccttacctttggcgcaatacaaataaaaacagaccccccgataaatag

SEQ ID NO: 98713 - DNA, 309 bp, Glycine max
  Peptide Sequence Number=SeqID_215491
atgcaattcttacagcaaggtattacctattccttccatcatctttcaacaatcagtttcttcccctcctcggcacctccctttcttatttatcactgtctccctcaaccaacacatgtggaagcaccctctattgaagggattggtccttcatctcctactccaatcattcctcctgttgcaatagactctgacttacccatcgctattcgcaaagggtggcgacaggcgatgattgatgacatgcaagctctagaatctaatctgatgtgggacccaatggacagatcccttgttggttgtcgctag

SEQ ID NO: 98714 - DNA, 336 bp, Glycine max
  Peptide Sequence Number=SeqID_215492
atgggtcgggttgaatgggagataaaatttcaaattactgctgagtgctccctaactgaaccttatgttgcacatgtgatgtcagaagctctttcctctgagtctgccctttttcttggtaatagtatgcccattcgggatgcaaatatatatggatgtagttggtctatatgctatcaaagtgtttcatcactcctgttaaactcagacctaccaattaacttggtgagggtagctgctaacaggggggctagtggtattgatgggatacttagcacagccattggttttgctgtaggatgcaacaaaaaggattatactgttagtttaaaataa

SEQ ID NO: 98715 - DNA, 486 bp, Glycine max
  Peptide Sequence Number=SeqID_215493
atggcgaaaccctcagcccaccttgtttcgcgagtggcagcggcaaaactagcaccccgtgccatggctgtttcgccaaccccattggcgaaatgccatgctttggaaaaacagaccccttgtgaaggttcttctctggagcatcccattctccggggtgtggttgttgtgtttcttggttttctttctccaaaagaactccaaccttcctctgtgtccttctctgccagcaaccccacacgatactcctccgtcctcctcaggagcatcccatttctccgattgccgctctacaaagatgtcatggtcgacaacgttgtatgcttcactaattcaaagatcgtcgacaataaatatataagcagagataacacacaagatgttcctgaaaagtctataagctttcaaatgctatataaccttgataaaaggaagaggatagagtatgcaccaactgtgtttcaagatttaatggtgatcgcctag

SEQ ID NO: 98716 - DNA, 762 bp, Glycine max
  Peptide Sequence Number=SeqID_215494
atgaatttggcggtgtcggcgttgggagggtggagggtgtgcaatggagcaatgtttttggttgagggaggcggtaatggtttgggaatgggaagtgggagagtgtgcagtcggagtcggagtcggagtgaggttggtggagtcagagtcggagtgaggctggatggacctgtgcccctaaacgacgacgttttggaaaaggaagtggttttcgagcagtgcgtgacgcggactctgtctccggcgttgacattggaggagggacttgagaaactgaaggaggctctccaaatcttgaattctccttccccttcttcccctactggattccttaggtttcaggtggcgctccctcccagtcctaaggccttcactttgttttgctcccaaccccactcctcctcggtctttcctctcatttatgtttccaagaacgacgccgactctaaatcactctatgtcaatggaacccgtggtgtttgtggcatcggtgctgctgtttcctttctccctccaactccaaaccaccgcactttcctcaacagatacatttcatctgattcaaccaatgtagtggcctatggtttcatggatgttaatttggatgatgatgtgagtcaccaggaaggttctttttggtttttcatccctcaggttatgtgtcatgtctggtctactattgacacatggaaatccaaatgcactagagctgccctcaaaaaactcaatttggtagaagatagatctattccaagggtataa

SEQ ID NO: 98717 - DNA, 234 bp, Glycine max
  Peptide Sequence Number=SeqID_215495
atgggaatatcacattctctcatgggaatatcccatcattcaaaaaggaattgtttattcccaggaatagtgtttcctattcccatgattgaatgtgggtttctttatattcccatgggaatcctatatcatagtagtcctgctataacatgtgaaaagctgctattgaagactgatacgcaatttgaatctcatagcagccctgggcgactccgcttgattactcctgtatag

SEQ ID NO: 98718 - DNA, 687 bp, Glycine max
  Peptide Sequence Number=SeqID_215496
atggcaacatttgctcaaaatggtttaggcaataaaacaatcgaaacatatgaggatatgttgaggatagaatgcaaacctggccatataagctatgttgttgttttatcttgttgcaaccacatggggcttgtagttgaagggaaacattattttgattccatgactcaagtgtttggcatttccccaacaaatgagcactttgcttgtatggtagatttgcttggccgagcagggttactagaccaggccaagaatttaataaacggaatgccttttaagccaaatgccactgtttggggtgctatactaggagcatgccgaatccatcacgattcaatactagcagaaactgccacaaagaagttgatggaattaaatgttgaagattttggaggttatgttcttctagcaaatatatatgcagagtttggggaactagaaaatgttgctgatatgagaaagagtcagaaataccatagtgaaaagcttgcttttgcttttgggttgcttagtttgccaccttggatggctatacaagtaacgaagaatctccgtgtctgcaatgattgtcacttggtaataaagttgttgtctttggtcacctcaagggaacttatcattagagatggatttcgatttcatcatttcaaggatgggttttgctcctgtcgagactactggtag

SEQ ID NO: 98719 - DNA, 1155 bp, Glycine max
  Peptide Sequence Number=SeqID_215497
atggacattcgccggaaaatggaaagggagttagcattactacggaagaaaaaaatggaggagctgtggcaccatttcaaaaaatggggtgatgtgagggagattttcatccctaaacgaaggaacaacagtggtaggagatacggtttagcaaggtttaaggggacaccaacacaagtagctccgggagctaaccttaaggggcagcatgagagaaatggaaatgaagaacacaacatcgaaccacacagctgcgaaagctccgcatcctcggtatatcttgacattgcaccagacaacacgaaatggcttgacgaagcttgggtaggccgactcaaaaatccaaccatgcttgagagacttgaagatcatctactgtgggatgttggagcggatagtagaacaaatgctaatagaagaaaaccacgatggtgccccgatgttccactcattggaaaagtggagtccgatcctgtgttcgggcttcaggctaactgggtacaatgctggggtattccgatagtggcttgggatgccaaacagatccagaaaatagtggccggcatgggagacatggtggatctcgacaatgatggtgaggatgtttggaggagggatagagcaagggtggtggaggaatgtggctatgttactcaacactgttattgtagacgtcggagcgacatgggatcgtcggaggagattgagtccatcgaaagtgagttcagcactctgattctgggatttgtcgacgcgtcggaaaaagaagatcagtcagaggatacgacggtatcggaaaccgaagctggattgcgagggaccacccttagccctaacgtcgacaatggtaaccacaggataccgataatacacaacggtcaaagagaaaaggaaaatccacaggataatggaaacacctcgcggttaatgaaaaacacgcaaaaggtgaacaaacaaggcactaaagggagctgggttgtgagtcaggcggcacgtcaatggagggggaaaaatctcacctacccagacgaggttgcacgtaaggtgggtgagttgcatactgtgggaatcatcaatcccacagaggaggtgctattcaatcacgaagatggcaaacaagtaggggaagttagcagtgacgtggaagggccatag

SEQ ID NO: 98720 - DNA, 276 bp, Glycine max
  Peptide Sequence Number=SeqID_215498
atggagggggatattggtagacaggaggttcacatcaagtgggttaatcctaataaaggttgggcgtgccttaacactgatggggctgtgaaaggcccaagcatatgggtaagaagcctcaaggctgggaggactatgtccattaggctgttaggatcacggtgtcgttttgtgtctaaggcagtggactatgctgcttatataagcatgaatgatcatagaataaggacaggaaaattcacccttaaattctatttcacctctttgcttctggag

SEQ ID NO: 98721 - DNA, 363 bp, Glycine max
  Peptide Sequence Number=SeqID_215499
atggcctccatcattgcggccatttgctctttcatggcctccatgtcggcctccatctactcttgtaccttctctgctttacccattactctagctctagcacagattttcaacatggtccatgacatctccgtcaaggtgaaactggaagtaacagggacatcgacagccctaaatgtgtttggcagtagacgaaggagcgataaatgggtttatgatcctaacatagttggctcatggtacctaacgcatatgcatgatgatgcaatgactcatgcaaaatgggaatgcgataacgaacaaatgcacgaacgatatgttcattatgatgctgaagaaatgtttatgcggtgcatgatatga

SEQ ID NO: 98722 - DNA, 222 bp, Glycine max
  Peptide Sequence Number=SeqID_215500
atgaaattgggagagagttttactggtccagaatgtcttatcctctcaaaagaaataaagactctcttggcaaatttgatgcaaaggcagatgaggctatctgatgcaatcctacccccaagggcattggataaaagactccaagaagattgggccaaagatgcaagagaaggccctagggttctcatgagccttagggtaaatttcgggtccatgggctaa

SEQ ID NO: 98723 - DNA, 823 bp, Glycine max
  Peptide Sequence Number=SeqID_215501
atgtccgctcagatacctgccgcagattattcaggtgcagagaaacagcgcctgtcagaaacacgttccattgattacatcccgctcagcgagcgtcacgggcatccgtttagccagttcacgttgtggtttggcggcaatttgcagatcaccgccattgttaccggtgcgctggcggtggtgctgggcggcgatgtggtgtggtcgattgtcggtttactggtgggacagatcgtcggcgcggccatcatgtcgctgcacgcgattcagggcccgagccttggcctgccgcagatgatcaccagccgtatgcagtttggcgtgtttggcgcggtgatcccgctggtgctggtgtgcattatgtatgtgggcttctcggccagcggcacggtactggccggccaggcgctggcgaagctggtcaacgtcagcaatgcagccggcatgatcatcttcagcgccatcatcatcgtgattgcggtgctcggctatcgggtgattcataaactcggcaaagtggccagcgtcatcggcgtgctggcgtttgtttacctgttcatcaccctactctccagccacgatttagcggccgtctggcaaaatcagcacttcagcgttgccagttttctgctggcggtatcgctctcctcgtcatggcagattgcgttttgcccttatgtgtcggactactcgcgctatctgccggtggatgtctccgcgaaaaagctgttcagttcggtgttttttggcaccgtgctgggcacgcaggcatccatgacgctcggcgtcattgtggctgcaattgcgggtaaagcgttctccg

SEQ ID NO: 98724 - DNA, 642 bp, Glycine max
  Peptide Sequence Number=SeqID_215502
atggcgtttggcgcattcggttttttcccttcccatatgaccggcaatacctcgcaaatttcggcagaggtgaatggttctgacctgcacgatctgctgtttctggccgtgctgatttttgcttttgtctgtggtgccatgctggcgcgtttgacggtagcttacggcctgaagcggaatctgcgcaccatttactgtctggtgctgctggcagagggtattttcctgctgctgacctccctggtagaaattctgtggtattccgaacgaaacaacggcgaaattctggttacgctgagtttgctgatgggcatccataattcaacctcgacccagctttcctccggtcgcgttcgctccacgcacgtgaccggcacactgaccgacgccggcatcgcgttaggctcctggctgcgcgcatccttcagtcaaagcgaggccgccgatcgcgatggccaccgaaccgtgctttttactcatctggttacgatcttctcatttctgtccggctgcgttatcggttatctgctgttcagacaccttggatttgaagcgatggcggggttgggcattgtgctggcgctgatcgctgtcggtggtatcgccagaaccctgcatttaaccggcatgcgattttggtaa

SEQ ID NO: 98725 - DNA, 324 bp, Glycine max
  Peptide Sequence Number=SeqID_215503
atggtgtttcatttgacaagtttggctttgttggtcattggctgttctagtacaatccatcaagagaatgaattgaaaaatgatattcatacactggttgggtgcctactgcctagtgtatctcctggccaagaattagagacaaatttcttgagactcccgaaaggcttaaaagagcaaatgttgtcacacatgcaattgaagtttaagactgcagagttacagcaagaagtctctgatgattttatcgcccagctggtgtcagaaacgaaagcagaatactacccatctaaggttttaaaattggcattgtggctggcatga

SEQ ID NO: 98726 - DNA, 261 bp, Glycine max
  Peptide Sequence Number=SeqID_215504
atggaacacgagcatcagcatctcaaacttcctcaatgcccaccttcaccagatgacgtggtgcacgattgtcaactgcttgcagttggtgtctcgctaagcgaggcttgtgcacttagcgagaatcatgcgctaggcgaggcactcaacccgcttagcgagttaggagaatctgagaaacatctgcgtgctcagcgcatcatcagctcactctacgaggcatttgtctcttcccacgctaagcgcacccagctcgcttag

SEQ ID NO: 98727 - DNA, 555 bp, Glycine max
  Peptide Sequence Number=SeqID_215505
atgttgtgtgcaactttcaacatcgttttttcagaactgaatccttctacctatgttattgttgttacaaaagcaaagggaaaagagcgttttggtattggtccactgatgcttgagcataagcttttagcctatgtggttgcttgcattattactctgagggggagcaatcatgctcagttgaccgaggaggatcttctccttatcaatctaatgcaagggaagatgaagatcaaatggattaacattcttgtttatatcatgttgaagacaaagaggattggctctttcaagtgtccctatgcagttttgatctccaggattcttgactattttggtgttgatacccaagaggaagtatttggttttgttgaggcaaagtttgaagtgaagacaaaagtcttgaagcaaatggggtacatcaagattgaagaagatgggattggatggattgagaagaacagagaggatcaaacagaacaagaagaagtagaagagaagcccatgagcccctttgagcaaatgatgctagcaaagatggatgagcatggataa

SEQ ID NO: 98728 - DNA, 441 bp, Glycine max
  Peptide Sequence Number=SeqID_215506
atgaagtttgcttctacaagatgggatgaagcagcaagagcctatttgtttcatctagtcggttgcaccttatttgctaataaaattgcaacctatgtggaggtaaaattcttagatttttttcgtgacctcaaaggatgttccatgtattcatgtggcacaactaccttgacttatctttgtgagcatcttactagtgctagttttgatggcacaaagcaaattagtgcctatgccactcttcttcaggaaacacgtcataggattggtcgactactacagcgtatgattgatcataggttggttacccaaggcactgatgcatattttgtgactgaagaggcattagcattagcccgtggagtaactgatgatggtgctatgaacaccaatagggcacgaggtgacaccaaaggtgggcatggcaaaggaggacattga

SEQ ID NO: 98729 - DNA, 225 bp, Glycine max
  Peptide Sequence Number=SeqID_215507
atgaagaacggtggaaaaccttcacgaaatcacccacggaaacgtctcggaagcgttatggaagcgcttcggcttgaattttctaaacagaaacaatttttctcacaaatttcaagggaaaagagggaggtggttgccgcccagctcgcctgggcgagctgggttgcttccaccagaaggcaccgccttttgttggaacaccctgaaaggtccaagtgggcctga

SEQ ID NO: 98730 - DNA, 381 bp, Glycine max
  Peptide Sequence Number=SeqID_215508
atggaaaaacggaaagcaacaagcaatttccgtcattccaaagacatgcatttatcaaatggtgaaattaatttggcacatccaaagcagcgccagaccaagttaaaatctggtcaagcacatccggaattcctgaaagtggtggatacaaagacttcattgtttttcaatcaaaagtctcagttagctgctttcctagccaactcgaagtcaaaagaaagtctggctaaaaatttgaaggaagtcctacaacttcttcaacaagaggaagatgaaggctcgtcatccaaaagggaggaaaatgaatcctcagaagaaaatgatgatccattctaccaaaatgaagatgattgttttggtatctcactaaatgatgattaa

SEQ ID NO: 98731 - DNA, 1037 bp, Glycine max
  Peptide Sequence Number=SeqID_215509
atgaccacattcatttgttccattggtgtcattttgcttcatgtcaaggacagggtgttggactcaatcagagaacgtggtcatttattgatagcggagaatgaatattcggtggtcttattccaaaatgataagggttttcaagatgggttgaaactaatcattgaagaccaacatgcattagagttagcaaagtatgcaatcaactgcaatgttgaagtccatatgtatgttcaacatattccccatgctaaagttgaaatacttgaacacgtggtggatggagagagtgttgctagtgatgttgatatgcaacatccaactaatgagggtgctattgatcaaggtgatgtgcatgtagttgatgatcatgttgtcggtgttgttgatgctactgaaaagggtgaagtgcatgatcaagggggtttggaagcagacattgaatctaaaagtagtgatgatggtaactttaacccatctatggtggatgagaatagtgtgcagacaagtttggagtttgagactgagtctaacgttgatgatgatgcctctatagaagcacatggcactggcataaatgaagaattattttttgattttttggacatagttgatttaaatgaggactacttgattgaagaattgcaaagtgacaatgatggagagggaggtttcgccaacaaaccaaggatatttgtaaagactcctagtggactgggaatggaattcagcacactagcggaattcaaagatgtaatgttggagtattcagttctaattggtagagaagtgaaccaagaggtgccgacaaatttgcccaagcgagctaaactcgcccaggggaatatgttgcttggctttgaaggcactcactcacccagcaaaaggaaggagggtcttgttggtgaagagataatcgggggagtagcagaggaggtgagtgatgaaaaggaagatggagcaccaagtgtccctaccaaggatgttccttatcctttggaaccttcaaagaaggataaagagttccattttgcaag

SEQ ID NO: 98732 - DNA, 285 bp, Glycine max
  Peptide Sequence Number=SeqID_215510
atgaagcattcacccccggaaaaagccttaatgaacgccattgaatgcctcatgaatgaaaaagagaaagatctcaaggcttgcttggatgatctaaacaaattgaaggaaattcctccaagggaatatgcctttgaaaagctgaagaaggatactcttgcagagaaacctaaggtggagttgaaggttctacctcttcaccttaaatacgttttctggaagaggatcatgcataaatggttgtcatcagcaatgctctatctccaaccaaagaagcacaattag

SEQ ID NO: 98733 - DNA, 300 bp, Glycine max
  Peptide Sequence Number=SeqID_215511
atggctcttcctcctctctgtattcttcttttcctcgtctttctgttatcagcaacatcaacacaacaagaagaagagttcacggaggagttgctgctgaagcccttgcccgatcgcaaggttctcgcgcatttccacttccaaagcgattctcctcctctcgccgccgctgatgagtcctcctccttcgatcgtcaccaccacctctttcccaaatctatttctcagctgatgttggataagatttcagaattggattctgagttgaagcaacttggagcagcttttacgttggattaa

SEQ ID NO: 98734 - DNA, 567 bp, Glycine max
  Peptide Sequence Number=SeqID_215512
atggaacccgcacacgcttgtgcatttgcacatttgagaagaaaactcattcaaccaggagctcgtggaaaatgcccaaagacaattatgatagtaggctggatcgacagacccttgagatcactctatgactttaaatcaagaaagtttcacttggtcacataccaaagtgtgacaatccattgccatccttcaatggggtgcaagatcgatcccaaagccttatgtttttattcaatcctacccccaagggtattggatagaagcctccaagaggattgggctagagctgctaaagaaggccctagggttctcatgaacctcagggacattatgagtagtctttgtagtagggacttttttgtattttcatgtattttggcatggggtgagcttagctattctaggaggtgtttagttaaggctctagcttctcatctcaaggagacctcatttgaggcacaaaatttcgtgctcctctcccttcattcatcttctcctaccttcaagctcttatccatggcttcctatggtggtaagcttgttcttgactcatcttctccttga

SEQ ID NO: 98735 - DNA, 285 bp, Glycine max
  Peptide Sequence Number=SeqID_215513
atggttcttggggcaagtagtccccttgtacttgtcaaagtccgacaccttgaacttgggaatgaccatgtttgggtactaggaacagctcttctagccatagtaggaggggctcttcccaccgcaaaatgcaagggttgtggttgtggacgaaactgtgggccctccaaagtgtttggcatgagtataccaccaactgcttgcctttcagtggcatattcgaggcaaggctcgaagtcggctagattgtggtggggaatttcgtgtgtatcccccacggtttaa

SEQ ID NO: 98736 - DNA, 432 bp, Glycine max
  Peptide Sequence Number=SeqID_215514
atgcgtcaggtggcaggcggatatacccaagtgattattcgtacaaagacaacatctgctgatcctgacccatgcgtcagagacgccctatacggtaatccgcacacatttcaaagacaaaaatgtcttcagtcattggatgccttcaaagacgacaatgaccctcatttacatttcgaagactacaacggaaacttctcggattcactcacggtggaaaatcttcatggatttgttcacagaaacgtctcggaagcgttacggaagcaccttggtttggattttcttcaccgaaacaagtttttttcatccaaaacagctgaaatgcatagcataggggtcaaggataaatttacacagcccccttcccctatttatagccaaaatgcggaggtgtttgccacccagacgcttcttgaggaagatttttaa

SEQ ID NO: 98737 - DNA, 144 bp, Glycine max
  Peptide Sequence Number=SeqID_215515
atggcgaaacgcatgccatgctgccacatggaaaggaagggaggagaattgggaaaccaaacccatcctcatctcattttcactcccctccaattttggggggttttaaggagagggaaaaaggatttagaacattttaattga

SEQ ID NO: 98738 - DNA, 189 bp, Glycine max
  Peptide Sequence Number=SeqID_215516
atgccttctttgacttccggcatgtcacggaactttacgaattgcctaacgatgggtgccaagtacctcgaagtggtcaaacaagggtcgcatcccaacaacggatggtcccgggacgaaattagggaactgacaatttatcagcaatttgtcttgccgcctcagatgtcatcttcccatatcggttag

SEQ ID NO: 98739 - DNA, 507 bp, Glycine max
  Peptide Sequence Number=SeqID_215517
atggttgctggtgctcttgtttctactttcgttcagatgacaattgacagtttggcttctcgttttggggactactttcgtggaagaaaacaccataagaagctgctgagcaacttgaaggtgaagctgctagccatcgatgttgttgctgatgatgcagaacttaagcagttcagagatgcacgggtcagagattggctttttaaggccaaagatgtagtgtttgaagcagaggatctcttggaagaaatagattatgaactctccaaatgccaagtagaagctgaatcccagcccatttttaacaaggtgagcaatttcttcaaaccttcttctttgagctcttttgaaaaggaaattgaatcaaggatggaacaaatccttgatgacctggatgatcttgaaagccaaagtggctatctaggtttgacaaggactagtggtgttggggttggatcaggatcgggtagtaaagtgttagagaaattgccatcagcatcttcggtg

SEQ ID NO: 98740 - DNA, 237 bp, Glycine max
  Peptide Sequence Number=SeqID_215518
atgcctaggcagacgcagggtgatgcacctcaggcctcagacgcaccgccaccacctcatcaggccgatcccgctggatcgctaggcatggagcagcagtttagggctgaggtcgcatggcccgaggcccaggcaggggagaagcccgcaggattccccggtgaggcagaggaggctcgtatggatgaagaaatgacggacttgcttggtttctcgggaggaagcggagccatgtga

SEQ ID NO: 98741 - DNA, 261 bp, Glycine max
  Peptide Sequence Number=SeqID_215519
atgtttttcagcatgaaaaacacgattttcactctctcctcctctccaaacgccacccaaaccctaacacctccttctccaccactcatgaccactagtggttgccatgagccgtcgttgcttgccgtcgaacccccacaccaagaggaacattttaatcaaagtggaatccttagaatcctcctcaaggattcggtggagaaaattcccccaatcctccatttcaaagcttctatgagggtgtttttacacttcctttga

SEQ ID NO: 98742 - DNA, 1623 bp, Glycine max
  Peptide Sequence Number=SeqID_215520
atggaagctcggatgaggaagtaccggcaagtgagtccagagagggcaaaagtgtggacggaaaagtccccaaagtaccatcagaaccggaaggtgccggtgctttactatctttgccggaacaggcagctagagcaccctcatttcatggaggttccactttcatcccctgatgggttgtatttgagagatgtgattgatagactaaacgctttgagaggtagaggcatgacttctttgtattcatggtcgtgtaagagaagctacaagaacggatttgtgtggcatgatctctgtgaagatgatctaattctacctgctcatgggagtgagtatgttctcaaaggctctgagctattttacgaatcaaattcagaacgttttggccccattagcaatgggaaaatacagagcctgaagcagttaccggagccggttacttgtaggagccatgatgaggcttccacttcttctagcatgactgagaaagagacaagaaactcccaagaagatgatgacctttccccaagacaacaaaccggttcatctgatgtgtctccacagtctagagctggaaagagtgattctcttagcttaccgttgacagaataccaaatctacaagaatgatggattggcagatgcttcaactcagacagaagaaaatgttaacaaacccgaaacccagaaaacttgtaccaggggtgtatcgactgaggatgatgggtcattagaacctgaatgccatgaaataggtgaaactcaagtgccgcaagtgaaatataattctgaaatctgtagggatactgtttctcctcctccctcaactccatcctcttctggagggaaaactgagactttggagtccctgataagagctgatgtgagtaaaatgaacagctttaggattctggaagaggaacgtattcgaatgcaaaccaatgcaaggctgaaagcctcaaatctgttgatgcaattgatctcgtgcgggtccatatcagtgaaaaaccatagtgttggccttattccttcctataaggataggctttcccactcgaaattcccctccccgttgttctcaacttctgttacgtttggagactttgattgcgtagcggagaaagcaaaggtgatgggcctcaaattggaagacaaagaatattatagtgggagcgtagttgagtctaaagtactgaaggaaggagacggacatggtgttctgaaacgctcttcttcttgtaatgctgagaggacatctgaagagttgaaatcacaagacacagaggcgtcatcatccttaggaaattcaaaatatgctccacagtcagttaaggcttcatcaaccaagcagcaaccaagtgaatgcatgagatctcctgtttctgatggatcaagaaattccacggataaaacttatggtttaggcatatccccagtaccatctatcggtagcagcaaaagaatcactgaactttcagcaggatcagggagaaagcaatctaagagggtagactcatttagagaagaggagagggagtgtgttcttacttcttacagttttcagtcattgattgacgagtttgattttaactctacaggcttgcttcaggagctcgggttataa

SEQ ID NO: 98743 - DNA, 564 bp, Glycine max
  Peptide Sequence Number=SeqID_215521
atggttaagactagaggattaggccatgccttaggtagggttgttggcagaggtctggggagaggggatggtgatgattctgacggtgctccccaacaccgaaggccgactgcatcggcacacaggcgacgggtaactgtcattgttgacgatgttgtgcctgcggtacctgcagactcgtctgcggtaccagagacagaggctgttgtagctagggatgaacccatggtagatgctgacgcacaggacaccggtccagatactgacgcacaagatattggtacacaggatgctgcagatgagcctgagggatttcttggtggacccaaggacccatcagtgcttacggagtatgctgaccatgttgcggccaacgtatggtctggacaggaatgtcctgagttgatgttatgctcccatgggaggaaggaacataacttaggcaggcttgttcctgcaattgatgacatggttgctgggataggattaagtcctttgatcgcgtgttcgatagacaccggcgatcggggacttatatcctcctttgccgataggtggcactag

SEQ ID NO: 98744 - DNA, 357 bp, Glycine max
  Peptide Sequence Number=SeqID_215522
atgtcttcctcttgcgaatcatgtattcctattgtgcaaaaatcaaatgcagatgacctaaatcccctatgcggatcaatgaaatgcctacaaacatgcaactacactaaaccaacaatcaacaaaagagaagaagacgaatgcgcaagaggaacagtagttgcaaaaggaagacgaaagcgcaggagcaaccacgccgttggcaatgtcaaagacgtacgttcacaagaagatgaacggcggaagggaggaggcgcggaaccaaacttgcaaagaaggaagcaggaagcaagaaggtcacagcggaaggaacgcgcagaagagctggtgatgctgggtgtacaagttttaatttaa

SEQ ID NO: 98745 - DNA, 189 bp, Glycine max
  Peptide Sequence Number=SeqID_215523
atgattgtcagggcaaatattttggggatgtggcctcaaacgagaaggtgttccccctttctacaaagttcattactctccggtaatggtggtgtgccctcaaacgagtggaaagatgttcctgatatttggagatcttctgctcagaagtatggtgatacaatagttcattactcttttttgtcatga

SEQ ID NO: 98746 - DNA, 756 bp, Glycine max
  Peptide Sequence Number=SeqID_215524
atggacaaccaacgtagccctcttctaagttgggcttactacttccagggaaagtcaatggaggagctgaggcagtccctgatatacacaactctggagctagaacaaacaagggttgcagtgcaagaagagcttaaaaagagggatgaacaactactcaacctaaaggacctcctgagcaaaaccataagagagagagatgaggcacaagagaaatgccagagacttctcttggagaagctagttttccaacagcagctacaacatgcagctcctgtgtctggaatttcaagcattgaggatgagccgagaagaggaattgactccaacaatggtcattcatcatcagattgtgaagaaagcatcgtttcctctccagtcattgaccatttacctcaacctcaaccacaatcaatgattgaactaacaccagacaaaccattaccagaaaagggtaagcttttgcaagcagtgatgaaagctggtcctctccttcagacccttctccttgcaggacctcttcctcaatggagacaccctcctccaccacttgagtcctttgagattccacctgtcaccattccctcaccaccaccaccaccactacaactactccaccaagacactttttttaacaaaaccaacggtagcagcagtaccacaaccaactgtggaagactcagtagaaaaagggtcttctgtgatggctctgattctcctaccgagaccaagtaccaaaggcttgtacttcactga

SEQ ID NO: 98747 - DNA, 198 bp, Glycine max
  Peptide Sequence Number=SeqID_215525
atgtggaatgtcttactgtgcagtgcaaaatgtgcaatggtgatatatggtcaaggcaagggaagaaaaagtcacatggatagtcttcaacagaggaaacagatagatgtaacgaatctagctagcactgctttgaaacattacatcgatacatcatttccagtgatggatgccagaagtcctgaaaaacgcgcttaa

SEQ ID NO: 98748 - DNA, 396 bp, Glycine max
  Peptide Sequence Number=SeqID_215526
atgaagtctgaagtcggtttatatcttagctgtgaaatagtaaattatccttctccccttccgcgactccactgttcgtgcagaccccgcactacggcgcctctctctcccttccatgcatatctgagaaaggcattgcattttttttctgatttgagaaagatacggtggttgcggtttgcctccattggcttggaagggagagtcatcgtcgtcgtcgttgccgccgcaacgttggttgcggatgtgttgacacagttggcttggaagggagagttgttgcggtggttttgcctttgtcattggtttccttcgatgtcgtcgccgtggtggttgcggtggtgtcgccgccgttggttcttgatagcgacggcgcggtgtgcttgctgttggtaa

SEQ ID NO: 98749 - DNA, 1377 bp, Glycine max
  Peptide Sequence Number=SeqID_215527
atgtcagagcagaagaaaccccccaaaagcagagttttctatcttagaatgaagctcctacacaaacaagggaacaagcctcaacaagacaagaacaacaactggtttcacacatattacaaatgggttctctggctttctttttccctctatttcttcacttcctatctcatcaccagcaaccccaacaacactaacacaccaacgtctcatgtttcaaactccgaatccaacgttgtccctcgtacccttgtcgaatccacttccaacactctaggggtgctgaagaatatgaaggtgtttgtgtacgagcttcctccaaagtacaacaccgattggcttgcgaacgagaggtgtagcaatcatttattcgcttcggaagttgctattcacagggcattgttaacaagcgaagttcgcacgtttgacccatacgaagctgatttcttcttcgtccccgtttacgtgtcttgcaacttcagcgccgtcaatggcttcccggcgattggccacgcgcgcactctcatatcctccgccgtcaacctggtctccaccgaatacccattctggaaccgcagcagaggatccgaccacgtcttcgtcgcttcccacgacttcggcgcgtgctttcacactctggaggacgtggccatggctgatggaataccgaaaattttgaagaactcgatagtgttgcagacattcggcgtcattcacccgcatccgtgtcaagacgttgagaatgtggtgataccgccttacgttgcgccggaaagtgtacggagcacgctggagaagtttccggtgaacggacggcgagacatttgggcgtttttccgagggaaaatggaagtacatcctaaaaatgtcagcggacagttttacagcaagcgagtgaggacggagatatggcggaagttcaacggtgatcggaggttttacctgcagaggcgtaggtttgccggttaccagttggaaattgcacgttcggtgttttgtttgtgtccgttagggtgggctccgtggagtccgaggttggtggagtcggtagcgttggggtgtgtgccggttgttatcgccgatgggatacggttgccgttttcctccgcggtgaggtggtcggagatatcgttgacggtagctgagagggacgtggggaagctggggaagattcttgagcgcgtggcggcgacgaaccttagtgtcattcagaagagcctgtgggacccggggacaaggcgggccctgcttttcaacaacaacaagaaggttgaggaaggggacgccacgtggcaagttatggttagtttgagtgagaagctgggtaggtcttaccgaaggtctttggttggtgaccaattgaagagtgacacgtaa

SEQ ID NO: 98750 - DNA, 507 bp, Glycine max
  Peptide Sequence Number=SeqID_215528
atgcatgccaagaaaaatgttgatgacagtgaaattggcacccttcttaacattcaaggcaagacaaaggatggtttgaaatatcatcaagacttgcttgacatggtatacgagagcagttgcatccgatatcacaaggtcaacgaatatttctgcccccaacatgtcacacaatgtcaacaaaagagaaaaaacaaagtcattgaccctcgacaattggatgatttggagaatgaggctaccattgtcctttctcaattggagatgtattttcctttgtcattttttgacataatggttcatttaaatttgttgggcttcctgaaactcgtcatgaccgaacatgaggagaataagccagacaagtgttttatgtccaagatccgtgtgattcaagattgtcagtggttctataaggaagacccagtggtatcaatcaccaaaatgatgattcaacacttgacatttctgagacgcatgctttctccacacgaatgccttctataa

SEQ ID NO: 98751 - DNA, 249 bp, Glycine max
  Peptide Sequence Number=SeqID_215529
atgagggataaggaacaacatgccatgcaaattcataaaagaaccaaggataggcctagagccatccattacagccaccaatccaagcattttaatcatggatggagatggcacttacttgagtgggatgaaaggaatgcaagaataaatgacacaaaggtgcataaaaagcttgaagatgctgctgctaatggaattctcgtgagtccttatgtaatggcttttgatttttgggggaagatggggtga

SEQ ID NO: 98752 - DNA, 522 bp, Glycine max
  Peptide Sequence Number=SeqID_215530
cgggtagccccgcctgacctgaggtctcgttgggagcgtgcgtgcacgcaaagggtcgtcgatgggtcagaactgaccggctcgcacgtgattggtctcgagcgtggctcatccaccatttatcacggcgaagtcggcatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 98753 - DNA, 456 bp, Glycine max
  Peptide Sequence Number=SeqID_215531
atgaccactgtcgtcaccaccaccatcaccactgccaccaacgatggtgacaacaacgaccatgttggtggcgacaacggtagtcatgacgatggtggcggcggtagtaacaacgaaagtaatcatattggtggtgcgacggttgacaatcatggtgatgattacggtggcggtcatgatagttgtgatgaaaatggtcatgacaatgatggtggtcatggtaatgataggtttgagatatttggagatcatgttggtggcgacgataatggtcacgatgacaatcacgacgatggtgatagcagcaacggcggtgatgatggtggcgacgacgatggtcatgacaatgatcacgatgatggtgacaacgacaacaacgatgatcatgttggtggtgacgaaggtgatcatgatggcgatagtggtggttgtgatagcaatcttaatgtaaattaa

SEQ ID NO: 98754 - DNA, 249 bp, Glycine max
  Peptide Sequence Number=SeqID_215532
atgataggcatcttactgaggcaagtatgcgagcgaggaattccaatgtgtatggattgctcgagccacagtctatttagagatctgggcaatcgcaatttgaatcagaaagttggatgcagagttcaaaacgcgatgtctaccttggagcctactattcggcttccggcaagtgtaccagatcgcacaagtagtataaaacgaaagaaagaaaatcgcgtgagggaaatgatgtgtaaaaacaagtag

SEQ ID NO: 98755 - DNA, 1044 bp, Glycine max
  Peptide Sequence Number=SeqID_215533
atggaggaccccactttgtttcaccaataccctatggataattctgtattattccagctcgaagatcttgactttgagtccttctccgcgtccccaaagaactcttcctctcccaagcgattcaactccgaaagcacacaaaactcttccctcactcaaaatcctgaacaatattctgttacccctccaagaccaaccaagcaaaataagactgtgagcactacttggagtgcttacaacactcatgacatgatggctccgaaagcttcttcttcttcatcctccaagatcatctcctttgagaactccaatgcatcttcggttacttcccaacaactatacaacgtggatgctgcttccaaagtgaagaagcccaagagtgaaactgggtatggtgaaaacttggattttgcagcagctgcggcttctcaaagtgtctatgacaacaacagttttctagatcactatgatactcgagagaaaaaggctgcagcttcattgactagaaaccctacccaagctcaagatcatgtaatatccgagagaaaacgaagggaaaagctcagtcagaggttcattgctctttcggctataattcctggactcaagaagatggacaaggctaccgtcttggaagatgctataaagtacgtgaaacaactacaagaaagggtaaagactctggaggaacaagctgtggataaaacagttgaatcagcagtatttgtgaagagatctgttgtgtttgccggtgatgatagctccgacaacgacgaaaactccgaccagtcgctccccaaaatcgaagcaagaatttctggtaaagaggtactaatcagaatccactccgacaaacacagtggaggagctgctgctatactaagggaattagagaagcatcatctcacagttcagagtagcagcttcttgccctttgggaataacacttttgacattactattgttgccaagatgaacatggactactgcttcacagcaaaggatctcataagaagcttaagtcggtgtttgaggcagctttga

SEQ ID NO: 98756 - DNA, 333 bp, Glycine max
  Peptide Sequence Number=SeqID_215534
atgtttgcacattcgattagaggctgccgtcccttgggacgggcgtgtggggtgctaataccttccccgtgcgtaaatacaactcccgaacctttcaacttaaaagttcgtagatcgcgtcttttccggtttttccgacgttttcctcaaataaacgttggtggcgactccgcgcgtattcctttcgtggaacacgcatcccgcgagtcacgcgtcgccctcccgccgaaggatctagtgcaggagtgcctgatagtgaatcctgagaaagaggaagatctggcactggtgcagatgactcaggctgagaagaagacatgtccagcactgtag

SEQ ID NO: 98757 - DNA, 645 bp, Glycine max
  Peptide Sequence Number=SeqID_215535
atgagattaagcaaggtggttggcaaactggtaaatgaaagtcagttaacatttgtgggaggacgaaatgtgctagattcgatggtagtagtaaacgaatgcatgcatgaggtgaagcgacggaagagatcaacactaatattcaaggaaaactttgaaaaggtatacgatgtcgtgaggtgggatttcctctatcacatgatgaggagaatggaattcagaggaatagttagagaagtgaacaagaaaaatttgatggaaggggtggagataggagaagagaacttggagatctatttacaaaaattcgaagatgaccccattgtatttctaaaaccagatttaaagagtgttttgacactgaaggcaatcttgataagttatgaagtgacagtggggttgcgtgttaatttccataagagtaccattggagggataggagtttgtgaaagagatgtacagagatttgcagttctactaaattgctttaccttggaaatgccctttgtttacttggggattccactaggggcttctcagaaaaggattcgaactcgggaaccagtgctgcaaaaaactaaagaggaaaatgacgccatggaagccaaaattactctcaattggggggcaagtttgtcttattaa

SEQ ID NO: 98758 - DNA, 132 bp, Glycine max
  Peptide Sequence Number=SeqID_215536
atggattttccttgcattggccgatgcatgcgggctaagccgccagattggcttcttgcgctaagtggacttcttgggttgagttatcttgatgcgctaagcgaagatgtcgcgcttagcgtaacactttag

SEQ ID NO: 98759 - DNA, 1620 bp, Glycine max
  Peptide Sequence Number=SeqID_215537
atgaagctgaacagcaagagtttgagattgtcttgcaaatcccacaatcccgggatcaaaatctcaacttgcacactacccaatttcctaattcgaattctccttctgtgtctctgttgtttcttggtccctgcatcttgttcccggaagcccccacctcttccaattttgcccctcccaacgactttccagctccaatggcaacttgacggcatggccctcttcttccacttcggcaccaacaccttcacagactcagaatggggcaccggccacgccaaccccaccgtcttcaatcccactaagctcaacgcatcgcagtggataagggtcgccaaagattcgggcttttcgcgagtgatcctcactgtgaaacaccacgacgggttctgcttgtggccctctgattacaccaattatacggtgcgttccagcaactggaggaacgggaacggagacgtcgtcgccgagctcgccgccgccgccaaggatgccggcgttggactcgggttttacctctcgccgtgggatcgccacgaggcatgctatggtgacacgttgcagtataacgagttctacttggcccaaatgactgagctactcactagcattcaaaccaggtatggagaggtaaaggacatttttctggacgctgcaaaggaagacgagacggatatgcattatctctttgatagctggttttccctgattcaccagctccaaccaggagccattgttttttctgatttgggtcctgacactaggtgggctggtaatgaatatggtgctgctggctccacttgttggtctctatacaacaagacaggctatgagattgggtatattgataaccaatacaatagcgagggagaccaatttggtcctgattggttacctgctacatgtgatgtctctattaggaccggttggttttggcacgcttcagaacaacctaagtctgcaaggagtttacttgagatatactataaatcagttggaagaaactgtcagctgttattgaatgtgccaccaaactcctcaggtctgatttcagacgaggatatccaagttcttcaagagttcgctgaacttaagaggtccatattttctcacaatctggctataaatgctgttattaatgccagcagcataagagggggaattcaagagactcactttagtccctacaatgttcttgaagaaggtatatacacatattgggctccctgggagaaccaatcgaagtggatattgtacatagatctccaagaactagtatccttcaatgttttgcaattacaagagcctattaacatgggacagagggtgattgagtttcaccttgaggctttgagccaagatggtgtgtggatgagagttgtaaatggcaccaccattggatatcagaggctgttgctgtttccaaaactgaaggctcagtatttgaagctagttatggacaagtcacgtgcagacccattgatatcttactttggaatttacatggatcctgttactattttgagcgacatatctgataaaaaatcaggagcctgtttcaatggaagtcaagttcttcaaaccactacaaacaacagttacccaagtgctacaatgtaa

SEQ ID NO: 98760 - DNA, 144 bp, Glycine max
  Peptide Sequence Number=SeqID_215538
atggttgatacaagaatcgattatcgtgaaggtggatacaatcgtagtggtagagattatagtgatgtcaattatgatggtgataaagactgtggttacagtcatggtggatcttgtttctctcgtgcaggagctgtggtttga

SEQ ID NO: 98761 - DNA, 1023 bp, Glycine max
  Peptide Sequence Number=SeqID_215539
atgggaagagctccttgttgtgacaaggcaaatgtgaagagaggaccatggtcaccagaagaagactcaaagctgaaggattatatagagaagcatggaactggagggaattggattgctcttcctcagaaagctggtctaaagagatgtggaaaaagttgcagattgagatggcttaactatcttaggcctaacattaagcacggggaattctccgatgaggaagacagaatcatttgcagcctttatgctaatattggaagcaggtggtcaattatagctactcagttgccagggaggactgacaatgatatcaagaactattggaacaccaagcttaagagaaaactcatggggttgcttcctgcatctcatcaaagaatagcaccctttcaacaatcctcacctcaaaacctttcttcatttccttctcactctcactcatcatcactatcctcttcaatctatagtgactactacaaccacaactctaatcattattacatgccagccccaacctcatctttcacatgccttgaaccaatttctgttccttcaagtaattacacgaacacaacaacagcctccaccttgaaccctttttaccaaaaccaagaacccttggctagtattattagtcccatgcagtattaccccatcaaagacagttccatgcttgtgtttggaagtgaaacaagttgcagttcctctgatggaagctgcagtcaggttagccttggaagagaggtcaaacaagaagacatggggtttcagaatttcatgtttggagaccatcagaacatgaacaacattaatcatgatggaggtgaagaatatgtggaccaatggacacagaagccaaacgggcacatttttcagactcaacaaacagcaatggattatgatcttgaggttattaggaacctgattagtagcaacagtaatagtagtaatagtaataatgagtacttgagtgttgatgaaaacaagacggaggagaagggtgtgtactacaactactga

SEQ ID NO: 98762 - DNA, 990 bp, Glycine max
  Peptide Sequence Number=SeqID_215540
atggataaagaaattcccgccgttaattggaccctcgttgggccaaccctccttatcagcccatccagtcagtcccatttaagtaaattgcttcctgcacctccaaaagactcaaataaacaaaacaccatcttgccccacctccccctaacctccccacaccacggctccatgcaaataccaccatcaaacaccacagaccatagtcgacaactccttgcaagaaagaagacgctgatggagaaaaagacaaagagtgttatccttttccatgacttatcaacaggtttgaatcctcatttcccgcctctcactggaaagcagcaaaatcacctttgggtagaagtcatggtaaggctcactgctgacttgatttggaaaagccctcatttcttcaacacgattaaagagcgtgagttagatctcagaggcaacaagatagctgtaattgaaaacttgggtgctactgaggaccaatttgacacaatagacttatctgacaatgagattgttaaacttgaaaatgtaccatatcttaaccggttgggcacaatgctcattaacaacaacaggattactagaattaatcccaacatcggagagttcttgccaaatttacacactctagttctcacaaacaacagaattgtaaacttggttgaaattgatcctttagcatctcttccaaagctgcacttccttagtctgctggacaacaatattacaaagaaacctaattacaggctttatgttattaacaacctgaaatccctccgggtgttagatttcaagaaagtgaaaaataaggaacggttggaagccaaaaacttgtttgcttcaaaagaagttatagaagagattcaaaggacaccagcaaaaacattttcaactggtgaaactccaaatgtttctgaggcgattgaggaacaacagacgcccaaagtggttgctcctacacctgagcaaattattgctattaaggtacaatga

SEQ ID NO: 98763 - DNA, 264 bp, Glycine max
  Peptide Sequence Number=SeqID_215541
atggttggtttcacacctattccaacaagacataagacacccatgtccgctccgaagccattgctcattttggcgcgcaaagtttcaagattaaggaaagataaaggacttaggggcatccataatggtatcatcggtggttatcatgaatggctgaaagttcgtacacgagggttagattggctctccaagttgaaaattatcaatgaggagaacttcaaagctccggaagaggatgaagaagttcgagctctaaaaacataa

SEQ ID NO: 98764 - DNA, 312 bp, Glycine max
  Peptide Sequence Number=SeqID_215542
gcattgaagtctggtcagcttcctgcagatttaataagcttgagtgataatataatgttggataatgttgatgaaaaacatgaggacatgattcatgatgatagaagtcaagctgatggcaaatcgaatgatacacaagagcagagaaatactgattctgcttcaatggaacaggtttataagtgtgtatttgatgtttgcatatatagcagtttagcactattttatgtgcaacttaatgaagcacagattagagtgaaaaggttttcaaatagtcctagcactgtggacttctttaatgtcaggttctag

SEQ ID NO: 98765 - DNA, 555 bp, Glycine max
  Peptide Sequence Number=SeqID_215543
atgaaggccgacgtggaggccatgaaagaccaaatggccgccatgatggaggccatgttgagcatgaagaaaataatggaaagcaatgcggctgtagttacccctacaagtgtcgccactcaagtagacccaactcacccatcgggcctcaatcaattaaatcctccaatctcggatatggtaggtcagggaggagaagcatttggaaatacaggtggcccctatgttgtgaagagcaagaattctttcccatcatacgacttgcctcctaactatgcaccacccaatgctgtaccagtgcttgacgagaatgccaacaactccacacctatacctattgagggccaacaaccccaatctgatcatgcacatgctcacctcggatatgccactaaggggcaggcattttgtggcgtacccctgccaaacactttgtggggccctcagtatcacccacaaccacaacccttgcattctgtggcgggaagagtccctcctgctagggtgaaaagggagaaattggatcatatagaggaaaggctaagggccatttaa

SEQ ID NO: 98766 - DNA, 171 bp, Glycine max
  Peptide Sequence Number=SeqID_215544
atgtgtttcgtgaagaaaatccaagtcgaggtgcttccgcaacgcttccgtaaacgattctgtggaaattcttcatcgttcttcaccgtgcttcgttcgttcttcatcattcttcaatcttcaaccattttcttttcttccgctttaacgagctttttaccatttatttaa

SEQ ID NO: 98767 - DNA, 792 bp, Glycine max
  Peptide Sequence Number=SeqID_215545
atgacttccgcaaagccgaacgcgtggatgctgcaggcgcggcagaacccggtgtcgccggtgccggggacggtggacgtgtacgactggccgggccattttgtcgaccacagccacggggagttttacacgcgcatccggcaggaggtgtggcaggttgcgcaccacagcgtgagcggaacggggacggcgacgggcatcgcgccggggtaccggttcggcatcgtgaacgcgccgcacttcagcgacaacggagagtacctggtgacgtcggcgcggtacgacttcgaggagaacgggtacgcgagcggcggcggcggtgcgcggcacaacatcgcgttcacggtgcttccgtcgtcggtgacgtaccgcgcggagccggcgacggcgtggccgaagacgcacggcccgcagacggcgaaggtggtgggcccggcgggggagtcaatctggacggaccgctacggccgggtgaaggtgaagtttcactgggaccgcctggcgaagggtgacgacacgagctcgtgctgggtgcgggtgtcgagcgcgtgggcgggccaggggtacggcagtgtgcagatcccgcgcgtgggcgatgaggtggtggtggacttcatcaacggcgacccggaccggcccatcgtaaccggtcgtgtctacaacgatggcaatatgccgccgtgggcgctgccggcggcggcgacgcagatgggctttttaagccgttcgaaggacggcacggcggacacggcaaacgcgctgcgcttcgaggacaaggcgggcgaggagcag

SEQ ID NO: 98768 - DNA, 207 bp, Glycine max
  Peptide Sequence Number=SeqID_215546
atgtcgcagaatatccataacttgtctctgcgtgccatcggactcgatcgtctccggacagcaaaaagttgcgaaataaccataatttgtctccgcttgtcatcgggtttgccgcctctggatgaaaaaaggcgcagaattaccataatgtgtctctgtgtgccatcggacttgatcgtctccggatggcgaaaaggtgcggaatga

SEQ ID NO: 98769 - DNA, 633 bp, Glycine max
  Peptide Sequence Number=SeqID_215547
atgggacatgaactagaagaaacaactggcatcaaggatcaagctagacttcaacacagtgttatgattgttgtggaggtcgacaatggcaaaggcaaactgagagcctactttggcgatgaaattatgtttattattaatgagtaccacacttatcaaagttgttatgtttatggcccattttaccccgataagtccattagcaatgcctcatactcgatgcctgactcattccaaaatcactctttaaaggatactcattcattgggagaaaacgttacctcgaaggctcctatccggaggtcaagcattggtgttatattcatctacacgttttttgtagccattcttgcctttgtaaagaaagagcacttgtatcattttccagatgaagtccccattctcaaatctgatgaaagtcgtacatggagaattctatggtgtaacaaccaatgcaagtttggagatggttggtgtcagttatgcaaaactggaaacttcaatatcggtgatgttctaatattcactaaggaacccggttctcatgtaattcatgtgtcaagaggtaaagctcctttcatagaacaacttcgtaatggggaaaatagttattttataatgtttttcatttaa

SEQ ID NO: 98770 - DNA, 636 bp, Glycine max
  Peptide Sequence Number=SeqID_215548
atgacttcggggaacagtgtggggaccctcgatactggagcagatggaagacatgaggagacaatggagcaaatggaaggcataaggagggagaacgctaaagcaagaagggaaagcacagagatgttgattagcggaggaaccgatctagtgaagtgcaaattgtttgttggaacccttactagatttgctttggattggtttagtggattactgaacaattccattgcccattttaacgatttcttgcgcctcttcgttgcacaatttgcgggcaacaaggaatcgcctgccaccacgactgatctttttgatgttcgccaacacccaggggaatcattgaatgagtaccttacatggttcgatggggaggtcatttgggtgattgactgggatgaaaggatgatcatagcagccttctgtaagggtttgcatgcggagccgtttagggaatcactggtgagacgacaaccagatattgtggccaatgttcggtccaaagtaacctgtcacatagaagcggaggaggcaatgacaagaaaaaagcatttgagaaaaaggagatcaggtcggcttctgagtcaagttccaggtcttatgaaaggacttcttgaaacctcgtggaaattggaataa

SEQ ID NO: 98771 - DNA, 225 bp, Glycine max
  Peptide Sequence Number=SeqID_215549
atggcgactccacgcgtattcctttcttggaacaggttccgcgagtcacgcgtagcctcctgcccaatcatcttaaaatttaaagaatttgaaaagctcactcagttctcgctcgcgattttctcactctctcgtccgacgctcgcaatactcgctacgaccctcgctctactctctctgtctcacgcgcagtggtgcagagcgtctctcatctctgcgatttag

SEQ ID NO: 98772 - DNA, 204 bp, Glycine max
  Peptide Sequence Number=SeqID_215550
atggggcaaaacacaccgaataaaatagatgatgatggctcaaaatctcaccaagggcccttccggaacattttgaaaattgggttgcttaaggaggaagcaactgggcagcaagctcctccacggaggagacaagacgatgaaaatcaaatccgaaacacttccataaggcttcctaactttcccgtaaagtacgaacaggag

SEQ ID NO: 98773 - DNA, 956 bp, Glycine max
  Peptide Sequence Number=SeqID_215551
ggcgggctggagaggcgtaactttcacaagtgcctcaccaacttagctgatagtagcattgacctcgcgttggtgaaggagttctacaccaacctctacagtctcgaggggccttcacctaaacaagtcagaaaccggggccacttaataaggattgatgcagacagcctcaattcctttctagaaacacctgtggtgcttgctgagggtgaatctttgcccacctacttaagatattgcaggatccctactgacattagagaaattgagggtcacccagggaagatccttagaaaagatctaaccacccttgctcagctggacatgaatgttggagccctcatttctgggcagattacttctatggcccagtctaactcctcaagacttggttttcctactcttatcacagctttatgcaggaccagaggagttgcctccgacagtcttgtctttgaacgtttgagcccgggggccagaagaccaagggcaaagcttgttgaggcttcttctacatcaacagctcctcatctagcttctacatcagcagctcctcatctagcttctacatcagcagctcctcctccagctcgtattgcaacagctccttctaccctacctcctgcagattctcaatgtttcgaagccatgcttcgaagcatacataaggggcagattattttgctgcaaagtctccagctggtagcacctccagactccatccctacagtagagcaatttaatgaatgggtaggctggccagggactcagcctcctcctcaatgggacgacgaggatcccgccgctcaggtaccacatcagccatcggataagtcatcagagtcttccactcctgagcccttgatcaggaagaggagggtagttgtaactgaaattctgatactgaggacagatgtcgtacaggatgtcacgacatcgcgcttcagaacatgcag

SEQ ID NO: 98774 - DNA, 429 bp, Glycine max
  Peptide Sequence Number=SeqID_215552
atggctgtctcaatgtttttgcctgcccttatcttccagccaaaatttcttgatctagcttttggtgcagctttggcaattttcctgatgttagaaattattcgagtatggagaatctggcctttgggacaaccaataaatcaatttatgaacgcattcactgaccaccgtgactctgatcttctcattgtcagccatttctcactcttgcttggatgtgcgcttcctatttggatgtctactgggtacaatgatcgacctcttgctccttttgcgggaatattgagtctaggaattggagacacaatgtcaacaataagagcaaggacctggatcaacctggaaattttatactgcaagtctgataaatttttaaacaaggaagtttttactcctcttgttttaggcagtcatgatgatttttcataa

SEQ ID NO: 98775 - DNA, 1848 bp, Glycine max
  Peptide Sequence Number=SeqID_215553
atggtgtctgacgccagcaagaagaaggctgcgcagaagaaggcggccgcagcggccaagagaggaggcaaagcagcagctgctgctgcttcgtccaaaacgacgtcgtcggagaagcttgccgacggaattagggacattcagatttccgatcgaacctgcaccggtgtcctctgctcgcatcctctttccagggatattaggctaattgctcatgcatttacagtgatcagtattgtattgacgtgtttgtttatgccgtcatcacagatagaatctatgtcagttactttccatggacatgatttgatagttgattccgaattggagctaaattacggaagacgttatggcttgcttggattaaatggttgtgggaagtctaccctgcttacggcaataggttgtcgagagctacctattccagaccacatggatatttatcaccttaccagagaaattgaagcctctgacatgtctgcattggaggctgtcataagctgtgatgaggaaaggttgagtttggagaaagaagctgaagctttggcagcgcaggatgatgggggtggggaagctcttgaacgtatttatgaacgattggaagccattgatgcatcaactgcagaaaagcgtgccgctgaaaatttatttggtcttggtttcaacaagcagatgcaagcaaagaagacacgtgatttttctggtggctggagaatgaggattgctttagcacgtgctctatttatgaaccctaccattcttttacttgatgaaccaaccaatcaccttgacttggaagcttgtgtgtggctggaagagaatctgaagaagtttgaccgtattctggttgtggtttcacactcccaggatttccttaatggtgtctgcacaaatatcattcacatgcaaaacaagaagctgaagctctacactggtaattatgatcaatatgttcagacacgttctgaactggaagagaaccagatgaagcagtacaaatgggagcaggagcaaattgcctcgatgaaggaatacattgctcgatttggtcatggatcagcaaaactagctcgccaagctcagagtaaagagaaaactcttgcaaaaatggagcggggtggacttgcagagaaggtggtaagagacaaagttttggtattccgctttgttgatgtgggaaaacttcccccgcctgtcctccagtttgttgaggtgacatttgggtacacgccagataatctgatctacaagaagcttgactttggtgttgatttagactctaggattgctctggttggacccaacggagctgggaagagtacgttactgaagctaatgactggtgatttggaacctctagatggcatggttcgacgccacaatcaccttcggatcgcacaatttcaccagcacttggctgaaaagctagacttggaaatttctgccctccagtttatgataaaagaataccctggaaacgaggaggagaggatgagagcagccattgggaaatttggactatccggtaaagcgcaggtgatgcctatgaagaatttatctgatgggcagaggagccgcgtgatattcgcatggttagcttatagacagcctcacctgctacttttggatgagccaacgaatcatttggatattgaaacaattgactcattggccgaggcattgaatgaatgggatggtggcatggtgcttgttagccatgattttaggctcataaatcaggtggcccatgagatatgggtgtgtgctgatcaagctgtgaccagatgggaaggtgacattatggatttcaaggagcacctaaggtcaaaggcgggtttatctgactga

SEQ ID NO: 98776 - DNA, 807 bp, Glycine max
  Peptide Sequence Number=SeqID_215554
atgacgacgtcgtttctcaacggcgagagagcggtggtgctgttcttcatctgcagaatcctctattctctccctttctctctcctcttccatggcctcgctctctctctcctctcgctctcctccttcttccttgagatctccttcgattcttccaattccccttctcttttccgcaccaggccaggtgcttcttccggaattctgctcggcgctgtcactctcccttctctttttctctccaaattggtacaattgtcgcggggattctcactcgctcaacttcaacttgaagagattcaatatctgacattgcaatactgggccacatctgccagcgcctgcagcgttattttcctcctcgcctttgctcgacgtcgtgctcctttatccccttttcattggggtgtgaggtttagtttatgctccattttctttcaagctcttgtttctgttgctgccctttctaccacgtctcaaattgggttgcacccagcactgaagctaatgtgggccttttgtcatggcttggcatctgtgaagctaattcagcttttcctcagaacttttccctcttgtgcttccattggggaaacatttttggtgacttccggtattgttctctattttggtgacatgttgttgcttactattaaaaagttacatgaattattgatgtcatcagagttagttactgcagaatatgaaataagtagaagggcttgtgcttggtcttctgctatatccaatagctttgaaatatattctccaaatatgggagtggtctataaatacaacttctgctga

SEQ ID NO: 98777 - DNA, 1086 bp, Glycine max
  Peptide Sequence Number=SeqID_215555
atggaagaaatacagtctcaatcagataattatagatcttcgtcatcgtcggcaagcagcccggcaagtagggtgccatcaagtaactttttctacctgcgtaaacctggttcacttaggcagcccatctcttttgaggattcacctgagtgggaggatactgatattgatgttagagttgaggaaggaggtgactctattaatgtcgcaacaacaccagcttctccctctctttcaaagctcaacagtgggtccctgccgtctccacgtctaccggagggtgcagttattccgcggaaaattgctggggcttcagttgcctggaaagatttgaccataacgataaagggaaaaaggaagtactctgataaggttattaagagttcaactggttatgcgttacctgggaccatgaccgtaattatggggcctgctaaatcagggaaatctaccttattacgagccattgcaggaagattgcatccttctgccaggatgtatggtgaagtatttgtgaacggagcaaaatcacaaatgccctatgggtcatattgctattgcattgtggaattccttggaactgcaatcgcaactccatccgctattgtggctgatatgggtgttgtgggttatgtggagagagaaactactctgattggatccctcactgtgcgggagtttctgtattattcagctcttcttcagcttcctggtttcttttgtcagaaaaagagtgtggtagaggatgctatacatgcaatgtctttaggtgatcatgcaaataaacttataggtggacattgttatatgaaaggacttcctagtggggagagaaggcttgttagcattgccagggagcttgtgatgagaccgcatattttatttatagatgaacctctttatcatttggacagtgtctcggcacttttaatgatggttacattgaagagacttgcaagtactggttacactctcatagtgaccatctatcagagtagcacagaagtctttggcctttttgaccgcatatgtctactttcaaatggaaataccctcttctttggagaaacattagcttgcttgcag

SEQ ID NO: 98778 - DNA, 1188 bp, Glycine max
  Peptide Sequence Number=SeqID_215556
atgaacgaagcaacttacaacaatgtcgagagttatctgtaccttcacccaagcgaaaacccagctactgcccttgtgtcaccagtgctagaatcgactaactatcactcatggagtcgttccatgatcactgctcttagcgccaaaaacaaactggagttcatcgacggaagcgcgccggaaccgctgaaaaccgatagaatgtacggtgcgtggcggcgatgcaacaacatggttgtatcctggatagtccactctgtagccacttccataaggcaaagtgtgctttggatggataaagcagaagatatttggagagatttaagatcgagatattcgcagggtgatttattaagaatttccgaccttcaacaagaagcgtcaacattgaagcaaggagcgttgacgataacagaatacttcactcgactacgtgtcatctgggacgaaattgaaagcttcagacctgacccagtctgcacctgcaacatccgatgttcttgctcagtttctgccattatcggacagagaaagcttgaggaccgagctatgcagttcctgcgaggtttgaatgagcaatacacgaacattcgatctcacgtattgcttatggatcccataccacctatatcgaaaatcttctcgtatgtggcgcaacaagaacgacaattactaggtaattcttctcccaatctcactttcgaatctaaggaaatctccattaacgctgcaaggtccatttgcgagttttgtggacgagccggtcacactgaaaatgtgtgctacaagaagcatggtatgcccctcaatcatgaagcaagaaacaaaacctatgggggaagaaagtcttgtacccacagcggaaaaatgggccacaccgtagacgtgtgctaccagaaacacggctatccaccgggatataagccatacagtggaagaaccacggtcaataacgtggtgacgatgaatgacaaatctatggacgatcaaacccagcatcatgaagcccaagattccgttcgattctcaccagagcaacataaggctctacttgctttaatccaacggccattgactggaagcacggcatcggagcaaaccaaacaggttgcttcaatatcatcttgcaccactgataggcttcccaacccaggacacgaacactcgtatgaggattggtatagttga

SEQ ID NO: 98779 - DNA, 778 bp, Glycine max
  Peptide Sequence Number=SeqID_215557
ttgagccttcctcctatgctaaagcatctcagcatgactgctggattaaagcaatgcaagctgaattagatgctctacaatcgaacgagacttggagattaactcctcttcctccacataaaacggccataggatgcagatggatatacaaaatcaaacaccgagcagacggttccatagaaagatacaaagctcgtctcgtggccaaaggttacacgcaaatggagggccttgactaccttgacaccttctctcccgtagcaaagctaaccacagttcgctttcttcttgctattgccgctatgaacaactggcacctaagacaattagacgttaacaatgcatttttacatggagaattagacgaagaagtttatatgcaggttccgcctggcttgacaattcagaacccaaacttagtatgccgtttgcagcgctctctatacgggctcaaacaagcaagccgacaatggttcttgaagctttcaagtctcctgacaactcacgggttccaaaagtctcaatcagaccattcactttttttgcgttttactggatcaatcactactatactactagtatacgtggatgatatcattcttactggaaatagcagctctgaaatacaggagatcattaccatccttgatcaaacctttaagatcaaggatctcggaaatttgaagtattttctcggccttgaagtcgcgcgttcctctaatggcattcacttatctcagaggaaatataccttagatattttgtctgattcgggcat

SEQ ID NO: 98780 - DNA, 132 bp, Glycine max
  Peptide Sequence Number=SeqID_215558
atggagcagagaaaaagaatacatgtacttgaggagcttatggatatggtcatcaatgctggggcagggtatagagtttctgatataactgagagtatggtttcaataaagagaacttccacaatcaagtga

SEQ ID NO: 98781 - DNA, 552 bp, Glycine max
  Peptide Sequence Number=SeqID_215559
atgagtgaaataaaggaggtgcaagagcagatgaaggcagacaagaaggccatgaaggaccaaatgacctccatgataaaggtcatgttgagtatgagaaggatgatggaggacaacgttgccacattcgccacttccagcaccggcgctaaggcggacccgactcacccatcgggcctaaaaaatcctccagtctcagatatggtagggcagggaggtgaagcgttaggaagtacgggtggcccccattttgtgcaagttcaaaacaagcattccttcccaccatatggcttgcctcccaactatacaccactcgatgttacacatgctcccaatgagaatttcgacaactctgctcccacacctattgagagccaacaaccccaatctgatcatgcacatgtctctgaacccatgggggagacacatgaagcacctcgagaccacaatctagtcaacttcaagcctcacctcggatgtgccattgaggggcaagcatttggtggaatacccctaccaaacactttggggggacctcagtatcgcccataa

SEQ ID NO: 98782 - DNA, 198 bp, Glycine max
  Peptide Sequence Number=SeqID_215560
atggatggccctaggcctatccttgatcctattgtagattggcatgtcatattgttctccattcctcatttttacatacttgaacatgcaatggctccaaggaagcttctctctaagagggcaaggaaggatgccacggaagaaggatccagtgcggccttacaagcggatatagaatttgatggacaccgattctga

SEQ ID NO: 98783 - DNA, 430 bp, Glycine max
  Peptide Sequence Number=SeqID_215561
agggctacatgccctcgccttcaaaggactacacgtcctcaccttcagaggactagacatcctcgccttcaaaggactagatgtccttgccttcaaaggactacacgtcctcacctttagagggctacacgtcctcaccttcagagggctacacaccctaaccgtcagagggctacacgccctcgccttcatagggctacacgccctcgccttcataggactacacgtcctcgccttcagaggactacacaacctcaccttcagagggctgcacgtcctcgctttcaaagggctccacatctgcgccttcagagaactcaagaaggaggctatcacgcagctactctgcataccggggcaagatttcgcccaggccactacaaagagacgagtgcagatcatgcgcaccaacatgaccactcttacatag

SEQ ID NO: 98784 - DNA, 159 bp, Glycine max
  Peptide Sequence Number=SeqID_215562
atgacggcagaaatcaaccaaagtaagacgatgacccggtcaggattggccgcacattgtttgtttcctacttgcagggtcacgaccgaccgatcttcgtcccttcccggagctggacaagcagagaacgtcgctgcaaggaagcccagtatcctttga

SEQ ID NO: 98785 - DNA, 354 bp, Glycine max
  Peptide Sequence Number=SeqID_215563
atggcattcactgcgctgcttctgcaccgagcctcctatcttgccacggaccacagtagtcaccgcggtgcctctgcttctccgtgcaaacaatgcaatgatgcatcaaggcgtgagaataatatgaaggaaatggagggaggactactgtcataccaaaaggtgataagctctacagcccctgctagtcaagtgacatatccaacatacttgattgtgttgttctttgtcctttgccacaaatgccttcaaataatcgtgatgactgtcatggtcagccgcaagataagaggcatggtgcgaaagcggcgcagtgaatggtgggagatagagagagaacagagtcaaggctag

SEQ ID NO: 98786 - DNA, 336 bp, Glycine max
  Peptide Sequence Number=SeqID_215564
atgacaaggtggtggtcaatctcttttcactgcccgcgctcagtctcgctaacctaccttcgtcactaccattgcccctggccccccaagctgagtctcgcaaagccaccctcttcacatgccattgtccttaacccaccacgtagagtctcgcaaagccacctggtcgtgctctggtcgcaaagccaccctcttcactgccatcgtcgtgctctgatgcaatcctaccccccgagggcattggatagaagacttcaagaagattgggccagagatgcaagagaaagccctaaggttctcatgagccttagggtagattttgggtctatgggctaa

SEQ ID NO: 98787 - DNA, 819 bp, Glycine max
  Peptide Sequence Number=SeqID_215565
atgatcttgtatcctgaactttcatttctgccaaatattcctgttaatgctgaaaacaaggaactgcccattgtgctaaatacagtcttggctggaaggcattatgtaacagaatatctttgttcagctgccttcagtagggttgttcaggcacatgatcttcagacaggaatagatgtttgcttgaagatcattaaaaatgacaaatacttttttgatcaaagcttagatgaaatcaagcttctaaaacttgtcaataagcatgacccaccagatctacaccactttttgcgcctttatgattatttctaccatcaggagcatttattcattgtaactgaacttctgcaagcaaacttgtacgaatttcagaagttcaagcaagaatctggaggggaagaatattttacgttgaacaaattgcagctcattactcgccaatgtttggaagcattgcaatacttgcatagcttgggaattgttcactgtgacctgaagccagagaacattctaatcaaaagttacagaagatgtcagataaaggttattgatctagcaggaagcagttgcttccaaacagacaatttgtgtctatatgtacaatcccgatcctatagagctcctgaagtgatgttaggccttcaatatgatgaaaagattgatatatggtctctcggctgtatcttggcagagttatgctctggtgaatttaatcaggttttcgttttggtactatttccaaatgatgcagttgtgatgattctagcacgcatgattggaatgttggttctattgatatggagatgtagcatattatga

SEQ ID NO: 98788 - DNA, 1083 bp, Glycine max
  Peptide Sequence Number=SeqID_215566
atggaaggcttagattttccggacacgttctcccctatagcaaaactcaccactgttcgtttcctgttagccttagcagttcttcatggttggcatttgcgccaactcaacgtcaaaaatgcttttctccacggtgagcttaatgaggaggtatacaagcaacttcctccaggtctcttggttgataatcctcaccagggaatgacatcaaagctattcgtcgcatcaccacctttatggatcaagctttcaaaatcaaagatcttgtacactctggacatcctctcagattcgggtatgcttggttctcgccccatcaccactcctatggactatgctactcgattacaggccacaatgggtgatccattatttgttgaagcttcctcttcttatcgtcgtctggttgatcgccttatttacctcacgaacacacgccccgacatagctcatgttgttcagcaattgagccaatacatggctcatccaactacttctcactcccaagatgcctctcgtgttcttcattacctcaagggtactccaggttctggcattttcttctctgccactggttctctccagctcaaagcattcagtgattccaattgggccggttgtcgtgacactcgacgttccatcaccggcttctccgtctatctcggcaattccattatttcttggcgctcgaagaaacaacccacggtgtctcgcagctcctccaaagctgagtatcgagccttggcctccactacttgcgagctccaatggcttacatatctccttcaagatttatgtgtttcgtttgttcaacccgccaatctttattgtgacaatcaatccgctatccagatcgcctctaaccaagtttttcacaagcgtactaaacacattgacttagattgccatattgttcgtgaaaaagttcaaagtggtctccttaagcttcttcctgcctcatctttgatgcagctagccgacttttttactgaacctttacctccaactatgtttcaacttctagtttccaagctgggaatgttgaatatccattcccagcttgaggggggctcttgtaactaa

SEQ ID NO: 98789 - DNA, 478 bp, Glycine max
  Peptide Sequence Number=SeqID_215567
atgaagtggataccggacggaggtcgaggtggtagcagttgtggaagtgagaaaccggtgataatcgtgaagataggtagggggatgtttgtctctggtcgagcggcgcaaggtcgtggatggtttatcttcaatgtggtgccccatgtagaaatgctaaagatcaataggggtgacggtgcactatgggtgagtgatgacagtttgaacagtggtggagaagaaaataagtttacaattggtagaagaaacaagcttggatatggaaatgagattaaagaaggtaagaatttacctgtgattgaagctgggtcgatagaacatgaggagacagaagctatttgtttgacattagatgaagtggaagttgagttcccatgggatggttgttggattaaagcaagcaatgccttgtattgctcagttggaaaacctgtatcatgggggaaagccatgcttcctatagcatacatcaatg

SEQ ID NO: 98790 - DNA, 354 bp, Glycine max
  Peptide Sequence Number=SeqID_215568
atggccatttcttctgttgagaggcatttgaaagataccctcagggtggacgacgaggaaggtctagagggcggtggcgatggtggcggcgtgaacggggagaacaatggatcattaacagtgggcgagacccacaatcctatttgccgcaaagtttggggttctggccgtagacgaaatagctcaattggaaaggagactaagacccacaatcctatttgccaatcttttgaactttgtgaggtagtcattaacggagctgcactgctgaagcttgaacaaagctccctgagggttgttgtagaaggaaggcacaaaacgggactacaattcttggagcattgttggccataa

SEQ ID NO: 98791 - DNA, 234 bp, Glycine max
  Peptide Sequence Number=SeqID_215569
atggtcgaattgggagagaagagaggtgatgattgggggtggaatctattcctagggggtgacggactagatgagggcagtggccgagtgaaggggtacattgacgcgcagggtaatgggttgccccaagtagcgaaaggtgtggccctgaatggagatgtggacctaagggtaggtggtgtcgcagtcgaggatgctactgctaccaaccatgaagcgaagtgcaaccgttga

SEQ ID NO: 98792 - DNA, 309 bp, Glycine max
  Peptide Sequence Number=SeqID_215570
atgggtgaaacgaagttgagtttaaaggacaaaagatggtcactccgtgggatgactgctctagtcacaggaggcactcgaggcatagggcatgccattgttgaagaattggcagaatttggagcagttgttcatatatgtgcacttctaaggtctaataattggtccgacatgcctttgccatgccaaaccacaacactcaccaaaccatcaccaactgccttaaggaggccgttaatcgcctcacccaaggccaaaaaactcttgcacaaaaccatgcctcactctctccatcccaaacaacaatga

SEQ ID NO: 98793 - DNA, 327 bp, Glycine max
  Peptide Sequence Number=SeqID_215571
atgtcacggaagaaggaaatcgtcagccccattggcgagtttgggctggcgtcgacacgtggcgtggagtgtagtggtctcgccacttgcactggcgatttgaccatgcaggggactagccagtttgactggcgagttgcgctaggggggatcagtttttcagggttgcaggcacgcgtaacaaaagagcagggtgcagtgaaggcaacagcagcaggcaaaatcgcaggcttcagtggtgatttgatgttagaggaaatcgcaggctttagtggcgatttgaggtccataaatccctcccttccccctaaacgagcattcacttaa

SEQ ID NO: 98794 - DNA, 321 bp, Glycine max
  Peptide Sequence Number=SeqID_215572
tttctgtgggagccttacacaacaactgttatgtcagcgttgcctccaatttgtttgattggaagtgtagcatggtgcgccgtggtgtcactcatttgtttccatgttgttgagtggtaccaacccgatagagttttgagacaatttggaatgcaacaacctattcccgggtgtccttcgcaacttgtgaatatccatggcataacgctgaaaggcaaacaagatgaaaattgggacaactgttcgccccaattatcagtcaatggaacaatcgagatgagtttagggtcgacatttatcctcgacaagagggcttattga

SEQ ID NO: 98795 - DNA, 396 bp, Glycine max
  Peptide Sequence Number=SeqID_215573
atggtgtcaccacaagggaggaacacatggccagttgatgatctcgtgccttatgtggagaagataacgattttatccgaagagcaagagagaatcactgagcccgtgtcacatggtctaccatcagagcgtcaatttccagcacaagagtttcacattcttcagtcaagtgttgaaactcaaggcataggcagacgaagggaggctgttgaagcggaagaatattcgcaacaaatggtggaccgtggccatggaatgtattacacgccaccaacattttctcaatatcctttcgaaggtcatcacactgatacttttgcaagcgaacattcgttcgatggtgttgtggaaacacatcctcatttttcatggccgactatgaccccttcacagtaa

SEQ ID NO: 98796 - DNA, 1007 bp, Glycine max
  Peptide Sequence Number=SeqID_215574
aagaaataccctcacgcgctcgaacatctcccgctcctgagacggatgcagtgcatgttgaggaacagggtgaaggtcaaggtattgggtccatcagtccttatggatcgagtcagaaaagttcatctgaagaaaactttttcgatgaagaggccatacaagaggctgaagctggaggttcggacatttacccggcgtcttcaacatctaagctttccgctagcatagggatcgcagaagacacattcattaaaatgcaagacgaagacccagctgcagcccttcgactcctgctgaacaccagtcaagccaacacttcgagtgaaaagattcctggtgcctcgtcctcatctgatgctgacatcacctcttcagtacgccaagattgcctgcttttgaagttatcaatggaatacgcacgggaagatgtacttaaatccattgaagagaacccctctgctgcctttgggcacctgaactttttgaagaaattgcacaacccccttacctctgatgagattctaggcaaagtcatccaaatcgaggccatcattgatcaatttgcaagtactgtgcagaaaaaacgcgaaaatggcgccagactggatgcccagaaacaggcacatatccttctgctcgagaaagcgcgagctgctcaacatgaagtcgaacgtctcaccaaagaggcgaaagaaggatcttctgagatcaaagcctgtgatgataacatctcctcctgggaggcaactattacggatttgctgtctcaggtcgatgatctaaggcaaaaaattgtgacggagcaggccaaacgcaaggaactccaggagaaggccgctaattcgattcagaaactggttgccaaaaaagggaaggaaggcctgaaggcctttagcgcatctcaagctgtagcagatgaggcgagagttatggagagtgctgaccaggtcttaactaaagagatggccaccttgaagaaactatatgaggacttggtcatgcattag

SEQ ID NO: 98797 - DNA, 429 bp, Glycine max
  Peptide Sequence Number=SeqID_215575
atgtgggagaagcgcctatttaaacctgatgatctcgctagtgccactggctatatcagtgatctcgccagtagcactggctatttccatgtcatctcgccactgcatctgaaccctaaaaaaacgttgccaaaagctgatgccctagctgtgcaaatcgccaatacaagtggctactcccctcatggtcaaatcgctaatatgactggtgagaccattgccacgtgtcgatgccagcccaaactcgccaatggggctggcgatttccttcttccttgcatgcattcacgtacaaaacagacccatgcaggaataagtttaaaaacaacaccatttgaggaaaaagtttggaaaagtagcccctttagggcaatttgcccctacatggcaacatttccatcacacttcaccaagtctgttaaattttga

SEQ ID NO: 98798 - DNA, 226 bp, Glycine max
  Peptide Sequence Number=SeqID_215576
atggttgttaatgaaccaacatacaacaactttaataatagaggtgatatcggtggtgacaatagtgatagtagcagtgatggtggtggtagcggttacaactacattggtggaggttgtgatgacgatgacattgacagtggtgctagcaattccgataacgattgtgatgtcagtaacaatagtggtgacaataacgatggtagtggtgttggtggtcgtggtg

SEQ ID NO: 98799 - DNA, 213 bp, Glycine max
  Peptide Sequence Number=SeqID_215577
atgtcacgaaaccttatggattatgcaatcatcccttctttggcttccggaatgttacggaactttgcggattgcacattaacacttcctttcaactcccgacattaccttgaagtggtcaagcgagggtcgcatcccaacaaacagatgatccccggacgaaatcagggtatgacagtcgctaaacactgttcacagcaaaacaccaactga

SEQ ID NO: 98800 - DNA, 1014 bp, Glycine max
  Peptide Sequence Number=SeqID_215578
atgcatgacgacgattatcgtcagcgggaggcttttcttgcagtagttcgcgctggcagctttagtgctggtgcgcgcgatttgggaagagatgtctctgtcgtttcccggcgtgtagctgcattagaaaaacgtctgggaattcgcctgctggaacgcaccacccgccgcatacgtcccacagaagagggcttacgctatcggcaaaaaattgaattggcagatgaattgctgcgggaagcggaagagcaagcccgtgatttggcagcgcgtccggccgggacgattcgccttaccgttcccgcctcattcggacgaaagtgggtcgtacaggccttaccattctttttaaaagcctatcctgacatccgtattgtgctgcactgcagcgatcgctacgtagatttactgggtgataattttgatatggcaatccgtattggtgttctgaaggacagcagattaattgcccgaaagctggcaaatacaagtcgcattttatgtgtcgcgccggattacctggagcgccattctcctgtaacacaccctcaggaccttcgtaagcatgattgcctgggtttcacacccatgcacagctggcccgaatggcgactcgagaaagacggtcaacagatagcggtacctgttaagacgcgttacgagagtgacgaaatggatgggcttatactggccgctcaatcgggtatggggatattactcgcggccaactggctggtacagaaagaactggctgagggttcactggtgccagtgctgtcggactggcaggcaacaggcgaggatggtgtctggttaatgaaaccttcaagccagttgcagtcggcaaaaatcagtgcattaacagactggctgacttcatggttttccacaccacgctgcttgtgcagtccagcagtcgacataccccggaataatgtcggcgctcctggagataataacgtatttcttcacgctgatgccgctccacttcgtcatggatcaccggcaggttag

SEQ ID NO: 98801 - DNA, 285 bp, Glycine max
  Peptide Sequence Number=SeqID_215579
atgtcctacagcttttttctggatgaaactgtattcatcataattgtaaagagcgtttttaaacacctttataagcggatccacactgaacaaattatcctaagagatgttaaaggagtttgtccttatattgaaccttgtgattccaaaactcagaagagcaatctggggattgctcttgttggagttggttgtgaacaaaacaaggttgatgttagggtggacaataagcttcgaaagactagtgaaatagtacttgggttgagtggagcctacatagactga

SEQ ID NO: 98802 - DNA, 495 bp, Glycine max
  Peptide Sequence Number=SeqID_215580
atgcctacaacatccacacataggcaacaggaagttgcccctgttgctgaggatgatcttgtgcttactaaagatgtacatgcacatgctgaagaagctattgatgatgctgagggatttccaggtgggccgcgtgacctatcagtgttgactgactatggtgaccatgttgcagtcatcgtatggaatgatgaggaacgtcctgaattgaagttatcctcccatggaaggaaggttctgaaatttgggaggcctgctccagaaattgaagggctagtcgctatcacaggattaagtcctttgatcgcatgttcagtagacactggcgatcgaggacttatatccacttttgtcgagaggtggcataaggaaactagcagttttcatcttcctgttggagagctgaccatcaccctagatgatgtggtgtctctgcttcatcttccaattattggcgcattccacagttttgagcccctgcatgtcgacgaagcg

SEQ ID NO: 98803 - DNA, 360 bp, Glycine max
  Peptide Sequence Number=SeqID_215581
atgtttctcctcttttctcctttgctagttggtgttggtgaagaggaggctaaaggcttaatcctaggaagtgctcaagtttccattccatctcctaaccttgctctttctttttcctgcacttcaagaggtaaaggaggaactaggcatgatgggtgtagtcttaattttcttgtatccatgcttagtagaaatcaaacatgggtgtcagcatgtacaacgacaaaggagatgtgggatctcattcaagtgactcatgaaggtactctgaatgttagaagaacaaggaggaattctctcattcaaaagtatgagacattccagatgcaacaaggagaaacaattggagatgtttgttag

SEQ ID NO: 98804 - DNA, 840 bp, Glycine max
  Peptide Sequence Number=SeqID_215582
atgtggcgctgcaatgacgagctacgtgtccgtgcagatgaacttaacaggtcttccaagaaaaattcagtcgcaaaacactacatagaattttggaaagccattcctccaaatgaaccatatcgtgtgctactgggtgaagtaaggaataggctttaccagactcgtgaacgctcacgccatttgctagctcacggatactctgacattccagaggaagagacttttaccaatgttgaggagacttgtatggctgatgatgtttcatctaacattggagctttctcagtcctatcactctgtgcttgtggcgatcgtgcaattgccgatggaagccttctagatttcttgagacaagtctctactttcggactctccctagtgaggcttgacataaggcaagagtcagaccgccacacagacgtcttagacgccatcaccaaacatttagaaataggctcataccaggaatggtcggaggaaaaacggcagcaatggcttttatctgagttgagtggcaaacggcccctattcggccctgatcttccccaaaccgaagaaatcagagacgtgttggagacattccatgtcatagcagagcttccactagacaactttggagcatacatcatctcaatggcaactgcaccttctgatgtgcttgcagttgagcttctgcagcgcgaatgccatgtcaagcatccactaagagttgtgccattgtttgagaagctagctgatctagaagcagcaccggacgcgttggcgcgattgttctctgtagactggtaccagaaacaggatcaatgggaagcaggaagtgatgataggctattctga

SEQ ID NO: 98805 - DNA, 421 bp, Glycine max
  Peptide Sequence Number=SeqID_215583
atggaactccaacgacttaatcaaaatgaagaaaccgacaaaaagaaaagaagtatagcactcaaagcctcttcatcaatgcaagaagaaaatgaagaagaagaatcaaaagatgaagaagacttctcactctctgtgaagaagtttcaaaaatttgtcaagaagagaagaatcgagaggcttcagaacttcaacaatggaagaatatctcaagaaaactctcaaattcttagatgctacaaatgcatccaacttggtcacattaaagcaaattgtccctcaaatgaggaatggcctgagaaaagtgataagaaaaggtatgaagaaagaaggaccaagaaggcctacattgcttgggatgacaatgactcatccgacggttcagagaaggagatcaacgttctaaccaaggactatgaga

SEQ ID NO: 98806 - DNA, 573 bp, Glycine max
  Peptide Sequence Number=SeqID_215584
atgcctggtgaatctcccggtcaaaggaatgtcgcgatgtttttaccaaggaatcgagcgggtgccgttcttttggcgtcgttggcgtttgcgcccggccatgcaacttccgccgcgcaggggtggggcaaagtcaacatgcacggcgccattatcgacaccgcctgcgccattgccgccggcagccgcgatcagacgatcgatatggacactattcctctcgggcagatcattcgtgacggccaggggatgaccaaacctttcagtatcgaattggtcaattgcattttggaacggccggaaaacaagcctgactggaaattctttcaggtcacgtttgatggttatgcggaaggcgctctgtttggcgtacagggcgatgcgcgcggcgttgcattggagataaaagacagcagcggcacggcggttattccagggaaacctttgccgatggagggaataataccggggaaccgagtgctgaattattccatgacgttgatgccgaatcaccagccgttgaaggtgggagcgtatttttccacagtgcgttttaagctggattatttttga

SEQ ID NO: 98807 - DNA, 985 bp, Glycine max
  Peptide Sequence Number=SeqID_215585
ccgcggcgtcttccaccgcgacctcaagccggagaacctcctcctcgacgacgatggcaacctcaaggtcactgacttcggcctcagcactttctccgagcatctcaggcacgacggcctgctgcacactacgtgtggcacgccggcctacgttgcgcctgaggtcatcggaaaaagaggttacgacggcgccaaggctgatatttggtcttgtggcgtaatcctctacgtacttcttgctggttttttacctttccaggatgaaaacttggtggctttgtacaagaaaatttaccgcggtgacttcaagtgtccaccgtggttttcctccgaggcacggaggctcatcaccaagctcctcgacccgaacccgaacacgcgaatcacgatttcgaaaatcatggactcgtcgtggttcaagaaacccgtgccaaagaacttggtgggaaagaaaagagaggaattgaacttggaggaaaagattaaacatcaggagcaagaagtttccactacgatgaatgcatttcacatcatttccctttcggaagggttcgatttgtcgccgttgttcgaggagaagaagagggaggagaaagagttacgtttcgccaccacgcgccccgcgagtagcgtgatttcgagattggaagatttagcgaaggcggtgaagttcgacgtgaaaaagagcgagactaaggtgaggttgcagggtcaagaaaatgggcgaaaaggtaaactcgctattgctgcggatttgtacgccgtgacgccgtcgtttttggtcgtggaggttaagaaagacaacggtgacaccttggagtataaccagttctgcagcaaggagcttcggccagcgctcaaggacatcgtgaaagggggaattgttgaaaaggcgaatgcagtagtagtgaaccgaaatggacatcgaggagttgttgtcgatgattcgggtacatgtgctgcctgttgtattgctcgtggctga

SEQ ID NO: 98808 - DNA, 447 bp, Glycine max
  Peptide Sequence Number=SeqID_215586
atggcagaaatgggaaaggttgatcatcaagaggaaaggctcaaggccattgaaggaggcaaagattatgcctttgctaacctagaagagttgttcctagtacccaatatcatcacccctcctaagttcaaggtgttggactttgacaagtacaaggggactacttgccccaagaaccatctaaagatgtattgttggaagatgggggcatacgcaacagatgaggaaatgctgatacatttcttccaaaaaagtcttactagggtagctgttacctggtacactagcttggaaccttcccaagtccattcttggaatgacctaatggttgccttcattagaatacgcccaaaggtggagagacctggcagcccaagtggcacccctaatgacaaaaagggagatgataacaatgatagtagacatattaacaatgttctactatga

SEQ ID NO: 98809 - DNA, 126 bp, Glycine max
  Peptide Sequence Number=SeqID_215587
atgaagatcatgttggtggcgacaacggtgatcatggcgacgatcacgatggtggtgactgttgtgctggtagaaacaataaagagggaattttatcaaagagaagaaagaagcattttgagatag

SEQ ID NO: 98810 - DNA, 495 bp, Glycine max
  Peptide Sequence Number=SeqID_215588
atggcttctatttcttgtatgagtgctattttaagctttcttctcatctctatctttctttctgtttacaatattgaagtgtgtgaggcacaagccaggcctcctacagcgaaggggctatcatacaccttctacgacaaaagctgtcctaagcttaaatctatcgttagatcagagctcaaaaaggtcttcaataaggacattgctcaagctgctggcttgcttcgccttcacttccatgactgctttgttcagggttgtgatggatcagtattattggatggatcagcaagtgggccgggtgagaaagaagcgccaccaaacttgactttgagacctgaggcatttaagatcatcgaaaaccttcgtggtcttttagaaaagagttgtggaagagtcgtctcctgctccgacatcactgctctcactgcacgtgatgctgttttccttgtaagtaccattatttggattatagcttatgagatgcctgtgtaa

SEQ ID NO: 98811 - DNA, 384 bp, Glycine max
  Peptide Sequence Number=SeqID_215589
atggttccttatcacaaaaaaaagccctctgctgggaacaagaaacaagggcttatcaattattcatcatcaccacaacatatatatacaacaaacatacactatcatgcatgcatcgacccagtcacattacatttctatcaaagtttccaccacatcttccaccacagaagtcaagagggacttgttattggcatttctaacggagcaattggcacgaatctccccttgtttcccggtgagcacattaagctgacccatcttgagcatagcgaacacaaacttctcaaagaagaggttctggttgacggcaaagtcggagacaatgcccttagtccttttatcagtgtacaagtcttggtcggaggtgaagaggccctggcg

SEQ ID NO: 98812 - DNA, 390 bp, Glycine max
  Peptide Sequence Number=SeqID_215590
atgaccctcatgattctcaaagctcaaaagggcactatccaacaccacacatggggtgccaccacacaggatcatgatgttgatagatcaaagagaaggttttctttctcaaacttggtggatttggtcatggagaaaagcaagtcattccctgaatactcctgctcttacactgaatttgggttcagtgaaagatccaactcatacaatttcaatgggccaaaccagaagggaaatgggttttctgcatcaagtgatccagaactcaagagaaagaagagaatcaaggcctataatgtgttgacagtggagggaaagcttaaaacaagtgtcagaaacagcttcaagtggatcaagaacaagttcagtgacattcgctatggtgtgtga

SEQ ID NO: 98813 - DNA, 753 bp, Glycine max
  Peptide Sequence Number=SeqID_215591
atgcgaaaaatattagctttagcgctgatatcaatagtagcaacaatctttcctttctatataaactatcaagttcagaagggggatactctttatagtatttcaaaggggtttggtataccaattcctatacttcttgattggaatacagggttagcgccatcaaatttaagagccgggagttcaattaaagtacctgttgtcccaggtataatgttcaaaagcactaagagtattagtttatcagaacttgctaagtattttttcattgatcctgaagagatagtcacagttaatccatctattggttcaacaataccagcaaataaagaagtttttgtaccattgggaaaaacaaatacatcttttgctcaaatatctgatttcatatggtccgtttatggaagaataacttcagagtttggttggagaatacatccaatatacggcaagaaccttttccatacaggagtagatatttccgtgccaacaggttggatgagcggctatggcaatttaataataatcgatcatggaagttttgaaacgtattatgcgcacctttccaagataaacgtttacgttggattgcaagttgagaagggtgatttcatagcaaggtccggaagtactggtacgtcaacaggtccacatctacactttgaagttagaaaatatggagaagcaaatgaccccgttgcgtatctcccaagaacaacaacgtacgttatgaggagggttatatctgaataa

SEQ ID NO: 98814 - DNA, 195 bp, Glycine max
  Peptide Sequence Number=SeqID_215592
gtgaactctagaggtgatggcggtgcgtctgttgcccgctgccggccatcctcaggctgctatggtgtttcaccctgcgcctgcctggggacgcagtacttcttgatgaaagctcgattagcagggggcctgatgcccttgccggaggcgcgatccctgcaaacaatagatgacattcaaaatcagttgagcgag

SEQ ID NO: 98815 - DNA, 393 bp, Glycine max
  Peptide Sequence Number=SeqID_215593
atggttgaaaatgttagttggtttgacagattgattgtgaaggtaatcactggccacaacccgggtacatctacttgggttgttgtgattgagaacaagagagggtacatctcatgtggattaattctagtggaaggtacattcactaggttgttcaaagagaacaagggagggtacatcccttgtggatctttgcttgtaaaggactttacaaggttgaaaagaaatctcaaggacagcaggtcgcttggggactggatgcttgcagttggtgtctcgctaagcgaggcttgtgcgcttagcgagaatcatgcgctaagtgaggcactcagcccgcttagcaagttgggagaatctggaggagaatctgagaagcatctgcgcactcagcgc

SEQ ID NO: 98816 - DNA, 249 bp, Glycine max
  Peptide Sequence Number=SeqID_215594
atgaacaaaatcacaaattccctaggcttagcgagactaactcgcttagcccaggcttattcagccaacagggttgagtggcttagcgagaggacttgcttagccaccaaagaagacaaaaagactcgaagagtttgtcctaagcaaactaactcgctaagcgcggcatgccggcttagtgagttcataccaactgaaaataaaaactggaaatttaaatactcgctaagcccaagtgtagtggcttag

SEQ ID NO: 98817 - DNA, 286 bp, Glycine max
  Peptide Sequence Number=SeqID_215595
ttacgggcctctgtcggttcacggagtgcccgtcacccccaacaaggtcatcaggccccctattaatcgggatttcatcaagaagtattgtgcccctaggcaggcccagggcgaggcaccacggcagcctggggacggctaccagctggcggcagacgcaccgccaccacctctagaatccacctcagctcatctacaaaggctagagcattgcctacgatacatggccgaccagcaggcacccaaccaccgagacaggtatgagcaggtagcaaaaatgctttga

SEQ ID NO: 98818 - DNA, 231 bp, Glycine max
  Peptide Sequence Number=SeqID_215596
atgacctctccagcaacaggtacaatcccgggtggaggaatcatcccaaccttagatggtcgaatccttcacaacagcaacaacagccttattttcaaaatgttgctggcccaagcagaccatacgttcctccaccaatccagcagcaacaacagcaatagccccagaaacaggaaacagcaaccttcccttgaagaacttgtgaggcaaatgactatgcaaaacatgtag

SEQ ID NO: 98819 - DNA, 246 bp, Glycine max
  Peptide Sequence Number=SeqID_215597
atggataaagttgatatctttgtccctcatcctctcacaaacgcatgtttgcttattcaactttcaccggaatgtgggtgcaagccattggtctgtttgctcaagcgacctgcgctcctgagtgttgacttccaagactgttcaatcagagattactcgtcttgcacgttggtggggagaagtgagttatcaagaataggatgttgggcaaatggcctcagttaccttaagaaaaaggggggttga

SEQ ID NO: 98820 - DNA, 402 bp, Glycine max
  Peptide Sequence Number=SeqID_215598
atggcatcagattcaactgggacttctacatcccatggggcaaagcgtaaagctgttatgattgatgtcattgatacacaatttgataagctcaacaccggccttgataagatggctgaagcgattgggagtggtagtgtgtatgctaaaaaactatcaaatgcagccaagaaacaaaagagaaatgagcttttgaggaggaccaatgcatttcaatattcagagggggacatttgggaattatcggaaggagtgggtttcacttatcagcctttaaaggaacaatgttttgactatttatgcaacaaccaatcgcagactcgaagattgtttggtatgccttcccatttgcaatacaatcatctgatcaaattgatgagggatgctggcctcattgcttag

SEQ ID NO: 98821 - DNA, 319 bp, Glycine max
  Peptide Sequence Number=SeqID_215599
cataaacttggctttggtgaaagagttctatgcaaacttatacagctctaaaggcccttcaccaaagaaagccagagtcagaggccatttagtgaagattgatgctgacagtctcaacatattcctggagacaccggtggtattggcagaggggttcattttgaatgttgagggccatcctgggaggattctcaggaaagacttgactactttagccaaggacccgaccacaccagtcctgactatggacacttctcctccagatactccagtacttcatctgacagatgaggaggatgttcaaacacaggatacttag

SEQ ID NO: 98822 - DNA, 867 bp, Glycine max
  Peptide Sequence Number=SeqID_215600
atggacatggagaacaataatcatgccatggctgcaggtgctagtagtgattctaacactactactgatcaccccaccccaaaatcttcttcttgtgttaatgataacaacaagttatacaaaggggtgagaaagcgaaagtgggggaaatgggtttctgaaataaggcttcccaatagccgtgaacgcatatggctagggtcttatgactctcctgaaaaagcagcgcgagccttcgatgctgccctttactgtctacgtggccgccatgccaatttcaatttccccaacacaccttgcaacatggacactaccaatgctcctcaccaatctcttaccccacaagagattcaagaggttgctgctaatttcgcaaaccaggccccactactacaaaaacctcaagaaccattggaatacaagtgtgagatgaaggttacccaacaaaaaacccctcaacttagtgggggtggtggtaattcttcatcgtttggttcaaagtcgtcatgtaaatcagacagcaaacaagatagtactggtactagtactaatactacttgtacccccaccaccactgcctcgtcatgttctactactatgtatgaatgtgatggaacggtgcaagtggaccatggggacatggattggacattcttgaacgtatttgattattccaatgaggtgtttcctgttgttggatccgactatgatctccataattctgagctacacaagatgcactcaggttcaggtgagttattgtattccactccttttgatcagggttacgaacaattaattgaagctgatcatgatgatgatgaccctttttctcaccaatcattcctttggaattggaacttttga

SEQ ID NO: 98823 - DNA, 591 bp, Glycine max
  Peptide Sequence Number=SeqID_215601
atgactcaagagctgatacgcggagataccttacggttatctgcaccctttgctaggcagacacagttgtgtccgatggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcaccccctttgctaggcagacacagttgtgtccgatggcaagcagagaccaagtttggtcattctgcacccaagatacgcggagataccttacgatacgcggagataccttacggttatctgcacccctttgctaggcagacacagttgtgtccgatggcaagcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttatggttattcgcacccattctcttgctatctgtaa

SEQ ID NO: 98824 - DNA, 174 bp, Glycine max
  Peptide Sequence Number=SeqID_215602
atgaagcaggtaccaagaagatttgctcctaatgtaatggaggccgacaaatcagagatagagagattaaaagatgaagttgaattccgatgggaaaaggaacaccaagaacctttcgatgacatgaagagatatcttgctaatccactaattctagtacctcgtgtgaaataa

SEQ ID NO: 98825 - DNA, 120 bp, Glycine max
  Peptide Sequence Number=SeqID_215603
atgatcgcggaggcggcaataacatcgactaatagtggaatggctagttggaaacttggagtattaccagaagaatcaaaagagtctgctcaacgggctttacaagatgaagctcagtaa

SEQ ID NO: 98826 - DNA, 990 bp, Glycine max
  Peptide Sequence Number=SeqID_215604
atggctttccctccccacgtagtagaggattgcatgggcctcctcacactcttgagcgacggcaccgttttgcgttccaacatcaacttccaagaacaacctcaacccacccaacacgacaacctcgtacaattcaaagacttcctcttccacaaaaaattcaacctccacctccgtctctacaaacctaaatttgacgacaacattaataatgatgacgacaagaacaacaacaataagtcgttgcccgtggtgatgttcctccacggcggcggcttctgcttcggctcgagagtgtggccacacattcattcgtgctgtgtgcgcctagctacgagcctccatgccgccgtggtgaccccggactaccgcctcgctccagagcaccgccttcccgccgcagtggatgacggcgtggaagccctgcggtggctccagcgacagggccaccacggcggggatgagtgggtgacccggggcgttgactttgaccgtgctttcatcctcggtgactcctctggcgggaacattgcgcaccacttggcggttcagctcggacccggttcgagggagatggatccggttcgcgtacgaggttacgttctgctgggcccgtttttcagtggggtggttcggaccaggtcggaggtgggcccaccggaacaaatgctgacccttgagttgctcgacaggctgtcaatacctattggagagacaagagatcacccattggcgaacccatttggagctaacagtccaaaccttggacatgtgaagcttgaccctatcttagtgatagttggtggcaatgaattgctgaaggacagagcagtggactatgcaacaaggttaaaagaactagggaagaacattgaatacattgagtttaaggggaaggaacatggctttctcactcatgattcgcactcagaggctgcggaagaggtcgtgcaaatcattaaacgattcatgcttgaaaattctcattaa

SEQ ID NO: 98827 - DNA, 522 bp, Glycine max
  Peptide Sequence Number=SeqID_215605
atggtttattctctgctcaagcagcaccaaaacctccaacctccagttgctatctccaaatcaatggttttcatcaacaaagacataagagcataccaatctagggaggatgagtggtatttctttactcctagagacaagaagtatcccaatggagtgaggcctaataaagcagctgcttctggttattggaaggctattgggactgacaaacccattttcacttcttgtgggatgaagagcattactgtcaagaaggcactcgtgttctacaagggtcgtccaccaaagggatcgaaaaccgactggatcatgcatgagtatagattgcatgattccacgatctccaattcaaagcaagaaggagacttacaaagaaggtataatattgataaaaagaactatttccaacaaccttacaacaaagagtcgcgaagcgtaccttcaatggagaaaaacaaagcgcgaacaagaacattcaatggagaacaacagagcacaaagaacaaccttagatggtga

SEQ ID NO: 98828 - DNA, 177 bp, Glycine max
  Peptide Sequence Number=SeqID_215606
atggagggttttacgatggtgacagcgaggatggtgccagagagaggagtggttggagactgtaaagggagaagggctatcgagaaagaaggaaaaaaaataatatatgatctaatgtggacactttcatggttgtgcgggtgtttgaggatcgtcgagagaagaacgacatcgtga

SEQ ID NO: 98829 - DNA, 501 bp, Glycine max
  Peptide Sequence Number=SeqID_215607
atgaattcgagtaattataatgatactaacatgcatgtggatcggagatacagccactactgcgagcaaatgcacatggtggtgaatgcattcgacatggtgatggggtttggcgccgcggtgccatacacggcgctggcacagaaagcaatgtctcgtcactttaggtgcctaaaggatgcgataacagcacaattgaagcatagttgtgaggtattgggagagaaagatggtgcagggaattcggggttgacaaaaggagagaccccaaggctgaagatgctggaacaaagcttgaggcagcaaagagcgtttcatcaaatggggatgatggaacaggaggcttggaggccccagagagggttgccagaacgatctgtcaacattttgagagcctggcttttcgagcatttccttcatccatttaggacttatgagagtgggaaaagacagttaatgattgcgagactgtggaaggagagggacagcgagacacaatga

SEQ ID NO: 98830 - DNA, 641 bp, Glycine max
  Peptide Sequence Number=SeqID_215608
atgggaatagcaacaccttcttcatcgcttccttctattctctctcactcgaagacacaccaacaacaaatacatcattcgaattctatgtcccaagattaccaccaccaccaccaccaaggaatcttcagcttccctaatgggttcgaaagatcggcggctactacgatgactcaccaagaccctcaccaccaccaccaccatcaccaccagcaacagcagattcggagggacaaagtgagggtgcaaggcttcgagccgccaccgcaacaaactttgctacctatagaggaagacgaatcggggagcctcccggtgtacgaaaccgccggaatgttatcggagatgttcaatttccctcccggcgccgctgaattattggaacagcaacagcagcagcaacaacaacaaccaatggcgatgacgacgacatttcgggcatcgccgtcggccagggcagtgggcagtggtggcagtgagtggtacggaaacagacaagggatgctaagcgggttgggaccgttgggagattccaagaatcatcatcatcatcatggcagtgtgaatagccgtgacagtagcagcagcagcatagttcagaatcagcatcatcatcatcacaaccaccagcatcatcagat

SEQ ID NO: 98831 - DNA, 165 bp, Glycine max
  Peptide Sequence Number=SeqID_215609
atggacttagggttcatcattgtcaatctcaagctccttgaatggggacaaaataaggttatgtttctagggcatgatgatgggtatgcaagagataaggacattaaggttactgttgtgcataactattttggacctaattgtcaccaatgcatgccaagataa

SEQ ID NO: 98832 - DNA, 510 bp, Glycine max
  Peptide Sequence Number=SeqID_215610
atggtggagagatataaaaaaggtatgtggtggagggagtcttaccaagtagttcaaagcttgtatctcaagggaggtaggagatggggaggattctttgaaagacaaatactctatgccttttctcctctccaaacaacaagatgcaccgataaaagatatgggttcgtgggtggagaagtgtggcgtttctttatgttggaaggggaacttaaggagactttagtaggagaattgaatgcaatttctcctaaattttggggggtgatgggtggtgctgggagtcgcaacgtgcccttcgcgggcgagcgagggcggggctcacgggtgcgctttccaaaggaggaaagatgcatggagtcgccaccaacgtttatttgtggaaaacgttgggaaaaacgaaggaaaccagtcaaaatgaaaattctaagttcgggagttgtatttacgcttgaggaaggtattaacacctcttacgtttgtctcgaaggacaacagcctattttttag

SEQ ID NO: 98833 - DNA, 1134 bp, Glycine max
  Peptide Sequence Number=SeqID_215611
atgggagtgctagactacgacatgaaaggggtagtgttgtgcctcaaaggtggtcctcaactcggtcgagtaaaggggtccaggtcggccggcaagggtggccacagccacgtgggatttgtggtccaaaggggatcagtggtgttcgccatttgtcgtgagaaaggagcgacaccctccaaggtcgctcttggcttggtcttttcattgcttttggttcctgtgtttgggggtctcttgttctggtttgtgctagtgggtttcgtggttgttgtttctgggaaaagattgttggatcatcttgatgggtcttctatctgcagccccgaaggccgaagctgcattgctaaagacatgtgggcttacttgaagcgtatttacaaccagaacaatgcggctaagcgttctcaactcgagctagatattgcaaattatgaacaaggacttatgtccattcaggattattactctggttttctgaatttgtgggcagaacattcagccattttacacgctaatgtacctaaggaatcgctacctgctatccacaagatctacgaggtcagcaaacacgatcaatttcttatgaagcttcggctagaatttgaagtttcctgtcctacattactgaaccgtagcccagtcccttctttggatgtttgtgttggggaacttcttcgccaggagcagtgtttactcactcaagtggtgcttctaatgcgttttcttctgcatattcggctcaagaaatattgcaattattgcaagcaacgtggccacatcatcaccaagtgcccctcaggacctgcacaatgcttaatgcatgcctttcatgctactgttggttctgctggttctactagtcagcccactagacttgttggttctcatattttgactctggagaaggtgcagcaaattgttctatccgctctttctaccttaggtattcaaggtaagcctactggtacttctacaacatggcttgttgattctggtgcttctaatcatatgactggatcccttgatcatttatacaatgcacatgcttatgatggcacccaaaacattcatattgtccatggtaacactacgtctatttttgttgttcgtgacattaattctatcttgtga

SEQ ID NO: 98834 - DNA, 510 bp, Glycine max
  Peptide Sequence Number=SeqID_215612
atggatgtgaagaacgcctttcttcatggtgatttggtagaggatatttacatgactcctcctccaggcctattttcctcatatgttgatattggtattgttcttcttatttatgtcgatgatatgataattactggttctgatcatgccaccattcaacgtcttaagcagcaactccaagcctcctttaatatgaaagatcttggtttccttaagcatttattgggccttgaagtttatactaattctagagttgagataggcttccctcaaattacaaccacacctctttatgatgacaatactagtgccattcagatagttactaatccgatttttcatgagcgcacgaagcatattgaggttgattgtcattctattcaagaagcattggacactcatcttgcagatatcctcaccaaggttatacctcttcctcaacatcagtttctcagcaacaaattgatggttcttgatcaaccgcatcaatttgaggggagatgtcaataa

SEQ ID NO: 98835 - DNA, 219 bp, Glycine max
  Peptide Sequence Number=SeqID_215613
atggcgaacgtcatggtaatgaaggagatcgaggacacggcactgcgtctcggcgtcgatctctccactctcgatctcgatgccattcgcatccctcccgatgaagattgcagcatcgttaggtatcaactacttcgtccttttcaggttctggaagctaagtttgctaaagagaagactcatgggtacaaattggaccgggcacatattttgccatga

SEQ ID NO: 98836 - DNA, 231 bp, Glycine max
  Peptide Sequence Number=SeqID_215614
atgccactgttttgggaagcttgggtggaaaaggttgtggagacaccatatatgacacctactacttctccacttttctttactcctcaattcactactcctatcagtccctataaccagtgtggattcaatcctctatttgaaacatcaactgatgctgagttcaacagattaaagtcctcacctcctccaaacattcaagttcttacaagaagcagaagagaagcttag

SEQ ID NO: 98837 - DNA, 222 bp, Glycine max
  Peptide Sequence Number=SeqID_215615
atgaggcagagtcaatggcagtgtcgtttctggcagactagatggcgattcgtggtggttgggattcatggcagtggcgctccttggtggaagggttcctttctccactcagatcttgatctggagagcaaggataaggataaaggttcacaaatggcggcaacagtgaagcctcacaaagagagggaatgtgagatttgtagctttggaggcaagatctaa

SEQ ID NO: 98838 - DNA, 111 bp, Glycine max
  Peptide Sequence Number=SeqID_215616
atggattacaacgtggcttgcagtggtctagggagtagtcaacaagacaacaaaggaagtttaatattcttggagttcttggagaaagtgttcgaacaaaacaccttctaa

SEQ ID NO: 98839 - DNA, 429 bp, Glycine max
  Peptide Sequence Number=SeqID_215617
atgcctgaagagaaaggcccctgcctcaggatctcaggccgatttgaccgatcaatattcacatctcaggaggcctatgatcgctattctgatattgtgattggcagaaagattcttcatgagagaaatgtcatgatatatcacacagaatttgatgagttcaagaaatggaattggcacaaggagctgaccaatttcatggatgggagcatcgatgttgccattcttaaggagttctatgcgaatttctattttcctaaggataaatcacccaagcaggcgagggtgaaaggccacttaattaagtttgatgaagacgccctcaacaccttcttgaagatgattgtgatcattgaggagagggagagcctacctgcctactccagattttgtcgtctgaggccaaatccacaagaactggcagcctga

SEQ ID NO: 98840 - DNA, 174 bp, Glycine max
  Peptide Sequence Number=SeqID_215618
atgaagtttagaagttgtgaaaaagtggctaagttttcaattgcaaaaagtagcagttgggctaagcgcatatccatcattaagagcgagatcagtgcgctaagcgcagcaggtgccttcagccagggtaagctcgaaactagcgctaagcccaatttcacttactcgcgctaa

SEQ ID NO: 98841 - DNA, 642 bp, Glycine max
  Peptide Sequence Number=SeqID_215619
atgaggttgtggaggaagcaaaaaggaggaagaagtgtctcttattcgaggtgtattttgataaagcgtatgactgggtgtcttgggagtttttactttatatgttgcaaaggttgggttttgatgccaagtggtctaaaagtggtttgtaaaaaacttattgctatccgaagaaggttcttgtggggggaagggggggatcaagaacataataaggtagtttgggttagttgggaggacatttgttctagtaaggagagtgatggcttaggagtgaaaatattgctttgtttaatgaggcatttttggaaaaatggaggtggaaacttttccaccaagacaaaagggttgtgggttaagagagggcttttgggaggaggcaattcttcaagggagtctttttggtggaaggacttaaagagagtgtgtggaagcctaaatggtgagaggtggttcgataaggatagtgagtggaagctcgatgatggagggaagatgaaattttgggtagatgattgggtgaatggacaaaacttggcatctttgtttcataggttattccttttgtcggataataaatatgctagtgttaggcatatgggacgatggtgtaatgatgttcggctttgggagattacttga

SEQ ID NO: 98842 - DNA, 876 bp, Glycine max
  Peptide Sequence Number=SeqID_215620
atgggtgaagtagacgaggtgcaagatcggataaaggccgacttggaggccattaaagagaaaatggccacaatgatggaggccatgatgagcatgaagaagataatggaggtcaatgcaactgcaattgccgctaccagtgccattgctgaggtggacttgactcccccatctagcctcaaccaaataaatcatgccatctcagatatggtagggcagacaggcaaagaattgggaagtacgggcggcccccattttgtgcaagttcaaaacaagaattccttcccaccatatgacttggctcccaactttgcaccacccaatgtggcgcgcactcccgataagaatgtcaataacttcactcccatactcatcgagaaccaaaaacctcaatctgatcatgcatttgtccctcaacacatgggggagacacatgaaataccccaccacaatctagccgacttcaagcctcacctcaaatatgccctccgtttcttccacaaccacaacccttgctttttgtggcaggaggaatccctcttgctatggcagagaagagaagctacagaacttctgaaaaagggagcacgagtctttcaaaaggtacgcccaaaggtggaaggatatggcaactcaagtagcgcccccaagagggagttgataacgatgatagtagatgcattatcggtgtcctactatgaaaagatggtggattatattccttcaagatttggcgatttagtgttcgccggtgaaaggattgaagtgggtctaaggagaggcaaatttgattgtctcgctttgacaaataaaaagcctggggcaaatggagagaaggagaatgaggaaggaacccatgttgaaggttggttttag

SEQ ID NO: 98843 - DNA, 1397 bp, Glycine max
  Peptide Sequence Number=SeqID_215621
gtaacaaccagtattaccagttcaacacgtcctatgaggttgaaagaggagactcatattttgtgatcgctaacaacacttttgaaggcctctcaacatgtcaagcattgcaggaccaaaacaacattcccgaaggagatttaatgcccggaaatgacctcaatgttcctcttcgatgcgcttgtccctcgaagaatcaaactgagcaaggtgtcaagtacttgttgagttaccctgtggcttctaatgacattgtttggctcattggtgaaagatttggtgtcagcataatccatccttttaccacacttctaatacctcttcatgaagagccttcgagtaatcaaacttctgagccatctccaccaccaccaccatcttcttcatcttcttcaagtggaagctcaagcaaaacatgggtgcatgcagttgtaggagttgttggaggtattgcattaatatcattagtcctttgtgctatcattttcaggaggctctatctcaaggttaataaaaagaaagatgattctgtgattgtgtctgatagttttgtggctgtggctattgagaaaccacaagaaaaaaagttggaagaagaatctgagaatttggcagagatcatatctggcataggtcaatcgttcaaggtgtacagatataaggaactacgaagtgcaacaaatggttttagtcccacctgctgcatcaaagggtcggtttatcgcggtttcatcaacggggatttggctgcaattagaaagatagatggtgatgtgtcaaaggagatagagcttttgaccaaagtgaaccgttctaatgttatacgcctttctggggtttgcttcaacgagggctattggtatctttattatgagtatgctgctaatggaaacttgagtgattggatcaacatcaagggaaagtttataagttggacacaaagaattcagattgcattggatgtggccacaggacttgactatcttcatagtttcacttctccaccccatagggtacatggctccagagtatttggaatatatggtcttgtgtctacaaagcttgatgtttatgcatttggggttctgatgttggaaatgctcaatggaaaagatgttgctgatgtttatgcagaagggaatattgtgaatttggtagatgttttaagcgcgatgcttgatgaggaaggtgaagatttgagattgagtgagtccattgatccctctttgcaaggaaattatcctatggaacttgctgtgtttgtgtctagaatgataagaacttgcataaagaaagatccagcaaatcgccctgatatgcatgagattgtgtcatctttgtccaaagccttggactcttcattgagatgggaaacgtctatggaaaggaagttttga

SEQ ID NO: 98844 - DNA, 1623 bp, Glycine max
  Peptide Sequence Number=SeqID_215622
atgggttggtttactaagttgcttaagggatccaaccgtaaatcttcaggaggaagatatcatgggaaatatgaagatgacagaatatcagaaaatcatgattgttcagcggatgatttgatggatattgagaaagaagaaattgatcgggccatagcactctctctttcagaggcagatcagaaagggaaaaaatatttaaaaaggccttatgttttgcctcacaaaaccccagaggacgactctgaatctgaagatgatgaactgtgtccacttagtgacgaggaagctgaatgtgttgaagttcagcaagatgaagatgaccatcatgctaaaattcaacaggatgaagacaaacatcttgatgaagttcaacttgaggaagatgaacaacttgccagggcaattcaagaaagtttgagcattagttctcctcctcgatctgacagtgattctttatttcaaccttttgcacacttattcccacctgtatacagaatctgtgctggctgcaattccgagattggccatggaagatttttgagttgcatgggaggttattggcatccagaatgtttttgttgccatgcttgcaaacttccaatcactgattatgagttttccatgtctggaaatcgccgttatcataaatcctgctataaggagttgcatcatccgagatgtgatgtctgcaagaaatttatcccaccaaattcagctggcctcattgagtatagagcacatcctttctggcgacaaaaatattgtccatcgcatgagggtgatggtactcctcgttgttgtagctgtcaaagaatggagtcagtggataccaagtatctgttgcttgatgatggtcgaaagctgtgtctggagtgtcttgactcagctatcatggatactcatgaatgccaacctctctatgtggaaatacaagagttttatgaaggtttacatatgaagatagagcagcaagttccaatgcttttggttgagagacaagcactgaacgaggctatggagggagagaagaatggtcatcaccacttacctgaaacgagaggactttgcttgtctgaagagcaaactattcccactattttaaggagaccaaggataggagcaggataccagctcatagatatgataactgagccttttaggctggtccgtcgttgtgaagtgacagccatacttgttttgtatggccttcctaggttattgactggatcaatcctggcccacgaaatgatgcatgcatggcttagacttaaaggctatggcaatctgaggccagaagttgaagagggaatttgccaagtcttggctcatatgtggttagaatcagagattattcctggcactggggatgaaggtgcatcatcgtcatcatcatcttcatcttcctcatcctcttcatcaccttcgtcctcttcatcatcaaagaagggtaaacgttccgactttgagaagaaacttggtaagtatttcaaacaccagattgagtcagatagctcagcagcttatggagatggattcagagagggtaaccaggctgtggctaagtatggacttagaaggacccttgaccatatccgattgactggaagttttccatattga

SEQ ID NO: 98845 - DNA, 171 bp, Glycine max
  Peptide Sequence Number=SeqID_215623
atggcggtggaaacgagatgtggtagcgataaggttttgagggatgagcgagagcaagataaagagggagttcaaaaaggaaataagtgcagaagccaaagtatggtgttttgtggaatttgggggaggaaaaggtatttagtaaagggtattggtgatggagagatttga

SEQ ID NO: 98846 - DNA, 264 bp, Glycine max
  Peptide Sequence Number=SeqID_215624
atgttttttaaatcacattttgggaatggccatagatccgtatacctaattttggagcctctatgtaaactaagagagacctatcaccctaagagttggtggctgagttttcaaaaaaagaaagaaagggaggcttggtgcttggtttgtgagagagtttctcaagagctacaagtgaatggtccattttcccattttgagcatgtagagctatggaaccaaggtaagggggagtttttccaaatccttgggatctatgtgtag

SEQ ID NO: 98847 - DNA, 201 bp, Glycine max
  Peptide Sequence Number=SeqID_215625
atggtaggttacatgccttcgagttttccagatctaaaggttgttggcgagagaattgaagcaggtctgaggaaaggaaaatttaattatgttgcttctatgaatcctagtaatgggggacttgggaggaatgacaagaggaagaatgagggagaacctcatgttgtggctccagttctcgcgtggccaaacttccactag

SEQ ID NO: 98848 - DNA, 342 bp, Glycine max
  Peptide Sequence Number=SeqID_215626
atgcagtcaaggaggaaccaccatggagggtggcaggccgcccctagcaccattggtgcagggcccaatgatgcgagaccaccacgggggtggcggcagcatgacgacggcgatgggccatcgacaaagggcctaagggcaaatggtgatggtagcgctcctacattaccacgggataacgacaaatggtggtggcagcatggacagaggcaccgcctctccgacggccaaggtggagtcaccatggagggtgacatgggagttattgtcggtgcgaaagagatgaggtacaaacaaggagtgattcttaataggcttcccgtaggagggatacatgaatga

SEQ ID NO: 98849 - DNA, 327 bp, Glycine max
  Peptide Sequence Number=SeqID_215627
atgtgtgccaagaaaaggataatgagtgacatagaacaagtacaggagcaaatgaaggctgatatggaggccatgaaggagcagatgacaacgatgttggaagcgatgatgagcatgaggaaaatgatggaggtcaacgttgctacaattgttgctgccagtactactactgggagggacctaattcaccttcctgatttcaatcaagagggtcgtccaatcttagatgtagtaggtcaaggaggcaaggcggcgaaaaatgcatataggccttattatgcccaggtccagagcaagtcttctttttcaccatatggtttgctgtag

SEQ ID NO: 98850 - DNA, 684 bp, Glycine max
  Peptide Sequence Number=SeqID_215628
atggcttctaggaaaaggaaggcaccgtctacacctacccaagtcagatttgatagatccagattcacttcccaagaggcttgggaaaaatacactgacattgtggtgcctcataagcttttaccagaaaggaatgtggtggtctactatacagtgtttgatgagttcaagggggaactcgagagatgccactgggatgaagagttgactgattttgttgacgacaacattgatgttgccattgtgaaggaattctatgcaaacctctctgaccccgaggacatctcacctaagcaggatactctcaacacattcttgaagacccctgttgttgtggaagagggggaaacactttgtgcatattccagatttgcactcctgaggccagaccctcaggagttagctgttaagctctgtatcccatggaggggattcaagcttaatgctgatggttatccgttgaagatattgagaaagaacatgaccaccctagcgcagacatggagtgttctatccttctctaacctaattcctacctcctatacttctgatgtcaccctagatagagccaaactcatttatggcatcatcatgaagatggatatgaatttggggtacctcatttcccaccagatctccctcatagcacaacatgacaatccagacttggatatcgtgccttga

SEQ ID NO: 98851 - DNA, 209 bp, Glycine max
  Peptide Sequence Number=SeqID_215629
ggattcctgtccgctgttattgtctcgccacagtctttaaaagaagagaatatgggtctgaggcttcagtcctcactttggggcagaatcgtcttaggcaacggtcagaggtcgagacaaggtcaaaggcagaaaccaatcaaggtacttatggacggacgcaaggagaggctagggtcatgaccaataggtcgtcatcctttgcctag

SEQ ID NO: 98852 - DNA, 726 bp, Glycine max
  Peptide Sequence Number=SeqID_215630
atgacggaaatccaacacattactacctacttcttcagtcatttcccggagggtcatcatgaaatgcagttgagagagatatttagcaaatggggaaatgttacaaaggtcttcattgcacaaaaaaggaatcaaaggggtagcaaatacgggtttttaaggttcaaaggagtgcacaatgcgaagagccaaagcacaggaaggagaacaggcatcgtgggtgtgcgaacttggcaagagtgcaatcgaatcaggaaatggatgttggagaaagagaagccaattggcataggagtgttagaaggcaagaagtgggaaccggatgtcgtccctaggcacatatatatgtgggaaaggatcagagggtttcctctacacatctgcaatgaggtgtgctttgaagggatttttgccaagttaagtaacttggtgaaggtggatgatgagacaagttctctatcaattcttgagtttgcaagattgctagatttgaaggatgaggactcgctggcggtaaggatggatggtatggatgacaacttcctggcatcagattgggaggagaaggatagggatagtacaacagaggatgacactaacagattttatacaaggtgtgttgataaaggaacaaattctatggtggataaagacaaagtggctttctgtcagggaaatcatgagaaagtcaaccttgagataagtgacagacccactatagggtga

SEQ ID NO: 98853 - DNA, 979 bp, Glycine max
  Peptide Sequence Number=SeqID_215631
atggccacgatgttaccgaggtcacaacgggtggagttcttcttgacaaggttgcacatgcagagggagattttgaatttccctccacttaggagtatgcccagggtgggtatccttggggaaaaggcgattataggaggtgaggttgggttaggttttgataggggtgtccttttggtacattcaaatgtagagaaggagtttgggcaaagtaatggtccaggcacggggatggcagtgaggggtaattggtgtagatctgccaatcaaagtaatcctaataaaggcaaggggtgcagggcaacgactaaggccaatcaactaggctacctaatggttgaggttgcaatgcaagataggtgggaaggatggcaactgagaaaggatggattgagcgaggttgcagcatttgaggaaggttgctcaagaggaacaggagaaaggatgtcttcacatttggaccgcaaatgtgggaagaagattggccaattgcgggatatgagtctgtcggtagggaaagttcatcatgggccaaatgcagttatggaaaacaaattcatggaattaaagaagagggataagaaactataccttaagagggagaagggcatatgtgtgcttctatctgtgggggactccaattatggatgggagacttctcctgccaccaaccttgcaagggggttgctctgcatcatggggattaagaggaagtggaaggacgaagcattttgtagggttattatcaatgtgtactcccaatactgcatagagggaaaaaggaccctattgaatcttttaaggcaagagagaggaaggttgatgaatgatctttggtgtgttactaaagacttcaatgttgtaagacctgatgttgggggagctatcggtagcaaaaagaatttcacgtggcttaggagtggattagcaagcttgataggttccttctctccttgtcttggatggattctctgtcaag

SEQ ID NO: 98854 - DNA, 970 bp, Glycine max
  Peptide Sequence Number=SeqID_215632
gttccaccctactgatgaagaacttgttgattactacctaaggaagaaaattacctcaagaaggattgacctcgatgtcataaaagatgtggacctctataaaattgagccatgggaccttcaagagctttgcagaataggagcagaagagaaaaatgaatggtacttctttagccataaagataagaagtatccaactggaactcgcacaaatagagcaacagcagcagggttttggaaagcaacaggaagagacaaagcaatctattcgaagcatgacttgatagggatgaggaaaaccttagtcttttataaaggtcgggccccaaatggacaaaaatcagattggatcatgcacgagtatcgacttgaaacagatgataatggcgcaccacaggcaatattcaaaaagagactaacaaccatgcgtaaactgagtgagcatgattctccctgttggtatgatgaccaagtctctttcatgcaagacttggactcaccaaagcaaagctctcaacctaattttccctaccagcagttccaatatccttgcaagaaagagttagatttttcataccatttacctctccagcttccattagagaaccaaaaattgttccaatctgcagcctccaactcaatgacaccatatggtatagaagaaaaccctaatgccatgcagccagcatcaatcatgcaacaagttcaacaacaaaattttcaagtgtttggaaacaattccaatgatcaacaagtggctgattggagagctcttgacaagtatgttgcttcacaacttagtcaagaagatgcatccaaagatcacaatagttattcaaacgcagacaacatttttcaagtgaagaacaatagcactattgaacagttgagggacttggacaaggaagaaaagatggctgaaaatgcctcaacatcaacctcaagctgtccaattgacatgtggaaatag

SEQ ID NO: 98855 - DNA, 1031 bp, Glycine max
  Peptide Sequence Number=SeqID_215633
atgaaggttatgtgcgacttccatacccatgggttgttccctagaggatcaaatgcctcattcctcatgctgattcctaagaaggacattattcaagactttggtgattacagaccaatctcattgattggctatctatacaagattgtagcaaagtggaagagactcaatcgggcctttgctagaggtagaagcatgatagatagcatggttattgcaaatgaggtaatccacgaggcgaagaggactaagactccaacctttgtcttcaaggaagaattcaagaaggcatataacacagagcggtgggacttcctatattggatgttggggaacgctacagatcaattccaggttcataagggcttgtggggggtgaagttgggtaggaaaggtctacacatcacgattcgacaattcttcgatgatacattggtgtttttgcaaccaactttggagagtgtgatgatgcttaaaggtgttcttaggtgtaatccaacggtttgccagtcttctgatttatatgactgcagggttactgttcacctatcttggtgtactaatagggatgctctgtgggttaaggtgttgagtgttatgtgtggggagcttagaggtagcttaatagatgaacaacatctgaaggggtcactctggtggagggacgtaactaaggttactttggcaagtagtgttgataactggattgtgggatggggacttatggagatggcgcctaacattgagaagattttgagtatcaccccaagtagggaaggggtggatccttggttgtggaggggtggggtagaggaagggtattcggcacaagtgcttctggatagatatttggctcgagatactctagtctatatggctgcatcgaaatgcaatcgtgtttcgtgggaagcaggcaaatgcataggagggactccaaccccgacgagaatttgggagggagttgattgtatagtggggttttttgcttttagtggtatagaggattttggttggatgttaatgatgttggg

SEQ ID NO: 98856 - DNA, 258 bp, Glycine max
  Peptide Sequence Number=SeqID_215634
atgagaccaagtacactgatcacaactattggagcactacgctacctcaatcaaaatgaacaacactacactacactatgctacccattattctacttttggaaactctgccaaaactgcagtggtcacaagtattggaacatcgcactccaagtgagaagtggccgccatggtgctatacacattacaatagacattaagcattcaaaggtctacaaagtgagcacgacttacctcaatcaaaatgagaccctgtga

SEQ ID NO: 98857 - DNA, 474 bp, Glycine max
  Peptide Sequence Number=SeqID_215635
atggattggattgtggtgggtgatgggaagatagatgatggctacagcgatggtccagtagcttatcgtcctggagtttggcgagggccacaacctaaggcaagcacatcaactgcaaagcctacacctcttggtggagttcaggagtgggacctaatacgaagtagctcaacaaaaatggcagagcactgtgggggtcatcgtaatatgatggagcgaatcgcgactccaatgcctgaagcatggtggtctacgatatccaaccaaggggatcttgtctatcgaagcgagggacttcaagtttcatgtggggtctggagggagaaactggcggggggagatggtggcggtttgggtgatggtagggctgaggttaaggaagcaaggcgatctaagacagattcgagtttaaggttgagattatacgagagcgagtattcattcaagaaattgacggggggcacttgtagttga

SEQ ID NO: 98858 - DNA, 384 bp, Glycine max
  Peptide Sequence Number=SeqID_215636
atggctttatggtggtggggttggaattgggtaaaaggtgtatgtggtgggatatggggcagtcagggcaatcgtgacctggggatattggtgctggcagtgcatgatgccaccattactggtaatggttccattggtgtggcatgtagaccgaggaacttggccatgcgcatttgcacgaaattgtgtgtactaccaccatcgacaaggatagtgagcttgtggtggtggacagtgccgtatacccgaaatgtttcgggtgctggcatgccggacatcgcgtttaggctcagatggggaagaggttcttccgatggcaagcgcgaagaaggagcccgagagggggttggtgctttgagaggccctagtgagtgggagaagtaa

SEQ ID NO: 98859 - DNA, 219 bp, Glycine max
  Peptide Sequence Number=SeqID_215637
catagattcaaaaggtactaggttgcctcctagtagcgcttctttaacgtctttagctggacgccttatgacttgtcggtggtggcggtgcgtctattgcccgctaccggccatcctaatgctactgtggtgtctcgccctgcgtctgcctgggggcgcagtacctcttgatgaaagctcgattagtagggggcctgatgcccttgctggaggtgacag

SEQ ID NO: 98860 - DNA, 435 bp, Glycine max
  Peptide Sequence Number=SeqID_215638
atggatcctctctttatcgatgaagatgatgttgtggggcttgatggccctagagatacattgaaaaattggttgacaaagggaagagaaaaacgcactgtaatctctgtggtgggaattcctggggtgggaaaaaccactcttgccaagcaagtttatgaccaggtgcgtaacaatttcgagtgccatgcattgatcacagtgtctcaatcctactctgcagaaggactactgaggcgtttgttggatgagctttgcaaagtgaaaaaggaggaccctcccaaggatgtttctaacatggagtcgttgaccgaagaagtcagaaaccgcttgcgcaacaagaggcatttcagtatagttccgatggagattgtccagaagaacttaaagatatatctcttcacattgttagaaagtgtaaaggtttacctctag

SEQ ID NO: 98861 - DNA, 3121 bp, Glycine max
  Peptide Sequence Number=SeqID_215639
atggcattggagtgtagtagtttccacttcctaaatggggtttacatggtgctgtttttttgccttggcattgtccttgtaaattcggttaatgaagagggtttgagtcttttgaggttcaaagcttcccttcttgacccaaacaacaatctctataactgggattcttctgatttgactccttgcaattggactggtgtgtattgcacaggttcagtggtaacttctgtgaaactttaccaactcaatctgtctggtactttggctcctgccatctgtaatcttccaaagcttcttgagttgaatttgtcaaaaaatttcatctctggccccattcctgatggttttgttgactgtggtggtttggaggttttggacctttgcacaaataggcttcatggaccccttctgaacccaatttggaaaatcacaacacttagaaagctttacctgtgtgaaaattacatgtatggtgaagtgccagcggagcttgggaatttggtatctctagaggaactggtcatatatagcaataatttgactggaagaattccatcatcaataggaaagttgaaacagcttaaagttataaggtcaggtctaaatgctctctcagggccaatacctgctgaaatcagtgagtgccagagcttggagatattggggttggcacagaatcagctagaaggttcaatcccaagggagcttgaaaagcttcagaaccttaccaatatacttctgtggcaaaactatttctctggggagattcctccagagattggaaacattagtagcttggaactgcttgctttgcaccaaaattcactgagtggtggtgtccctaaggaactgggaaagctgtcgcagttgaagaggttgtacatgtacaccaacatgttgaatggaacaattccaccagagctagggaactgcacaaaagctattgagatagacctttctgagaaccatttgattgggaccattccaaaggagttgggaatgatctctaatcttagcttgcttcatctgtttgaaaacaatctgcagggtcatattccaagggaactcggtcagttgagggtgctaagaaatttagatctgtcactgaataacttgacaggtacaattccactggagtttcaaaaccttacatacatggaggatttgcagctatttgacaaccaacttgaaggtgtgattcctcctcatcttggagctattagaaacctaactattcttgatatatctgcaaacaatcttgttggtatgatacctatcaatctttgtggatatcagaagctgcaattcctgagccttggttcaaataggttgtttggaaacattccttacagcctcaaaacatgcaaatctcttgtgcagcttatgctgggggacaaccttttgacaggaagcctacctgttgaattgtatgagcttcacaatctcactgcacttgaactctatcagaaccaattttcggggataataaacccggggataggccaactcaggaatctagagaggcttggcttgtcggctaactactttgaaggctatctccctcctgagattggaaatttgacacaacttgtgacattcaatgtttcctctaaccgtttcagtggaagtatagctcatgagttgggaaactgtgtaagattgcagaggcttgatcttagcaggaatcacttcactggaatgcttccaaatcaaattggcaacttggtgaacttggagctgttgaaagtttctgataacatgctctcaggagaaataccaggcactttggggaatcttattaggctcacagacctggaactaggtggcaaccagttttcaggaagcatctcccttcacttgggaaaacttggagctcttcagattgcacttaacctgagccacaacaaactttctggcttaattcctgatagccttgggaacttgcaaatgctagagtccctttatctaaatgacaatgaacttgttggtgagattccttcatcaattggtaaccttctcagtcttgtaatatgcaatgtatcaaacaacaagctggtaggaactgttccagacaccactacatttagaaagatggatttcacaaactttgctgggaacaacggcttgtgccgtgttggtaccaatcactgccatccatctctatctccctctcatgctgcaaaacatagctggatcagaaatggttcatcaagggaaaagatagtgagtattgtttctggggtggttggactagtttctcttattttcatagtgtgtatatgttttgccatgaggcgtggtagccgtgctgcttttgtttcacttgaaaggcaaatagagactcatgtcttggataactactactttcctaaagaaggctttacataccaggatctcttggaagccacaggaaatttttcggaagctgcagttctaggaagaggagcttgtggaactgtttacaaggctgctatgagtgatggtgaagtgattgctgttaagaagctgaattcgcgtggagaaggagcaaataatgttgacagaagcttccttgctgagatttcaactcttggaaagatcaggcacaggaacattgtgaagctgtatggattttgctaccatgaggattctaatcttctcttgtatgaatacatggaaaatggaagccttggagaacaacttcattcaagtgtaaccacttgtgcattggattggggtagtagatataaagttgctcttggagcagcagaaggcttatgctatcttcattatgattgtaagcctcagatcatccatcgagatataaagtcaaacaacatattacttgatgagatgtttcaggctcatgttggagactttggcttggcaaagttgattgacttttcctactcaaaatctatgtctgctgtggctggctcatatggctacattgccccagaatatgcttacaccatgaaggtgactgagaagtgtagctttggggtagttttgctggagctagttactgggaggtcacctgttcaacctttggaacaaggtggtgatttagtgacttgtgtgagaagagcaattcaggcatcagaatctccattggatgaggatgatggcatttcttccaaag

SEQ ID NO: 98862 - DNA, 318 bp, Glycine max
  Peptide Sequence Number=SeqID_215640
gaacgcctacgaagcattgggaaggctagtggtggtaccattggtatccttgaggatttacaaatgtgtgaatccacatcaagccggagccgttacaaactccatgttgtggtggtgacccccacatacatatttcctaacgatgccccaattgctctaagatcatatctagtgtcaccccaatggtttttctttgacatgtttcattttgaggattcgccctgttgttgctgctgcaccatgcttaagagacacgtcaaacggattcgtccacatgttggagatctccatggagttgagtctacttatatggcataa

SEQ ID NO: 98863 - DNA, 1779 bp, Glycine max
  Peptide Sequence Number=SeqID_215641
atgaagatggttctgtctgggttctctgtgctgctgcacattgttctgctctcaagactttgttttgctggcgacccaactgttttcactgaacttcgtgtatcctacaccactgtttcacctctgggtgttcctcaacaggtcatagctatcaacaagaagtttccaggacctgtcatcaatgttacaaccaataaccatgtaattgtgaatgtgtacaatgaattggatgaaggccttctcctttcatggtcgggggttcaaatgcggcgtaactcgtggcaagatggagtccttggcacaaattgtccaattcctcccaattggaattggacatatcagttccaagtcaaggatcaaattggaagtttcttttacttcccttctcttggtttccaaagagcctctggtggctttggtccctttgttatcaataatagggaaattattcaaattccttttgcacggccggatggagagattttcattatgattggtgattggtatactcagaaccacacggcccttagagcaacacttgatggtggaaaaaatcttgggataccagatggtgttctcatcaatgggaaagggcctttccagtacaacactactcttgttcctggtggcatcaattatgaaacgattactgttgatccaggcaagacttatcgaattcgtgtccacaatgtggggatctcaacttctttgaatttccgaattcaaaatcataatctattgttggtggagactgaggggcattacacaactcaaacaaatttcaccagttttgatattcatgctggccagtcatactcttttctgctttccactgaccagaatgcaagtacagactactatattgttgcgagtgccaggttcgtgaatgaatcattgtgggagaaggttacaggtgttgcaattttacactattcaaattccaaggggccagcaactggtcctctgcctcccccacctagtgatttttatgacaagacagcttcaatgaaccaagcaagaagtgtcaggcaaaatacatctgctagtggtgctcgtcctaatcctcaagggtcctttcattatggctccatcaatataactgatacttatgtgtttaaggttacatccctggtgccaatcaatggtacaaatcgagctactattaatgggatctcatttctcaagcctgaggttccattccggcttgctgacaagcatcaattaagaggaacatataagcttgattttcccagcaagccaatgaacagaaccccagtaattgacagatcaatgatcaatgctacatataagggattcattgagattatattgcagaacaatgactcctctattcaaaactttcatctggatggctactccttttttgtagttgggatggattatggtgattggtcagaaaattctagaggttcttataacaagtgggatgcaatatctcgctgcacaactcaggtttttcctggaggatggacagctatccttatatcgcttgacaatgttggatcatggaatatgagagcagaaaacctggacaggtggtacctaggtcaagaaacttatttgaagatcgtcaatccggaagagaatggtgacaccgagatggctgcaccagataatgttctatattgtggtcccctcaagagcttgcagaagacgcattctactttttctgcagcttctactttgggacatagcttggaccttttcacagtgctcctgggactttttgctatgatttttctcttcctagctagataa

SEQ ID NO: 98864 - DNA, 420 bp, Glycine max
  Peptide Sequence Number=SeqID_215642
atggtgactacaaagtgtgttgtggacatggggaagggcaacttggagatgaaaagacttgttttaaggtggaggaaattgagcaaaaagctaaccttgctgggaggacacctgaattctatgcttctagaagaagatgaagccaagccaattgtgaatcttacagactattctagtatctttctagggccaaaacaggccaagactcgagccactccagacattccaccagctcttccaccaacgcctttaccacgaccaatacctactgatggagagcttccaccatttctccctccaatagctggtcatgacactagaggcattcttagccagattgcttggcccggagtccaacttccttttgttaggcaggacatcagtgatgctcatagagcttgggatccagggcccacatag

SEQ ID NO: 98865 - DNA, 787 bp, Glycine max
  Peptide Sequence Number=SeqID_215643
tctcggccgaaagacgctgacatctcccggaaaggtgcagatgaccacattggtctctgcgtgtcatcggacttggggtctccgaataacgagtcggaagacgctcacagctccaggaagagtgcagattaccacattggtctctacgtgtcattggacttggggtgtccgaatgatgaggtgctaataaccgtaagacttgggatctccgaattttgtggtgcggataaccgtaaggtgtctatgcatgcatccgaactcttgggttaccggatagcaaaaggacgagatgcagatagctgtaaggtgtctctgtatgccaccagactcttgggccgctggatagcaaatggtgagactaaatggtttcgggcaaaagacgctgacgtcttcgagaagggtgcagatgaccacattggtctctgcacgtcgtcggacttggggtctcggaatgacaaagctacgtataacaataaccatattggtctctacgtgtcatcggacttggggtctccaaataacgtgtctcaaccggaagacgctgacatcttcggaaagggtgcagatgaccacattggtctctacgtgtcattggacttgggctgtccgaatgacgaggctgcggatgaccacattggcctctctgtgtcatcagacttggggtctccgaatgacgaggtgagacgaaaatattctcgaccggaagctatcgacatctccagaaagcgtgcagatgaccacattggtctctgcgtgtcatcggactctgggtctccgaatgatgaag

SEQ ID NO: 98866 - DNA, 387 bp, Glycine max
  Peptide Sequence Number=SeqID_215644
atggcaagaaagagacaaaaatgtgatcctggcgacaatagagaaagtatccccataatcaaggtcatatatctaagtgtagcctttggctaccaagcatgccttaaggtgatgaacttcaccattcagaccaaccctagtagcatagatccatttacaaccaatttccttctttccatggggaagataaatcaactctcatgtaccattgtgttcaagagcctggatttcaacaatcacagcatgtcgcagtctaggggacaatggatggtgaaggacatgaaacagatggatcttcatgagatattggactggtgctttgtgtcctgtccttgtatatatgtaatggaaggtgatgtagatgactcaggtggactattgatttga

SEQ ID NO: 98867 - DNA, 998 bp, Glycine max
  Peptide Sequence Number=SeqID_215645
atgttagacattgtatcaatgatatgcatgtggagaaaaatgtgtatgatagtgtcatcgaaatgcttcttaacattcaagttaagacaaaggatggtttgaatactcatcaagatctagctaagatgtgtatatgtgaacaattgcatccaatgtctgatggatactcttcaaatattaagaaccttgttcagctgaaagatctaaaattagttggcttaaagtttcttgattgccacgtcttgatgcaacaactcaatgtcattgatcctgtcaagttagatgagttggaaaacgaggctgctattatcttatgtcagttggagatcatctatgttgaaaggtacattgcagaagaagcaattgagttttgtttagagtacattgaaaaggcaaaacctcttgggcttcttgagtctcggcatgatgaaagaatgggaggtaagggttcaagaggactgcatgttatcactccaagcctagaagaattgcaacatgctcatttgtatatactaaatagcagtaatggagttatgccatacatagttcatctcgaagctttagtcaaggaaagtaacccaagaataggggttagtctaagcgttgaatctcaacattttgctactgtacatgatgacaatccccgtctagcatcaattccttactttggagtcattgaagaaatttgggagcttaattatgtaaaattcattgtctgtgttttcaagtgtaaatgggttgatagcaatatcggtgtacgaaccgacaattttggatttactttggtagatctaaagaagctcgcttatcggaatgagcctttcatcatgggaaaacccattggtgttaatgttgaagatgatgattcaaccattgatacttgtgttagttctttctccacacaaatgccacctaacatcaacgaagaagaagaagttgacgacgtccatgcaaattataatgatcatgatgaaggagaattaattaacaacatataa

SEQ ID NO: 98868 - DNA, 396 bp, Glycine max
  Peptide Sequence Number=SeqID_215646
atgacaaaaaatggcttgaaattgtttcaataccctcgtcttagaaaaggaaattatgataattggtgtcatcgcatgaaagctttgctaggttcccaagatgctttggaggttatggagaaaggtttagatgaatccatgtttaagatagtgtccaatgcctctaggtccaaagaagcttgggagattttgaagatatcccttgaaggtgttggcaaggtgaaaaaggtgcgcctaaaaactctttgtggagtgtttgaatcctgtatgaaggagtttgagtcaattttagattttggcaatagggtgataatggttgtgaaccaaatgaaccgttatgggggagaatatggaagatattcatgttgtagagaaggtccttcattttctaattaa

SEQ ID NO: 98869 - DNA, 528 bp, Glycine max
  Peptide Sequence Number=SeqID_215647
atgtggacgtggccaaagaaggggatgcctcacatcaaccatcctaatcaactgtctaaatcatgtctttttggcaagcatgctagaagaagttttcccaaagaagtcgaatcaagagcaaaggtgcctctccaacttgtccacaccgatgtgtgtggaccaattgatccttcttcattttgtaaaaacaaatatctttttctctttattgatgattttaactttgggagcattgcatatgctcatgtgcctgaccaaggaagatccaagcttgattataagagtgtgaaacaagtgttcattggttatgatgcaatttcaaaaggctacaagttgtacaatccatgcaatgagaagattattgtaaacaaagatgtaaaatttgatgaagaaaagatatggaattgggagaaagaagaaacatatgatttatttccttattttgaagaaaatgttgaagaagttgcagcaccaaatgagttttctactccacctcctttaccaactcaatttattcatgaagcatga

SEQ ID NO: 98870 - DNA, 195 bp, Glycine max
  Peptide Sequence Number=SeqID_215648
atgacttgtacacattctaatgtcgcttatgcacaaggttatactgatgcaagttttgcattagacaaagatgataacaaatctatttcaagatatgttttcactttaaatagtggtgcagtatatggaaatgagaatgtggcaattcctttcaccaaggcacttggtataaaggaatttgacaaacacaaatag

SEQ ID NO: 98871 - DNA, 765 bp, Glycine max
  Peptide Sequence Number=SeqID_215649
atgaaacttcctttttatcctgaattggttagagccttttattccaacttagaaattcaagaagattccttgatttccgaggtatatgggattaagatggtcatagaccagtcccttttcttcgaactcacccagttatccagtgatggtgtaccgtttgaaggtacactagatgatgattggaagttcaacttttctatttctgatgcccacttattggtttgcaccaatcaagtggatatgaccggaaggcttcttgtcggatcattggcattcgaatgccacatcatgcactacttgattgtgcgcatcctacttcctagatcatccaaccttgggcaggtttctgagaaagatttgataattatgtgggttttcttaaccagtcgtcaaatcgactgggcccatcttctctttgttaaagtcaagagatctttctatatcggtgcgaatgtggtctcctcttttggataccgcaaagagagggatggttcttgggtaaagaaggacgctcccacacaggccacagaagaccgctctccatcaccacctcctcagagagatgactcttcatctcttatgcaaagtgttctagacaaattggatggtctccacaccttcgtcggtgagcactttgattccttggacaaccgcattgatgccattgatgcacggtttgcaggaatggatacccgcatcactcagcttgaggaggatatgagtaatgttcgtcagtgcttcgaccttccaccaccattttcatag

SEQ ID NO: 98872 - DNA, 978 bp, Glycine max
  Peptide Sequence Number=SeqID_215650
atgggtgttgaaggtggtcatggtttgttagacatgccttttaccatggaggttaatcatgggggttatttggtttgtgaccccattttgaagtatgctagaggagacagaactctattatcacacaaagacattgacaattggagcttttttgaatttttttggattccgaagaaggatgttaagattaaaggagattttaagttatggtggaagggggatgatgttgaacttaaagagttggcgttggatagtcatactattgaggaaggtgtttgtgctggaatttgtgaggttgaagttatgggaaaggaagttgctgttagttctgatggtctctttgatgttggcaatactaaaaatagtaaggaggagagaacagctgcagatgatgatggttttgatgaggaggaaccttttgttaacatcaatttgaggaaaaaaggcaaggctcaagctcatagtgatattggatccaatggagttaataagcatgcaaaaaaaggagatcatgaaataagtgaggggtatgaatctaaagaacttcacatttgtgaattggaatttgatgaagaggatatagtggatgatgttagattcaggtctagcattgacataagtttggttgttgcttggaaagctaggatgattgctagaggaataaaggatggggatgttatcagacaatacacatatttgaagacttatggtgatgagttgaagcatgcttgtgaagggaataactacaacctaattttacgaagaccacaagggttgttgctacacaggtttgggagcttctatggattggttcaaacacaaggagccaagggagctagtgaagaaaataggtttagcttaagacatttgtatcaaaacttcaagaaaaaattgggtagagggacacttctgagagatgtaacaatgggtgaagcaaaggcaacatatgtgcaagcatgggatgataaaatggcataa

SEQ ID NO: 98873 - DNA, 276 bp, Glycine max
  Peptide Sequence Number=SeqID_215651
atgatgcaatcctaccccccaagggcattggatagaagacttcaagaagattgggccaaagatgcaagagaaggccctagggttctcatgagccttaggcgcgtatccatcgctaagcacggcttcaacgcgcttagcgtgaagaaggaatctggaagagcacctgaaccaaagcagcgcgctaagcgtgagatcagctcgctaagcgagtcatctgtctcttgccaggctcagcgcaacattggcaccaagcccaaatccacttactcgcgctaa

SEQ ID NO: 98874 - DNA, 280 bp, Glycine max
  Peptide Sequence Number=SeqID_215652
gcgagctcagctcgcccaggcgagccaggttgcttcctccagaagcaacagccttctggaggaatattctggagggcccaagactcatgggcctaacttggaattcttgactagagtggaggcatatccatggtgggttagagcactatgtcttgtaccaacatgtgactgtcctcccaatcgtcatccatatgttgaatatgactatgaagtcttaagaggcttagtggcagtgttggaaccaagacaagaactatgtgagagtagaattgaagaatag

SEQ ID NO: 98875 - DNA, 645 bp, Glycine max
  Peptide Sequence Number=SeqID_215653
atgaagactgggacgatgatgatcaggggtcttcgaagaagacctctcgaaagtgaaaaacttcctcttagagcagcacaagacaacaggcttccaccaaaaccaccaaaattacaacaaccatccaagtctaccacctccaaaccattgaagattgatatctcaaagggattggatgattttgataaggatgtgcctgttagttcctctttcaaagctacttctgctgctaccccaaagcaaaaggttgacaaaatagtggatctttcatcatctcaggatccctctcaaagcgatgataacggggcaacatcaattccagagcccataatcgaaaagaatgccattgaggtggattctacacttgatgatcttctgaacattgaaactgaacataaccctctaactgtagaagaacaagttaggatcgaagctgttattgatacctctgctcccatgctagttgttgagacaagtcgcggtggcagtggaggtggtggacgtggtgtctttagacgtggaggtggtggcactgctgcaggcacgactcatcaccaccatggtggtagtaataatggcacactatgcttttaccattttcctctcttgtttctttctattgctatcggaatttctcttatgtaa

SEQ ID NO: 98876 - DNA, 561 bp, Glycine max
  Peptide Sequence Number=SeqID_215654
atggagactttcttcaattggcttgctagggtagaagcgaaaaaatcccaacactggaaaaacatagatatgcctatgttgatggccttattccttttctgcaatcgaagtttacatgcgctggaacttccttatggtccagttagcttaactctattagacatagttgctattattggccttaaacccttaggcaaaacttatgctttaggtttattcaaggaccagatcgaaagagctgaaattgacatagactttagtgataagtcctgtggggatttcatcgaaaagaatgtgaggaatactaaacagatttctaatgtggagtatatagctttttttatgtattgggtatcttcacacctcagttgcactcgttctctccaaattcccatgtatagttataatttagcccaagctcttcattttggagacaatatttgtcttaggaagttttttctagcttcaatctacaaattcatggaagaagctgtcgaaattctggacaccccaggcaaaatgaagccaatagctggacctttgtggattatgtgtcgctaa

SEQ ID NO: 98877 - DNA, 423 bp, Glycine max
  Peptide Sequence Number=SeqID_215655
atggaaatagggatggccatcagacacaaatttattgggtattttagaagttacttgcaaggggtagggtttataccaatcaaatggatcttgatcagtatagatatttacctaaaattttgcagttatgggtacaatagaggtattatagtgcgtaatcttacccatactttcataatgtacatagttcaattgagagtgagccccggcgcagtgataaaattgcgccttgagaaagatggcctggagtcagtctactgtgtgaagagtcttgtttgctatggcttttattatgaagttgtgtatgaagatattctcggatgtatcccatctttctgtcttctttccttattacagactgaaaggtttggctttgcccaagatataacccaattagatgttagtatggagatacaaggttga

SEQ ID NO: 98878 - DNA, 339 bp, Glycine max
  Peptide Sequence Number=SeqID_215656
atgattcctcggtcaaacactgaagatggaggtaccccagccaagcctcaagttgtacctaacccaccaaacactctccttgataccaagtggtcaattggtaagtgctttgatgatgctcaaacacaaaaggagatgaaaatggttccattcaggattgttaaggctccaaatggcgatgcgtgggtggaagctaatgggcaacaatatttccctggccacattggtgcctttgttctcaccaagatgaaggaaattgtagaagcatatctagggaaggttgttgaaccaggtgagcttagctggaacagcctttgggatcctaaaggacttgggtag

SEQ ID NO: 98879 - DNA, 228 bp, Glycine max
  Peptide Sequence Number=SeqID_215657
atggtgatttgggcttactgtggggaacacaagggtcacgcatatgagaaaggggttcgagacccttgtgtggaaacggtggtggtgttgttttcgacttcaaggtgtccgcacgttgtgaaaggaaacaacagtggtaggcagagtggtggaagacacacaatgattgtatatgttgacattgattccgactcgacagcggctacaagtgacgacgtcgtggaatga

SEQ ID NO: 98880 - DNA, 672 bp, Glycine max
  Peptide Sequence Number=SeqID_215658
atgtctaaatattcctctaccttgaaacttctctatttggttatcctatcagcttttgccatcgtgcaagtaacaatggccagcgacccagacattctcattgactacaaactaagggaatgggtgataattctctcctctttcattcttttagatgtattgttgtcatcaactgcagtattgctatcagaatacaacaacccagataggaaattcttcaccttcacgggctttcatgtcctcgttggtcaaaacccttcaccctcaacctttaaggtgtcgaaagcgagcatggtagagtttcctgctctgaatggacaaagtgtgtcttatgctgtccttcagttcccaggtgggaatgtcaacccaccccacactcaccctcgttcttctgaagtagggtttgtcgacacaaccaccaacaagctctgcacgcagagccttcaaatcggggatgtgttagttttccccagtggtcttgcccacttccaacacaatgtcgatgcaaagaatcctgctcttgctatttcggcctttggtagtgctaatgctggcacggtttctcttcctaacacgttttttaacacgtctattgatgacactgtcttggctttggccttcaagaccgatgttgccaccattcgaaatttgaagaaaggtttggcttcctag

SEQ ID NO: 98881 - DNA, 828 bp, Glycine max
  Peptide Sequence Number=SeqID_215659
atggcatttaaatgggctgtccaagtttccttgcaaatattcttagcaagagctacacttgtcgaatcaagcaatggtattctcaacaacaaactacttgtaacaattgggaataaggctggacactatattcccatggtgtcttgcatgtactttgtaatctccaataatcttgggtatcgtccgaatggcctgcagcaaaggatgtctaattccaccaccttgaaagttgtctcagttgtcatatcagcttttgccatcgtgcaaatggcacttgcgggtgacccagacattctgagtgacttcataggcccaataaatggcatgataccagatgggaactttttcacctacacaggcttccgtgtcctggtaggtcaaaactcaccaccctcaactttcaaagtattgaaagcaaccatggcagagtttccagcactgaacggacaaagtgtgtcttatgctgttcttcagttcccagcaaataccatcaacccaccccacactcaccctcgttctgcagagcttctttttgttgcacaaggttctcttcaagtagggtttgtggacaccaccaacaagctcttcacgcagagccttcaagctggggacatgtttgtcttcccaaagggtcttgttcacttccaacacaacgccgatgctagtaagcctgctcttgctatttcgtcctttgctagtgccaactccggcacggtttctcttcccaacacgctcttcaacacctccattgatgacactgtcttagctttgtccttcaagactaacgttgccaccattcagactttgaagaaaggctttgctccttaa

SEQ ID NO: 98882 - DNA, 426 bp, Glycine max
  Peptide Sequence Number=SeqID_215660
atggaacacatatggaagcatgtgatgctagtctgcattgtgctgctgtttcatcatcatcttcttccggtcactgcagaacaccaaagaaactcctctcatacagacaaggcaagaacaacggctataacaagttcaacaaaaattatagtagcagttaataggcggggtggtggtggcggcggccatgccggtggtagtggaggtcgtgggggttttggaggtggccacgcaagaagcatgggaatgtttaatagtcgtggtggtggtcacgcaagcagcatgggaatgcatggtagcacaatccctttatatggagctgctgttggaggctctgctcatcagagaaacaataataataatcaccatgatgttcatcctccatcagttaaaacgggcaagttcaaggatgaaaaaataatttaa

SEQ ID NO: 98883 - DNA, 729 bp, Glycine max
  Peptide Sequence Number=SeqID_215661
atggaagaaaagattaataaggagcaccaggtttgcacatccgatggagctattgatagccatggtcatcctgcagttcgaaagaaaacgggtgactgtgttgctgcaattttgattttagtgaatcaagggcttgctactttggcattctttggagttggagtgaatttggtactgtttttgacgagagtgatgggtcaagataatgctgaagcagccaacagtgtgagcaagtggactgggacggtttaccacttctctcttcttggagccttccttagtgactcttactggggaaggatgatgatggactatggactttgtggttctgggcttcagctggctcgatctgctgctctggcattgattttgtttctttgtggcacacgaaggtatagatactttaagcctaatggaaaccctcttcctagattttgccaagtttttgtggctgctacaagaaaatggaaggccaaggtgctacaagatgataaactttacgaggttgatgagttctcaaccaatgaagggagaaaaatgttccacaccgaaggattcaggttcttagataaagcagcatttatcacatcaaagaatttcaaacaaatggaagagagtaaatgcagtccatggtatctatccattgtgacacagcaaggtgatgtcatggacacagaatttcaaggttccacattcctcccgcaagcatgtccacctttgacattctaa

SEQ ID NO: 98884 - DNA, 333 bp, Glycine max
  Peptide Sequence Number=SeqID_215662
atggaaaaaaagaaaaagaaaaaaggctttgggctaggatgtcgtgcgtcagttcacaacgcgcttgcgaaacggcgtttggggcttcgattgacagagattgaggtgttggttagggttttacggagagtagctgtggatttggaaatttcttatgaaactgtgttgtggcattatcgggagagagagaattgcggatttgcaattccctcccctttctgcggtgaagtcagtccaatgaggtgtcccacacggctgcttcttgcctttcttctggaagtttcacgcttgcatattttcatgcccttttgtttggagtggagggagcaataa

SEQ ID NO: 98885 - DNA, 213 bp, Glycine max
  Peptide Sequence Number=SeqID_215663
atggaggacaaaaggaccgcaatcacaaataaccaagcaaggaagaaaatccacccattaattagaagcttaagcattggcggcgaaggtgggattgtggggcttgttgtgttcggtggagccttggccattgcgggtttcatggaagttgcttcttttgcgagcaacaaaaataaggcaaaggacactcatgatgatcaccaacaaaaataa

SEQ ID NO: 98886 - DNA, 114 bp, Glycine max
  Peptide Sequence Number=SeqID_215664
atgaccaatcatcaaaagagtgcctcaaacaacttaatcagaggggctaacattctagttgatcctaatggtgaaatcaagctgacagactttggaatggctaaacatttataa

SEQ ID NO: 98887 - DNA, 252 bp, Glycine max
  Peptide Sequence Number=SeqID_215665
atggaggccaatacattcctgccaccagccacaaagtcccaggccaagtactctgatgacaaagagatcaaaaacgggaagacaaataccaagtggctctctgtacctagccaggaagcatcttttggaaaggcctcttcttttgctggtgcctctatggtgtcgtcatcgacggctgctgctttgattattttggagaacttgaggggcttcgagcgggagaaggagaggtgcggcgttacacaagactga

SEQ ID NO: 98888 - DNA, 747 bp, Glycine max
  Peptide Sequence Number=SeqID_215666
atggaagaagattatccacccgggtttcgtttcttcccaacagaagaagagcttgttggcttctacctacacaacaagctagaaggccaaagaaatgccatagccatagccatagacagagttatcccagttattgacatcaatggagttgagccttggaaccttccaacacttgctggggagctttgtcgtggggacacggagcaatggtttttcttttcgcccggtcaagagagggaaaccaggggaggcagacccagcagaaccacagcttgtgggtattggaaggctacaggttctccttgctatgtttactcttctcacaacaaagtcattggggtgaagaaatccatggtcttctacaaaggaaaagcacctatgggaacaaaaaccaaatggaagatgaatgaatacagagccatccatgtcccttcccaatccacccctgccacccttcatttgacatgtgaattcagcttgtgtcgggtatatgtcatatcggggagctttcgagcatttgatcgacgaccattagagaaagaaggagcagagtcgcgggttcatagaattgagaataattttggtggggcacgtgctcaccaaacttgccctcactctcagatgctagaagctggagaatcaagtatcacaaagtgggatgtgaataataataataataataataatgggttccaacttcaagaaccggtgtgggaattggaatgggaacattttaattggctctaa

SEQ ID NO: 98889 - DNA, 342 bp, Glycine max
  Peptide Sequence Number=SeqID_215667
atgcagaaattttcctccaagctacgcatgtcactcactagagattacgattacgaaggaggaggagaagaagaagaagaagaactcacttccgaaggtgtcgttggccatacagacgtaggtgatgccatccgatcggagtatgtggaagatgtagcgatcctgagagaagcagagcctggagtcggactccgccggaagcttctcgaggatgcggcgggagacggcgccggtgttgccggtgacggcgctgaactccgccaggacgaccgtgcctctggccaccaaagcgtagaagatcgccatcggcagaagattagggagaacgttctctgcctctag

SEQ ID NO: 98890 - DNA, 2745 bp, Glycine max
  Peptide Sequence Number=SeqID_215668
atggttgatggaaactatgttcaacccgcgattcctaggttcgatggtcattatgatcattggacaatgttaatggaaaatctccttcgatcgaaggaatactggagcttggtggaaaatgggatcacaacagcaccaacaggagcaacccaagaacaactgaaaagtgaagaggatagcaaattgaaggacttaaaggcgaaaaactatttatttcaagctatagatagaagtattatggagacaatattaaacaagaatactgccaaggagatttgggactccatgaagcataagtaccagggttttacaaagaactttgccattgtgaacaagatgaaatcacatggtgaaaaggtggagcagcttacaatagttgaaaagatactaaggtccatgactgccagattcgattatgtggtgtgctcaattgaggaatctaacaatgtgattactatgactattgatcaacttcaaagtagtctcatggttcatgaacaaagaatgaaagggcataaagaagaggagcaggtgctgaagatcactaatgctgggagaacaggaggtagaggaaggggtcgtggtagaggtggaagaggtcgagggagacagttctttaacagagaacacgtggaatgcttcaaatgtcataaattggggcatttccagtatgaatgtcctatgtgggagaagaatgccaactatgcagagtttgatgatgaggaagaaatcaaccatatgtgtggaattaaagattggttccttgattttgatgataaattcaaagaattagtgaaactgggtgacaattcgaggatggcagttaagcggaagggcaatatcaaattgaaaattgaagggataactcaggtaattataaatgtgttttacatcccagaattgaaaaacaatcttcttagcattggtcaacttcagcaatggaatctcactattgtttttaagcaagacatgttgattgtcccttcctgcttgcaaatggagagtgagggaagtacacatctatggcattgtagatatggtcatctcagcatcaagggactgaagattcttgcacagaaagaaatggttagaggcctaccaaaacttcaggagtcttgccaagtgtgtatagactgtatggttggcaaacaacacaaagaagcgattccaaaggagagttcttggagagcctcacaaagattggagcttattcattctgatatctgtggacccatcaatctagaatccaacagcaataaaaggtatttcattacctttattgatgactacagtaggaaatcttgggtttattttatgtcagaaaaatctactacacttgatatctttaagaagttcaagattatggttgaaaaggactctggaaactctatttgttgcttaagaactgacagaggtggagaatttaattcctgtgagtttaacagcttctgcaggaacaatggtattaaaaggaaacttattgcaacatacacatcacaacaaaatggtgttgccaagaggaaaaatagaactatcatgaacatggtaagaagtatgttgtctgaaaaaagagttcctaaacagttctggccagaagctgtgaaatggacaatttatgtgctcaatagaagtcatactctagctgtgaaaaatgttactcctgaggaggcatggaatgacaccaaaccattagtcaaatactttagagtctttggttgtattgcctatgctcatgttccagatgctcaaaggaagaagttagatgacaaaagcatcaagtgtgtgcacttgggagtgagtgaggagtccaaggcttacaagctttatgatcctattacaaagaaagtcattgttaaatgcaaagatgataatgaaagttcagaaggggaaaatgtagagattgaagctacacagaacactgataatgaaaatgcaaaatcaaaagatcagaatcctcaagcgacagattcaccaaatcctgctcaagggaggaataggagacaaccggcttggacagaagactatgtgacaattgatgacctgcagaaccttgctatattcagcattgcagaagatccaaaaacgtatgaggaagcattgcaaaacaatgtgtggaggaaagctatggatgttgaaattgacgcaattgaaaggaataatacctgggaactgactaatcttctttctggagttaatacaataggagtgaaatggatctacaaaactaaatgtaatgaagatggaaaggttgaaaagtataaagctaggcttgtagcaaaggattacacacaacaacatggaatcgattataaagatgtctttgctccagtagctagatgggatacaattagaattattctagctcttgctgcagtcaaaggttggaatgtgttccaacttgatgtgaagagtgcatttctgcatggagaactgagtgaaactatgtatgttgatcaacttttggggtaccagaaaatgggtgaagaagataaggtctataagttgaaaaatgcactatatggtctcaagcaagcccttcgggcatggtatagcaagattgaatcctactttagcaaacagggatttgtcaagtgttctcatgaacacaccttgtttgttaagacaagaaatgaaggcacgttgcttattgtgagtctatatgtggatgacttaatttttactgggaatgatgaagagatgtttgatgtattcaagcagttaatgaaggaagagtttgatagatag

SEQ ID NO: 98891 - DNA, 489 bp, Glycine max
  Peptide Sequence Number=SeqID_215669
atggggaactgcatagttctacaagaaaacgtggtaagggtcatgaaaagtgacggcaaaatcctcgaatacaaagcacccatcaaagtccatcaagttctgaaccagtttccgggccatgcaatatccaaatccctaccagtcttacaccatctccaccccaacacaagattgctcaagggccagttatactacctcgtgccgccgccacaaccttcgccgaaaaaagtgaacaaaaagagggtgaggtttgctgaacctgatcatgatgatgatcaagtggaagataagggtgatgaggtggttaggattaagcttgttcttagtaagcaagagctgaaggacatagtgcaaaaaggagggatttctgttagagaggtgttgtctttggtacaaggaaagggaatggatggtgatgtagatgtgtgtacaagagttaacgatggttctcatgggtggaaaccagcgttagaaacaataccagaataa

SEQ ID NO: 98892 - DNA, 213 bp, Glycine max
  Peptide Sequence Number=SeqID_215670
atggcgacacgaggtgactcagcatgtctcgccagtctgagcagcggcataggcgtgagtcagctttggttccgcttttgccaatggcgcacaggggttgactcgttaagtctacacagagtcataactcatagcaagaattgtctgattgtaaagcaagtgaattatcatcgtatggtccacgtcccactactacggttaaaaatcgtgtga

SEQ ID NO: 98893 - DNA, 240 bp, Glycine max
  Peptide Sequence Number=SeqID_215671
ctaactatttatgtgttgatgagagcagccggttcatctggcactgatcgcaagacggaacatgggaaagagcatggttctgatcttagtagcggtatgcagatgttactatcaatgggattcagttacatgcaagcgattgaggcttacagcatatttggggacgatgttgattccatggtttgttacctgttagaaactggcagtagcagcagacgtaaaggcaaggccactgaatga

SEQ ID NO: 98894 - DNA, 159 bp, Glycine max
  Peptide Sequence Number=SeqID_215672
atggaactaaaaattgatggtagcaatattggagaagacatgaggcactcaagtgagatcataaagggcatgcagcaccatgacaatttgatggaaaactggctgaaaaaagggcttagtgctaggtggtcgatgttgcctacacgcatgcataattga

SEQ ID NO: 98895 - DNA, 213 bp, Glycine max
  Peptide Sequence Number=SeqID_215673
atgaaaaaagttaagaaaaaaataaaattgggaatgggaacatactcgaacgcagttttgggtgatgtgaacgggctcggaggaaaaaggagagggagtggcatgatgaagagtggaagcagaagaagaagaagaagaagaagaaagacgaacgaggttgtggtaatgtcggaatcgtgcagccaaatgaagagcaaggctttgaatcattga

SEQ ID NO: 98896 - DNA, 213 bp, Glycine max
  Peptide Sequence Number=SeqID_215674
atggttttcattgctcgggatgggaagaagttgagaattgatgaagagcttgtggcttgctttggcaaatattcaccgattcctgttacttatgctggtggtgtgactgaaatggctgatctagagaggataaaaactgccgggttggacggtgtgaatgttactgtgggcagtgccttggatagcatttgccttcaagaggttgtagcttga

SEQ ID NO: 98897 - DNA, 573 bp, Glycine max
  Peptide Sequence Number=SeqID_215675
atgggtacttcagagtttagccacgacacatggaaagagaaagagagagaattggtattttacttaaagggaacaaatgtggaacagtggaagcacaaaagcatttcaatgaaatcagaaaccataaaaccaggcaagcatcaacggggaaacaatagaggcgagagagaaaccaaaagcaacaaaaccaaaattagcaagcagcaaagagggaaacggaggcgagaaaaacgcaagcaacaacatggagcagatgagaaaactcagaaaagaaagaagggcctacatgcaaagggggaaacagaggtagcgaccagcaatggaggttcgcttgcggcaaggagaagacgtgcagaaacgattttcgttttagttggttgggccacgtttggacgcgcgtgtccacttgttgggctgcgtccaatcacgcgtctcctacatccaaccgtgtccggcgacggcggcggcaacggacaccgtgtcgcaccggagtcatacccgtttgtgtgtccggtgcgtctccgacgcgggacgctgcacttcgacagtgtgtccgtgcttcatagctggtaa

SEQ ID NO: 98898 - DNA, 906 bp, Glycine max
  Peptide Sequence Number=SeqID_215676
atggataccctctcaaggattagattcctccccacttgttacagccttcagttaccaaaaatctctgcattatctcgtttcccaaatgctttttccaaaaccactcaccaggtttcagtgctaagagtaagagcttctcgtccttcagtgagtaatgcagacgaggatgtcttgcaaatattttttaaggagagagaattaaatggggattttatatcaagagcttccgatttactatggagaagagatttcagaagttctggtgattatgatattagcgagctcaccaacaacacttctcaacaaactgagcagatcatagagactgacaatgatgctggttttttgaaacttacaagaacccaagagtggttaacaggtgacaattctccaccaataaacacgaaggtgactgctaagctcaagagggaattactgcttctatctgtgggtattggattggcttgtagtggatattgcttggttattttgtccgtacaggttgctataagttatgcgattggagtccttttcagttgcttgtaccttcaactcttgtatcaacatgcagacaacctatccagtgaagatgttcctcaaatattcaagaaaaagaagtcaaagaaaattggtataagaagtgaagaccttgaagatttcttggagaggacaatcaagggtagcggtatatcactttcatctcctaggctagttattccagcaacaatatatggactttggattctgtttcatcagtattttaccaatgacatttttgatttccagcttgtgccagccatgttcggaatgtttgtctacaaggctgctgttctggtgcaagcttatagagataatgaacgcttacggcttgtatttccagaaaatgaagagggatcaagctattga

SEQ ID NO: 98899 - DNA, 162 bp, Glycine max
  Peptide Sequence Number=SeqID_215677
atgttgattataaggaaaaaccccatgaggcctcgtagtaacttgtcactgtcattggagactgcattagctatttcggatgttactaggaaacgaccaggcttagaacaaaaggagtcaagacttttcttctgtgcaagttgtttcgaggaattgggttag

SEQ ID NO: 98900 - DNA, 276 bp, Glycine max
  Peptide Sequence Number=SeqID_215678
atgaaacgctcaaacgacgacgtcgctgctcctgtctcaatcgccaacgccgccaggaagacatcgtcaactagaagcgccgccaggaatagctcctcacccacaaccactcatccaatcccaagccctcctccgactgcgacagagaccaccgagactgggacggtgatcgtgaccaagaccgggacagagatagagaatgcgtgcgagcgtgagagggcacatgatcgggaccgtgaagccaaacgccacaacaaagagagggagcggtcatga

SEQ ID NO: 98901 - DNA, 278 bp, Glycine max
  Peptide Sequence Number=SeqID_215679
agaaagaggaagaagatgatgatgagaggcatgaaaagaaaaatgaaattgaaatgagcgacttggatgagttggaccttgcccaaagagaaaacctagctagtgtgtgtttggattgctgtttagagtttgttatacggataatcacactttccaacgttaaaaacagcaaagaaagtcttttttatctcgttgagatgaaagttacgttcaacaaaactgatatacaaacataccttaagcttaatatgtttggatacggattatatccaagttga

SEQ ID NO: 98902 - DNA, 123 bp, Glycine max
  Peptide Sequence Number=SeqID_215680
atggataccgtgaaaagtctgcaatggacagatttgaagaacattccagaactacagaataagaaggttgatgaaatgaatcaatacagtacagagaatcaagccaataaatcaaggcaataa

SEQ ID NO: 98903 - DNA, 208 bp, Glycine max
  Peptide Sequence Number=SeqID_215681
aacattagcagattttaggtggtacagagataccttcctaactagagtctacaccagagaagatagtcaacaacctttctggaaagaaaaatttctagccggtcttccaagatcattaggagataaggttagagacaaaatccgtagccagtctgctaatggagacattccatatgagagcttaagttacggtcaattaatctcttag

SEQ ID NO: 98904 - DNA, 810 bp, Glycine max
  Peptide Sequence Number=SeqID_215682
atggcagggaagtataaagtacatttagtgatgggtgtgatagagagggacggctacacactttattgcaccgttctgttctttgattctcagggtcattacctaggaaagcacaggaaaatcatgccaactgcattggagcgggttatctggggatttggggatggatcaaccattccagtgtttgaaactcccgttggaaaaataggtgctgccatttgttgggagaacagaatgccactattaaggacagcaatgtatgccaaaggtgtacttagcttaaaatttacacatctcgcgatagctgcacttagcgagtatagcagtgattacgcgcttagtgcgggattcgcgctaagtgccttcaggtttcttcgtgtggagatatattgtgctccaacagctgatgccagggatgtgtggcaggcatcaatgacccatattgcacttgaaggtggatgttttgttttgtcagcaaaccagttttgtcggagaagggattacccaccccctccagagtatgtttttgctggcacagaagtggacctgacaccggattctgttgtgtgcgccggaggtagtgtcattatatcaccattaggggctgttctggctggaccaaattatgacggggaggcgctaatctcagcagaccttgatcttggagaaattgcaagagctaagtttgattttgatgtggttggacactattcaaggcctgaagtgcttagcttaactgtaaaggaccatccaacgaaccccgttacttttacatcaacatcgacaaaaattgaagacaagaccaagtag

SEQ ID NO: 98905 - DNA, 2023 bp, Glycine max
  Peptide Sequence Number=SeqID_215683
ataccgtttcaagagagccattttggttgggaagaaaggagggtcaagtaccccagttcccatgtggaagactaacacaagttcttctccttctgttcctactcaacgacaacaacagcaacaacaacaccacacgaagcctttgttgcattcttctggctccatgttaccctccaaggacaaggagctttctgtttctgccagaaaactcgctgctacactgtgggaaatcaatgatttgcccccttcgagggtgaagaaggagttcgaggttgatccaatgagaggctgcaaggagaaggttagaagcagagagaagaagggtgtgggtttgtccagatcgggcttgttaaggccacagatgtcagatccatctcatagtcctgcctcagagaggatgaaggggcttgaagggggtagctgcaagagaagagtatcgaggttttctcatcagcttctgtctggtgattactatttggatgctcttgatgctcatagcagtgccaattttattgagggtacaactggaagttatagtcccacattggaagaactggaaggtttttatcaactggtatcaaagtctttcaccatgtctctcaactgcaaactgagggggcttgagttgtctaactacaacaaatggcacttgatgcatgaggtagaaaatcagctcagaagcaagaagaatcgcggcaaaggcacaggtgatgttaggaaccgtctgaaggaggctagaagtggcctatctacatcaaagaagcttctaaaggtgttaagtcaaatgtgccttagagagcagcaagcatcaagcatgccccttgtcttggctctggggagtgagcttgatcgagtgtgccaccaaattgatcaactgatccacgaacagtgctcgaaccagaacgatattgagtatgtgatgaagcattttgcagaagagaaggctgcttggaaaagaaaagaacgagaaaggattcatcatgccataaaacatgtggcggaggagcttgcagtggagaagaagttgaggaggcaaactgaaaggttgaacaagaagattgccaaagaaatggctagtgtaaaagcttcccatttgaaagcatccaaagagattgaaagggagaagcgtgcaaaggagattcttgagcaaatttgtgatgaacttgccaaaggcattggggaagatagagcacaggtggaggaactgaaaagggaatcagctaaagttcgtgaggaggtggagaaggaaagggaaatgcttcagttagccgatgttttgcgcgaggagagagtccagatgaagctttcagaggctaagtatcagtttgaggagaaaaatgctttcctcgaaaagctgagaactgagcttgaggactttatgaggactaaagatggacaaaatgaggatgtttctcccgaatgtaaaaagatcaaggatcttgagtcttatttcaaaaatgtctgttggggattccagaatgcagagaaggaggatgattcggatgttgaaaatgatgtagggcatgaaggagatgatgattcagatgacagtgatctccactccattgaattaaacatggatgatgacagcaaaggctacaagtggagttttgcttgtgaaaatgttggtcaagataagagattttcaattgacaaagagagtattgggaggaagtctttctctgagaaaattctgtggggaagtatttgcttcaacaagggaacatcaagtggtaggaagagggatttttctataaatattcaggaggtttccgatcattttgatcctgataggtcaattgaatttctttcacaagctactttacaagatgataaagatgaaactcagagcaataggtctaataaggggctccaagacactgtgtcgtgtgccaattctgacaagagaaataatctattattagctttgcagtgtgctggtggagaagctggggaaaatgctcttgccctggaaggtgacaatttgaaacaagaagttgcaggaaaaaaatctggatgttaa

SEQ ID NO: 98906 - DNA, 3274 bp, Glycine max
  Peptide Sequence Number=SeqID_215684
atgggtgccatggatgattctaatccctttctcatacaaaccagtgataatcctagtttgagccttgtcactcatcctttatccggagagaattataattcttggaagaaagccatcaagatggctcttcttggcaaaaataaattcggttttgtggatggttccattctcgaacctccattagagcacttcagtcatgctttgtggcagcgaaataacagcatcgttgcttcttggcttctcaactctcttataaaggagatacaagtaagcatccttcattgttccactgctcaagctatttggaatgatcttaaggagagatttgaacagaggaatggtcccttgattttccagttgaaacatgaactagcaaatctgcagcaggattctatgattccagatatcagtctgttcacaaggttagtgctatttccagaaatcgacctctctgtgcacattctggttgacttggtcatactcaagataagtgtttcaagttacatgctcactgctcaacaatatagccaactcatgagtttgcttcaagcacacacttcaaatgctgctactcctgatattgaatcttctaacactggtatgatcttgtctgcttctttaactaagtttcctcaaaattgttggattgttgattcggttgtctcagtcattgcagttggcattgtgcatttatctccttctctaactctctataatgtgtctttcattcccaactttacctttaatctccttttagtcagtgccctccttaccaattcagcttattctgtttgtttttcttccaaccaatttgtcatacaggaaatgcctcattgcaagaagattggtagaggggatctccttcatggactttatgtcttgaacctcatggatactcattccacttgcaatgtttctgatcataattcctgtataaattttgtttccagcacttgtattcaagccattaattggcataatcgatttggccatgtatcagatagtgttttaaaaatattgagtgataaaatttcttttgccttacctaatgagttctccaccaaaagttgttacgtgtgtcctattgctaagtttcgtacactatctttcccttctgttaatcatgtttctgctcagccctttgacttgattcattgtgacatttggggaccttataagcattcaacttatgctaactatcaatactttctaacaattgtggatgacggttcacgatttacatggatttttatgcttaaacataaatatgaagcatcaactgtaatcatgaagttttttgcaatggtaaagactcaatttgaagcttcaatcaaatgtctaagatcaaataatgctcaggagttagctctaacaaatttcctagcatctcaaggcaccttacatcagttttcttgtgttgaaagacctcaacaaaattctgttgttgagaggaagcatcaacatttacttaatgttgctagatcattattttttcagtccaaggtgcctagtaccttttggggagagtgcgtggttattgctactttccttatcaatagattgccttcaccattgctgaaacaaaatactccataccaagttctttatggttctgcacttgattattcaattttgagatcttttggttgccttgcctttgtagctactttgaattctgagaggaataagttctccccaagagcaatcccttctgtgtttgttggttatccacaaggaatcaaggggtataggcagtataacctgcagactagaaaattttatgtttcaagggatctagtttttcatgagaacattttcccttttcaaactttaccaaatacatttcaagaacctgatttccttagtgacctagctgtttccctacctattcctgaatctatgtcctcaaccattcaacctagaatcattgaaaccaatatctctgaacccaatatttctcatgccacaaataacctgcctattcaattatctgattctgcagtcaatactaccattagtgcctcatatgctttgccttctccttctttgagaagatccattagaacatcaaaccctccaccttatcttcttgattacattagacctcaacctagacagaaatctcaccctatacaagatcattactctctggttcatctcaactctccttataaggacttcattgctcagtggcaccaagccatgacagctgagatcaaagctttggaatccaataacacatggactttggttcctcttccaattggtaaacaatgcattggctgcaagtgcgtgtacaaagtgaaattcaagcctgatggcactgtggatcgccacaaagctagattggtagctaagggttacacacaacaagctggtattgatttttctgatactttctctccagttgctaaacttacatcaattagagtccttttggctgttgcagctgctaaaaactggccaatcttacaacttgatgtagataatgccttcttgaatggtgatctatttgaggaagtttatatggaacttccaaaagggtacacttcagttgataaaaatcttgtttgcaggctcaacaaatccatttatggccttagacaagcttctagacaatggttttgtaaactctcaacaacattaattgctaatggtttctctcaatcaaagaatgactattctctttttaccattggcaaaggtgcttccctggttgttctgttggtctatgtagatgacattttgcttgctggcccaagtgctacatgtgttcattctattcaggccaagcttcaagctttgtttagactgaagatccttggttccttacaatattttctgggcctggaagttgcaaagtccagcaagggcgttgtcttgactcagggaaaatatgccctttcactattagaggatattggttttcttggctgcaaaccatcttcccttccaatggatccaaatttaaagctcaacatgcccagtggtgatttactgcccaatccctcaatgtacaggcgtttacttggtcgtctcatgtacctaactatttcaaggccggatattacatttgctgttaacaagctaagccagtacattcaacatccaaggacacctcatctagatgttgtgtatcatctcctacaatatatcaagggcactccaggtcagggtcttcattttccagcaagtaactccttcaacttatttacctatgcagatgctgattggggaggatgtttggacacacacagatcgacatctagttcct

SEQ ID NO: 98907 - DNA, 204 bp, Glycine max
  Peptide Sequence Number=SeqID_215685
atgaagaagaagaaggttgaagcagctggtgtctcgctaagcaaggcatatgcgcttagcgacgagttggaagaatttggaagagaatctgccattcatgcacgtgcccaacacgccatcagctcgctcagcgagtcatttgtctcttctcacgcccaactcgctaagcgaaaatcgactaactcgcgcttagcgggaaaatga

SEQ ID NO: 98908 - DNA, 208 bp, Glycine max
  Peptide Sequence Number=SeqID_215686
atggccatgacaagttcaagagaaactatagcatcagttaataggcgaggtggtggaggtcatggaggtggtcacgcaagcagcatgggaatgcatggtggtgagaatggtgaacacggcaatttgccacgcccacttggcacaaaccctgtatatgcaggtgctgctgcaggatctgctcaccagagaaacaataatcaccaccatg

SEQ ID NO: 98909 - DNA, 354 bp, Glycine max
  Peptide Sequence Number=SeqID_215687
atgtgtaaaaagaggttaagttgcaacttcctttaccttcttccagtagctgagaccagtgagacacttgccatgtctgagttttcggatggagaagtaaggggtgaaagtggtggtctgccaagcgcgaccactagtagtggcctaccaggcgctaccagtagtggtggggtcccaggcgcaaccactagtggtagcttgtcaggcgcgtccactagtggtgggcccaagcacgtccctctttcctataaaatctcttcccttccgattcattttcacacaaaaacgttgaaaaaaggttcgaccaacacgttttcaatgctagtggtgagttttgaatgtgcgagtaattaa

SEQ ID NO: 98910 - DNA, 1038 bp, Glycine max
  Peptide Sequence Number=SeqID_215688
atggcaactgtttctgcggtctcagctcctattagaaggcttgaggggaaagtggcgattatcactggtggtgcaagcggcataggtgaggccactgcaagactcttctctaagcacggagcacacgttgtcatagctgatattcaagacgatttgggcctctctctttgcaaacacttggaatccgcttcctatgttcactgcgacgtgacaaaggaagaggacgttgaaaactgcgtgaacacagcggtttccaagtatggaaaactagacatcatgcttaataacgcaggtatatgtgatgagatcaaaacaagcatactagacaacaacaagtctgattttgagagtgtcataagcgtgaacttggttggtccttttctgggaacaaagcacgctgcaagagtcatgatcgctgctaaaaggggaagcataattaacacagctagtgttgctggaaccttaggtggagtggctacacatgcctacacaagttcaaagcacgcgctaattggactgatgaaaagcactgcggtggagcttggacagtttggtattcgggtgaattgtgtgtccccttatgtggttcccacaccgttgaccaagaaacatgccaatattgacgaagaaggagttcgtgagatttattccaacctaaaaggtgttcatcttgtgccgaacgatgtggccgaagctgctctttacttggcaggtgatgagtctaagtatgttagtggtcacaatctcgtgttagatggtgggtacactgatacttacaagggtgccataggcggtgtggaggagctcatcgtggaagtgcttagggaaggcaaagaggccaaagtcgaagaccttgaggtcgtcgacgtcacccaagaggaggttctaatgggagacgtcgtggcagtggcaaaaacggagtgtgaagacaagctgctcaaagttgagatgagcgagggcaatggggtctgggaggcggtcgtggcaggaaacttgaagaaaagcttgtcgtcgccaacgaagtcgatgatgatgtag

SEQ ID NO: 98911 - DNA, 978 bp, Glycine max
  Peptide Sequence Number=SeqID_215689
atgccatgtaggcttgaggggaaagtggctattatcactggtggtgcaagcggcataggtgaggccactgcaagactcttctctaagcacggagcacacgttgtcatagctgatattcaagacgatttgggtctctctatttgcaaacacttggaatccgcttcctatgttcactgcgacgtgacaaacgaaaccgacgttgaaaactgcgtgaacaccaccgtttccaaacacggcaaactagatatcatgttcaacaacgctggcataaccggtgtgaacaaaaccagcatcctcgacaacacaaagtcagagtttgaggaagtgatcaacgttaacctagttggtgtctttctgggaacaaagcacgccgcaagggtaatgatccctgctagaagaggaagcatagttaacactgcaagtgtttgtggaagcataggtggtgtagcatcacatgcatacacaagttccaaacacgccgtggtggggctcacaaagaacactgcggtggagcttggagcatttggtgttagggttaattgcgtgtcaccctacgtggttgccacgcccttggctaagaatttttttaagcttgatgatgacggagttcaggggatttattcaaaccttaagggtactgatcttgtgcctaatgatgtagccgaagctgctttgtacctggcaagtgatgagtccaagtatgttagtgggcacaatcttgtggttgatggaggcttcactgtggtcaataaatattatgtcactttgattttgggcaccccgacattacaccccgacattacagacactaagacgtggggtcatctgttggatgacttaaaggccaacaccgagtataccggttatacagtggcatcaaatgttgttcaatggttctgggaggtggtcaaagctttcaacaaggaagacatggcaagattactgcaatttgtgactggaacgtcaaaggtgatgtag

SEQ ID NO: 98912 - DNA, 1206 bp, Glycine max
  Peptide Sequence Number=SeqID_215690
atggctcattacacaaatcatttaatgctactctttctagccaccatcagctttttttcatctactttttctaaagatgcctcctctatcaatgtgcttagctttggggctaaacccaacggcaagttcgactctaccacgtcctttcttaaggcatggtctaatgcatgcaaatcaaaagaatcagccacattttacgtacccaaaggaaatttcttgataaaacaagtgacatttgagggtccttgctcgaacaatatcaaatttcgaattgatggcactattgttgctccttcagattataggtcccatggtaattccggaatgtggatcatgttcaggaatcttaatgggttttcagtacaaggtgggacttttgatggaaagggtgatagctattggcgttgtagaaaatctggatcgagttgtcctgctggagcaaggtccataactttcagttcgtgcaacgacgtgaaggttagcggattgacatcattaaatagccaggcaatgcacattgcggtggaccattgcaagaacattttgtttaaaaatgtgaaaatcgatgctcctagtacgagccctaatacagatggattcaatgtgatactttcaacgggggttactgtaagccaagccatcataagcaccggtgatgattgcatagccttaagccaaggtaacaccaatgtgtggattgagcacatcacttgtggccccggacatggcattagcattgggagtttgggcgcctataagaatgaggctggagttcataacgtgactgtgactgattcaatttttgaaggaacacaaaatggggttaggataaaatcatgggcacaaccaagcaatggatacgcaagtaacattgtgttcaggaacctcaccatgaaaaatgccaacaaccctatcattattgatcaaaattattgccccggtgacaagagttgtcctcatcagagttctggggtgaagataagcaaagtatcatatgaacatataagaggaacttcagcatgcccacaagcaataaatttagattgcagcaaaagcaacccatgtgagggtatcaaactgcaagacatagaccttgtttatggtgagggatcaacaacttcaacctgtaataatgttggtgggattaacagcggagtagtcataccaaagagttgtgtttcattacattcgttaaacgaaaaataa

SEQ ID NO: 98913 - DNA, 605 bp, Glycine max
  Peptide Sequence Number=SeqID_215691
aagaatctggggccgatgaacttgcggttgcagtttttgggagagaaactggcgccggtttcgcacgcgcctttccagtggcggggaatggggccgaggttcaaatcggagaagctgcagcgtttcggccagacactagtgtcgaagactccgacgatgacgtcggagccgtagtcggatttggaccagaggtcgcgctggttgcggaggccgaggaactacggggagcgcgtggcgtggagctggcggcggcggtcttcgaagatggcgaggacgaaagggatgctggtttcttcggcaaactcggaggtgtaccaatggtagtgagtggggaacacggtgggcttggattgggaatccacgcggaagatgaaggtcttggaaacttcatcaccggaaacagtggaaaacaaaatgaagaagaaaacaatgagaggaaaggaattcaatacttgtttacccatttcaaagacacagggtttgggtttttttgggggttagggttttttgtagttgtactagaggagaggggaatgggggcagtggtggtaccagggagaaggtggagaaatgtaatggaaagaggagaaggagaagacagctag

SEQ ID NO: 98914 - DNA, 321 bp, Glycine max
  Peptide Sequence Number=SeqID_215692
atggagataaagcccactgggaggttgtggacttcgatccaaaaggggaccttgaataaaggaatttggttggggccggacttcaacttcacgaataagactgagaagcagaagtggctattatggttggggctatcatggctttcttgcacaacggggactagcagttcttcatcatcctcatcaagagagcccttccatagtgataggatccatgtcactaagcaccagagagtcaaggaaagaatgaaacaaggcacctcacagacaggaaaccctagcagagagagagaaaaaatctcactagagagaaaaatataa

SEQ ID NO: 98915 - DNA, 267 bp, Glycine max
  Peptide Sequence Number=SeqID_215693
atgtcgtcacacgcgcgttgtatgttggtctcgtcttttgtcacgggaagccggaagctccatatcaccttcttaactacacacatggggcactgtgcccccaaatgcgcaatggatgaaggccgacatggaggccatgaaagaacagatgggctgcacgtcctcgcctttatagggctacacgccctatcctttagagggttacatgccctcaccttcagagggctactgtttgcttttggcaagtgcaccatatcacccaagtag

SEQ ID NO: 98916 - DNA, 384 bp, Glycine max
  Peptide Sequence Number=SeqID_215694
atgggggcatacacaaaagatgaaatgttgttgatgcatttcttccaggaaagtcttactggggatgcagctacagaacttgtgcaaaagggagcacaagtctttcaaaaggtacacccaaaggtggaaggatatggcaactcaagtagcgcccccaagagggagttgataacgatgatagtagacgcattatcggtgtcctactatgaaaagatggtggattacatgccttcaagatttgccgatttagtgttcgccggtgaaaggattgaagtgggtctgaggagaggcaaatttgattgtctcgctttgacaaataaaaagcctgggacaaatggagagaaggagaatgaggaaggaacccatgttgaaggttgttgttag

SEQ ID NO: 98917 - DNA, 238 bp, Glycine max
  Peptide Sequence Number=SeqID_215695
atgacgttcttcagtagtgagggtgcgttgttttatccatgtgttcgcattgtggtcaagatcttgaaattgaaccatgcgaggttttgtactggtcccttctctcaagctgaacttacgagagatatggtggttattgagattgcttttgagccagatactccatttgggattatatttcgaattggtgttggaggcctaactggaggtggtctaaacgcaattgacattggtggag

SEQ ID NO: 98918 - DNA, 207 bp, Glycine max
  Peptide Sequence Number=SeqID_215696
atggcggtggcggtagagatagtaaagagggtgtcgatggtgggtgaggagcacatgataatggaggcgttgacaagcatggttttttggatcttatttgtgttgcttctgtgtgggtatgattgtatgttctgcaatcaagatgtagctatcaaagtccttaagcatgaggatttgaatgaaaatatacttaaggagtttgcttag

SEQ ID NO: 98919 - DNA, 190 bp, Glycine max
  Peptide Sequence Number=SeqID_215697
atgttggaggttcaatcctccgccaggccacctttttccttcctctacgtgcttgagcctcctatgtatatgtaccctccccagcaaaaagaaaatagggggcaagctttacatggactcacacaatttggtcaggttaaggtatccctcgtgcaagaagagacaatgatgaaaatgtcaacaaatacag

SEQ ID NO: 98920 - DNA, 387 bp, Glycine max
  Peptide Sequence Number=SeqID_215698
atgtatgttggagtgtcattatatgtatccttatccttgcatatgcaaagagccagcaaaggcatgttagatcaggctacaagaggtgaaaagaagatgaaggaagaggaacaacagttaagaaaggttgcacttaatatttctaaggatgttaagaaattttggacaaaaatagaagagctggcaacttgttacttccaaaagcctagcctatgtggtgcaggtaatgtagtagagacaggttgtggagttaaagagacaaagaagtgggcatccacttcaaactgcagtggacatgcagaggaatctattgcactggatatagcaaaaaagggatctaatgggtggattcagtttaaggagagagaggcagcatacaagttttga

SEQ ID NO: 98921 - DNA, 120 bp, Glycine max
  Peptide Sequence Number=SeqID_215699
atggagacccctcagtatgatcccaaatatacttccaagtatccggatagtgaagtggatggatcggatgatgaatttgatagtggaaatgacagaacttgttcctgtgcgattatgtaa

SEQ ID NO: 98922 - DNA, 1227 bp, Glycine max
  Peptide Sequence Number=SeqID_215700
atggatagcaatgattatattttcacatttcagctactgaagcggaagagtgaagtggctgattttgaagctgattctggtgataggatgactgctggattcactgaagcagctaatagtccttttcagacacctgtatcaggaaagacgggaaagggaggcaaatcctctaggctgacaaaaggcaacagagttggaactcagaccccaggctcaaacattggttctcctgcaggaagtaatctcactcctgctggtccatgtcgttatgacagctctttagggctgttgacaaagaagttcatcaatttgatcaaacaagctgaggatggtatccttgatctgaataaagctgctgacacattagaggtgcaaaagaggaggatatatgatataacaaatgttcttgaagggattggccttatagaaaagaaacttaaaaatcgaattcaatggaagggactagatgtttcaagaccgggtgaggctgatgatagttttgccagtttacaggcagaagttgaaaatttaacgatgaaggagcgccagttagacgaacaaataagggagatgcaagaaagactgcgggatcttagtgaagatgaaaataatgacaagttgctttttgttactgaggaagatataaagaatttgccctgcttccagaatgaaaccttgatagccattaaagctcctcatggaaccactttggaggtccctgatcccgacgaggccgttgattatctgcagaggagatacaggatagtcctcagaagcacaatgggcccaatagatctttaccttgttagtcaatttgaagaaaagtttgaagagattaatggtgctgatgttgcacccaaacttccatcaagtccagatgttaccaaacaacaatcaacagtggtcccagaggatagagggaagcacatagaagtgcagggacaagcagctcctggacctagttcagattttactccctcccaggatttcgtgagtgggatcatgaagattgttccttcagatgttgctagtgaagctgattactggcttttatcagatgctgatgttagcataactgacatgtggagaacagaacctggagttgaatggaatgaactggaaccacttcaagaagattattgtatgactgacgagaacactacaacgccaagtcatccttcaaatgtaggtgaagtgtcttctgcatctaaacctactggaggttga

SEQ ID NO: 98923 - DNA, 1971 bp, Glycine max
  Peptide Sequence Number=SeqID_215701
atgtgggactttacctcacacttgtacacacttggggctattgatttgctaatgaatgtttacaagaaagaattcaataaacttggaggatatcttgtggacatgagcaggattggggaggaacatgctgcttttttgaagttatctagagttgaaaaatttatacttgctgttggtgcatatgaagagaaaatctttaagaaaagatccgaaacacgagaaagatatctgcgaaggcttattagagataatgaggatgctaagcgggaagaagtgaatgcagcatgttactccgatcttgatgatgaaaatacttctgattgtactcttctgattaagaaggcaccagattcaaaaactttgtctgttttggtcaacaatgtctcagctacacatgctgaaattgagcagaacacaaaggatttaaaaaatgaattgaagagatgtattagagagaaatgtgacttgtttaagagcggggatttcctaatagacaagataaaattgggaacacctggtttcaaagaaagatattttaaagcaaagttttctgtagagggacctactgacattgagtgcaaaagaaaagaaatagcatgcactagcagagtatcttttgctagtcaactttcaatggtggtggtgttagattgcaatttaattggaggtccagaagtacacggaaggttttatccatttcactatggtccatttgcttcggacttaaagggcatgggtcaggtgagagtaaaatttgaaaaaggtgtcccatttttaccacttgatcaacttttaagtgttcttcccccggcaagttctcatgcacttccaaaagcctattcgcaattgatgctagatgagcagtctagaatatttgacttttatcctcaagattttgaagttgacacggaaggaaagcgcttcatgtggcagggaatctgcatactttcatggattgatgataaacggcttgtggctgaaaccagagaactcaaaaatgaattatctgaaaatgaggccataagaaattcagtcaaagctgatagcttgttagttagaagcgctagcaaattagcagagaaatttggctctctttctctagacacaaacctgccttgcaaattagaaacaagaatgagtgacggcattgggggtatcctaagtctttgtgacgagttcgttgagaagccttgcttggacattagtgacaacaaaaaagaagatagtgtcttatgtgtctattacgagcttcctgctggtagtaatcatattcctggtttactatcggatgtgaagcttccagagaagacaatctttgaaagtgacattatggaaacagaactctggcatgaacgtcagaaatattatagtcgttttgagagggtgcaaaatcaagacaattggaggagtgaaaacacaagcaatacttcaaggtttgcctcaaatgcaattagccaacatacaagaatcttttcatcaaacacacctttattcactttccaaggtgctggtgtcggatggggttcgggtagagggaaaagaattgatgcaatggcaagtgagagtgtgccaaacaacacaaaaccacagcactttgtggacaactttagacaactcagaatatcagagtctaataatcattttctgaggcctggtggtggcagttctctgtttcgaccacataacaagggtcacatgaatcagtcaagaaatgctccttatcatcaaggctcaccatctaataatggttacattaatcagccaagaaatgctccttatcatcaaggctcacagtataataatggttacatgaatcagtccaaaactgctcctaatcatcaagggtcacaatatgtgactgtgcctaattttggtcgaggacaaggtaggggtgcatctagtaacagttcattgcggcctcaatggagtggtggaaaagcttatcaagtgaaagatcaagatcgttggtaa

SEQ ID NO: 98924 - DNA, 483 bp, Glycine max
  Peptide Sequence Number=SeqID_215702
atggaagaggccattcatgtgagatttaatgacaacaagcctaacactacaatgttagagctggatgagtccattgcaaagatgacgatagatgatatcattaagtctaccgctgcgtcaaaactccctaaaggaaaatttgttgttggagcaaagtgggtgtttagaaacaagctggacgaaacaggtaaggttgtgaggaacaaggctaggcttatagccaaaggttactcacaacaagaaggtataaattatactaaaacttttgctcctaatgctcgtctagaggcaatacgcattttactatcctttgatgctcatcatggaatgatgtatcaaatggacgtaaaaaaggcattcctcaatggactaatcaaggaagaggtctatgtgggacaaatccctgggtttgagagttctatctaccctcatcatgttttcaaacttaataaagctttgtatggtttgaaggaagctccttga

SEQ ID NO: 98925 - DNA, 249 bp, Glycine max
  Peptide Sequence Number=SeqID_215703
atggtattaaaaattgtaaacgataataaactcccttcacctatcgtgagctctccgtccattcctctttacgtcactcagaggtctttctcgttcatgctcgttcggcggcaagcaacgacggtttgtggtggccaccgatggtcgtgggtggtggaaaaggagatgttagtgtttgggtggcgtttggagaggaggagagtgaaaaattgtgtttttcatgctgaaggacgtatttataatctgtag

SEQ ID NO: 98926 - DNA, 1444 bp, Glycine max
  Peptide Sequence Number=SeqID_215704
atggcggatgctacacggaatcgcgttcttgagcgtgaaattgaagatcgcatagagaaccatctcagttcagaggatattcttctgcattttcatgcttctaccgctgctggtcactcaggaagaaatgcaaccttacaaaggctcaaatctgtggtctattggaaaggggtgatttttgtagtagttgataggttgagcaaggtagcccactttatggctctttctcatccttattttgctgctgatgttgctcaatccttccttgatcatgaccttatggcttttcagggtgttcagattcaccctctcaatggtctaagtggttacctctacctgaatggcggcataacaccacctttcacagctttatttgagctactccttatgaagtggtgtatggacagccgcctcctgaacagatgtgcagtggcctacaagatcaagcttccttcgggttcaagcatacatgatgtattccatgtctctcagttgaagaagcatgtaggtgaagcagtaacttcttcgagtcttccaattttagtagaaggagatcctctaaccaaagaacctgaagctattttggatcgcatgacaataaagagaaggagtcaagctgttactaagggtggtgtcaacatggctttagctcaacccttctccttggcgaaaatcataaatgtgatgtttcacatgggggctttcaaagcacaaggggaagacagtcttcaacttgtcttctatcaatctcaatgggccaaagttattattgcctgcatcactagcccaactatcaaagtgttatggaatggggacaaacttgatgaatgcactctagcttggggcataaggcaaggggaccccatctccccttacctatttgttatgtgcttagaaagattataccaattgattagagatgagtttagaaccaagagatggtgggccattatgctcacaagaaaatgttctctcctatcccatctagcattcatggatgaccttgttcctttctcagagagaaaagatgaaggtgtgtttctcgaagaatgtgggggtgcagagtttgagaggtcttcacatggtggcgcaggagagtgttcgacggccggaggactcttggttgaagaatctaagccctctaaagccttttattctttgcttgatgaaggtatgcaacttatgttgcatgatatggttaatgatgcaagttggaagaaggaggagttagaggagaagcttctgcaggatattttcttgaggttatttgcatgtatccctccaagcattgtggctattgaggatgttttaatgtggaatagtttgcaggatgacaacatgtcagtggcttcaacatataaaacgagagagggggctagtgtgagcaagaaagcaatacttactaacaacactatgagggcgaggggtatatcagactcggatg

SEQ ID NO: 98927 - DNA, 231 bp, Glycine max
  Peptide Sequence Number=SeqID_215705
atggacaggcttcattgtatggggaaaaaggaaaaaagcaagaggccagttctatcattcacaaagggacaatccccaaaaagtgggaaaaaggtcatcctaaaagctttggctagaaacaagggggtgggtgccttgactattggcaacaaggatttggagaatgagtccaacaaatcagagaacgtgacaggaatagaggttggtaactctaaatgcaacaatgggtag

SEQ ID NO: 98928 - DNA, 2922 bp, Glycine max
  Peptide Sequence Number=SeqID_215706
atggaagcttgtactgggctttttgctggtaccccaaacagcaatgagcttgtggtcattcaaggacacgatgagcctaagcctgtgaagaacttagatggtcagctctgtgagatatgtggtgattctgtgggacttacggtggatggagacttatttgtagcttgtgaagagtgtggtttccctgtgtgcaggccatgttatgagtatgaaagaagggaagggactcaagtttgtcctcagtgtcatacaagatacaagcgtatcaaaggaagcccaagagttttgggagatgaggatgaagatgatgtggatgatattgaacatgaattcaagcatgaagagatgctacaagggaacatgacccacggagatagtgaagggaattctaaatcgaaaccagtaggtttagcaaaggtgaatggggagttgcccgtatcttctcacagtgttggagaacctggtgcaaagttggatgacaaggagaaagtagatgagtggatgttgcaccaaggcaatctatggcctgaaactgatgcctcagttgatcccgaaaaggccatgaaagagccactgtcaaggaaagtaccaataccatccggcagactcagtccttacagaatgatggttgtcgctaggctcctccttctattactgttctttcagtacagaatcttccacccagtacctgatgcaattggactatggttcatatctgtgacatgtgaaatctggctcgcattatcctggatgattgatcagcttcccaaatggttccccattgatcgtgagacatatcttgatcgtctttcaatcaggtttgaaccagagaacaagcccaatatgctttctccaatagatatcattgtcactactgtggatccaatcaaggaacctcctctagttacagccaacactgttctttcaatcttggccctggattaccctgctgacaaaatctcatgctatgtttctgatgatggagcttccatgctcacctttgaagctcttcaagaaactgctgagttttccagaaagtgggtacctttctgcaaaacattttctgtagaacctagagcaccagaaaagtacttctctgagaagatagattttctaaaagataagcttcaatccacttatgtgaaagaacgccggactatgaagagagaatatgaggaatttaaggtgaggataaatgcacttgtggctaaatccatgagagttcccccagaagggtggactatgaaagatgagacaccatggccaggaaacaactccaaagaccatcctagtatgatacaagtccttcttcctcacaatgtaggtaatgaacttccttgtcttgtctacacatctcgtgagaaaaggcctgcattccaacaccacaacaaagctggcgcaatcaatgccatgcttcgtgtatcagcagtgttaagcaatgctccttttgtgctaaacttggattgcaatcattatgtaaataacagcaaagtcgtgcgagaggccatgtgtttcttcatggacatacaacttgggaatggcattgcctttgtacagtttccactgaggtttgacagcctcgataggaatgatcgttatgctaacaaaaacactgttttatttgatattaacttgaggtgcctagatggaattcagggacctgcttatattggttcagcatgtatcttcagaaggaaagccttaaccggctttgattctccaaagacttcaaaacgcccaagcatggtgcaagtacactcaaaacaggacgagaatggagaggaagcaagcataacaggtgaggacaaggagctattgaagtcagagatgaatgatgaaaataaatttgggaagtccatacttttcatgaattctgcattagcagaagaaggtggtgttgatccttcttccagtcaggaagcactgcttaaagaagctattcatgtcatgagttccagatatgaagacagaactctctggggatatgaggtgggtttaagctatggatccatagcagcagatactctgacaagtttgaagatgcattgtggtggttggaggtctgtatattgcatgccaaagagagatccattcaggggtacagctccaatcaacctcactgatagactgaaccaggtgctaagatgggcagtgggatcgcttcagatcctattcagcagccattgcccacttctatatggaggaagactcaagggactccaaaggattgcctatattaacagcactgtctaccccttcagctcaatacccctcctcatttattgtatcattcctgccatctgcttgctcactgataaattcatcacaccatcggtaggcacttttgcaagtctcatcttcattgcgttgttcatctcaatctttgcctcggcgattcttgaattgagatggagtggagttagccttgaggaatggtggagaagccagcaattctgggtcattggaagtgtgtcggcgaacctctttgcccttttgcaaggcattatgagagccctgccacttggtagagtcaacacaaacttcagcattgtatcaaaggcaccggatgatgtagagtttcgtgaactctatgccattagatggactgcacttctaatacctccaaccaccatcataataatcaatctcattggtattgtggctggcttcacggacgccataaacagtggtgaacattcttggggagctttgctagggaaactcttcttttctttatgggtcgttatccatttgtaccctttccttaaaggtctaatgggtaggcagaacagaacaccaactcttattgtcatatggtctgtgctcttggcttctatcttttccttggtttgggtcagagttgacccttttgtgttgaaaacaaaagggcctgatgtcaagcaatgtggaatcagttgctga

SEQ ID NO: 98929 - DNA, 597 bp, Glycine max
  Peptide Sequence Number=SeqID_215707
atgttgggctttgcatatatacctagctattctcatgaattaagattattggtgaaagttcttcctttgttaaggtacgaaggtggaataagcatctcatgtttcaatttcaaaaaatttcaagctcataaagttggtggtgtggttgaggagttacgaagtggagtgggagacgaagaagggtgcgtgagagaaggacactcattgcacgcattcacgctccgcagatgcgcatgcttcattccacgccgtaacgccgctgttgccgtagtcagatcagcaagctcttcttgttttccatggttcgtttcttcacttcgcacgtgtgtctgtgcacccttgactctcagagggagatcgttttcaacattgtttaacctcagagatcttctcgacccaacagtgcacttctttgatttcttggcggaaacgctgcgtttcgcggatttggggttggagtgtcgcgattttgatgggggaggaacctgggtgaccttcgtggggtggtggattgggggtggagggaggagtttccgtcaggcattttcacgaagatgcgccttttttgaattcaaatttgaaataaatggcttgtga

SEQ ID NO: 98930 - DNA, 498 bp, Glycine max
  Peptide Sequence Number=SeqID_215708
atggtacctcccagagacccaagacccgaccttccacttgaccctcccgttgaccttaacgttgaccactacggcgccggcggcgctctggtcctgctgcagcgaggtcagcacaaacggcgagacggggacgacattgccgaagagaaacggcgaccagacggcgaagtcgcggtggccctggtaggtgtcggggagcgcggtggcgagggagatctgctggctccggtaggaggcgtagacgcggagcgcgtggtagtagacgccgatgcgcgcgttggggttgtgggaggagagggtgacctgcatggtgagggtgagggtgttgggtgtgggggtggagaggttgaaggcgtagagggtggcgtcttggagggtgaagtggggctttgtggggcggaggatgacccagatgaggaagatgacgaggaggatgaggacgacgaaggccgcgatggcgccgaggatgaggcggaggaggttgcggcgttgggatga

SEQ ID NO: 98931 - DNA, 2764 bp, Glycine max
  misc_feature (2752)..(2752): n is a, c, g, or t
  Peptide Sequence Number=SeqID_215709
atgtcaagcaatgcattaactctttttatcttgtttctcaacatctccttgatcccagccacctctgctctgaaccaggaaggtctctctctactttcatggctctcaacattcaattcctcagattctgctactgctttttcatcatgggatccaacccaccagagtccatgcagatgggactacataaagtgttccaaagaagggtttgtctcagagatcataatagaatccattgatcttcacaccaccttccctacacagcttctttcttttggcaaccttaccactctagtcatctcaaatgcaaacctcactggtgagattcccggtttggtgggaaacttgtcatcatcagtggttactttggacctcagcttcaatgctttatcaggaaccattccatctgaaatagggaacttgtacaaactccagtggctgtatttgaattcaaattccttgcaaggtggaattccatcccaaattggaaactgttcgaagctgaggcagctggaactgtttgataaccagctatctggcttgattcctggggaaataggccagttgagggatcttgaaacccttcgggctggagggaacccggggattcatggtgaaattccaatgcagatatcaaactgcaaggctctagtttatctaggccttgcagacacagggatatcaggggagattccaccaactataggagagcttaaaagtctcaagacacttcaaatctacactgcacacctcacaggtaacatcccaccagagattcagaactgctcagccttggaggaattgtttctctatgaaaaccagctttctggaaacattccctctgaattgggttccatgaaaagcctcagaaaggtacttctgtggcagaataatttcactggaacaattccagaaagtttgggaaactgtacaagcctgagagtcatagatttttctatgaattctttggttggtgaacttcctgtgactctcagtagtctaatcttgttggaagagtttcttttgtctaataacaacatttctggagggataccttcatatattggcaacttcaccagtctgaagcaactggaattggataataacagattctctggggagattccacctttcttggggcaactgaaggaactcaccttgttctatgcctggcagaatcagctccatggaagcataccaacagaactctccaactgtgagaaacttcaagcaattgatctttcacataatttcctcatggggtccattccaagttcactgtttcatctagagaatttaacacagttattgttgttatcaaatagactttcaggtccaattcctccagatattggcagttgcaccagcttggtcaggctaaggttgggatcaaacaacttcactggccaaattccaccagaaataggctttttaagaagtttgagctttcttgagttgtcagataattcactcactggagatataccctttgagataggtaactgtgctaagctagagatgcttgacttgcacagcaatgagttgcaaggagcaattccttcctcattagaattcttagttagtcttaatgtcttggatctttctgcaaacagaataactggcagcattcctgaaaatttaggcaagctagcctctctaaataagttgatactcagtggaaaccaaatcactgatttgatccctcagtcacttggtttctgcaaggctttgcagttgcttgacataagcaacaataaaatcagtggttccgttcctgatgagattggtcacttgcaagaactagatatcctcttgaacttgagttggaattctttatcaggcctcatcccggaaaccttctcaaatctctcaaaactttccaacttggacctctctcacaacaagctctcagggagtctcagaatactgggtactcttgacaatctattttctcttaatgtctcttacaacagtttttctggttctcttcctgacacaaaattcttcagggatcttcctcctgctgcatttgttggcaaccctgacctgtgtattaccaagtgtccagtaagtggacatcaccgtggcatcaagtcaataagaaacattatcatatacactttccttggtgttattttcacttcaggatttgttacatttggagtaatgttagctctcaaaatccaaggggggactaactttgacagtgaaatgcaatgggcttttactccatttcaaaaactcaacttctccatcaatgacattatccataagttatcagattcaaacattgtgggaaagggttgctcgggagttgtttaccgtgtggagactccgatgaaccaggttgttgcagtgaagaagctgtggccaccaaagcatgatgagacaccagagagagaccttttcgctgcagaagttcatacccttggatcaataaggcataaaaatatagtgagacttttagggtgctacaacaatggaagaactagattgctcttgtttgattacatatgcaatgggagtttttctggattgctccatgaaaatagtttgttcttggattgggatgcaagatataagatcattctgggagcagctcatggattagaatatcttcatcatgattgtatccctccaatcattcatagagacattaaggctggcaacatcttggtaggtccacaatttgaagcttttcttgctgattttggccttgcaaaacttgttggttcctcagattattccggangcttctgcaata

SEQ ID NO: 98932 - DNA, 354 bp, Glycine max
  Peptide Sequence Number=SeqID_215710
atgcaaccatttccaacaccgctgaatggagttcatcaaccgctcaaccttagtagagaaagttctaacttgagtgttagagtgcctttgcatgtagcatccgtgccacatcgaacaaggagttcacaaaggaaagaacgagatgattatagcaagaggaacgagggtagtggtaggaatgggagcactcgtagggacgagcaccataatggccaacccggcttaagtgtcgagctagggagaagagctgcctataaaagatcagacccaatagtcctcggtcataagaaattgtgtgtcgaggtagttgatgcgacaacaacatatagaggagatgaaggccctctgcaatga

SEQ ID NO: 98933 - DNA, 786 bp, Glycine max
  Peptide Sequence Number=SeqID_215711
atgttcactgatggcctacaacctcattccaagaaacttcttgatgcctccaccagtggtagaatcaagttgaagattctcgatgaagccatggagcttattgagaacatggcagctaatgatcacaccatcctccgtgataggactcatactccttctaagaagagatgcaccctgtgtggtggagctcatgaagtagggctatgtgtggttcaagaggaagcatctatggaggtcaattacatggcaaaccaaaactgtcaaggctaccatcagggtggtaacttttctcaaaatcaaggtcaagggtggaaattccatctggggaacaacttcaacaaagataaagggggtccatccaatcaacctcttgatcaaggtcccaatctatatgagagaactaccaagcttgtgaaaaccttgacacaattcatgcaagtcttcatctcaaaccataaaaccacgaaatcggcaatcaaaaatcttgaagttcaagtaggccaacttgcaaagcaacttgcggagaagtccaatgggaattttgtggctaacacagagaaaaaccacaaagagaaatctaaagtggtacttacaataagaaaaaggatggatggccttgttagtgataatttagtggaaggtgtagtaaaagatatgggtgatgcgaggaaagtatcagtggcagtggaatggagaaggaggaaaggtgattggagacaccatttcaaggagaagatgagtcaagaacaagctcaccaccataggaagccatggataagagcttga

SEQ ID NO: 98934 - DNA, 570 bp, Glycine max
  Peptide Sequence Number=SeqID_215712
atgtcatccttgaaaaaggaaacaaaagctaggaaaaaagcaaggggagcttctccctctccaaaatctacaattcctctcctcatcttggagaaatcagcagtgcctattcctcctctcatctttgaagagcctcatatggtggaagaagggccatctaaagtgacacttgaaaactattcgagctcgacaatgcctcaatacttcactagtattgtaaggctgaatgttcaagcgatcaacatctcctatcggtactctctcatccagttgattcaaggaaacctcttccatggtctagctaatgaagatccttatgctcgcttggccacctacattgaaatatgcaacacagtcaaaatagccagagttttggaggatgctattcgactcaacctattcccattttcattgttcgatgaagcaaagaaatggatgcactctttcaagggaaatagtttaaggacatgggatgaggttgtagagaaattcctcaagaagtacttcccaaaatctaagaccacagaggggaagacaggaattttgtcatttcaccaatttttggagtag

SEQ ID NO: 98935 - DNA, 870 bp, Glycine max
  Peptide Sequence Number=SeqID_215713
atgacaatgataaagaatgacatgaatgagctgattcccataaggaccatgactggtttgagaatgtgtattgattattgccttctcaacaaggcaacaaggaaagaccactttcctcttttcttcatggatcaaatgcttgagcggttagccaatcaagccttctattgctttttggatggatactcaaggtataatcaaattcttgttaatctggaggatcaagagaaaacaaccttcacatgtccatttagagtctttgcgtattggagaatgccctttggactttgcaatgcaccaaccacattccaaaggtgtatgaatgccatcttttctaacatggtagaaaaatgcatagagatatttatggatgatttctttgtattcggagattcatttgtgtcatgcctcaacaacttggaaaaagtcctagaaagatgcattaaaaaaaaccttgggctttattggcgaaaattgcacttcatggtaatcgaaggatcaaagatcattatgcacactgaccattttgctataaaatatctactcattgaagtgaactccaagccaagattaattagatgggttcttctgctacaagagttcaatctagagattcaagacaaaaaggggtgtgacaacctagtagcctatcatctattgagactggtcaatgaagaagtcaccaagaaagaaaaggagatcgaagaagaattcccagacaagacactcatggaaataagcttcaaggagaaggactacccttggttcactgacatggcaaactttaaggccacaggacaaccaccggaaggtatgaaattccacgagaaaaaggttcttctaagaagccaccaagtatgtttgggatga

SEQ ID NO: 98936 - DNA, 3057 bp, Glycine max
  Peptide Sequence Number=SeqID_215714
atggctcttattgctcgaatccagcacccttacattgtggaattcaaggaggcatgggttgagaagggttgctatgtctgcattgtcaccggatactgtgaaggtggagacatggctgaattgatgaaaaaattaaatggtgcttactttcctgaggagaaactctgcaaatggttcactcaattactgttggcagtagagtacctgcattcgaattttgttttacatcgtgacctaaagtgttccaacatctttcttaccaaagatcgagatgttcgcctaggggatttcgggcttgctaagacactaaaagcagatgatttggcatcttcggtggtaggaactcctaattacatgtgccctgaactgcttgctgatattccatatggattcaaatctgatatttggtcactagggtgctgtatatacgagatggctgctcatcgccctgcttttaaagcttttgatatggcaggactgataagcaagataaatcgttcatccattggccctttgcctccatgttattccccttccttgaaaacactgataaagggcatgctaagaaaaaatcctgagcatcggccaacagcatctgaggtgttaaagcacccttatttgcagccttacttggatcaatatcgtccatctttcagtcctccaacctcctgttctcctgaaaaaccaatttctgctgtcaataatcatccaaaaaatatggctgaaagtcaaaacagtaatagttcaagtagtgacaaagatagtttgatgtcaaatgagaaaaaaattgcaccagcaggaccgaagtgttataacaaagccattgagacggatcaaatatcaattgatgatgatggctcagaggatgaaagtggctctagtaatgctaatgccaaaacagctgagcaagaggtgatgaaaccatctaataatgaacaccattctaatgttgaatctaagcagccaaaaacaattagaaatataatgatggcattgaaggaaggaaaagttagagaagcaacttctccaatgagaggcaaccgcataaagcctggtggcatatcaacgcaaaaaataaacacagagacattgtctaaattgcctaagcctacttttattgctcctagtatgaagcctaatttagaatcacctgctgcacttgcaagggcaagtcctgaccctgcaaaaagaatgatgggttcacattatccaaagcatcagattctgatgacagaagcctcaccaaaagttaaagctagacatgatttgactccaccatctgcacttgccaaacaagtagaaggagatggattttctcccaagccaaggcaaaggactcctccaagctcacttagaagaccttcattttctggaagaatgaggctggctggaattgatgttccaaatgcagcaaatgatactgggaagctaggctcaaataaaataatccaggaacctgagatgagcccttgtcaattggccaatggcaatgtaccacatatttcaagacaagttactagagagcctcagaaggcttttgaaagaagttccaaaggaatgcaaacagacagcagcaattctgcctcatcttcagtttctatcaaaggatgtgaacttgctgatgatgcaaaaactttcattgacatgagagagcagatgcttcctaatcatgagaaagtaaaccacattgtaggtgttgaaacatgtcctgataggagcccacctacaacttgtgcacattgtaagatggctgaaaaagtgcctaaagaaacctgtgaggttaccatgaattttcagaataccataagtagtaatgagaaagtgagttccagtttaactcaagatcaccgtgttgaggattccaaggtaacacttgcttcagaatgtgatcttgtcataaaccagacaactatatctactaccactagctgtgataagagatctgtagacccctctgctggagccaccaaagaaatcaaagaatttcaagatataaccaaggaaattcttttaaccaagtctcctaaagaaatcaaagattttcaatatatttccaaggaaatgcctatgatcaagtctcccaaacaagcacctccaagttctggagaaaagtctgttcatgtagaagttagtccagtaagtgaaccagatatagttagccagccagcacttggatgtaagtccccaggtgatgacaaattcacagtgagggagcgactgtcaccggcagctgaaactgttcctgtggttgccactactaaattatcaagccagaaaccggcggctgaaactgttcctgtggttaccactaacaaattatcaagccagaaagttttgcacgagaaagtaactttgctgcagaatccagcacaagaaaggcacgatactggccatcttcctccagcctttgatgatgttatccatgtcatacgccacagtagttaccgtgttggaagcgagcaaccagttaaggaatctgtggagatgggagttcaaaatgtagatgttggtaagttcatcaatgttgtgagggatgatttggaaatgaggaacataacctctcctttgaccacccacaaatcttcaacttgctctgatgctgcaagcttgaaatcagacatttctgatcagctgcaaatgaagaacttgaacactcctccaatccttaaatcttcaagtttctctgatgcttcgagcatgaaatcaagcatttctgatcatcctggtcttaaggagcaagatgtgagtaacccttctcctatagtttcagaacctgattctgctgagctcagtaaatgcaacactcccatgaatgaagagaaaccaccggcggcaaaggaaacattggatgtgaaatctttcaggcagagagcagaggcacttgaagaactcttggagttgtctgcagagttgctgcagcaaaatagattggaggaacttcaagttgttctgaagccctttgggaaagacaaggtctccccaagggagacagccatttggttagccaagagtctcaaaggaatgatgtctgaggaaagtgggggacactcttcatga

SEQ ID NO: 98937 - DNA, 198 bp, Glycine max
  Peptide Sequence Number=SeqID_215715
atgaagcgaacactttcaagatacaacaaatgccttggttctacagatgctgctgtagcagaaattaagacagaaaatgaatttcacttatgggtgaaggctagaaaaggaagaaatggtttgagcctatggtacaaaaagagcaagacgggaaatattcaagctaatgagctacagcttaacaatctgcctatgtag

SEQ ID NO: 98938 - DNA, 288 bp, Glycine max
  Peptide Sequence Number=SeqID_215716
atgggtcgagggaagatcgagatcaaaagaatcgacaatgccagcagcaggcaagtcacgttctcgaagcggaggaccgggttgttcaagaaggctcaggaactttccattctctgtgaagccgaggttgccgtcatagttttctccaacaccggcaagctcttcgagctttccagttctgggtgcgtccctcgcttttccaacgcccttgcatgtcctcttacttttatctatatgcccttcgcacctacactaatgcttcacttccagaaccttctatcagtttaa

SEQ ID NO: 98939 - DNA, 198 bp, Glycine max
  Peptide Sequence Number=SeqID_215717
atgggtgccaagtacctcgaagcggtcagacaaaggttgcatgccatcaaacaatggtcctcgggcgaaattaggggaagtaaagacaagacactaatttcgttcgagcgaaacaccatttggccggtcaatctccctgccagcagaacctgcaaaaattttgaaaatgatcagtaccgacgaccaacatcatcctga

SEQ ID NO: 98940 - DNA, 216 bp, Glycine max
  Peptide Sequence Number=SeqID_215718
atggaattaacgagagatgcccacgttggacccaggatttacacggagccctatgagttgacaatgatacttaattacaataggaaggagcagtggaatagggtcaaagagaagcaaccaaacagagctctgagcttcttcctctacgtcgatagagcatcattctctggacaagcacatgccatgcacattatcatcatatcaacaaggaaataa

SEQ ID NO: 98941 - DNA, 504 bp, Glycine max
  Peptide Sequence Number=SeqID_215719
atgagaggtcctaccaagcctcttataggatcacctcgcacagaaacatcagtcgttaatggaacttataagggatttatggaaattatgctgcagaacaatgatactaagatgcatacctatcacatgagtggatatgcatttgttgtagttaggatggattttggtgattggtctgagaatagtaggggtacatataacaagtgggatggaatagctcgtactacaacacagtcttacggtgaagtgagtaggtcatttgctataagatggaaagatgaactagagcctacgtggcatctgctacactctagtggcaacatgcactttgtcacatataaccaagttttgatgagcccaattctacttgctagatggatggaacttagagagttctatgagcttactggaaatcatcaggtcaccttgacccactatgggcagagtgttttcctcctcaccatcttcaaaagcagctttgaacccaaagcttttcctaaatag

SEQ ID NO: 98942 - DNA, 915 bp, Glycine max
  Peptide Sequence Number=SeqID_215720
atggctgatgggaggaggccagagctactaacattgttgcattcacatgtttgcattgtatcagcaattggcattttaaaagaagactttagatatggtgatcaaccattaaggctatggtggaaaggtagtgatgatgagtataaggagattactatagacagtcatgcattggagttgtctaattatgtcattgctaatagttgtgaggtggagttgtttgtggaatgtggtggttgtaatgaggggttatggatgacatttttttcttgtaattttgaagacaatagtgatgaattagtgaaggctgtccaattagatgactctaaggaggaaaatgcaattggattggatgatgattttgatttacctattccagaaattggtagactggaaaataaacgaataaagaggtcgactataaaaaaaaggccggtggacaaggcttgtggtggtaagaaggctactggtggaggtaagaaggctcctggtaggggtaagaaggttgaacacaactatgtgaatgtcagtggtagtttatttgtaacacctactttgcctgaagatgatattgaagattggtatgttagtgaacagttgtgcagtgatgattcagatgaagagaagttaggattggagtttggttctctgaaagagtttaaagaaaccatattggaatacaatgtgttaaatgggagagaaatcaggtttaatttcaatgataagaggcaagcaagagaaaaatttgtagaaatagagaccaaggaaagatggagatggtttctgaacttattgttggaggatattgttgatgttgaaaccaacatatgggtgttcattagtgatcaacaaaagggattgcaacaagcatttctagaatttccaaaacagatagagcatagattcttcttgtga

SEQ ID NO: 98943 - DNA, 1101 bp, Glycine max
  Peptide Sequence Number=SeqID_215721
atggaaaaacatgatgggaagaagagagtggtgatcataggaggtggtgttgcaggctccctcgtcgccaaatctctccaattccatgctcatgtcaccctcgttgatccgaaggaatattttgagattacatgggcaagtttgaggtcaatggttgagccatcttttgcagagaggtcggtgatcaatcatagagattaccttaccaatggcaatatcgttacgtccaatgcagtcaatgtaacagaaaccgaagtgttgacttcagatggcgatcgaattcactatgactatcttgttattgccactggccatgcagatgatgtcccccaaagtaggagagaaagacttaatcaattcaaagaagacaatcaaaaaataaaatccgctcattccattctgattgttggaggaggtcccactggcgtggaacttgctggagagataactgttgattttcctgataagaaggttacaatagtgcacaaaggaccgaggctgctggatttcgtagggacaaaagccgcagataagactcttaaatggttggaatcaaggaatgttgtggtgaaactagagcaatcaattgacttgaacgaattaacatatgaacagaagacatatcgaacttcaaatggagagaccattgaggcagattgctatttcttatgcttagggaaaccgcttgcatcagcatggctagaggaaactgtgttgaagaatgatttggatgatcttggaaggattaaggtagatggaaaattgagggtcgttggtaggacaaacatttttgcaattggagacatcacagatgttccagaaatcaagcaaggttttgctgctcagcagcacgccatagtggtttcgaagaacttgaaggcgatgatagatggaggaagagaatgtagtcaatgtaggatggacacttataagccacagttagcaatggcagtagtttcacttgggaggaaagatgcggtggcacagataccattcttgacaatcagtggaagaattcctggactcattaagtctggtgatttgtttgttggtagaacaagaaaacaaatgggactcaaccctgatacttcacaagcttga

SEQ ID NO: 98944 - DNA, 1035 bp, Glycine max
  Peptide Sequence Number=SeqID_215722
atggcggagaagaaagtggtcatcctaggaggtggtgttgccggagccaaccttgcaaaaactatacaacatcaagccaacgtcacccttattgatccagttgttgaacacaggaaagaatattttgagattccatgggcaagtttgaggggattggttgagccaacttttgctgaaaggatagtgatcaaccatagagagtacttcaaaaagggtgaccttgttgtatccagtgctgtcaacataactgaaaccgcagtggtgactgcagatggccagcagatagcctatgactatcttgttattgccactggacacacagaacctatccccaaaaccaggagagaaagacttgaccaatacaaaggaggtccaactggtgttgagcttgcagcagagattgctgttgattttcctgataagaaggtcaccatagtgcataaaggaacaaggttgcttgaatacattgggacaaaagcttcaagtaaggctttaaagtggctcaaatcaaagaaagttgatgtgaaactagagcaatcagtagacttgagctcctcctcggaagcaagtaagacatatcaaacttcaaatggagagactatagaagcagatcttcattttctatgcatagggaaaccacttggctcaacatggattagggaaactcttctaaacaatgacttggatgctgatggaaggatcaaggtcgataaacacttgagagtgaagggcaagagcaatatttttgcaattggagatattacagatgttcaagaaatcaaacaagggatgtatgcaagtgctcatgctcaagtggttgctaagaacctgaagctattgatagagggaggaggcaaagagcataagttgggaacatacaaggcacaaccaccaatatctatggtttcactaggaaggaaaatagcggttgcacagttcccattcatgactgtgcttggaaggcttcctggcatgatcaagtcaggagatttgtttgtagggaaaaccagaaaggaattaggagtcgaacctaat

SEQ ID NO: 98945 - DNA, 252 bp, Glycine max
  Peptide Sequence Number=SeqID_215723
atggctttggaaggaaatgccttccgacgcaaagtattggacacagatgaattgatggactactgtggtttgtttgcgaatttgctaattgttccaatggctttggaaggaagtgccttccggagcaaagtattggacacagatgaattgatggacaactgtggtttgtttgcggttatgttagccacttctaatgactttgtagcacatttctcgttggggtttagcaatgttgaaggcaaggtcacgtag

SEQ ID NO: 98946 - DNA, 249 bp, Glycine max
  Peptide Sequence Number=SeqID_215724
atggtttggtttaaagacttcctcctcactattcaacaccaccaccaccaccttagatcagagaagaaagatgaaacatttccctatttaaggcaacttcagctcttggccctatcaatgttgcaactgctccaactacaaggccaccttcacactttaagtctcatcatattacctccattaagggattcgaacaagccatcatccaagatgctgcctccctctctcaagttcctagagcccttgtag

SEQ ID NO: 98947 - DNA, 819 bp, Glycine max
  Peptide Sequence Number=SeqID_215725
atgggtggcatgacctcttcaatggcgacaaagctggcattcttcccttcttcgtcgacatcgtacaaggtggtgaaggaggaggccatggggttgctactgatggagccattcccgcaccgcgagaatatggaggtcttgaggttcctgaaccgtcgtggcatgaagatcgtggccatttatctcaacatccacctccgcgtcaatctttgcttcttgtagaagagattaaagctcatgaggagagtcttgtagaagagcatgattcaagagaaagagatgaagaaaaagaagaaaaaggtgaggagagaacacaacaacagtgggaaaagttctcacaagtagaaattcaacaagaaaacattctccaagtcaatacccctcctcatcaactgattggcaaggaagaaagacatatagaatatgataaatctttaagtgtcattctctccttgaacaccaacacttctcttgcaatggtatggaaggcatttccgggatacatgagtttcatggagtctctagctaagagtcaaacccaagtagatgtaccctctacttgtaccacaaaggatgtatcctccaatgtgttaagacaaagatctcaggctgttaaacctttgatactttgtgaatggggatacaaaagaattctcaggcgggagaagggagacacaaaagaattcaggcggttagtcctttgttcttttggaaaagggagaagagagacacaaaaagaattcaggcggttagtccttgatgaattctttttggcaaagggagaagagaatgaaccgatgaatagcacaagttttcaag

SEQ ID NO: 98948 - DNA, 195 bp, Glycine max
  Peptide Sequence Number=SeqID_215726
atgggaaccaccacagagggtgatgcgccctccccccggtgccattggccggcgatgcgaggccgccttaggggcgatggcaacgcgatagcggcagaggcactaccagaggcacggtggcgcaaacaaaacaagaagaaagaagaaatgcaggtgaatgcgaaacgtgtgaaaaaactaaacaaaacgcaataa

SEQ ID NO: 98949 - DNA, 948 bp, Glycine max
  Peptide Sequence Number=SeqID_215727
atgaaagaatgtgctttacgacatccttaccagacatgtgccaaaatgagtgacatagagaaagtaaaggctgatatggaagccatgaatgagcagatgacaacgataatggaagagatgatgagaatgaagaagatgatagaggtcaagactgctacagtcgctgctgccagtactgctactgagatggacccaattcacccgcccagtttcaatcaatcttcttttccaccatatggtttgcctcccaattatacaccgcctattgttgtatacactcttggtgagaatatcggggaaacaaatgaagctccccaagaccacactctagccggttttggggtttatccgggatataccactgaagggcatggattttctggacctaatggatgctgtcacaacctaccctacgacgggggtgtgaaaggcgaaaagaaagggataagggttcgggagttgtttaggcatgaggaaggtattagcatcccacgcgctcgtcacaagggatgggagatgccccttgctcctacatatcctcaggcaaaaacccaatttggggcagttgatgctcacccaggagagctgaaccttagccttgaagtaatgagctcactcaggcgagttggttgcttagccatgaagccatttcatggcccaggcgagccagatgctagcatgggcaagctaggagagatgataacaatgataatggacacactgctggtgttctactatgagaagatggtaggttacataccttcaagttttacagatctagtgtttgccgatgagaaaattgaagcaggtctgaggaaagggaaatttaattatgttgcttctgcgaatcctggtaatgggggacctgagagttgtggcgagaggaagaaggatggagaaactcatgttgtgaatgttgttcctaaatttcccactagccccttataa

SEQ ID NO: 98950 - DNA, 222 bp, Glycine max
  Peptide Sequence Number=SeqID_215728
atggcgaagaagacagcgagaacgagaagacagcgcgaaggagatgaaacatacctaggtatggtggcgaaggagaagaagcagagacttgtgacgatgctcaagtgcgacgaacacgatgctcagatgcagaacagagaccttcaaggtagacgaagattagaagaagaagaagagagagtgaaagcttcgatggagaagaagacagcgcgagcttcatag

SEQ ID NO: 98951 - DNA, 201 bp, Glycine max
  Peptide Sequence Number=SeqID_215729
atgggggcagggaaactcattgtcagaaagagaagggcatccctcaatgattttgataggttcaagataatgttgaccaagatcaagccttgcagcaatccagattgtctatatcttcatgagattggctctcaagacgatagtttcacaaaagatgaaataatttcagcatacactaggtatttttctaatcttaaatga

SEQ ID NO: 98952 - DNA, 153 bp, Glycine max
  Peptide Sequence Number=SeqID_215730
atggataatctggacaacaacggtggaggacctgcaagaaaagaagcaaggttggaggttatgttgggaaaagaaaggaggggaaggtttggggaagggaatcttgaagttggggcaagaaggataatttcaagaggaagtaagggccaatag

SEQ ID NO: 98953 - DNA, 669 bp, Glycine max
  Peptide Sequence Number=SeqID_215731
atgtataagatcatagggcagagtgattggtgtgttgggttggagttagctggagttgggtttcttgtgtggtttatcagcagagaacctttagtttccattgctgatcttacccttttcatttataaagaattggctgtaaatgtccattacatggaatgctttggttcctttgctcccataagaggtttgactgaagataggagccaagcccaatggtttgtagatggacaggcaacatttgaagcaattgctacttcaattcaagatgcaaagttagagatcttcattacgggttggtggttgtgcccagagctatatctgagacggccttttgatagcttttctacctctcggttagattcattactagaagaaaaggctaaccaaggggttcaaagaacaatgcttatgccattaaatgatccaacagatctatgtgcttctctacaaggagatttaatttcacagggttcaattctaggtgttgaggtcaacgtttctagaaaatcatattctactcaactggttgtcatggaagatgagaatgggaaccaaaattccgcgccacctcaaaatgaagggttactcatcccgaatatatttactttaactataccgcaggttgatggaggttccaatttatcaattaaagtttggtggtcataa

SEQ ID NO: 98954 - DNA, 696 bp, Glycine max
  Peptide Sequence Number=SeqID_215732
atgtgttttcttatgacaggaacagttggagtccccatgacaaccattgaagccaggcttgaatctgtgccagagatgggatatgatgccctctccaatgtaccccgtggagaaatttgtctgagaggaaataccttgttctccggttatcacaagcgtgaagatcttaccaaagaagttatggttgatggctggtttcatacaggtgatattggagaatggcaatcaaatggagccatgaaaattattgataggaagaagaatatctttaaattgtcccaaggagaatatattgctgtggagaatattgaaaacaagtatttgcaatgcccacttatagcatcgatatgggtgtatggaaacagctttgagtcattcttggtagctgttgtgatccctgaaagaacggtcattgaggattgggcaaaagagcacaatgtgacagatgattttaaatctttatgtgataatcttaaagcaagaaagtacattttggatgagctcaacagcactggtcagaaacaccaacttagaggatttgagctgctaaaagccattcatctggaaccaattccctttgacatggagagagatttaataactcctacattcaaattgaagagaccacaattgctcaagtactacaaggatcgtattgatcaactatacaaggaagcaaagggagcaatggcgtaa

SEQ ID NO: 98955 - DNA, 300 bp, Glycine max
  Peptide Sequence Number=SeqID_215733
atgtccacgaatgctcactaccacacggctcatgcactgaaccccatcttacctcttagtgaatttattcaccttcaaagttcaaatccttgtattcattccaaaaaggaccttacgaagagctacttgaagactcatcaagccaaaagatatgatgaggacatgatcaagagcaagagcaaggattcacttgaaggacttgaaggacctatgacaagggttagagcaaagaaagtcaaggaagctattcaacaattgttgtccatactatttgaatacaagtctaagtttcaaggataa

SEQ ID NO: 98956 - DNA, 2904 bp, Glycine max
  Peptide Sequence Number=SeqID_215734
atgggtatgatgaaagttagcatctttgtgtttttaaccctgatgatcacaatgggttgttatggtgtcactaacccgaatgatctcagaattctgaatgatttcagaaaagggttgaagaatccagagcttctcaaatggccagacaatggaaatgacccttgtggccctccttcatggtcttatgtgtactgttctggagggagagtcactcagattcagaccaagaatctaggtcttgaaggatcattgcctccaaactttaaccagctctacgagcttcagaatttgggtcttcaacgcaataaccttagtggaagattgcctactttcagtggattgtccaaattgcaatatgctttcttggattacaatgagtttgattcaatcccatctgatttcttcaatggactcaacagcatcaaggttttgtctttggaggtaaaccctttgaatgctaccacagggtggtattttcccaaggacttggaaaattcagtgcagttgatcaatctttctctggtgaattgtaatttggttggaacattgcctgatttcctaggcacattaccctctctcacaaatctgaggctttcaggcaacagattgactggtgcaattccagctagttttaatcggtcttcaatccaggttttgtggttaaatgatcaagaaggaggagggatgacaggtcctattgatgtcgtcgcttccatgactttcctcagacaggtttggcttcacggaaaccagttcagtgggacaattccacagaacattggaaatctaacttccttgcaggagctcaacctcaatagcaatcaacttgttggtttgattccagattccttggcaaatatggaccttcagatactggtgttaaataataacgggttcatgggtccaataccaaagtttaaggctgacaaagtatcttatgattctaatttattttgtcagtccaagcctgggcttgaatgtgcccctcaagttactgcactgctggattttctcaataatctgaattacccttcaggtcttgcttctaaatggtcaggtaatgatccgtgtggagaatcgtggttcggattgagctgcgatcagaattcaaaggtatctataatcaatttgccaagacaacagctgaatggtacactgagttcgtcactagctaagttagattcactccttgaaattaggcttgctgaaaataatattaccggcaaagttcctagtaaatttactgaattgaaatctttgaggttgttggatttaagagataacaatgttgagccaccactgccaaactttcatagtggtgtgaaggttattattgagggtaaccctcgtcttggtaatcaacctgtaagtagtcccagtcccacgccttttacaagcaggccaccttcaagtgcacagccttcaccccacgacccgtcgcggtcaccatccccaccatactcccatatgcaaccttctccaaggcagagtccaagctcgaattcgaatcagtctagttctgtccggttaaaaccccaccgaaatggcttcaaaagattcaaaacagtagctatagtagctggagctgcaatctttgcatttgtagctcttttggttacttctctcttaatatgttgcttgaagaaggaaaaagcctccaaagttgtggttcacactaaagatccatcttatccagaaaagatgattaaatttgcagttatggatagcaccaccggaagcttatcaacaaagacagggataagttctctgaccaacattagtggtgaaactgaaagctctcatgtaattgaggatagaaacattgccatctccattcaagatctacgcaaggtcaccaataactttgcttcagaaaatgagctaggccatggtgggtttggaactgtttacaagggtgagctagaaaatggtaaaaaaatagcagtgaagagaatggaatgtggagctgttagcagtagagcactggaggagtttcaagctgaaatagctgttctttccaaggtccggcaccggcatttggtatccctactaggctattccattgaaggaaatgaaagaattttggtttatgaatatatgcctatgggtgctctaagcaggcatctttttcattggaaaaacttgaaattggagccattgtcgctgtctcagaggcttacaatagcccttgatgttgctagagcgatggaataccttcatggtcttgcacgccaaaccttcatccatcgcgacctcaagtcttctaatattctactgggggatgattttcacgcaaaagtttctgattttggcctggtgaaacttgccccggatggccagaagtctgtggcaacaaagcttgcaggaacatttggttatcttgcccctgaatatgcagtgatggggaaaatcaccactaaagttgacgttttcagctacggtgtggtcttgatggaacttctgactggactaatggctcttgacgagagccggtcggaggaaagtcgatacctagctgaatggttttggcaaattaaatccagcaaagaaacacttatggcagccattgacccagctcttgaagcaagtgaagaggcttttgagagcatttctattgtggctgaactcgctggacactgcacttccagggatgcaagtcacaggcctgatatgagtcatgcagtcagtgtgctatccgcattagtggagaaatggcgacctgttgatgaagaatttgattatggctctggcattgacttcagtcaaccacttcctcagttgctgaaagattggaaggaatcagaaggcaaagaatcaagctatacaagtgcacacagtgaaggaagcataccagctaggcctactggttttgcagactcttttacctctgctgatgcaagatga

SEQ ID NO: 98957 - DNA, 312 bp, Glycine max
  Peptide Sequence Number=SeqID_215735
atgtctgctagcgtgcctgaccttcataggtctcgcacggagcaaactcactgtgaacagacgtgccttcgacttcacggcggcgctatcatcggaggccttttggaagacgaccctctcagagttggagttcgtgccgccggtgaatcggaagagggaggtgacacaagagagattagaaggagaatgaggcctatgaacatggtacttttcccattcgatgcaccctcattcatcttgacattcattttaatcgcacggcccaaactcactttcgcaccgtgcgagacctatgaagttcatgcacgctag

SEQ ID NO: 98958 - DNA, 342 bp, Glycine max
  Peptide Sequence Number=SeqID_215736
atgccgacaaacaatggtccccgaacgaaattagggtatgaaaacgtgtatgatagacgcgtccttccttctgtcgggcccttgtgtggcatacctccatggtaccgctttgtcattcttgtaggggaaagggacaggcttcttaactgggataggctggaaacctcggggcttttgtgtggcgacatctctggtgaagtagatcaccaatggcttgggtttgctttattgaatatctcgggacacccccatgataggcacaagttgcattggggttgtaccatcaagggaagggagattggtagatcttctcgagattcaccactgccatctggttggtga

SEQ ID NO: 98959 - DNA, 279 bp, Glycine max
  Peptide Sequence Number=SeqID_215737
atgatgaacataattttgaaaatttctcagctggcaggaagagttgaagagaaaaggagatggtctgaggggattcaccagactgtggaggcaaaggaaggcagattctattgttgtggcacatatcacatactagtcactattcaagctttacccaaagttgtcagcaatgactgggactgccaaaacagaagtcgtgggaaatgggagctagttcgtcgagaagttgaagttatgtttagacaaggttatcctgtcttagttgggacaactaggtaa

SEQ ID NO: 98960 - DNA, 264 bp, Glycine max
  Peptide Sequence Number=SeqID_215738
atgtccccagtggagtcgacagctgtcgcaacctaccctttgatgggagggcgagcaagacttgagggtgcgtcttccactaaaggaaaatgcgcaggagtcgccaccaacgtttatttgaggaaaacattagaaaaccaaaagggatctatgaattttaagaataaaggtttgggagttgtttacgtgcggggatggtcgacaagagcgtggctcttgctcctacgtatccttgagagggaagaggaattcagacctatgtag

SEQ ID NO: 98961 - DNA, 480 bp, Glycine max
  Peptide Sequence Number=SeqID_215739
atggcaccgtcccttcctatacccattgaaatccaaggcgactcctcttcactggaaatatttctcggggccaatccgcaactaagcctcaacgcgcttgttggaatgcctacaccggagacttttcaagtctacggtctcattaatcaccatcgtgtcacgatccttgtcgatgaagaaagcactcacaattttatccaatctcatgtggccacattcctggatctcccgtcatcttcgacccaccactacatgtcatggtcggttcccattgctattcagggtcacaaatttaccctggacttgtatgccttatcactcagtggtgcagatttgattttgggggttcagtggctcaagcttttggaccccattatgatggactacaacactctcaccatgtctttctttcatataggccaccccgtgaccattcacgtagatgtacccatatacccttccttggcattgacccaatag

SEQ ID NO: 98962 - DNA, 982 bp, Glycine max
  Peptide Sequence Number=SeqID_215740
gtgcacttggtttgctgcgtgtcctattgggtatatgctcgtgggctgttttgctaacaacaccctattcaggaaaaatcaccttgtcctcaaggtgatattgcaacttcaggtcatcccagcgctctcaggtggattattaaaggttcaatcattgggtggttatctgaattcgttggaggtaaagtaccgatatcctctggtagttgtccctaatgaagcttcagcagggagacatgaaaactggatgaattttggagggcaacaatctagtgcccgtatgcacaaaggtgttgtaagaccatttagccaaggtgaggaacttgaaccattgagtgggcttatcgtgaacaaaagcttggagatactgttccaaaactctattgagcacatctgtttggccgctcgtttccgggtgtgtgccacaatgaacccccttagagaatcgagcaaccacaaccagtatggtggtataaccatgggattggggacaaagaagcttgttaaaataagcaatggggtgagagttttgaaggaggactactctcattgccacccccgaagcgtccatttccagggtgaagggaatgcttatcaaaagcaacctgagcatcgtgatgccactaaaattgatcttttcgcaaaagggcagtcaggggttggtgatttctgtgtaacctcgaatgaatcttttgtaaaattcggtgagaccgaggaagcctcgaaggtttgtggtggtccacttggagcgccaaagatagaactcgctctgagaaagcttcgtgaaaattgcttcaaggaaaggtcggagaagttcattcatggtggcctaaaatgtggaaggggtattgcagagaccgaacgacatgaccttgaacttgtaatggtcttgatgggtgcgaaaagcaattttggggatgtcgtcctccgccatgtgaatttggtggaacccctgtcggaggtcaagcttagaaaaacatga

SEQ ID NO: 98963 - DNA, 150 bp, Glycine max
  Peptide Sequence Number=SeqID_215741
atgatgcagagaagcagtacacacgcaacagaaagcaaaagaatgctcagagatgagaagttacagaggtttgggtgcaaaggcttagcgccactacttgcactaagcgcacttccaatgatttcaaaacataacgatgttggcgcttag

SEQ ID NO: 98964 - DNA, 1266 bp, Glycine max
  Peptide Sequence Number=SeqID_215742
atgaagcctcccagaggaaagcttcctctgccaatcattatcaccacaatctgtgttcttctcttcatagcagtcttgtatgctgagagactaagtttccttaactccagctccattttcaagtccaaaacatgtcctagaaagcacaacaaatcaaagtctaatgataaaaaatctgaggaagtgtttgcaaatgcctcgtggatcgatgataggttcgattttgacccagaagagtgcaatgttgcaaatggaaaatgggtgtttaacagttcattgaagcctttgtactcagacacaagctgtccatacatagacaggcagttttcttgtgtcaagaatggaaggaatgattctgattacctccattgggagtggcaaccagaagattgcaccttgcctccgtttaatccagagctagcactcaaaaagcttcaaggaaagaggctattattcgtaggggattcactgcaaagaaatcagtgggaatcttttgtctgtatggtacaaggtatcatacctgaaaagaaaaagtcaatgaaaagggggcgtgttcattcggtcttcaaagctaaggaatataatgctaccatagagttctattgggccccatttctagtggagtccaacactgacattcgtatcataggagacccaaagaagagaataataaaagtggatcaaatcacggagcgtgccaaaaactggacaggagtggatatactagttttcaacacctatgtatggtggatgagtggtcttagattaaaagcactatggggttcatttgccaatggagaagaagggtttgaagaattggatacaccagttgcttacaaactaggtttgaggacgtgggccaattgggttgactcaactattgatccaaacaaaacccgggtcttcttcacaaccatgtcccctgcacacacaaagagcgcagactggggccacaaggatggtatcaaatgtttcaatgagacaaggcctgtaaagaagaagaatcactggggaagtggctctaacaaggacatgatgagtgtggtggccaaagtggtgaagagaatgaaagttcctgtgaatgtcatcaacataacgcaaatctcagagtacaggattgatgctcattcctcagtttacactgaaactggggggaaaattttgagtgaggaggaaagggctaacccactaaatgcagattgcatacattggtgtttgcctggagttccagatacttggaatcaaatatttttggcgatgttgtaa

SEQ ID NO: 98965 - DNA, 285 bp, Glycine max
  Peptide Sequence Number=SeqID_215743
atggaggaaagatggagagaaagggaggaacaaaggaggattagggaagaagctagggctgagaagagggatgcactaatcacagctttgctaaacaagctagagaggcaaggaatttgtgagtggtttacggatcaagtgatccgtaaacaacccatcaacttccccacggcattttctgccatcactggcaataaccaaaacgtgaacagcaaacttacctcgaagaagaagcaaaaacgggaagaagaagtagaaatgcgaagaccgacaccttcctcctaa

SEQ ID NO: 98966 - DNA, 288 bp, Glycine max
  Peptide Sequence Number=SeqID_215744
atggtagcaatgagactcacagtgacgacgacaacagtggcgagaagtggcgacaaaaatcgaaagcaccaatggcggggtgttgacgacatgagaagaggaagcgaaaacgaagaagaaaggggcacaccagcggtaagcatttctgctgggtgcacgaagcaattgccctcactttgccgtaaacacgcccttgtttacacatatggcgaatatgagaacatgcttccatcatgggcagttttcatgggaattgtcctgaacattttcccatgttttaatctatga

SEQ ID NO: 98967 - DNA, 1446 bp, Glycine max
  Peptide Sequence Number=SeqID_215745
atggcatctccaaacacaaaccaggagaaagcaggggtgctaggtcgagtattggccttgccaaaagttgttaaggggaaggtgttgagcatttgtaggttaacaaaagagatagcacaagatgatcctagaaaagtgattcattcactgaaagtaggacttgcaatctcacttgtttctcttttctattactatcaaccactatatgagaattttggtctttcagcaatgtgggctgtgatgactgtagtggtggtttttgagtacacagtcggagccactctaggaaaaggtttgaataggacaattgcaacattggctgctggtgctcttggtgttggggctcattacttagctagcctatcgggtgcaacaggggaacctatattgattggagcgtttgtcttcgtgcaagctgccatagcatcattcataaggttttttccgaaagtgaaagcaagatatgactatgggatgcttatattcatcttgacattctctttgatatccgtgtctggttttcgagaggttgaagtgttggaaatggcacacaagaggctatcaaccatattcatagggggttctgcttgtgtgatgatttccatttttgtttgccctgtgtgggctggtgaagaattccactattccattgctcacaagttggaaatacttggctatttcttggaagcttttgtacgtgtatacttcacgatgtcaaaagaaggagaatctgaagacaacaaaggagattctaaagacaagtcgtttttagaaggctataaaacggttctcaattccaaaagtgttgatgactctctggccaattttgcaaaatgggagccaggtcatggcaagtttagatttcgtcatccttgggacctatacctcaaagttggtgctctttctcgccaatgtgcatatcgaatggaagctctagatgcacacatcaactctgatatccaagggtcccaagaaatgcgttccaccatccaagagcaatgctcagaaatgtgtttggaagctagccaggcctttaaggaactaggatcatcaatcagaacaatgaccatgccatcatcttcagacacacatgttgcaaacgcaaaagctgcagtgaagagcctcaagacattgctccaatcaagttcatggaaagaaacagaccttttatcactcataccagctgcaacagtggcttcactactgattgatatagtcgaattcacggaaaaaatagcagattcagttaataatcttgcaaccctcacacattttgaagttgtagatacagataaatcctcaacaaaagcgcaacaaccatcacaatcatctccacactgtgaatgtgttgaaccgggtcccaagactgatagcctccaactcgttattctaattgaggactcagcgctagctgtgtcagatagtgaaaaatcgaacagagtttga

SEQ ID NO: 98968 - DNA, 480 bp, Glycine max
  Peptide Sequence Number=SeqID_215746
atggcgtggaggtctttggctatggtgatgtctactgttcacccattaaaaaaagcaaaaggatccactggggatgccttgatgtcgagggagagaagtcagtgtgacgctggccagagatgcgtcatccgtcattgcaaactgacaagagggcagtgtggtggctaccaaacaggacaaatagtgggcgcaggaatctcgaaagccatgaaaaagagccaaacaagggaattgtcaaagtccccgaaggaagaaaagcacgaagttgcggatgctggactgtggaaaggaagactcactgatagtgaacgaaagcccgcaatgctttgtgtcacactgttcacacgaacagaaacacaaacactgaaagaaaagaaaattgtttggcgcgtgatggcggcggcggcggtcaccagaaaagtcattggaaaaagagaaagggtcgctggaagatgggcagcgagcagaaaggtccactag

SEQ ID NO: 98969 - DNA, 1458 bp, Glycine max
  Peptide Sequence Number=SeqID_215747
atggatgaattctatgtaaatggacgatttccgaagggaaccaatgctttgttcctagcactgattcccaaaaaggcattgccagatattattgatgagcgacaaactacctttattgaaggcggacacatgcttcatagtgtactcgttgctaatgaagcagtggaggaagcaaaaagaggaaataagagttgcctggtgttcaaagtcgactatgagaaggcgtacaattcagttagttgcgatgttttggtgtacatgcttaggaggatggagtgttgtcctaagtggattacttggattgttggctgccttagatcagcctctatcttggtattcgtcaatgggaacccttcagctgaattctttccccaaaaaggactcagacaaggggacccattggccccacttctgtttaatattgtggcagagggcttaactggtttgatgagagaagcattgcacaagaaacagtttaagggattcatggtgggaagaaatatggtggagattagtatcttgactaaaaataaactttgcaaaaagtcatttccggacgattgggatgtcaatgcagtggatgaagaatgcagcaacatacctaaattgcagcttgttgtctgtacctttttcctacttaggtattccgatgggggcaaatccaagaagatcacgaagaaggtggttgataacctagtgaaattaaagaggtggttcctttggggaggaggattagagcagaagaagatcacctgcattagttgggaatcagcatgcctatcaaaggagaaagaagaaaatggcgatggaaccggtttaatcatcaagaagaattgtgggctagagtgttggactcaaaatatggaggatggaggaacttggatgaggagaggaggagttttgcagaatctgtttggtggaaagaccttcgttctatctgtcatgggtctggggaggaaagctagtttaaatctggatgatgagattctgctgatggtaaaatatcctagactttacctaatttcaaatgagcaaaacaaatacatccagcagatggggagcagtgcaggtggagcctcggagtggattctgttgtggaggagattactttttgaagctgagatagttatgggtgccaattttttggaagaaatccaggacctcaccataaatgttcatcaagacaagtgggtgtggatgagtgatccaaatgggatatatactgtatgtagtgcatacaagctgctggacaaggactcaagagacgacaatctggatggggcatttaaagacatatggaagttaaaaatcccaagcaaagccgccttttttgcttggggattgatatgggacagattgtccactaagtccaacttgtgcaggaggaatgttgggaaattaggattagcagctgggaggatgtacgaaatctccacagtcagatttttagttccttaa

SEQ ID NO: 98970 - DNA, 162 bp, Glycine max
  Peptide Sequence Number=SeqID_215748
atgtgggcagttgatattcaattttcacaaattctagaagttcttgaacagctatacctatatcctttcaacttgataaaaatatgttccattttcggtgcgcattgggaaatgttgaagttctattcaatcaaactcatccacgagtttctaaaaccataa

SEQ ID NO: 98971 - DNA, 1944 bp, Glycine max
  Peptide Sequence Number=SeqID_215749
atggttacacctcctgaggatgaacatttaaggcatgtaattgatacaatggctttgcatgtcctggatggaggatgtgcttttgaacaagctattatggagaggggtcgtggcaatcctcttttcaacttcttgtttattcttggctcaaaggaacatacctactatgtttggaggctctactcatttgcccagggtgatactcttcaaagatggaggactgaaccttttatcatgataacgggtagtggaagatggattccgccccaattaccaatgtcaaaaagtccagagcatgaaaaggagtctggttccacacatgctggaggaagaagcaggcgtgtagagcccgacagaacactgactgatgcacagagggatgaatttgaggatatgctgcgtgctttaacattagagaggagccagataaaagaggctatgggattttctttagataatgccgatgctgctggcgagatagttgaagttttgacagaatccttgacacttaaagaaacccctattccaactaaaattgcaaggcttatgcttgtttctgatattcttcataatagtagtgctcctgtacgaaatgcatcagcatatcgcaccaagtttgaagcaacattgccagacataatggagagttttaatgacttgtatcgtagcattatgggacgtatcactgctgaagccctaaaggaacgagtgctgaaagttttacaagtttgggccgactggtttctcttttcagatgcttatgttaatggattaagggccactttccttcgacctgggaactccggtgtaattccattccattccatttgtggtgatgcgcctgagattgagcagaataccacttccaaagatatggttgttggtggcaagaccaaccaagatgctgcattggcaatgggtcgaggggctgcaatgaaggagctaatgagtcttcctcttgctgagctggaaagacggtgccggcacaatggattgtcacttgttggtggtagagaaatgatggttgcacggttgctaagtcttgaagaggcagaaaagcagagaggttttgaactagatgaagaattgaaatatgcccacaaccaagtgagttctgggaaatattcaagtaatcaacgagaaacaagtgaagagcctgacccagtatggaaccactatggggatgaagatttgcagtcacagggcagaagttctgtacctttatccccaacacttcctattgcacaacctgaacttaaagctttcacaaaaaaggagaagaatgatccagttctgccagcctctaaatgggcttgggagggtgatgagagtgatgatgaacaaaggagaagtggaaaaaatatcggcttaagctactcatcttctggtagtgagaacgtgggtgatggtcttgttaaagctgatgaatcagagtctgcagctgatacacgtttttcagctcatgctgacagtggaatgaatgaagagcagaggcaaaagctgagacgcttagaggttgctttaattgaataccgtgagtctcttgaagagaggggagttaaaaatttggaggaaattgagaagaaagttcagtcacataggaaacggctgcaagtggagtatgggttatcagattctggtgaagatggtcatggccatagaagaacttcagagaggagggattggaatgatgtttcaaggaaacggcatcgaagccctagtccaagtggtagtccactgccaaaattatatggcaaggacagagatagagaacaccacgatttagaaagggatcgagacagacaaagagacagaagtcatgatttcgatagtgaaagaggaagggaccggcaccgggaaaagagtggaagcagagagagagatgatcatgataaggatagaagcagggatagagacagggacaggagaagacgagccaaataa

SEQ ID NO: 98972 - DNA, 204 bp, Glycine max
  Peptide Sequence Number=SeqID_215750
atgggtgttgggctgggattgttgttcacaccttccttccttctttccttccccggagtcggtggtagaaacggaaggatgcgcagtaacactgatgaagaagggcacacgacagggaagggtatttggtatgttgttttcttttctatccaaaaaataaagtgttgggtagaatatatactgggttttgtaaaatttaaatag

SEQ ID NO: 98973 - DNA, 393 bp, Glycine max
  Peptide Sequence Number=SeqID_215751
atgccatttactgtttacagggatcgcgcccgcaagacacccagtggactcgaagaagtccaacaaggccctagggttctagctctgattacgggcctctgttggttctacggagtgaccaccactccgatctccccctgccgaagtgtaagtatgtgcgtggctcaactgatttttgatgccatctactgtttgcgggattgtgcctacaagacactcagtgggcccggagaagtccaacagggtcctggggtttccagctctgattacgagcctccgtcaattctacggagtgctcgtcgcccccagcagggtcatcaggcccctattaacagggctttcatcgagaagtattgtgccccctggcaggcgcagggcgaggcatcacagtag

SEQ ID NO: 98974 - DNA, 411 bp, Glycine max
  Peptide Sequence Number=SeqID_215752
atggtagaaagagaaagttgcagagaaaatggtagagagagagagaaagttgcagagaaaatggtagagagaggaagttgcagggaagaaggagaagagagtaaggggagaacaaaagagggagagggtttggttggtgaggtgaaggttctgtggaactgtgatgtgcttttctctgtctgtgtgtgggtggggaggtgtttctctctctttctgagacccttggggaaaataaatggaagtgagagggaagaaaaaggacagattttggagaaatatttactgcaggagccactcagcacagtaagggtttgtcggattgtggaacagagaaggctctggtttgaacagtgtagcagctgcctatggacaaaattattgtttgatatgaaatttttcatgtctctatga

SEQ ID NO: 98975 - DNA, 1808 bp, Glycine max
  Peptide Sequence Number=SeqID_215753
atgccttcgcgaagctttctgcatctatgacttcgaagttcgatgagcttcttaaccgtatgaatcagttggagacctcacgtaccaatcctcacgttccaccaatgtttgcaagtccttcatccgccacaaccacaaattctgcttatcggttgaagctggagtggatgtatcgcaatggccaattgtcttcttggtcaacttttctacatgctatccacgcaaggttttcgtcttcagcttacgaagatcctacgagagtactgtgtaaattgacgcagcgttcaaccgtttcggcgtatctctcggagttcgaagctctcgctaatagagttatcggccttccggcgccgtttgtgctcaattgttttgtatctagactgagtcctgcgattcgaggggaggtgcaagtcatgcagcctcattccttggctcaagcagtctcgttcgcaagactccatgaggagaagttgctagatagtcgccggccgggagttcgatcttcccctactacgacctctatccccccttcttcacgactctggcctcctcctagctttaatccttcggaatcctccttgctttcgtctgtggccaaaccacgctcctccaccatttctttcaaaaggttgactccgacggtattagctcttcgccgagaacaaggactatgttttaactgtgacgagaaatacttgcgcgatcataaatgtgcttcttccctattcttgtttgttacggaggaggatgagtatgctcaggaaatcgatcccgagcctttattgccaacgctccctccttcttcgcaggactcgtcaccggcgcagattagcctgcatgctctctcagctggtctcttctctgaagttgcttccccaaaatacttccatgctgcgagtgacggtgggcaatggcgaggagctgcagtgcaaccagatttcgccatcccagttgcgtcatttggtagacacagggcactcaatgcgattacagtacacgatcgtttccctatacctgcagtggacgaattattggatgaacttggaggcgtagtatggttttctaaactggacttgatgcaagggtatcatcagattctgatgaaagaatccgatacgagcaaaactgccttccgcactcaccatggacaatatgagtttcgggtgatgcctttcgggctttgtaatgccccttcatctttccaagcaacgatgaaacgcttgtttcagccctatctgcaaaaatatatcatcgtcttcttcgatgatatattgatatacagtcgaaatctggaggaacatttgaatcatttggaaactgcgtttcaagtgttaatggatgattacctagggcacattgtttccggcaatggtgtacaacccataccagaaaaggttcaagccatccaaaggtggccgcaaccgcgaacaactcgagctctgcgtgggttccttggcctcatgggattttatcacaggctcataaagggttacgttgctatggccacacccctctcacaactcttaaccaaggcggacttcgtatggtcaccagaagctgaacatgcatttcaaactcttaaggatgcagttactatggccctagtacttgctcttctcgattttgctaagccctttatggtagaaacagatgcttcgggttcggatcatcggagcctaaaggagcttatgaaccaggccattcaaacacctgaacaacacaggtacttagcaaacttgctaggatttgattatgctatcaagtatagagcaggcaaaagcaatgtagttgcagacgcgttatcatga

SEQ ID NO: 98976 - DNA, 321 bp, Glycine max
  Peptide Sequence Number=SeqID_215754
atgattgcagccatgctaagaggagctggtcaggtgtgtgaggttgggaatccattgaagaagggaagattcagaggaaagaaatggaggatcttgccacgcttgtggaagaatcagaaggctcttgatgaggacatgaccaagagcaagggcaaggatccacttgaaggacttggaggacctatgacaagggctagagcaaggaaatccaaggaagctcttcaacaagtgctgtccatactgtttgaatacaagcccaagtttcaaggagaaaagtccaaggttgtgagttgtatcatggcccaaatggaggaggactaa

SEQ ID NO: 98977 - DNA, 531 bp, Glycine max
  Peptide Sequence Number=SeqID_215755
atgtggatgagtcttcctatgtccattctgtttgtttcttgtctgtgcattcttttgaacaaggtggaattccattggaagaaaaatcaactgccactgaatgacgggcacctcacttattcacctccccctcccaaatggaagaagaagattaattctcctattgtggaggctgccttaaatgattttgttgatttgatattgaaggactttgtgataaatatgtggtatgcaaacattactccagatatggagtttcctgagctggtacatgacttaatcatgcatgctattgctgaagtgtcagcaagagttaaagagataaacctcgttgacttgctcacaagggacatagttgatctaataggtgatcacatagaccttttcagaagaaatcaagctgctataggtgttgatgttatgttaaccttatcttctgaggagagggatggaagattgaaattctgtctgttgaattctaaggagcttcatctagcactaatgtctccaaagagtgagtacaaggtgtga

SEQ ID NO: 98978 - DNA, 822 bp, Glycine max
  Peptide Sequence Number=SeqID_215756
atgcacatcaggctcgagaaaccccttctcattagtagcttcactactattgatggtcgaggtgttaatgttcacattgttgataatgcatgtttgatgatctttaaggcaaccaacataatcatccatggccttagaattcatcactgtcgacctcaagctcctggaatggtaatgggacctaatggagaagtgatacctttaggtcaagttgatggagatgcaataagattggttacagcttcaaagatttggattgatcacaacacactttacgattgtcaagatggtctccttgatgtcacacgtggttccactaatgtgactatctcaaacaattggtttagagagcaaaataaggttatgcttctcggacatgatgatgggtatatgagagacaaggatatgatggtcactgtcgtatataactattttggacctaattgccaccaacgcatgccaagaattcgccatgggtatgcacatgttgcaaacaatctttatatgggatgggtacaatatgccataggtggtagcatggaacctagcctcaaaagcgaatcaaacctctttatagcaccaacgtcagggcgtaaagaggtaacatggagaaaaagtaatggtattggagactcgtgggaattccattcggtgggggatgtttttgaaaatggtgcatctttcatggaaacacaaggtggacaagtaccaaagccaaattataatcctgagcaaagttttaaagttgttgatgccaaatgtgtgagatcattgactatctcatctggagtgttacgatgcagtaaaacctctatttgttaa

SEQ ID NO: 98979 - DNA, 237 bp, Glycine max
  Peptide Sequence Number=SeqID_215757
atgcttcaggttcaggaagctaagaacaagcttgatgttcctaaagatgcagaggaaaaattgtgtgatgaaaccaaggggcataaactggatattactagtgatagagatgtccaaattttggatgatactgataggaatcaccttgagtataccaacactgggcccgaaactgcagaaacaaggcccaaacgaacagcatcaagacccagctacttgaacgactacgagccatga

SEQ ID NO: 98980 - DNA, 540 bp, Glycine max
  Peptide Sequence Number=SeqID_215758
atggacgatgaagcaataaaattatctggttcaaataggagaccacattctgaaataactaagaactccaaaagaggaaatgcgaaagccaatatggaaactgataatttagactctgttcaggaaccaaaatcagaaacgcaattgaatactgtaccaaggaagaggggccgaaacaaaacctgggaaatcagccaatccagaaaggcttgcaattgcagctctccttatccatcttctgaaaaacctacttctagaaaggataagttgcatagaatgcctaaaactgttagtgaaactctagtttgtatgcagaaaagtgagaacatagcaaaagctatccaatccagaaggactcaaaatattggcactgattttctagctaatgatacaagcaaagttcatgaagctttagcttctaagcctaaagctgatgagaatacaaatgctgcttctgtaaataataactatcctgatgcaggtgctatctcaagtgctatctcaagtaaaaccagatcagaaaaacaagttcataaatga

SEQ ID NO: 98981 - DNA, 3513 bp, Glycine max
  Peptide Sequence Number=SeqID_215759
atggccgaccacgcaacacggaaaacgaccaccgacaggctcgaggacgctatcacccgtctctccaatagccaaaccacacttctggataaacatgctgatctcgttgacaaatactcagaactttccggcaaagtggatacgatccttgatcatctccatttgcgatctccggcgcgggagcatcctgggtcctcttcccatttccaccaacgtaactctgtcaagttggacattccaagatttgatggccgcgaccccatggggtggattttcaagatttcacagctattcgaataccagaacacgccagaagaagaaaggatcaccgtggcctccttctacctggatggggctgcattaagctggtaccaatggatgtttaggaacgggtttattacttcatggtcaggcttcctacaagctctcgagtccaggttggcgccttcgtattatgatgaccctaagggggctctcttcaaactgacgcaacgtggcaccgttaatgagtacctaacggagttcgaacggttagctaaccgtgttattggtttaccaccacctttcctgttaagctattttgttttaggtttagcacaagatatacgtcgagaagtgctagctcttcaacccatttcccttccacaagccatggctcttgccaaattacaggaagacaaactccgagatcgccggcaagcgccaccacgaagtcacaatactccatctccatcatatgtccctaccagccggaaagcacagtccacatatgttcagagaacaccagatgagatggcccttcgtcgggaaaagggtctctgttacaattgtgatgaaaaatggagctccactcaccgctgcaagggacgcatccttttgttcatcgccgacaacccatcccttatacaagaagaacccattcccgaaccttccttgccttcaattccggaaccaaccccagcgtccaccctagactttgacacaccctctgagttaaacctccctcacgtgagcctccacgccttctctggcctcccctcctccgagaccttccgacttgtcagagtcatcaatcactcctcccttaccatccttatagatagcggaagcacccataacttcctccagcctcgcattgcccagttcctccacctaaaagcccaaaacacgagcccactccatgtcctagttggtaatgggtctgtccttgattgtaaccaagtctgtcccgatacaccgctatccctccaaggccaccatttcacggttacgttccatttgcttcctatcagtggtgcagaagctgtgttaggaatagagtggttaaggcaatttgggcccataaccactgattgcaccacgttttccatgaagttcacccatatgggccagcccattgagttacacgctgatgtttccactgggccgaaaccaatctcaacccctcaagtgaaacggttattacaaaccggatccgcctcagctctctttcacttaaaactgatccacgacccacaacccgacccacaacttcatcttcctcacccgatacctgcagtcgaagcactcctaacccagtttcaacacctattccaacaaccatcttccctcccccctccttgctccatcgttcaccacataaacctcctacccaatacaccaccaatcaatgtaagaccataccgttacccgcaattccagaaatcagaaatcaaaaagcaggtgtcggagctcctcgcatctggtttggttcaaccaagtatgagcccttattcctctccggtattactagtaaagaagaaggacggaacctacagaatgtgtgtcgactatcgtgccttaaatgcagcaacaggattccaccagattcttatgcatggccctgacgtagagaagacggcttttagaacacaccaagggcactacgaatatcgtgtgatgcccttcggactgtgtaacgcaccgtccacctttcaggcagcaatgaatactctgctaacaccgttcttgagaaagttcgccgcagtttttttcgatgatatcctagtatacagcaggacattgtccttgcaccttcatcatctcgagcttgtcttccaaactctccgccaaggtcagtaccatctgaaaaagaccaaatgccttttcgctcaaaagcaagtcgaatatttaggacacatagtttccggcaaaggggttgaacctgagccctccaaggtcgaagctatggtgaaatggcccacaccgacatcagctaaggaactcagatccttcttagggctcactgggttttacaggaagttcattaagaactacgctatgctcgcggctcccctcacttccctctttaccaaagatactttcgaatggtccctggacgctcagtctgcgttcgagcaactgaaggcagcaatgacaactgcccctgtccttgccttaccagactttgaagaaccctttgtcatcgaaacagacgcttctggcgccggtatgggcatggttttgatgcagaaaggccaccctcttgcgttctttagtaaacaatttgggccgcgtatgctccatgcctccacctacgtgagagaacttcacgcgatagtacctgcagttcgcaaatggcgccagtaccttctgggccatcctttcaccattttcaccgaccataaaagccttcgcgagctcatgtctcaagttatacaaacgccagaacagcattactacctttctaagcttctcggcttcgactacacgatccaatataaggtaggatcttccaatgcagtagcggatgccctatcacgatcaccttccttcggcgagttccttctgctatcggttcctaacctcgacttcatgcatgacttacgtcgcaccctccacgctagcagtgatttccaggatctactctctaaggtgcgtgatcatcctgaaaattatcctgagtatcgaattcatcaggggctcatcctctttaagaatcgtatctggttgaatgacaataacccatcgatacccaacctcatgctggaatttcatgcaactccattaggaggacatctaggggatatcaagcgctttctcaaggaatgccacatctgtcaacaaaccaagtccagcacacaacgacccaccggacttcttcagcctcttccaccacctaccggaatttgggaagatatatccatggatttcatcacccagctgcctccctctcacggttatactgttattctagtggatgtggatagatactcgaagggcgtccaccttggagcattaccttctaaccactccgccttcaaggttgcttccttgttcattgatatcgtctgtaagcatcacgggtttctgaggagtatcgtctccgacagagacccaatcttcctgagttctttctggcgtgaacttttccgtttgagtgggacgcgactccgcatgagtacggcttaccaccctcaatccgatcggcaaaccgaagtcatgaatagagttcttgagcaatatctcagatga

SEQ ID NO: 98982 - DNA, 240 bp, Glycine max
  Peptide Sequence Number=SeqID_215760
atgcatgctaatgttaccaacattccttacaaatggactgcttgcagatgttttctaaaaacgtttcaaatcataagcagactggttctcgttcttaaaacatgcccaaaaatcataggcatactaaaaaatcgagtaggaaatgaacagatgtcaaaccatgtcacctgtgttccattcaaggaggaagctctgatcaaattccagcagagaaaaataaccactattgctgattgctaa

SEQ ID NO: 98983 - DNA, 180 bp, Glycine max
  Peptide Sequence Number=SeqID_215761
atggaattttggccgatttccttgtggcgaagattaaaactgggtaatttggtggcattctgtgatttagaacccatctatacctacgaaggcacgtatgacattaacaccttggttacaggtagagaagttactggttttgccagctttaagccagttgctcaaagaagtcgattgtaa

SEQ ID NO: 98984 - DNA, 270 bp, Glycine max
  Peptide Sequence Number=SeqID_215762
atgagactaaaggttctcatgaactatatgacaattgagggtggattaactatcacagtaaggaaaagtgagggtgataaggggaaccatgaggtcttggagaaagcctccaagcggaaaatcaaacacgcactaaaccatgtgctggtggtgctgggtagctgcctcatattgatgaatagtaggagcttgcataaactgactcaaagtatgtacgacaaaactgatgtgaggccttgtggtgttgaggtactagaggcgcccaattaa

SEQ ID NO: 98985 - DNA, 219 bp, Glycine max
  Peptide Sequence Number=SeqID_215763
atgaaattgttgaccgttaccgttgtggatttgtacagattttcatggctaagagtagaaaaaggtgaagcagctggtgtctcgctaagcgaggcatatgcacttagcaagttacatccgctaagcgaggcactcggcctgcttagcgcgtggagaaaccctagaagaggatcagtcatagatgctcgcacccaacgttccgcaagctcgcttaggtag

SEQ ID NO: 98986 - DNA, 225 bp, Glycine max
  Peptide Sequence Number=SeqID_215764
atgagaagggtgggaaggaagacgatgagaacactgggcttagtttgcttcttagccgcaggtgatgtgatcccaaccccaacttcctgtgagaactgtcaggttactccaccaccttctggttatcctttttatgaagctccaccaccaccatcacaaccacctcctccatcttctggctactctatatatggtgctccaccgccaccatcaccacacaagtga

SEQ ID NO: 98987 - DNA, 2868 bp, Glycine max
  Peptide Sequence Number=SeqID_215765
atgaaaggaaacctaccaatcctggacgaaaagaattgggatcgctggcgaattcagatgaaggcgatcttggggagtcaagatgtaagtgatatcgttgaacaagggttgtcggcgcttcccgatggagctacggaggagcagaaggcagcgcacaaggaaaacaagatgaaagattgcaaggcgatggtgttgttccaccagtgcgtcgatgaagcacacttccagaaaatctcaacggctaccagttcgcgagaggcgtggaagattcttgaaaggtgtaacataggagcggaacaactgaataagatggaggaaaacgagagaatcactatctacctcaataggatcataagtcacacaaatgcaatgaagtccaagaaggtagaaaccttgaaggttgaagagttgcaaggctcactcgaggctcatgagcaaagactcatggagagatcaatggcaaggtctggtgaccaggttctacaagctacggtctccaagaaaggtggttatggaggaagatccagtttcaggaatcaagaaagctcaaataaaaggggaacttccagtaaatggcgtggaggaaggaaaatggttaatagcaagaatctcaaatgtttcaattgcaacaagataggacatttctccactgaatgcacaacacccccagctcaaaatgacaatcgtgggaagcatcataaggaaacacacctagctaaggaaggtattgagacaaatttaaaggaaaaaccttttatgctcatgatggtcacaaatcataatcccagagatgatgaaagatggtacattgactcaggaagctcgagtcacatgacaggacacaagaattggtttgtgaatcttgatgaaaccaagaagagcactgtgaggtttgctgactacaagagcaacctcatcagcttaggtcaaattgacatacacaatggataccttgcaatttttgagccagtaactgagaaactggtgataagaacaaaaatggcatctaacagaacattccaggagatggttctagggttacctgcaatccagattcctagtaaagtctgtgatagttgcttaatcagtaagcaacctagaaactctttcagtaatttcacactatctagagctaatgacttactccacattgtatactctgatgtatgtggcccctttgatgccccatcactgggagggagcaaatactttgtgacattcattgatgatctaagtagaaagatatggatctattcaatacaactcaaaagtgaggtatttttagtgttcaaaaacttcaaagcactggtagaaaaacagtctggtaaatgcatcaagatattcagaactgatgggggtggagaatttacctcaaaagagattgaggatttttgcaaggaccaaggcattgtgcatgaggttgaagcagccacaactgcagtgtatgttttaaataggtgtcctacaaaaaaacttgatggaaaggtacctgaggaagcatggtctagagtaaaaccctctgtgaggcactttaggatctttggatcattgtgttataggcacataccagatcagaagagaaagaaattggatgacaaaagtgaagctatgatatttatagggtataattctactggatcctacaaattatataatcctaagaagagtgaatttgaatgggaagatgaaaacacaattgagaatgtttgtgatataatcaatggtactgaggaattccagattgatgaagccagacctcaaagacaaaggaatctaccagctagactaagagattttgaagtatatccagataatgcaatctcaaaggatggagatttggttcaacacatggcattactagctgatacagaaccagtgagctttgaagaagctatcacaagcagtgtttggagggatgctatgttagaagaaatcaagtcaatagagaaaaataatacctgggagttggtgtcactcccagcagagaaaactccaatagttgtcaaatggattttcaaattaaaattgaagcttgatggtactatagctaagcataaggccagacttgtcgccaagggcttcatgcagaaggaaggactggattactcagaggctcctagggcttggaataggaggattgattccttcttagccaagacaggatttcataaatgcagtgttgagcatggtatgtatgtaaagcaattgagtcagaaagctggggatctctacatttgtctatatgttgatgacctactcatcaagggagagtttgagatgactgaccttggtgtcttgtcatatttcctaggcttagaatttcataagcatgattgtggtctgtttatgcatcataggaagtacttgttggaagtactaaagaaattcaagatgctagattgtaacccctctaaaacaccagctgaaatgagttgcaaattggactacaaatcacttttagtgtggagaggcacactagactttggtgttctatttccacatcataaagagaaggatgttgttgcactctctacttgtgaagcagagtatatagctgcttgttcagcagcatgtcaagcttgttggttgtcctcattactagaagaattgggagtagttactactgatgctataaagttactggttgacaacaagtcagcaattgaccttgctaaaaatccagtctctcctggtcactctaagcacattgaaactaagtttcatttcctaagagatcaagtaactaaaagaaaaatcaagttggttctctacaagacaaaaattcagttggcaaatatcttcacaaaagccttgaagatagacaaattcaaggagctgagaatgatgatgaatattctagagctttag

SEQ ID NO: 98988 - DNA, 489 bp, Glycine max
  Peptide Sequence Number=SeqID_215766
atgaaggttggcaccactcctttcgaaaacacttttggaaggaaaccttttaattttccagagtatctcgctggaacctccaaaattgatgcggtggatgaactcctgtatcacaggccggagaccttcaccaattttcgcaagaaacttctcatagcccaagaaaagatgaaattagttacagattccaaacgcaggtatgtcatgttcaacgttgagaaaattgggcttgtagcatataagcttcatttaacagagggagcccatattcatcatgtcttccactgttctttactgaaaccattccatggagctccggacaaagatacccaactacctctgctggaaaccgtcgtcgataatcatcctctcgtgaccccactggctatcgtggactctagacgggtgttgggctcctcttcaccaaaatgggaggtattgacacaatgggatgggttgtctcctgatgatacatcctgggaggactag

SEQ ID NO: 98989 - DNA, 321 bp, Glycine max
  Peptide Sequence Number=SeqID_215767
atgtggccagaaaatggaattcatggttgcttggaaagaagatggggcattgcaaagcccaaagggcatcactcgaaattcaaaatgaccgtgatgggtgcgaaaggcggtcttacagatatcctcttcattcatgcatatctggtgggacccctggaaaagtctatgcaaaagcaccaagatccatcatgcttcctcaccaaaaggatcggagatgagaacgggcttgtgctgggtctaatgatcccgttctgtaggaggtcacctgcgtctcaatttcctgcttctgatagtgggggtaacgatatgggcgtacattga

SEQ ID NO: 98990 - DNA, 897 bp, Glycine max
  Peptide Sequence Number=SeqID_215768
atggcggaatccaccaggtctaaagcttcttcagacaggctggaagatgccatagccaaactcactacccatcacctatccatgacagaaacagtacaaactatgaccctgaaactcgacaaattaatccacaataatggtcagttcacctcttggtcaggtttcctccaagcgctgcagacacgattcgccccgtcgcaatacgaggatcccaccggtgccctttgcaaacatacacggtgctccacagtcagcacatacctttcggagttcgaagatcttgcgaatcgtattgttggactgccttcgccgttcctcttgagttgctttatctcgggattgactccggagatatgccgggaggaggagaagcttttggatgcacgttccctgagccgagcgtgtccacacacactcgtcgcgcctcccccgcggcccttgtcgtcaatcgtgaccccattgcttccagccccagtgaaaaccccaaccctagtacctttgaagagactcaccccggatgaattggcttcgcgtagggaacgtgcggatgaggaagatgcaacccaagatgaccctacccaattggagcagccgcacgacccacctgatgccactaacccgatgcaggcccaaatcacgatccactctctttcgggaaccattggtgcgacaattgggcctcgctactcagaccacacctccactacgcatcatgcttggaaatggctaccaccttcactcgtggtcttaggcgtgcagtggctcaagacacttggacccatcatgactgactacaacactctaagcatgaaattttttcatgaaggccacttagtcgagtttcaaggggatactgatcttgtctctgttctcctcaccccaccacagcttcgctga

SEQ ID NO: 98991 - DNA, 522 bp, Glycine max
  Peptide Sequence Number=SeqID_215769
atggcgtttaagaaaaccctagcccagcggcttctcaacatcaccaaaatctccaattaccgcatttcctcctccgaagttcgttctccgaacccgacaaaagccgacattgctccggaccccggagacaaccgcaggttcctccacaagaggaccgccgtgttcccgccggagctccgtccgccaccaccggccggcagcctcctccagaggctccgggaaatggacatttcgaagagcaggatccggctcgacggcctcgctccgccggagacagatcaactagtggcgccggaacacgtgaggaaggtgatcagagcggtgcaaatcgaaacggtgaaatcgaagctgagaaaagttccgcagagttgcgtaagttattcagagttcattcgaatgtgcagcgagaattgctccgatcaggagcaagcgatgagcgttgcgaagatcctcgacgattccgcgtcggttatcatcatcggagacgtcgtgttcctcagacccgaacagacaggaaaatga

SEQ ID NO: 98992 - DNA, 717 bp, Glycine max
  Peptide Sequence Number=SeqID_215770
atgacgactcttgtgttatcgctacctgactttgtagttcctttcactgtcgaaatagatgcttcaggcattggcatgggagcggttttgttgcagaatgggcatcccgttgccttcttcagtaaaagccttaaggagttgcatactcaggtgattcagacaccagagcaacagaggtatttagctcgtttgatgggatacgattattgtatcaaatatcgttccggaagcaccaacatcgttgctgatgctctctctcgtgcacctcattcgtcatcagcgacactattagttttgtcggtgccatgcttgacatttctagatgagcttaagaaacatcttctctgcaacccccggttcatccaactccgacgagacattcgtgctcaactagatgcgtactcagattattccgttgcccagaacttgatcatgaagggggggagtatatggtcacctcgagggggcttcgaagggatgtcgaggaattcgtcaaggcatgcatccatttgggcatgttgcctacgtctcattctgcccttactatcgcattattattcatcgacatcgttggaaaactacatggaatgccttggagtttggtgtccgatagggatccgtgttcctgagccacttctggcagaagctattcctcttgagtggtactcacctgaggatgatctctacatatcacccccaaagcgacgactagactga

SEQ ID NO: 98993 - DNA, 456 bp, Glycine max
  Peptide Sequence Number=SeqID_215771
atggcagaagaggttgagttggttagttgtggccatgtgctcagaaaagcaaatcaagttgttgatgcctggcaaaacgaggacccacgcgccgatcccattgcacccgcccttgaggaagaagtggaggaagaagacggcgacgtggcaggcaacattgcaggcgaggagcacgatctggcagctgaggacgaaggggaagcacgcgccgcggaggccgatggcggtccagaagcggattctgaggagggtgcggagcatgtggaggaagcgggagaggggggttttggagcgccgccagaaccaccgcgtgtcgctgatctcggcggcggcagagaggaggatgccggcgaagatcgtggcggagatgagggacatggagaggctgtggacggcgggaagggggccgagagggatttgacggcggcggaagaggagagaaagagagaagtatag

SEQ ID NO: 98994 - DNA, 387 bp, Glycine max
  Peptide Sequence Number=SeqID_215772
atggctccaccaggaactatcttgacagttgagcagttcatagagaaggtagcctggccaagaactctgccttctcttataagggaaggtggaggtcccagtgcccaggtacctcaacaagtacaggatgcatcttcagaggccaccatccctgagccatttgtttttgaggcaggagggacacaggagctagcagaccctccttcaccagtgcatgagatgccaacatacccttctactccattactagagattcccaaggaccctgccacaccagtcctgggactgactaccactcctccaaccactcctatgctacattttacagatgaagagggcactcaggatcaggatacccagcgagatgaccagtcacaggagttttaa

SEQ ID NO: 98995 - DNA, 348 bp, Glycine max
  Peptide Sequence Number=SeqID_215773
atggacaaagccaggttggtttatggcttggtaacccacgtggatatgaacattggcgcactgatctcaagtcaaatctctgctattgctcagagtaactcctctaggctaggatttccagccttgatcattgcactttgtagagctagaggagttacctttggcagtctgacttatgagagcctgagcccaaccattaacttggcctacattaagaaaaactgttggaatatggatgatctgacagttaacttcagaggggcaaggaaggcaagggctcggccagcttatgctccttcttcttctactccaccagctcctccaggcttatctgcccaagacttttag

SEQ ID NO: 98996 - DNA, 414 bp, Glycine max
  Peptide Sequence Number=SeqID_215774
atggtgagtttagcctctcattatcatgagaggcttacaaatacaaaagggcttccaaggtggcttcttgcgctaagtgggcttcttgggttgagcggtcctgatgcgctaagcgaggtttactactctgcttggacggagagttttgttaccatagcaatcatactcaatgatgtaagctccattggagcttgtaggcctaggatcttcttcatcaatggattcctttgcttcttggaagatgaatggcagcggaatggagaaaggaagagagagatgagacgccacttcaaggagaagatgagtctagaagaagctcaccaccataggaggccatggataagagcttggaggaagaaggagatgaatgaggggagagggagagaagagcacgaaattttatgctctaaatga

SEQ ID NO: 98997 - DNA, 630 bp, Glycine max
  Peptide Sequence Number=SeqID_215775
atggagcaacatcacaaatgttggaggctgcaacttagagaagaactgaagttcttatgcccgagaatcttgagaaaatgtgggcataagttagagtcttcaccagatcatgacaaggaattctcttctgaaacagatcatcgagttgatgaggtgaaggacttcaataaatataaggactcactcaagagatttagcagtgcttctcttgtgggaatccaaactcatgagggagggtctccaaggtcagagttccacaccgctgaatctgagaaacatggtgaaggatttctaggaaagagtagttttgacatggtttttagaagagaggcacatgttgttcccaagcttcagtgtcgggtgttgggagcatattttgagaaactaggatccacttcttttgctgtctattcaattgtagtgactgatggtcaagagaaaacttggtttgtcaggagagttgtcttgcttcaagacctcctatcaacaacgaatattgctaagcaacatgaagtatgggactttttgagtgtttcctcaaaggttatagctattctaagcatggttacccacgagttaggattctctattatggcccctcatgcaggggcctttgggctcaaagcatga

SEQ ID NO: 98998 - DNA, 333 bp, Glycine max
  Peptide Sequence Number=SeqID_215776
atggggaacaatcaaagtatttatggccccattggaatctcctcaaacgattattcacaaccgctaatagaccatggtagtgaatctagtaacttggatctagatagaaaacataatgcaacaatggaagctaaggttggcaaggatgtaccagctacgaatttcaaactagttcctgataatttggaggacgttccacctgaagtctatagtcagctgggattgctctcttttttgttatgcacaacacacttgttgattgtgatatttgggatcaagctgttgaatgttatgctacctacttggcaaagttggggattgcatttagattaa

SEQ ID NO: 98999 - DNA, 441 bp, Glycine max
  Peptide Sequence Number=SeqID_215777
atgagttgtacagattcgctaagcgcactgcttcatctctctaagcgcactgcttcagttcatccgctaagcgagaaaggcgcgctaacccaaaaatcactaacgtgcgctaagcagtccataaggagtttggactgggattcagagctttgcatgtctagggtttgtaaagagagaaaggtccaagttccagagagttttgagagattttgttgtgtgaagatctgtagagaccagagcttgaagcaggagccgatgcatgctttgttagggtcattcaacagtggaaactggtctgactctaaagtccttgatagtgcagggctgagttgtcgtgctttcgcgaggaatcagggtgcgataagtcagttgagtatgtgtgtcttaatgcggtcgtggttgagtttagtcttacaagaggaatctgcggacgaggcttga

SEQ ID NO: 99000 - DNA, 571 bp, Glycine max
  Peptide Sequence Number=SeqID_215778
atgacaaacctgtggctaagcgagtgttgtctcgctaagcccagtgttgcttgcgctaagcgccgcccccgtgggctaagcgctaagcgccgcccccgtgggctaagcgctattccttgtggcatgcataaggctaagccagcgctactcactaagccattggttgaaataaaagtgctctgggagttcgatgagttcaaagtggagttagagaggcgtaatctacacaaacgcctcaccaacctccaagatggaagcatagacgtggttgtggttaaggaattctatgctaatttatacaccacagaggaccaagctccaaagcaagccagagtaagagagcacctgatcaaaatagatgcagacagcctgaatgagtttcttcatattccagtggtattagaggaggaggaatctttacccaccaactctagattttgtaggttgaggtccaatcctcaagagattgaagccaaactctatattccccgcaaggggtttattttgaatgctgagggccaaccatggaaactccttagaaaggatctgactacactggcccagacatgga

SEQ ID NO: 99001 - DNA, 417 bp, Glycine max
  Peptide Sequence Number=SeqID_215779
atggtaaaagaagtgactcaagctgtgggcagaagagaagaagaatttgtagaggttgaagctcaagagaaaagccttgtaaatgagcatgatttaaaagaagaagataaagagaaagtgcaacaatgggagcaatgctcacaagtacacactcaacaagaaaataatctccaagttaacacatttcctcatcaactgattgtcaaagaagaaaggcatgaagaccatgaggttccaatcattctaggacaaccctgtctgtcaactgctagttgtgtattagacatgggtaaaggtaaattggaactaagtgtagagacattggagctaagtgtagatcagaagatctcctttgatttatttgaagcaatgaaacacccagatgatagtgagcatgttttgaagaagaaacgttga

SEQ ID NO: 99002 - DNA, 171 bp, Glycine max
  Peptide Sequence Number=SeqID_215780
gccaagttaatggctagactcaggcgctcaaatgtgaggctgtcagagacaacccctcgggcttggcataaggtggtaatcaaagcaggaaacccaagtttggaagagttagactgggcaatggaagtcatctatcctgagatgagagtgtcgatgttcatgtccatatga

SEQ ID NO: 99003 - DNA, 573 bp, Glycine max
  Peptide Sequence Number=SeqID_215781
atgagacatcatttgaaagcttatgatctctgggaagtagtggagacagctgaaccaccaaccctggaagagaatcccactattgctcatattagatttcataatgagcaagttgcaaaaagagcaaaggctttttccatcttgcactcaactgtggatgatgatatttttatgagaatctcaaatctggatacaacaaaggagatttgggagaagcttcaagtggagttctttggaaatgagaggaccaagaaaatgaaggttctcaaccataagagggagtttgaagccttgaagatgaatgaggctgaaactgaaagtggttgtcttttgaaatcggaagttttttctgtttttaagaagtttaaagtccttgttgaaactgaaagtggttgtcttttgaagaaactcagaaccaataatggtgaggagtatacctctgtagaatttaattcatcttgtgatggtttgggagttgaacttcaactcattgtgaattattcaccccaacagaatggagtggcagagaagaacatattagtccttgagatggctagatgcatgattttttag

SEQ ID NO: 99004 - DNA, 321 bp, Glycine max
  Peptide Sequence Number=SeqID_215782
atggaagctgttattgatgattggctactgagtgagattcattggctctgcaaagaggagaccgttgcccaagggattcagtgggtccaagattgtttaactacttcatttttgcagatcttgtggcctggtggtacatttttcttaagagtacagacccctcaggtgttaattggtagcagtgcatgtgatcaaaagcctttaccaaccataaatgaatttggtggaagcatcattgccaaatcacaatcagggtccttcgagcaacagcttgaggctactcgtagagcaagtgaactgaagaaactgctatttggttag

SEQ ID NO: 99005 - DNA, 609 bp, Glycine max
  Peptide Sequence Number=SeqID_215783
atggacaccatttgcattcttgtagctttgccagctcaaatgagatggataatttggcatttagatgtcaaatctgcattcttaaatggacacttgactaaagaaacttatgtagttcaacctgaagactttgttgtgaaaggaagcgtaaacaaggtgtataatctccatgaagctttgtatgggtttaagcaagctcctaaagcttggtatagcagaattggtgcttacttttgcagtcaaggtttcaggaggagagaaaatgatgcaactctttatgtgaaaaagttgttggatgatggctctagcatgttctcttggaactcaaagaagcaaggcattgtagctcagtccactattgaagcagaatatgttgcagtagctggagcagcaagccaagatatatggttgaagaaaattatgtttgatttgggagtagagcaatttcaagaaactgagatttattgtgacagcaaatcaacaattgtcattgctgagaatccaaatcagcatggaaagacaaagcacattcaagtgaaatttcatgttgttcatgaggctgtcaagaattgtgagatcaagctcattcatcattgttctgataattaa

SEQ ID NO: 99006 - DNA, 456 bp, Glycine max
  Peptide Sequence Number=SeqID_215784
atgcatgctttgttagggtcattcaacagtggaaactggtctgactctaaagtccttgatagtgcagggctgagttgtcatgctttcacgaggaatcagggtgcgataaatagtttatacacttgttcatattcacacttacttttacacactagacgcctatttgctgaaatagcttaccaaataacacaagttccccgagtgttcgatactcagttcttaccattttatactacttgtgcgatctggtgcacttgccagaagccaaacaatggcccacatacagaggctaggattcccatagtggagcatgtgaacattcatgatacaagggagaaaggtaaggtggtggcctcctcaaggaaacaagacctcaagtcttggaagagagcaactagaaatagtaatgggggtggtgatggaaagatgctgataagttgtaacgggcagagatga

SEQ ID NO: 99007 - DNA, 1407 bp, Glycine max
  Peptide Sequence Number=SeqID_215785
atgaatttctttggcagaccatgtaaaaactattactttagaagccattctaaaagtgtaagtacctatggagtcctagagtcattaagcggaatgaatggatccatagcgaagccaataaaatatgtcctttgcactgcacttagttcttgtgcaaaatctctgaattggcatttgggtatacagatccatgcttacatgattcgatctggacatgaagataatttgttccttagcagtgcacttgttgatttctatgcgaaatgttttgctattgtcgatgcaaggaagtgtagtgtctgtgtggggcaaaatggtgcccttgaacattgttcaactcttcatgcttctgtcatcaaacggggatatgatactaacaattttgtagtcagctcattaattgattgttatgcaaattcgggacaaattgatgacgctgcattattatttgatgaaactaatgagaaggatattgttgtatacaattctatgatctctggatattctaaaaatctgtacagtgaagatacattgaaactatttgtagaaatgaggggaaaaaatttgaatcctaccgatcatactttatgtaccattttaaatgcttgcaacagccttgcagtgctctttcaaggaagacaagtgcactctcttgttattaaaatgggttcagaagggaatgtgtttgtggccagtgctttgaatgatatgtattccaagggtggcaatagtgacgaggctcaatgtgtgttagatcagacttctaagaagaataatgtgttgtatcatgggttatgctcaatgtgggtgaggctagagttaattcctgatcatatctgctttactgctgtcttaacagcttgtaatcatgcaggatttcttgacaaaggggtggagtacatcaacaaaatgacaacaaattatggcttgtctcctgatatagatcaatatgcttgcttgcttgatctttatgctggaaacggaaatttaagtaaggctagggatttgatggaagaaatgccttatgatccaaattatgtaatctggagttctttctttagttcttgtaagatttatggagatgtagaacttgggagggaggctgctgatcaacttattaagatgaaaccaggtaacgcagcaccacatttgacactagcacatatctatgcaagaaaaggtttatggaatgaagttgctgaagtcagaaggcttatgcaacaaaggagaataagaaaacctgcaggttggagttgggtagaggtggataagcagattcatgtatttgcagttgatgatgtaactcatcaacaatcaaatgaaatctacagagagttagaatatatttacttgggaatcatagaagcgtcatcttatgtagtagaggatagcaatattctagcatag

SEQ ID NO: 99008 - DNA, 126 bp, Glycine max
  Peptide Sequence Number=SeqID_215786
atgaagttatatggtggcccaggcaagctagagcctagcctaggagagccaagatacatatatttttttcaaggcttagaaacagaggacatcgagtcctacaaagcacaaagacaaggacgttaa

SEQ ID NO: 99009 - DNA, 1131 bp, Glycine max
  Peptide Sequence Number=SeqID_215787
atgtttgattggaatttggatgagattgcgaggtggtttacattatacacacctcaaggcattgggcccactttagaatatagaaattataagacgaaggtgctgccaaagccaccacaatcgcataagcctaagcctgagacataccatagactatatggtgtttctccacaattcccatggagcctaagacacaaccccaagcctaacttcacctgtgcacatactttcaacgaagttcttctattcgcgaatagtcctccaccaaaaccttgggaacaagcaggttcctcttcgggtccagcgcctttcaaacccccgtcagctggcaacacaagtgatgtagttgaggcttcagggactgcaaaacctggggaaattgtttctagttctgataggagtgcagctgtcaacaggaatactcttgggaggcctgttcccacaaggccatgggagcagaattatggaaacagcacctatggaggatatgggtctacaatgaattataattctgggtatggatctggaatgtatggatcttcttatggtggactaggaggaggaatgtatggatcatcttatggtggggggatgtatggtaacagtatgtacaggggaggatatggtggcatgtatgggtcatccgggatgtacgggggtggaatgtataacagtggcttagggggtccaatgggtggttatggcatgggtggtggtccttatggagaacaagaccccaacaatccgtatggtgcccctccatccccacctggattttggatttctgccctacgtgtgatgcaaggtgtggttaacttttttggtcgaatatcaatactcatagaccagaacacacaggctttccatttgttcatgactgcacttctccagctgtttgaccgctctggaatgttgtatggagagctagctagatttgtgttgcggttgcttgggattaaaacaaagtccaagaaggttcacccgccaggtccaaatggacaaccgttgcctggacctggacctggacctggaccacacaatccttccggaaatgtaaactacatcgaggcaccaaaggctgctcctagtggttcttgggacaacgtttggggaaatgacgcaaatcaatga

SEQ ID NO: 99010 - DNA, 123 bp, Glycine max
  Peptide Sequence Number=SeqID_215788
atggctaaggtgtgtgaatttccaccaccgggaaacgcattagacgacaacatgctaaatgtatcttccgatcgttattggactgagcaaccgtcttggcccatgttatcgaaatccaactga

SEQ ID NO: 99011 - DNA, 1470 bp, Glycine max
  Peptide Sequence Number=SeqID_215789
atggagttgtggaaaagctggggcagtaaatttgcggaaagtgagttccatcgtgcgcgacattggggatccctgcctttcgcagtcgcctgtaaagtattcttcatggagcaggtaaacagaatgcttaagccagacaaatggcaagccatgtccgatagtgaaggaaaggtgtttggtttccggaaggcactaaaattgattgtattagggggtgtagatccatcaataagacctgaagtttgggagtttttactaggttgttattcgttgagcagcactgctgagtatcgaagaaggttgagagcagctagaagtgtcggaactggttcgttggcatatgttgttggatccaaattaatggatctgaggacttcatccaaagatggacggaaatcgcaagctaaaatagaagaatcaacttataatgataataatgttgaagtaggaaaatgttatgataggaacattatttgtacagaaggagaaaattcaagccattgggaaagctccaataatggggttgacctagttagcttgagagtatgcactgataatgcagcatgcgattcttctggtcaacgaaactccagttccccaaagttagggggagaagtagaggaatcagactgtgtaactgaatgtagttttgattttcctcctttatcggtcactaatctgtttgagaagagtggtaaagataaaaattcaggcacagagcatggggataaacttcctgctccaggccaatcaagatttgaagttgacagtatgcgtagctttcgaattaataacaatgtagatttagttattgaatcgaattgccaacaacctcttgctaccttacatcccatggactctgaaattggaattgcttcacctgatgaggaagaaccagaacttctgtctgagaatcaagtttatgaagcacagatggtaactcaactgaaaatatcagatgtaccacagccagcaatgataagatccccaatttctcaaggatggcctatcagtgaagagagagtatcagaatggctttggaccttgcataggatagttgttgatgttgtgaggactgatagtcatcttgaattctacgaggacacgagaaatttagctaggatgtcagatattcttgctgtctatgcatgggttgatccttcaacagggtattgccaaggtatgagtgatttgctgtctccctttgttgtaatctttgaggataatgcagatgcattttggtgttttgagatgcttttaaggagaatgagagaaaattttcaaatggaaggcccaactagagtgatgaagcagttgcgagccttatggcatattcttgaactgttagacaaagaaatgtttgcccacctgtcaaaaattggagctgaaagccttcattttgcatttcgtatgttgctagttctctttcgaagagagttgtctttcaatgaggctctttcaatgtgggag

SEQ ID NO: 99012 - DNA, 3294 bp, Glycine max
  Peptide Sequence Number=SeqID_215790
atggaataccctttttccccaaaggatagagtaattggggattggcaatcttctggagctcagttggagggatcagcatcattagatggcagaatgatcaattcaatatcagaggatatgcccaatagcttttctgagctcatgaactttgatacttatgctgggttgtgctacagcccatccataacggatcagattttggctaatgagcttccatcatttgccccattatcatatccattgcctgatgggttcaatccagtccaactgaacagtgggcaatgctgtatgtcaggagttggcagaaataacaatgataccgaaaactcttccctttatggtgagaaagttgtttgtcagcaaatggacaccctacttggtttcttaaacgacacaaacgaagcaaacaacttgaattctaagctaaaaattaatgtttcttctcaacatcttaataactctgatacaggcaattatatgatgtctaggccacctggcctgtcacttgatgagagaatgctgagggctttgtccttctttaaggaatcagctggtggaggaatattggcacaagtttgggtacccataaaggatggtgaccaattcatcttaagcacgagtgagcaaccttatttgctagatcaaatgcttgcagggtatcgtgaagtgtccaggacatttacattttctgcagaaggaaaatctggttgttccctaggacttcctggtcgtgtgtttacctccaaagtccctgagtggacttcaaatgttggttattacagtatgagcgagtacttaaggttcgagcatgcaattaatcacaaggtttgtggatcaattgcatttcccatatttgatctgcattctgaactgccatgctgtgctgtactggaacttgtcaccacaaatgaaaagccagattttgacagagaattggaaattgtttgtcgtgcactacaggcatgtttttatttttccagtgttacttccctttctgcactttttgcctgtcttactacatctcatgttgagtctgatgacttggatgtcttaataaaaaattatcatgaagaattttctactttggccgataaagtatcttatgtgttcattggtcaatacttggtgggattattgccaaaaacaaaagaagccttatcctaccagcttgagatgccattgagctcagttaaagaccaaattctcaaggatattattcaccatgagatccatcttaacaatttattccaatgtgcttctgatgttgaaggtagtaatgataaatgtatttatcatggttttctgcagcttgtaaatttaaggactgccaagcctctccgatgtcttccccagtgtctttcaaacaacaaaaaggctactttgactgagatagttgatgtgttacgatctgtctgtcatgcacataggttaccgctgggactgacatggattccctgttgtttcactgagtgctcaagaggtgaagcttcaagcatacgaattgaaggtggtcattcaacttctagaggtaaaaacatactgtgccttgaagaatctgcttgctatattactgatagagcaatgggaggatttgtccgtgcatgcatggaacatcgtcttgaggaagggaaaggtatagctgggaaagctcttcaatcaaatcatcctttcttctatcctgatgtgaagacatatgatattagtgaatacccacttgtccatcatgcacgcaagtataatttgaatgctgcagttgcaattaggctaaggagtacttatactaatgatgatgattacatattggaattctttctgcctgtcaatatgaaaggtagttcagagcagcaacttttattagacaacctctcaggtaccatgcagagaatttgtagtagtttgaggacagtttcagaaaccgaattatcaggaatggaaagcttagcagtggggcttggaaagaaaaatgcccccagtttttttcctttatcaagtagaaactctgaaataccattaataaatggtgactgcgattctgtccagaaggcaactaacctaagggacaatgaaattgagtcttctcctaaccaggaaagaaatggatcaaaaagacaggtccagaaaaatagaagtacatcagagaagaatgttagcttgagtgtcctccaacaatacttttctggtagtctgaaggatgccgcaaaaaacattggtgtttgcccaacgactctgaaaaggatatgcagacaacatggaattccaaggtggccatcccgcaagattaataaagtgaatcgatcattgaagaagatacagacggtgcttgactctgtccagggcgtagaaggagggttgaaggtgcttgactctgtccagggcgtagaaggagtgttgaagtttgatccatctatgggggcatttgtggcaggagggtcaatcatccaggaaattgatgcacataaaagtactataaaagaccctgtgcctgttgcacaagatgcattctcagtacgaccagcaccttgtagtgaaggtgagaatttttcaattaagttggagggaaaattgaagaaaaccaatgtttcttcagttaattacagtgaagattcaaaatcaatggcaatcaatgatgggtcgtgccagacggcaagcctttgcaccaaggtgcaggattgtcctgaacaagcttgtttgggttctgttcttgcaaaagaacatgataaacgaattctgaacaagggcggtttgagtgtagaaaaatttaaacgcaatattgttggccagagttcaaaaactttgattggtgatgagatggacattggtgtagatggggatgatggagttgttgaacgtaaccaccctacttcctcaagcttgatagactcatctaatggctctggttcaatgatgcatagcagttcatcaggttctcagagctttaagaaccaggatcagtccaaagtcaaatcaaccattgttgatagtaggtcgaaactaattgtcaaagctacctatagagaagacaccattcgtttcaagtttgatccatgtgcaggttgtttcagtctatatgaagaagttgcggcaagattcaaactacaaaatgggttattccagctcaaatatctagatgatgaagaggaatgggtgatgttggtgaataatgctgatttgcaagagtgtatagaaatattggatgatattggcacacgtagcgtcaggtttcttgttcgtgatatgccttccgttttaggcagttctggcagtagcaatagctacttgggaggcagctcatag

SEQ ID NO: 99013 - DNA, 456 bp, Glycine max
  Peptide Sequence Number=SeqID_215791
atgactttggtagacttggttcccaggatgactccaagcgcgagattgcagctgcttttgcccatttcacacatgaaactggacgactactgcgacgagaatacgatttcacagtatccgtgcctttctaacagaggctactatgggcgtggtccgattcaactaacatggaacttcaactatggacctgctggacagagcaacgattttgatggattgaacgctcctgaaacagtgggcaatgatcctgtgatttctttcaagacagcactgtggtactggatgcaacacgtgcgccctgtcatcaaccaaggctttggtgcaaccatcagagccattaacggtcaacttgaatgtgatggtgccaacccttccacagttcaggctcgcgttaattactacactgactactgtagacaattcggtgttgccaccggtgataatcttacttgctaa

SEQ ID NO: 99014 - DNA, 648 bp, Glycine max
  Peptide Sequence Number=SeqID_215792
atgggtaactgtctgcgcacgtcggaaaagctgacggcggagatcgttccccacggcggcgccaccgtgtaccccgccgtgcgcctccacggctcccccaacagcattttcgccgcatacactcgcttcgcggtccttcacaacgccgttcccccggaccctgtcctcgccgccgcaccaccaccgcaggccccaacagcattttgtggcggaagatctgaggcggcggttcccgtggttttccacgtgggacacgacgtcgcgtcggggtcccgcgacgcgctgctccggtttatagacttgaaattccccgacctggcggaggaggagacggcgccacctcctccggcggagagcggcggagggaaggaggaaacgtcgttggttgtgagggtgacgcggctgcagcataagagcatgacttggcacttggagaggatggtggggtgggcggaggatctagcgacacgtggcggaacgagggccgttgatccaaaggtggggacttggaagatggaggttgtgaaatttgggagaagttactctcagttgttggaggtgatgttggaacatgcacaaatggaagagagagttctatttcctatctttgatagtgctgatcgagcaagtctagcacccagatgctaa

SEQ ID NO: 99015 - DNA, 534 bp, Glycine max
  Peptide Sequence Number=SeqID_215793
atggaaaacaaaggtaatgatgacgatgaaaatggtgatgggtgtccgtgtccggtgaagctgagtgattgtttagaggaacttgtgaggttgactctcaactctcactcgcaccatctcaatctttcttcccagtttttctccaacttctcaaggatgacccaacgcactcatcatcttcacactcacaatcacaaccaaacgttgaaaaggttgttttttatctgggtatcttcaaattctttggaaggagtgccaccgtatcccttatacaagcgcattgcttcagctctgttgaggtgcatggaatctgaaacattttgtaggataggcggcaatttagccatgaccaatgaatttgaagattcttccattcagcagaagcgtaatgagtggcacaaattgattgtagagaaggggtttgaaatagagaatgtaaatgcagtgttaagtgtcgcatttctttgctatgctcttgttcatctaccgcagaagctggttttaataagtgtacttttgtttcaacagatttga

SEQ ID NO: 99016 - DNA, 225 bp, Glycine max
  Peptide Sequence Number=SeqID_215794
atggcatattgttgttggctgaatgtgcatactgtcccaccacatggagttgtctttgaaataagggttgctggtggatatggtgcacgttggacagaagatggaagtaagagccctacatgcaagatggtcactcaaagggatggaagcactagttctgctggccaggccacaacaactgcacctttgtacttgaatgtcacacgttttcctttcatcttgtga

SEQ ID NO: 99017 - DNA, 1623 bp, Glycine max
  Peptide Sequence Number=SeqID_215795
atgaagagcagatctgatactgattatcaaaataatgtgtcagaagccattatacaaccggataatactattagagtggaccctttagatcatttccaaaaatacagaggaggatttaacatcacaaacaagcattattggagtgtaaatctctattgtcccttttcgtttctaaattctgcgatcttcactggagtatatggatatgcaattggggtgctctgcattttgtgtggaatcgtgtgtggaacttttttggcaatatccacggcttgtcacaaaaatgacggaggaagaaggatgaagaaggcaagagttaaaatagtcttccaaattgaaaacggaatggtcatagatttatcacaacttggacacggtggacatagatacaaagaaaggcatgagctgtgtaatattagtaccatagacaagtttagttttgaaagtaacagtgaaagtgaccagtacatttacttgatagctgcaactgggctagttcttgctgggagtgcaaggttccattctgaagcaaaaaattcagttaatattataatcaagacagcgaatgaggcatcagaaacgatacacaacacaacaggagtgttaaaagacatggaaagtaacttcatggaagccaatgtcaaagctgatgcttctgtaaatcttgactctacaactgagagacttgatgatgcatctgcaaacattgaaaaacaagctaggaagaataggcgtcttatttacaagagcttgaaactagtgtttataattaccacggtgattataagcttgaacttggctgctgtaatagctttgtcagtttctggagtactgaggttaaggcgggcactatacctgcttgttgtattatgctggctgatgacagtgatatgctggctattctttggagcctatttcttcttggaaaaattttctggtgatgtatgcacagctcttgacagctttcaagaaaatccctataacaacagcctaagctcaatcctcccttgtgatgaattgctctcggcaaagtcagttctatctgatgtcagtgctggaatctacgtccttgttaataaggtgaatgcaaacatatcagccatgcaggcaacatcagctgtgaatcttgttcaagtttgcaaccccttctcagccccacccaagtattcataccagccagaaaactgccctgctaacactatacgaataggagatatcccaaaggttttgaagcctttttcttgtctaaatgtgactgatggaacctgtgacaatggagatttaatacccggcagtgaatacatgagagttgaggcttacacaagttcaattcaagacctactgaacgtgtatccgagtatggaagccttgttgaaatgccaagtggtgaaagatgcattctctcaagtccttgttaaccactgcaagcctttgaagaaatatgctaagatggtatggctaggattgctgtttcttgcagtgatcatggtgttgttggttgtgctatggactataaaagctagtcatgagcaccgttatcatctttcagatggttctgtggagcctcatagtgcaccaaccaaagccttggaatcgggaccaattaaagagattgagatttga

SEQ ID NO: 99018 - DNA, 318 bp, Glycine max
  Peptide Sequence Number=SeqID_215796
atgtcaccaaggagatgtgctactcatgctaacttggagaacataattcaatggatcgagatcacacggttgcaattgaaggtggcccacttgacacaacaattgggtgctcttcaaccacaaccactacaccatgatgacgacaatcatctagtcatggatgataatgattttgacattgacaaatatccctttgacgttctccctcaatcagattgttattgggaagtcgaatttgaggttgatatttcgggctttgatatcaacattgaacctatttacaacattgatgttgaggttgatgatgttaataaataa

SEQ ID NO: 99019 - DNA, 249 bp, Glycine max
  Peptide Sequence Number=SeqID_215797
atggctttgcagctcatacagcataatgacaatgcatttcatcctcatgctcttctcattaggaagattcaatcctataagaattggcaatgggaggttcagttatcaccactagtttttgtagatgctatagtttctggccactgccctgttatagaaagcgatatttcttcatgtggtggcacgacgaaaatctctaaaaaaggagggaaactagaagaagctttgatcgaaggtgaagtagggtga

SEQ ID NO: 99020 - DNA, 1254 bp, Glycine max
  Peptide Sequence Number=SeqID_215798
atgggagggcaatccagcaagatgtttagtgttgaatccccaacaccaattaaaatgggtactcattctctgtatgctgctgacttgagctcctatgaagctgcatgtgttaaagatccaaacttgcaatcctttgatgtgagcattcaggagcataccaatagggtgattagttccctagctcatggggttgaggttagatccttatcttttgattcactgagagaaatgactgatagtcttcttgagatgaaccaggaagtagtcaaagttattttggattgcaagaaagatatatggggcaactcagaattgttctccttggtgaatgattactttaataatagcctccaaacattggagttctgtaactcacttgagaaatgcttgaggagggcacgcgaaaaccagatgatagtcaagtcagtggttacctactttgaggaagaggggcaaaatggggctgacggggtgacttatgtgaagacattgcaagagcttaagaagtttaaggatgccagggacccctttactgaagagttttatttgttgtttcaatcagtttacgcgcagcaggcatcaatgttgcagaaattgcaaatcaggaagagaaagctcgataagaaattgaaatccctcaagacatggaagagagtgtcaaatgtcatttttgtggctgcttttgtttctgtgttgattttctcagttgtggcggcttctgttgcggcgccaccggttgtgacagccttggctgctgcattggctgttcctatagggtcagtaggaaaatggtgcaactctctcttcaagcgctatgagaaagctctaaagggacagcgggaagtgatcagctcaatgcagattggtactttcatttcattgaaggacttagacaacattcgagtgcttgtcaacaaattggagggagttctagaatcattattgcagaatgctgattttgccattaaaaatgaggatgttatgaagtttgcaatcgacgagattaagaaaaaaatagaagcattttcagagactatggagaatttaagtactcatgcggataaatgctgtcgacagataaggagagcaaggactgtggtggatttggtcgttgtaatggtgtttggctcgttaatggtggattttgtgatggcggagggtggagacattgcgacaactcatagttctagtggtgccatggtggtgcgtggtgcagagctggtggcttggggtgtgcggttgaggcttaatgag

SEQ ID NO: 99021 - DNA, 627 bp, Glycine max
  Peptide Sequence Number=SeqID_215799
atgaaggagtttccttcttgttttggagaaaatggtgttcaggtagtagattcctcctattcaagcaccacaaggggagctcaaaatgctgttacttgtgtatatcagtgtaagttaggaggccgttcatgcttgatcactgtctcttggaccaaaaatttgatgggacaaggcttgagtgtgggaatagatgagttgggcaatcattgcctctgcaaggttgacataaagccgtggctgttctcaaaaaggaaagggtcaaagaatttggaggttgagtctaataaaattgatatactttgggacttgagctgtgctaaatttggctccgggccagaaccgttggagggtttttacttagttgttgtgttcaatcaagagatggtcttactcctaggggatctgacaaaggaggcatgcaagaagattgacagtgactatgcttgtgctcactctgaagccgtttttattgcaaagagagagcacatttttggcaagaagttttatggtgcaaaggctcagttttatgacaaaggccaggtgcatgatgtgagaattgagtgtgacacactagggcttaatgatccatgtcttgtgattagaattgataggaagacagtgatgcag

SEQ ID NO: 99022 - DNA, 4562 bp, Glycine max
  Peptide Sequence Number=SeqID_215800
aaaacgccgacgatatcaagaagttgtacgatgaagttcagatccagtttgagcgttttggtgctgtgacggatgctcgatttcaaaccatggaggatctgcaatcgtccactgatgggaaactggataaaatcaacgaagctcttttgatgttattacgcaactcctctcagacctcttcccatggtgttacgaactcaaacaaagctccgtttcaggtaagaaatgtcaagctcgatttcccccgttttgatggcaaaaatgtaatggaatggatttttagagctgagcaatttttcgattattatgaaacccctgataaggatcgattgactatcacatctgttcatcttgatcaagatgtggtaccttggtttcaaatgatacagagaacacatccttttaattcctgggctgagttcactcgtgccttagaattggattttggaccttcaatctatgattgtcctagagctaccttgtttaagcttagccaaactgggactgtgagtgattattatcggcaatttactgctttagcaaacagggtctatggattaagcactgatgctcttgttgattgttttataagtggcttaaaccccgatattaggagagatgtgatggttcacactcctattaacattgtgaaagctgtgtccctagcaaaagtttatgaagaaaaatacacttccaacaccaaaccacaaaaataccaaaacccaaacactcaataccaaaatagagctcacttcaattcaaataaaccagaaatcaaccaaaaaccaaccaatactcccttattaccaacaccccctaccagacccatggacattaaccaaaagaatccaaatatcaaaagaatcacccctgcagagatgcaattaaggaaggacaaaggactgtgttattggtgcgatgagaaattctcatttagccacaagtgtcctaacaaacacttgatgttgttgcaatctgaccatgaaccagaaaatgcagcagaagaggaaacagaaccaccagaccaaccacaaaacatcataaaccaaactcacacagaacatcacctatccttgaatgcaatgaaaggagccaacagtctagggacaatgcgtttcatggggaaaattggcaaactccaagtacaaatacttattgatggagggagctctgataattttgtacaaccaagaattgcgcattttctgaaattaccagtggaaccagcaccctgctttaaggtgttagtgggaaatggacagactatgacagcagagggggtagtgacacaactccctatagtcattcaagagcatgaaatgttgattcctgtgtaccttttacctgtagctggtgcagacttaatattggggacagcttggttggctactttagggcctcatgtggcagactattcagctttaactttgaaatttttccacaaaggaaaattcattacattacagggtgacacaagcatgggaccaggtcaggcacaattacatcagctgaaaaggatgtgtaacactagaagtattgatgaagtgttcactgtagagagagtacaagctgatgcagtcaatgacgtatgggatgagataccagctaacatgtcacctgaggtggctgtgatattatatacttacagaggtattttcaagacaccagaaggactaccaccccaaagacctcaaaaccatgctattcctttgaaagagggctccaatccggtcaaagttaaaccttataggtatccccacagtcaaaaggagcaaattgaaaagatggtgaaagagatgctagatcaaggaatcattcagcccagtaatagccctttttcatctcccattgtgttagtgaaaaagaaagatggaagttggaggttttgcacagactatagagctttaaatgccattacagttaaggatagtttccctatgcctactgtagatgagttgttagatgaactttgtggtgcaaagtatttttcgaagctggatttgaggtccggttaccaccaaatcttgattcaaccggaggatagacacaagactgcttttagaacccaccatggtcattatgaatggctagttatgccatttgggttaacaaacgcgccagcaaccttccaatgtctcatgaatcaaatttttcaacatgctctgaggaagtatgtattggtattttttgatgacatccttgtgtatagtaccacttggaaggaccacctcacacatttggaagcagttttacaggagatagagtatctgggacatgtggtgtcagggaaaggggtagcaatggaggcaacaaagattgaagcagttctcaagtggccaacacctcctaacctgaaacagttgagagggtttttaggattgaccggctactatagacgattcattaaatcgtatgccaaaatagcagctcctttaacagacttgttaaggaaagattcattttgctggaatgaaacaacacaagaagcttttcaagggctgcaacaagccatcacatctgcacctgtattagctctgccgaatttccaacaaacttttatccttgaaactgacgcttcaggaattggagtgggggcagttctgcaccaaaatggccacccgatagcatttttctcaaagaagctggcaccacgaaaccagaagaaatcagcttactttagagaaatgctcgctatagctgaagccatcgcaaagttcaggcactacttattggggagtaagtttatcatcaggactgatcagaagagcttgagaagcttgatggatcaaagcctacaaacacctgaacaacaagaatggctacacaagtttctgggttacgattttgtcattgagtataatccaggaaaggagaacatagctgccgattccttgtccagaatgttcatgatatcgtggtctgaaccaaagacacgatttatgcaacaattactagatgaagtgaagagtaatgataaaatgcaggagctcataactcaatgcaaagatcacccccagctgaagcctcactacacgaccaaagagggactgctttattggaaaggcaggttggttataccagacgcttctaacttgattcaaatgattttgaaggagaatcacagctctcctattgggggacattcaggaaattctagaaccatggctagaattgcttatcaatatttttggcacaatatgaagaaagacatcgaacagtttgtgcaaaattgtgctatatgtcagcaagcaaaatcttctcatagtttaccagctgggttgctccaaccattgcccatcccatctcaggtatgggaagatgtagctatggatttcattactgggctacctccctcttttggctacactacaataatggtggtaattgatagattgacaaaatttgctcactttgttccacttaaaagtgattacagcagtaaaacagttgcagaggctttcatgaattatatagtgaagttgcatggaattccaaagtctatagtttcagacagagacaaggtattcactagcgatttctggaaaagattatttgagatacagggtacaacattggccatgagttctgcatatcacccacagtcagatggacaatctgaaattctcaacaagtgtttagagatgtttttgagatgtttcacttttgagaatcctaaggcttggtataaagctgtaacttgggctgaatactggtacaatacagctcaccatacaagcattggcatgacaccctttaaagcactctatgggagggaccctccagctttaactcgctataggcctcaaccaaatgaccctattacggtgcaagagcagctggtagaaagagacagaactctacaacagctcaaaagtaacttggaaagagcacaagtttatatgaaaaatcaagctgacaagaaaaggagagatcttgagctgcaggttggagattgggtgctggtacgattacaaccttataggcagcaatctgttgctttgagaaagaataaaaaattgggtatgagattttttggacctttcatgataatagctaaggtaggtgttgtagcctacaagctccaattaccagaagaagcaaagattcactcagttttccatgtgtcacaattgaagcctttcaaaggagggaccactgaacaatacatgccacttcccttgacaatgactgatattgggcctattgtactacctgctaaggtactagctgcacgtgtgattcaacaaggagagttgaagattccacaggttcttatccaatggacaaacatgccaccagatgaatccacatgggaagggttggaagatatgaaagccaattatcctagcttcaaccttgaggacaaggttgtcttaaatggggatggtattgtaataagacaaattaaggagaaggaaatagatgttgctgagtcatcaattcaagtgtgtaagggcccacatggaatgcaagaggataattctgttatgcatgatccggaattacagggaatgcgcaaaagcaccagagcacgcaaggccaacaaccaattgaaggatttc

SEQ ID NO: 99023 - DNA, 168 bp, Glycine max
  Peptide Sequence Number=SeqID_215801
atggagttatatcaactccaaatggagatgggaggagatcttcatgaccacatcaacaagttcaataagctattgtggtggagtatgagcaaggaaggaatcattcaaggagacatgatgggccaagaggaagatcaaaaccacaatcgcatccacaatgagatatga

SEQ ID NO: 99024 - DNA, 294 bp, Glycine max
  Peptide Sequence Number=SeqID_215802
atggcatgtcattatttattatttaattcatctttaaaatccacatcgtcctcaccgccacaagcaccagcaccatcctcatcgcctctcgatgtcaccgcacaccatcgcattcagcggcacttcgggaccccagtttgccttctaatactcctcatcctcaacccctatcttagttcgccttctaagcctccaaaatcgaaatcacaatctcccaatgttgttattggaagaacacgggaactgaatcaaacactcgaaagggtcttgtcgaaggactcgagcaccgcttaa

SEQ ID NO: 99025 - DNA, 228 bp, Glycine max
  Peptide Sequence Number=SeqID_215803
atgacacgaagttttccttctccgtttgatgctttgaaacgtgtgaacgtccatttgcagcatttcacgactttgaagaacaatgaagatgggaacttggacgatgttgaagaagaaggaattggtggagcggaaacaggaacagaacgattcccaaaatgttgcaggcaaaacgatgtcgtagataacaaaaaaccgcaatgccaagaacaacatgcgcagagctaa

SEQ ID NO: 99026 - DNA, 741 bp, Glycine max
  Peptide Sequence Number=SeqID_215804
atgacaccccttcaccctccaccttctagaacgcccccttgtccccaaccaagacctttttctatttacctctacgaaaccaactgccatatctttgttgaggtcgatgccatttttgccattgaccttgtgtgcgacatctatggaagtgcaccctcgttgtgttcaaccttggcaccagttctcccattggcaaattgcaccaccagtttggtcaactctcagtgccccaactcctccgaccggtttggcagcaagtacgtcctagaaaccctaatccacgccctcactgaactcgaatctgtgttccactcccttgcctccgatgaacacttcaagcttgcgaagactctacgggagtacgtaggtcgcaagagcctgctttgctttgcgaagaggctcatgcgccgctatgcgtgcaagagtggaggagggctcgagaggttggggaagagaagggtcattgcagagaccggtgtggggcagcatggggttgccactgccactgtgtgtgagaggtttgggttggagtgtgtcatgtatgtgggggctaggaacatggaaaaacatgctcttaatgtgttcaagatgaggcttttaggcgctaaggtgctgtcattgtcaagccacataggtgcatttgtgatagcacggtcggggtggcggaagttgttgatccacatctggcagcagagggagacaccgttgtctttggagggggtgatagaagagaagcggtga

SEQ ID NO: 99027 - DNA, 234 bp, Glycine max
  Peptide Sequence Number=SeqID_215805
atggtgaatttgactgtcattgtttctccgaagcaaattcacgagattaaggacttcctcctcactgctaggaggaaggatgcacgctctgtgaaaatcaagcggagcaaggatgtggtgaagttcaaggtccgttgctccaagtacctttacaccctctgtgtgtttgattctgagaaggctgataagttgaagcaatcacttcctccaggtttaagcgtgcaggatgtgtga

SEQ ID NO: 99028 - DNA, 186 bp, Glycine max
  Peptide Sequence Number=SeqID_215806
atggcggtacgtggtgaaggaggttgtgttggaggcagggtgtctagtgctacggctctggctcaggcacaacgggaccctgggaaggtgtttgaacacggcaagtgcaccgaatcatgcaagtattataaaacagtatgtaaactaactattaaaaaggaaaatcacgtgagtaatgatgtgtaa

SEQ ID NO: 99029 - DNA, 264 bp, Glycine max
  Peptide Sequence Number=SeqID_215807
atgaatttcaaaatttcaaggttaggccaaataagtcttacctcttcaaattggaatagctacacagaaccaggcagtggccaacacagaaacattgcaatggactcatcataccaatgttattatcaatggcaaatggcggaaggccaagaacatgctgttgcggcctacaatgccaccaaagtcaaggccatgccatgccactccgttgtgacacttggcaaaaactcagccatgccactccgccatggcacttccatttaa

SEQ ID NO: 99030 - DNA, 336 bp, Glycine max
  Peptide Sequence Number=SeqID_215808
atggcaaatcctactagagttttaaatgctcctaacttgctcggtagacaatctcttcaggaatatctcatgacacttgggaacttattaagtgaggcttgtactaataacaattggaaatgctttcctgtgttatcacttttttatacttcaatggaacatttgttttgtgcatactttatggagtatgcgacgcaggcaagtagtgatactcctatggagtttactagacctgtttctatgttagtggggcattcatatatcctgattgagattgatttcattcatagtgttcatgccgtggaagctaacacttgttactttacctttaattaa

SEQ ID NO: 99031 - DNA, 354 bp, Glycine max
  Peptide Sequence Number=SeqID_215809
atggaccccccactgacgaccccaaaggctttcatccagcaggttgcttggccaggagtccagccctctattgatgggggtggggggcaggtgtcagttcaagtagtggagtatgaatcacaacaaagagagaaaatgttaggctatctgaaagaaatcatggtacgggttttaagagagcataagggttttagttatgtgatgcccctaatttgggggaggggtaaagtaaagattttcttagaaaggccacattacaagccaataaaggtccttagtgatccaccaagtgtaagcaagatagctttaactgagataaagtgcaaaattgggaacattaattgcatgtcgtag

SEQ ID NO: 99032 - DNA, 378 bp, Glycine max
  Peptide Sequence Number=SeqID_215810
atgaaaatgataaggggagcagtaaaacagcactacaagccagttgaaggtcatgcactggaaggtccaattatgaaggaggaaaagagggtaacaaacaagccagtgggcaaaattaacattctggagcaacccaaagaggccaaaattaaggcatccaaagtggctccaattaaaggcaacccaaagaggccgccattaaggcagccaaagaggctgcaattaaggcaagccaagaatgaccacaattacgatggctttccaaaacacccctcatgcccaatgccatataggcttggaatgtggcaatgcaagttgcccaataatggttctaaggaagcctctgataacaacttaaaatttgggattagggcttaa

SEQ ID NO: 99033 - DNA, 3276 bp, Glycine max
  Peptide Sequence Number=SeqID_215811
atggaggtgagaagcatgtgggaagctctgcaagtccacgggcaagtagtgaaattagggatggggcacaaggatgcgtcgcgtaagttgtctaaggtcttcaccttcgccgctctctccccctttggcgacctcaactacgctcgtcttcttctctccaccaatcccactctcaactcttactactacaacaccctccttcgcgccttctcccaaacccccctccccacccctcccttccacgccctctcccttttcctctccatgccctccccacccgataacttcactttccctttcctcctcaaatgctgctctcgttccaaactccctcctcttggtaaacagctccacgctctcctcaccaaactcggcttcgccccggatctttatatccagaacgtcctccttcatatgtactccgagttcggcgacttgctcctggctcgctccctgtttgatagaatgcctcacagagacgttgtttcctggacctccatgattggcggccttgttaatcatgacttacccgttgaggccatcaatttgtttgagagaatgctgcaatgtggtgtagaggtgaatgaggccacggttatttctgttttgagagcctgtgctgattctggagccttgagtatggggaggaaggtccatgctaatttagaggaatggggaattgaaattcactctaagtccaacgtttccactgctcttgttgatatgtatgccaagggtgggtgcatagcgagtgcgaggaaggtgtttgatgatgttgtccacagagatgttttcgtttggactgcaatgatttctggcctcgccagccacgggctttgcaaggatgccattgacatgtttgttgacatggaaagttctggggtaaaacccgatgagaggacagtgaccgcggttttaacagcgtgcaggaatgcaggcttgattcgcgaaggtttcatgttgttcagtgatgtgcaaaggcgttatgggatgaaaccttcaattcagcattttggctgtttagtggaccttcttgctagagcagggcgtttgaaggaagctgaagattttgttaatgcaatgcccattgaacctgatacagtcctttggaggaccctcatatgggcctgtaaagttcatggcgatgctgacagggccgagcggttgatgaagcaccttgagatacaagacatgagggctgatgatagtggaagttacatacttgctagcaatgtttatgcatccacgggaaagtggtgtaacaaggcagaagtgagggagttgatgaataagaagggactagtgaagccgccaggaactagtaggattgaggttgatggtggtgtgcatgagtttgtgatgggagattacaatcaccctgaggcggaggaaatatttgtcgaattggctgaggtggtggataagataagaaaagaagggtatgatcccagagtttcagaggtcttgcttgagatggatgatgaggaaaaggccgttcagttgcttcaccatagtgagaagctggctcttgcttatggactaatcagaataggtcatgggtctacaatccggattgtgaaaaacctaaggattattggtagcttcagaattgtccttgtgaagaatgcccactgtactgtcacattgacaaatgcagatgccaaagaatgttccacagcatcaaacgatccaaatagtcaagttaggaaggtcattgataatgagtttccagcaggtgataaaccttttgtgtgggccttcaaccttcaactcccaaccaaggataactatagtgccatcgcatattttacaaccaaagagacagtccttgaggatttgctaatggacaagttcttgaagggtggcaatgcattcagaaactcgagacttaagctgattgccaacattgtaaaaggggagaatttcatagaagtagatattgatatagggtcttccatggttgcaagtgcaatagttcatttggcatttggttacatttcaacattgactgttgacttggcttttcttattgagagccaagctgaatcagagcttccagaaaaaatatttggtgctttcagattttctgaactcgatcctgcttcagctagaacaattgagccatcagatgttgtgagttgtgacaatgcacaaacatctttacctactagattgtggaagtcaattggacagggcttttcccatattcttcattcaggtcctcaagaagatggctctacttctggttcagaacatactaacgatgtagatcacaaagataatccaattgacatcacgaactgttcttttctaatgagacactccaaagtacgtcccaatgcaccttctgatgatcaatcaccccaactaacgtacaatccgcaacttgatcatggagggtggtctaggcgtggtcgtgaattttgtgaggcaagaagagcgtttctgaatagttaccatttgagtttggaaagaaaaaacaatggtagcttcaaggaaaagttgaagaagtcagtgaaagaggttaatcaagtcgcaatgggagttgttttgggcatgcgtcgtggggtctccaagagaagggttggcatcaagagaagagttaacatgaaaattcagtgtgatgtgtgtgagagagctccggcaacagtgatttgttgtgcggatgaggcagctttgtgtgccaaatgtgacgttgaagttcatgctgcaaacaagcttgcaagcaagcaccaaaggcttcttcttcaatgtctatcaagcaagcttccaagatgtgacatttgccaagattgtgatgaaccaattcattcagccggaagcctttctgcgaaccaccagcgcttccttgctactggtatccgagtggcatcgagttctaattgcaccaaggacaatgaaaaaagtcacttggagcctcctactaggaatgcacaacaagtttctgcgaaaattcctcctcagcaagtgcctagcttcacttcctcttgggctgttgatgacttattggaactaacagcctttgaatcacctgagaaaaaggaatctctgcagtttggagagctggaatggcttacagatgtgggtatttttggtgaacaatttgctcaggaagccttggctgcagctgaagtacctcagcttccagtaactcataacagtagcagtgttgcttcatacagaacttccaaatcctacatgtcccacaaaaagcctaggattgaagtcctaaatgatgatgatgatgagtattttactgtgcctgatcttggctaa

SEQ ID NO: 99034 - DNA, 1887 bp, Glycine max
  Peptide Sequence Number=SeqID_215812
atgaaatggataatctttttctccttctcaactaaccttatatctgttatggaagtcatgttaacttactaccttagtcttcaagaaccgacttgcaacatcgggagttgcttaccaacatttgttgatctatgctcatcctcactcctcagtaatcattgtgactggtggcaaactccattatcagggcgattaaaatgcaacatagatgccgcattgttcaaggatcaaaactattttgaaccagttgaagtggaagaatgtggcttactacaacatgccttaacatgcataaaggatcagaatcttaacaatgttgattttgagatagatgctaaaaccatagtgaatgatatttacaacacctcaactggatgctcagactttcaattcttaataagaatagattatgatcctaagaaatttggaacattcaaacactttatccaacccattaagtttaactcccctgatactggaagcttcggtttctctccattttctcttagggttttcactttcacccatttctcttctctttcgatctgcgcccaaagtagtggattagctcttttaggattaaggagtgtttctatcttcatggataaagacaaatctctaggtttgccacctccgtctggacgttattccggttactcgcccaccagaagtgttttcaatgtgaaatctgagccgtcgccgtcgtcatcgtcgacgacgtcgtatccgccactggctctgggaaccaccagttccgagtctagtcattttggacatggaatgtccacggattctagtgggtttagtcatgatattagcagaatgcctgataatcccccgagaaacagaggtcataggcgtgctcattcggagattctcactttaccggatgatattagcttcgacagtgaccttggtgttgttggagctggtgatgggccttcgttctccgatgacgccgaggaggacttgctttcaatgtaccttgatatggataagttcaattcatcgtcggcgacatccacctttcaaatgggcgagccgtctaatgctgtgggagcatcggcttcaacgccggggtcaggggcacccaactattctgcagagaatgttgtttttgggactattgaaaggcccagagttagacaccagcatagtcaatccatggacgggtcaaccaccatcaagcctgagttgctggtctcgggttcggaagacatgtcggcggctgattccaaaaaagcaatatcagctgccaagcttgctgagcttgccttgattgaccccaaacgtgcaaaaaggatatgggcaaataggcagtctgctgcgaggtcaaaagagagaaagatgcgatacattgctgagcttgaaaggaaggtgcaaacattgcaaacagaagcaacatctttgtctgcacaattaactctcttgcagagagatacaaatggcttaaattctgagaacagtgaactgaagctgcggttgcaaaccatggagcaacaagttcacttgcaagatgcattaaacgatgcattaaaagaggaaattcagcatttgaaaatattgactgggcaagttatggcacctaatggaggacctatgatgaagcttgcttcttttggaggggggcagcaattctatcccaataatcatgtcatgcacactcttttagctgcacaacagtttcaacagctacaaattcaccctcaaaagcagcagcagcaacaacatcagcatcagtttcagcagtttcagcagcaacatcagcatcagcatcagcagcaccaacaatcaagtgacttgaaaatgagagaaacttcacctactccatgccccaaagacaatacttcgtcagatgtaaatccttctggagccaaggattgttga

SEQ ID NO: 99035 - DNA, 2835 bp, Glycine max
  Peptide Sequence Number=SeqID_215813
atgccgcctccttccaaattcgtggaaggcgaggagttgggaagccccaccaacaacctctgggtcggaaatctgccgccggaggtcatagattccaatctcatggaactattcgctccgtacggttctctggactcactcatctcctattcctcgcgcaccttcgctttcgtcttgttcaggcgcgtcgaagacgctaaggccgcaaaatccaacttgcaaggcgcatggctccgtgggtttcaaatcagaatcgagtttgccagaccggcaaagccgtgtaaacaattgtgggtgggtggttttagtcccgctgttgcgagggaagatttggaagccgagttttggaaattcggtaagattgaggattttaagttctttgtagaccgcggtactgcgtgtgttgagtttctcaatctggatgatgctgttcgggccatgaaagtcatgaacgggaagcggttaggtggaggccagatttgtgtagacttccttcgaccacaatctacgagaagagattttttggttgatcatgggcagtttcagactagaccacagcatttacaaccttcaattgggaggaatagtcaacccagcaaaattttgtggataggttttcctccttcttttcaaattgatgaacaaatgctccacaatgccatgattttatttggtgaaattgataaaatcaagatttttccttctagacattattcatttgttgaatttagaagcactgatgaagctcagcgtgccaaagagggtcttcaaggacggctttttaatgatcctcgaataacgattatgtattcaagcagtgagccggcacctggaaaagattaccctggcttttatcctggaggtaaagagccgatacgtgatggattagttaatgagtatccatttcgactgcaacaaacagatgtatttggtcataatcgtctgatggttccaaataattttcctggacaattgccacccggacataatgtcccaatgggaccttttggttctcaaggtcttgaacctcttatttccggtcctgattttaatgagatgggtccaagctggaaaaggccatctcctcctgccccaggaatgcttccttctcctgtgcctggttctggtattgggcctcctacaagatccacctctggtgcatgggatgtacttggcataaaccaatttcaaagagattctaaacgttcgaggatacatgatgcttggctcattggtgatgctccatttcctttaaggtatatagatgaccgtggattaggactagaacaaccatttgcaattgatccagttattgatggaggtggttctggtccaaacagtcaccttggtccagtcggcactaggatcacatctggagtacctgattctgtccaacctgatattgatcatatatggcgtggaattattgcaaaagggggaactcctgtttgttgtgctagatgtgtgcctattggaaaagggataggaactgagattcctggtgttgtagattgtgctgctaggactggattggatatgctaaagaagcactatgctgatgcaattggctttgacattgttttttttcttcctgatagcgaagaggattttgcttcatatactgaattccttcactacctcaaagcaaaacatcgtgctggtattgccaagttagttgataacaccactttatttttggtaccaccttctgatttattgaccaaggtttttaaagtcacgggacctgaacgtttatatggtgtggttcttaaatttccatcagttccaagtagcacatatatgcaacaagcaatgcatttgccttcaccctctactcagtatatgcaacagattcccccttcacaagttgagtatggttcaatatctgcaaaggaggaacaggttttaccaatggattataacagattgttgcatgaggattctaagcatcttccaaaaccacttcatccggctacaagtgtcccctcttcatctcattctgttccttctgattatgctcttactcatactgcttctgtatcccaagctggagttacatggacacctgaacttattgcaagtttaacttctttactccctgcaactacacaatcatcaacccctggcggtcaaatgggaatggctggtccctctactgtgaagtcaccttttccttctgttgcacctaataatggaaatcaatctcatttgtggaaacaagataagcaaattgctgatccttctagtcatcctcctcaacagtttgggagtattcataatgctcaatatcaaccttatccacctgcatcttctactgacaaccctgctcaagtggtctctggcagttctcgtttccaagatactgcttccagtcttaagcagctaggtgctgttttgtctacacccatgactaatttcatcttacctcctcaaaatggacaggtagctgtgtcccttcaagtcagtcaacagtatcaggaagtcccacacggcactgagaaaggctatggagtggttcagggaacagatgcctctgttttatatagttctaaggcgttccaacaacctaataattttatttcctcatctaaccaagttgccaatgctggatcacagcaacaatctgtgataccctatacagtggacaaagttaatttagggcccacaaatcagcaacttcaacctgcgttatttggagttggccagggagtgtcagaattggaggctgataagaaccagagataccagtcaacactacagtttgctgtcaaccttctccagcagatacaacaacagcaaacacaaggagggcatgggccaggaaatcaacaataa

SEQ ID NO: 99036 - DNA, 1233 bp, Glycine max
  Peptide Sequence Number=SeqID_215814
atggagaagataaaaataaaactactcatgaaggatgaaacatttctccaacacccttttgttcttgctgttgttctggttttaggccttgttatgatggacccttttcatctgggtccagtgtctgagcatgaattcagacccgtgaagcatagcattgcaccataccaccaagtcatgaaaaattggcctagggacaacatgagcagattagcacttcatgggaaatcagaattcaagaatcaagtctttggaccagagtcactcgagttcgatcacatgggtcgtggcccctacactggtttagccgatggacgcgttgttcgatggatgggggagcaacttggttgggaaacatttgcagttgtcacatctaattggacggagaagctttgctttaggggcaatgattcgaccactgcgaagcaatggaagcatgagaaaacatgtgggcgtcccctaggcctaagatttgacaaagtgaatggagatctatacatagcagacgcatactatggacttcttgtggttggacctaatgggggactcgctacatcattggcaacccatgttgaaggaaagcccattctcttcgcaaatgatcttgacattcataagaacggatccatcttcttcacagacaccagcaaaagatacaacagagttgcacacttctttatattattggaaggagaagctactggcaggctcctccgatatgatcctccaactaaaacaactcatgttgtattggatggccttgcttttcctaatggagtgcaattttctaaagaccactccttccttctctacactgaaaccaccaattgcaggctaatgaagctttggacagagggtcctaaaagtggaagtgtggaactattagctgaccttccggggtttccagacaacgtaagaataaacgaaaagggacaattctgggtggcaatagactgttgtcgcactccagcacaagaagttcttagtcataatccatggttgaggaacatctacttccgtttgcccataagaatgagcttgttagcaagagcgatggggatgaaaatgtacactgtgatttcacttctggacgacaagggagaggttttggaagttcttgaagatcaaaagggtgaggtcatgaagctggtcagcgaagtcagagaggagcaagggaagctttggattggaactgtggctcataaccatattgccaccttatcttacccttaa

SEQ ID NO: 99037 - DNA, 336 bp, Glycine max
  Peptide Sequence Number=SeqID_215815
atggtggcctctagcggcatagcttctcagctattgcctggagcacccatggctcacaaattctgttttgaggcacttgatcacagtcttagagatatcatcaaacacaactcaaaggacaatacaatctttggaggtaaagtcatggtctttggtggagatttccggcagatcctgccagtcattccaagaggcagccgctctgatattgttaacgccacaattaattcctcttatctatgggatcactgtcagatcttgagactaacaaaaaacatgcgtttacaaaacaacatgcaagcaacagatcaagaagaaactgcagcttttgcataa

SEQ ID NO: 99038 - DNA, 804 bp, Glycine max
  Peptide Sequence Number=SeqID_215816
atggatcaccaatctggccagggatttaattcagatgatagtgaccttgatatgcaagcagaaattagtgagaaacacaagaaagtagatgaattttcaaaaaacttagaattatgtggaagtgaagatgaaatgtttgttgaaattgaacaacctttagccaacatttcaactgatatagaagctgtagaaccattcataggcatggagttcaattcaagagaggaagccagagaattctacattgcctatggtaggagggtggggtttacagtacgaatacaccataaccgtcgttcacgagtaaataaccaggttattggtcaagattttgtctgttctaaagaaggctttcgtgcaaaaaagtatgtacacagaagagatcgagtgctgcctcctccaccagccactcgtgaaggttgtcaggccatgataaggttggctttgcgggatggagggaagtgggttgtcaccaaatttgtgaaggagcatactcataaactaatgagtcccagtaaagttccatggcgaggatctgggaagcacttggttagtgaggcacatctcaacagcttggataagttgattcatgatgagaaggataagagaatccgtgaactgtcgcttgagttgtacaatgaaaggcaaaagtgtaaacgacgttgtgctgcatatgaagagcagttaaatatgattttgaatgatttagaaaagcacacagaacacatctctgaaaaggttgctgctgtagtacgaagcataagagagattgaggaggaaatatcagattcagatggtgggtaa

SEQ ID NO: 99039 - DNA, 2616 bp, Glycine max
  Peptide Sequence Number=SeqID_215817
atgtcttccattgccgtctcttatggcgacaaagggtcagtattttgtggcttgaaatcagatggatctcacactgtgacctgttatggaatagactcagccataatttatggaacgccaacgcattttccattccttggtctaactgctggtgatggctttgtgtgtgggcttttaatgagttctaaccaaccttattgttggggtagcagtggccatgttgaaatgggtgtgccacagcctatggttaagggagctcagtacctagagatcagtgctggtgactaccacgtttgtggattgaggaaaccattgactggaagacacaggaacacttctttggttgattgttggggctacaacatgaccaacaactatgtgtttgatgggcaggttcaatcaatctcagcaggttctcaattcaattgtggcttgttttctcagaataggactgtgttctgttggggggatgagactagtagccaagttattagcatgatccctcaaggcatgaggttccagaagatctctgctggagggtaccatgtgtgtggaatcttagaaggggtgaattctagagctgtttgctgggggaggagcttgttggatttgagggaagagctttcaatttcgttgacgggttcggggcaaggacaaggtaatgttgaattggctccaattgatcccatgctttctgtggtgggagggaagttccatgcatgtggcattaggagctatgatcgtggtgtggtttgttggggctatagtttcaaagcaggtactccagttcctagtgggattaaggcctttgagattggtgctgggaattatttcacctgtggagtacttgttgagaaatctcttatgcctgtttgttggggtgttggcttccctacctctctccctttgcctgtttcaccaagaatgtgtaggtctactccatgttctccaggttactatgaaacccaacaaaatggtctttgcaagtccccagattctcacatttgcatgccttgcagtgctgcttgtcctcctgagatgtatcagagaagtggatgcaatttgaaatctgacatactgtgtgaatataattgttctatttgttcctcacctgaatgcctctccaattgctcctcttcctattccaatgctgcctttggcaagagaactgaaagattctggtctatgcagctgccagtgcttattgctgagatagcctttgctgttttcttagttagcattgtgtctataactgctgttttgtatgttcgctacaagctaagaaattgtcagtgttcagggccaaaggtgaagaaactaaaagggagctctataaaccaaaaggatcagaaatgcaagatccgaccggacttggaggatttcaagattaggagggcacagatgttcccctacgaggagcttgaaagggcaactagtggattcaaagaagagtccatagtggggaagggaagtttttcatgtgtgttcaaaggagttctcaaagatggtactgttgttgctgttaaaagggccatagtgtctcccaacatgcagaagaattccaaggagtttcacaccgagcttgacttgctctctaggttgaaccatgcacacttgctcaatctactaggctactgtgaagaaggtggagagaggctccttgtttatgagtacatggctcatggctctttgcatcaacacctacatggcaacaaggtgatgcaagagcaaatggattgggtgagaagggtaacaattgcagtgcaagcagctcgcggaatcgaatatttgcatggatatgcttgtccacccgtgattcacagagacatcaagtcttcaaacatcctcatagatgaagaacacaatgctagagtggctgattttggtttgtcactacttggtcctgcagatagtagctccccactagctgaactaccagctgggactcttggctatcttgatcctgaatactataggcttcattatcttaccacaaagtctgatgtatatagctttggtgttctacttttggagattttaagtggtagaaaagccattgacatgcaatttgaagaagggaacatagttcaatgggcagtgcctctgatcaagtcaggagatatagctgcaattttggatccagttttgaaacctcctcctgatcttgatgccttgagaaggatagctaatgtggcttgtaaaagtgtgagaatgagaggtaaggataggccttcaatggacaaagtgacaacagttttggagagagcacttgcacagttaatggggagcccttgtattgagcagccaattttgcccactgaggtggttttgggaagtaacagattgcacaagaaatcatcttcaaacaggtcagcctcagaaagcactgatgtggaggatcagaggtttgagtttagagcaccatcatggatcactttccccagtgtcacttcttctcaaagaagatcgggctcggaggccgaagtcgaggggaaaaatgcagaaggaaggaatttgagcaatgttggaggaggtggtggtgttttgagaagtcttgatgaagagattggtcttgcctctcctcgagagagattgttcttgcaacacaacttttaa

SEQ ID NO: 99040 - DNA, 1110 bp, Glycine max
  Peptide Sequence Number=SeqID_215818
atgagcacattgaagtgtagaaactgtttgacagatttaaagaaatttatttcttctgcgctggggatataccatgagggccttgggtatacaatgtataagggagcttcaaagaagagaaagttgcctgtaagaaactctgatgttcatttacgcaatacaagaagcaagacagtgaaaaattttcaccagaataactgtggagctgtagaaactggtgtttcttcggaagaaaaagattttacttcttcactaaaagcaactaatcaacctcctcgttgttttgagttttatgtcaggtcagatgagggaattaatctttttattgatttaaattcatccccatcagattggactaacaggtatagaaatgaggtatgcgtgagtgagaaagtgtgtaggaagaaagaatttaggagtctttggcaggatctcagtagcttaggagggagttctacacaaggaaaaagttcctttatatggaatacaaattctggccactttgatgattgtaatggacagaccaaatatgccccaagcttgaaattggtaaaagaagatgttacagggcttgatcaacagaatataggttgctgtccttcaatatatgattcattaactccatgcgccatgacagtaaatgtggaaaaaaatgtaaatgaaaatcaatccactgtctcaacggatgttagttatggtgcaccaaacagttatatttctggtgccgaatattgcactaaagatgtatctaagcaaacccttgattcaattgttactgatactgcattcattaagtcaatatgtggttctgattgcaattcacagtcaggtctcaactcactagggcatgaaagttcaaagcctgataatgaaatttctgaagattgtgctatgctaaatggtttttgccctgtgaaccctggtatgatatgtccaggagctttgttaagtggttctttggagctacaagtttcagaagttttaagtgatcctaagaattctttagacgtggaacagggtggactaataaaatcaagcgagataaagttggataccaatgggaagaatctcccatcaccaactgaagaatgggtatggtgctatctctag

SEQ ID NO: 99041 - DNA, 558 bp, Glycine max
  Peptide Sequence Number=SeqID_215819
atgaaaatcttatatagcagatcttttgttgctgcagttgagtttgggattgatggctccattaatgttgagacagtaggaaatgctactgtagtgcagattagtagcagcacaattgatgagaacaaagtaggctgcatttcttttaatccgaagctgcagcacatgcattctataatgcatatgctacacgtgttggattcatcatacgtgttaagtaagctctcacgaccaaggcgtgatggaactaatattggacgggctcttgtttgcaacagagaaggttacagaatgcctgacaaacgtgaaaagattgtaaggcaaagggcagagacaagggttggttgcagggcaatgattttggttaggagagtaagttctggtaaatgggttgttacaaagtttataatggaacacacacatcctttgacacctggaaaaggtagaagggattgcatttatgagcaatatccggctattgatcgcaattttagaagtttgagtttctgtattaagatggatgaaaaatatttcgacaatatcttctgtttggcgtag

SEQ ID NO: 99042 - DNA, 2880 bp, Glycine max
  Peptide Sequence Number=SeqID_215820
atgggggttatgtccaggcgggttgtccccgtctgtggtaacctctgtgtgttttgtccttctcttcgtgcaagatcaaggcaaccggtgaaacgatacaagaagttcattgctgatatattcccgcgtaatcaggttgctgagcctaatgataggaaaattggaaagctatgtgagtatgcttctaagaatccattgagaattccaaagattactgacaacttggagcaaagatgttacaaggatttgcgtaatgaaaactttggttcagtgaaagtggttttgtgcatatacaggaaactgttatcgacatgtaaggagcagatgccactgtttgccaatagtttattagggatcattcggactcttctagagcaaactcgggcagatgaaatgcagatcttaggttgcaacactcttgtagaatttatagattgccagacagatggtacatacatgttcaacctagagggttttataccaaaactatgtcaattggctcaagaagtgggtaataatgaacaagctctgcttctacgttcagctggactacaagctctatcccatatggtgcagttcatgggagagcactcacatctttcaatggattttgacaaaattatatcagtgattttggagaatttcaaggatctccaatccaaatccaatcttgccaaagtggagaaactgaattcacaatctcagagtcagttggttcaaggatttcccaaagaaggagctgtgacagagtccaagttggatgctgctaaagatcctgcttattggtcaaagctttgcttgtataatattgccaaattggcaaaggaagctaccactgtgcggcgtgtcctcaaaccactttttcataattttgattctgaaaaccaatggtcttctgaaaagggagttgcttcatgtgttttgatgtatttgcaatcccttctagcagaatcaggagataactcgcatcttctgttgtccattttggtcaagcacttggatcataagaatgttgctaagaagccgatccttcagattgatattattaacaccaccacgcagcttgcacaaaatgtgaagcagcaggcttcagttgcaataattggggcaatatctgacctcattaaacatttaaggaaatgcctgcaaaatttagctgaagcatccagcaatggaaatgatgcatataagttgaatgctgaacttcagtctgccttagaaatgtgtatattacaactttcaaacaaggttggggatataggaccaattcttgatttgatggctgtgacactggagaatatcccaattactaccatcatagcaagatcaacaatctctgctgtctatcaaacagcaaaattaatcacttccatccccaatgctttccctgatgccttgtttcatcaattgctcctggccatggctcatcctgactctgaaacacaaattggagcacatagtgtcttctccatggtgcttatgccatccatgtgttctccttggttagaccccaaaacaaagattgctcagaatgacaacttctccactcagcatgaaactttttctggagctgaaaactcgaatgggaaattggaagaaggaaaggcaatagccagtgtcaatgggaagaaatatgtgattcatccatatcgtggctacagctttactccgaagctaactgatggagaagatgatcaaagttctctttggctgagcagtcaccaagtgagtcttttgctttcttcaatctgggttcaggcaacatctgtggagaatggccctgcaaattatgaggcaatggcacacacctatagcattgctttattattttctcgttctaaggcgtcaaattacatggctttagcaagatgttttcaacttgcattctccctcaggagcatctctttggatcaagaaggaggtttacaaccatctcacaggaggtccctttttaccttggcttcatacatgcttatcttctctgccagggctggcaatgtccctggtcttattccagaagttaaagcatcactgacagagccaacagtagatccttttcttgaattggttgatgatatccggctgcaggctgtctgtatagaatcagagaagataatttatggatctcaggaagatgaggtcgctgctgcaaagtctctttcagatgtagaattggatgacaagcagttgaaagagactataatatcgtactttatgactaaattttcaaaattgtctgaggatgaattgtctagcataaagaatcaacttctacaaggtttttcccctgatgatgcatatccatcaggacctccattatttatggagacgccaagaccatgttctcctcttgctcagattgagttcccaaattttgatgagataatggttccggatgatttgatggaggaagagactggacctgaacatagtggaagtcagtcagatcacaaaacatcactgtcaaccaactaccccgatgttctaaatgttaatcaactcttggattcggttttggaaactgcacggcaagttgcaagtttctccacttcctcaactcctttaccttatgaccaaatgaagaaccagtgtgaggcacttgtaacagggaaacaacagaagatgtcagtcattcacagtttcaagcatcaacaggagagtaaggccataattctttcaagtgaaaatgaagtaaaagtttcccctctacctgctaaggcactggaatattcaaacggtgatttgaagttagtgactcagcagcaatttgaagtacaggatcaagcacgccaccgttctcatgactctgggcaccaacattctttgagactaccaccttcgagtccctatgataaattcttgaaagctgcgggatgctaa

SEQ ID NO: 99043 - DNA, 747 bp, Glycine max
  Peptide Sequence Number=SeqID_215821
atgcaagtttgttctctggaactcatggccgattcatcagatgtgtgtcccgctgaggatgctcttaaggcattcctagaatacttggttgatccagtgctgccagctaaaccttctatacgagataattccccttcaccatctcaacaccagttagttgccaaacaggcacatctgaagaggttagctttggttctgagaccaactatatcagtgcatatgaaatccatgttgaagcctgatgaaactgagcttgtgaagcagttgtcattaacagaaggcaagatcttgaatgcatgggtatggtcagtggttgaaaaagatgtggataccttcagccgaagttctgaaattacaagtggagccatacaaatgtacaaaaagagaagagccattaaaaaacctacaaaaaatgaatcaaattctgaggaagaaggaattttgcaaattggatattctgcagtaaagaaagctgcaggtattaataaaactgatattacgtctttggaaagctacactgtgtattctcagagcaaagcaaagacagcttcacgcttttatataatgaagtgctcccagttgatcaatctggaatttattcaacctatcaaatctttgattgaaaggttgctaggtccattggtcaagaggagttctagcagttggacagtcacctcagttgttgagtacttccatgtgcttctttattctgaagtaatcttggagtggatttctaggttggtgtag

SEQ ID NO: 99044 - DNA, 723 bp, Glycine max
  Peptide Sequence Number=SeqID_215822
atgttggtggtttctttggggcgaatcaatgtctcctcggtgtgtgccaaaacaagaaaatgcttttcctcaaaatctcatctccatactttcactcctgcttcagtctcccatcagaaatttccagaagatccgatgatttgcacaaatgaattgcctcaaattagtagtgaggcccctgcacattggaaaatggttcttcaagggattcgccaaatgcggagttctgcagatgaacaccaaccggtttcacgtgagaaagctgctgatactgtaccccctaagcattggttctcagttctcagactattgtttaggcaaacagaagacaatgcctgtatgtctttgatttcttcaacagttaggctacgtttagatattgttttgacattatatgacgggatggaggaaagaagatttgctgtcctgacatcttcccttttatcaagccaaactaaggagcatgttactcgtggagcgacacaacgtcttggtgaaaatgatctgcttactgctgatgcaatggacaaagctgatgaagaaaccatcaaaaagttaatttaccctgttggattttataaaagaaaagctagtaacttgaagaaaattgccaatatttgtctcttgaagtatgatggagacataccaagctcaattgaggaactactcttgctgccaggagtaggtcctaagattgctcatctggaattagttcctggatga

SEQ ID NO: 99045 - DNA, 228 bp, Glycine max
  Peptide Sequence Number=SeqID_215823
atgaatcatgaagatgttgggtgcatgagtgattttacaaaagagggttgcaccactcaacacattcatcatatcacctattgtcgcaacgtgcccttttgcgggagagcgagggcgaggctcacgggtgcgctttccaaaggagaaaaggaaggtattagcacttctcacgtttgtcccaaaggacaacagcctatttttaagaattgtggaattgtgttaccttaa

SEQ ID NO: 99046 - DNA, 501 bp, Glycine max
  Peptide Sequence Number=SeqID_215824
atggaggaggtccatactaagggggaccaggagcctcttgaccaagtcatggaggacgacgtggtaatagtggcgacatctagtagagagtttcctcagggaagagacagatggctcattaaggagagcaatgatgagggtcctgtagaggatcttgatgaggtcatggtatgcttgcccataagcggtattttcacacttcaaacattgcttgatgggatttatatgcttgacatcgatttacaaaactcgatgttcaagacttcgaccaaaattgaagatgaggccaacgaagagaaggtaaaagttgttgaagactcgcttagcaaggcagattggctcagcaagactcatctgcttagcaaggcatccagctcgtttagcagatgggaaaccctagaagaagataagtcaaagaattgcatgcccagcgcacagtcagcccacccagcgagggtgttgtctcttctcgcgctcaactcgcactcactctctaagtga

SEQ ID NO: 99047 - DNA, 165 bp, Glycine max
  Peptide Sequence Number=SeqID_215825
atgatggtattaatggttattgaggaatcaagtttagaaacattagtcttgattggagatttagaaggaactatagtgaagcaagtggactcaaagaaggcaattgcagcaaaccaaaaatacatgaagactagtgagactaccttgttaagccaagaaaattga

SEQ ID NO: 99048 - DNA, 192 bp, Glycine max
  Peptide Sequence Number=SeqID_215826
atggcggtgctgaaggtgacgacgctttgcccatgcaagggttgcaacaatagaattcacatgccggtgttgaagaataaaggagttaatgacatgggtatagatagagggaaggggatggtgatagtgaagggcacgatggacgttgcagctttggcaaagaagttgtcggagaagttaagaggaagatag

SEQ ID NO: 99049 - DNA, 240 bp, Glycine max
  Peptide Sequence Number=SeqID_215827
atggagaggaagacgaagcgcgactcaggctcaacgcaaactattagggataaccagtcattgtggaaggtgcaagggagtgagtcgaccaaggtgagatcgacaagtattgagtttgatcttgtagaagaaggggaaactggacagaggagagataacgacgtgaggggtctcgatcgaggtagaggggggaaaaggaagaagccaagcaatgatgtagatgggggaaggaagaactga

SEQ ID NO: 99050 - DNA, 258 bp, Glycine max
  Peptide Sequence Number=SeqID_215828
atggccatgccgttcatcgcctcccccagttcacagcgagtcagccgctccaactcgggagcatggctcataatccgcccgatgaagacgacacctggaagccatgtggttgccttgaagctaagtgcgagcccaacaactctaacaccgtcaactactattttgaatcctccccgacactgtcaaccccatcaccctcattgcattcatcatcagctccctgcacggtggaaaattcaccatcgatgctacctttga

SEQ ID NO: 99051 - DNA, 321 bp, Glycine max
  Peptide Sequence Number=SeqID_215829
atgggtttaagaagagctcttgacatttacgggtttctctttaaattttcatctagtgctaagcctaataatttaggtgacaatctatatctttgtgtttcaaattctaacactgaaggaccacctcaaaacattagagcttggatcaaatgcatcactgcttgttgtctgataagaagtaaaaaggctatcttctccactatagaagctgaagagatagttgaaattattatttatctattcctagattgccaatttcagggtttgttggtgcttttgaatgactacatgaaagtgattgtcaattactttacagactaa

SEQ ID NO: 99052 - DNA, 450 bp, Glycine max
  Peptide Sequence Number=SeqID_215830
atggaaagaggattagaggaaggtaatgcgtgtttgggaagaaagtgccaaaggaagttgttatctattgccaatgatgatggtgttcgaaaatgggggcgagaactaagggctgacccgagaaactcaatctcggccatggcatcaagatacctttggcaaggtgctctgacaagtctagacacaatcaatgagcatgattcagttactgaaggcggaatccttggaaacaaatgcgaaggggacaaggctttaaatgcaaatattttggcacaagaaaaacatgcggatttcatggctgtagtttttcataatccaaagatgatcatgaagccatcattacaacaatcaactacaattattgctctatatcaaaacaagattaaaactccttatcatgatgtgattatggacgttgaaaatgaggttgaaataatagtaggagattaa

SEQ ID NO: 99053 - DNA, 738 bp, Glycine max
  Peptide Sequence Number=SeqID_215831
atgagggaaggtatgccactgaaggagcatcttgataagctaaacttttttttgaaggagctaggcaaccttgatgttaagatggaaaatgaagatctagaaatgattatgttagcctttcttcctcccttctatgagaattttgtgagttttattagtgtaggcaaggactccactattgttgaagaagtcaagtataatgtttattctagagagcttcaactaaagacatccgggaatggtgatgaagcttctacatctagattatcagtgactggttttgctaaagagcaaaagaaaaataaaggaaaagatggtataggttttgtacaaatcagaatgcatgatggtgttgttaaaaccttaattgaagtttgtcacattccagagcttaagaaaaatcttgtatctgtgggtgccatgaatttgaaaggtttttcttgttgggttaaaggtggagttatgcaaattagaggaaaagagaagtttgtggtggaacatcttcagttttgtgagcaatgcatctatgggaagcaacatcaaacaaagttcccaaatgttatgcacacaacaaaggccatgttggactacgtccattttgattgttgggggcctttgagagttccatcactaggaagggcaaggtatttcctttccatcattgatgattactccatgatgacatgggtattcatgatgaagcagaaatctaaagctttcaaatttttcaagcattag

SEQ ID NO: 99054 - DNA, 348 bp, Glycine max
  Peptide Sequence Number=SeqID_215832
atggaaaaggagaatgacaagatatgtgaagccaaaaatccaccaccaaatgtctctacaaatctcgcattgcatttcctgcatgaatggagatcagttcgccatcatccatcaaagcaagtggctaactcagactcacaaaatgtagttctgacatggaagaagccacaacatggaattgtcaaactcaatattaatgcatcaatcttcatagaacaaggattgtttggtgcatgcttggtgctttgtgggggagaagggaatttttactgcaacaaaaaccatgaaggcataaggaataataaagccaaaagaagtcaaggtttaagcattactccaagcagttaa

SEQ ID NO: 99055 - DNA, 324 bp, Glycine max
  Peptide Sequence Number=SeqID_215833
atggcctccatgaccttcctatggaagggtataaatttacatggtcaagaagcaaagggaaaaattatttttgaaagtctttctatttttgagaactcagggcttttggaacaaacccttaatgttttcattgaagaagggtgggaaaatggaaccaatggtgatcttatctataagctagagagttgttcatcatacatgtactcttggggaagacacgtgaaagtggttttcaaagcacatattgatcaatgttgtaaagaaatggaaactctctgtgaatcatcaactgatgaagttgcacatcaatatgtcattgcatga

SEQ ID NO: 99056 - DNA, 131 bp, Glycine max
  Peptide Sequence Number=SeqID_215834
atggcgaaaccatcaaagaagcttaagggttctttgagtcgaagccaacggcattccgagactcaagaaacgcagattccttcctccatttcctcttcctcattgttctcatctgaagaacaacggatacg

SEQ ID NO: 99057 - DNA, 450 bp, Glycine max
  Peptide Sequence Number=SeqID_215835
atggaactccaacgtcttaatcaaaatgaagaaaccgacaaaaagaaaataagtatagcacttaaagcctcatcatcaatgcaagaagaaaatgaagaagaagattcagatgatgaagaagacttctcactctttgtgaagaagtttcaaaaatttgtcaagaaaagaagaatcgagaggcgtcaaaactttaacaatgaaagaagatcacaagaagactctcaagttcttaaatgctacaaatgcaaccaacttggtcacatcaaagctaattgtccttcaaatgaagaatggcttgagaaaagtgataagaaaaggtatgatgaaagaaggaccaacaaggcctacattgcatgggatgacaatgattcatccgatggttcagaaaaggagatcaaccttctaaccaaggattatgagagtgatgagaacatttctcaagaagattaa

SEQ ID NO: 99058 - DNA, 441 bp, Glycine max
  Peptide Sequence Number=SeqID_215836
atgttttccaagaaggagggaatgatgagaatcatgaaacaggccaaatacagtctaaaggcccaagtggagaaggacgaaggcccaagtggagaaggacaaagcccccgagtggagaaggatgaaggcccaagtaatccttgtggcgtctacccagacttatcttccttcaccggaagtggcgtctacccagacttatcttccttcaccggaagtggcgtttaccctgacttatcttccttcaccagaagtggcgtcatccaaatcttcgtagcctgtatcaaacgatccgccccaaaaatgaaactgaaaagggaagaggggatggagagaatagaatccatacctgtggactatttgctggcggaggagttccagacagtgatattctcatacatatctatggcctccctattgccaagacagaaaaagatcaaatag

SEQ ID NO: 99059 - DNA, 396 bp, Glycine max
  Peptide Sequence Number=SeqID_215837
atgaatcttgtatgtgggaagaatgtgctgattgacatgagcatacatacagcatatgtaaaggccattcgtgctgcacaacattacatttatatagagaatcaatatttcattgggtcttcatataattggagtcaacataaagaccttggtgctaataatttaattcctatggaaattgcactgaagattgctgcaaagataagggcaaacgagagacttgcagtgtacattgtcattccaatgtggcgccagagggtgttccaactggtgctgccactcaaagaattctattttggcagtttacctgttgatttgtctactcatcagaatataagaaattacttaaacttgtgtgaagctggaacaacttatgagtgggttctagttatctga

SEQ ID NO: 99060 - DNA, 522 bp, Glycine max
  Peptide Sequence Number=SeqID_215838
atgggtgtcaaagttgccctcgttgtgttcttcatgttctttgttctatgttcacccttcccacacttagtcctcttcttccacgacatcatctacaacggaagcaacgcagccaatgcaacgtccgcaatagtggcagccccagaaggtgcaaacttaaccaaattggcgagccagttccacttcggaaacatagtggttttcgacgaccccgtcacgctggacaacaaccttcactccaaccaagtcggtagggcacaaggctcttacatttacgacaccaagaacaccttcactgcgtggcttggattcacgtttgttctcaacagcactgatcatcgtggaaccatcaccttggctggagccgaccctaccttgaagaagactagggatgtctcggtgatcggtggcaccggagatttcttcatgcacagaggaattgccaccattatgacagatgcttttgaaggtcaagtttatttccggcttcgtgttgatgtcaagttctacgagtgttggtga

SEQ ID NO: 99061 - DNA, 1741 bp, Glycine max
  Peptide Sequence Number=SeqID_215839
aaagccacaaacaaaggcatccttccacaccacagcttttacattcctagcgatgagagttccctcatccccacaacccaacaacaaccattcccctacctcaaacctcgtcctccacacaaacaacaaccctactacaaccttcacctacgaacccacctcggtccttgacctctgccggagcccgagccccgaaaaaaaactcactgttcccaagccagaaccacaacacaacaacaacaacaacaacctaaacctagacctggatgatcatgtcttgcctaattcggattggtgggagtccatcatgaaggacttagccctacccgaagactctcccacaccccttttgaagaccaacatcaatccatcatgcatccctgatttcccaccttcttctcaagacccaccctttgatcacccccaagatttcacctctctctcagaaatctacaaccaaaacctaccctacaattaccccaccaacactttagaacattccttttacgacctaagccataaccaccaccacaacaacaacaacaacgttaacaacaacaattgggacttcatcgaagagcttatccgtgccgccgattgcttcgacagcagccacttccagctggctcaagccatactggagcggctcaacaaccggctccttcgctctcccatgggcaagccgctccaccgagccgcgtttcacttcaaagacgcgctccagtccattctcgccggttcgaaccggaccagttcgaaccgcctctcctccatggctgagattgttcagacaattaaaacgtacaaagccttttcgggaatttcaccgatcccaatgttctccgttttcacaaccaaccaagccctacttgaaaccttaaatggatcttcatttgtccacgtcatcgatttcgagatcggcctagggatccagtacgcttctctcatgaaagagattgccgagaaggccggcgccggagcctcgccgctcctccgcatcaccgccgtcgtgccggaggagtacgccgtcgagagccgcctcgtccgcgagaatctcaaccagttcgcgcaggatctagggatcagcgcgcaggtggacttcgtgccgcttcggaccttcgagacggtgtcgttcaaggccgtgaggttcgtcgacggcgagaagatcgccgtgttgctgtcaccggcgattttcagccgcctcggaagcaacggaggcagcgtcggcgcgttcctcgccgacgtgaggagggtgtcgcccggagtggtggttttcgtcgatggcgaggggtggacggaggcggcggcggcggcgtcgttccgacgcggggtggtgagcagtctagagttttattccatgatgctggagtcgctggacgcgtcggtggcggcggggggaggcggcgagtgggtgaggaggatcgagatgatgctgctgcggccaaagatcttcgccgcggtggaaggcgcccggcggaggacgccgccgtggagggaggcgttttacgacgccgcaatgaggccggtgcagttgagccagttcgcggattatcaggccgagtgtttgcttgcgaaggtgcaaatcagaggcttccacgtggacaaacgacatgctgagttggtgctctgctggcacgaacgagtcatggttgccactcccgctctcactctcactctcacccttcagtctcgcgacagttctctccctcacgaccctgactcaccaccatcactcgcgaag

SEQ ID NO: 99062 - DNA, 228 bp, Glycine max
  Peptide Sequence Number=SeqID_215840
atggagcaaacacctcgtgggtcgtggtcgtggctcatggtactcgcggcttctaagcttctctcgagctcgtcattgacacaagctaccaagcttctcttgagctcgttgtgttcgtgggtgggactcgcagcttccaacagaatcaggcaaccaccgcaccacgtcgcttgtcgcatgtcgtctggtctcacactctcacgtcgcgccgctgctgaacaactctaa

SEQ ID NO: 99063 - DNA, 783 bp, Glycine max
  Peptide Sequence Number=SeqID_215841
atgtgggaccttgttgcgcgtgatagatgggtcatcttcgatgcattctctgctctcattgttgctacagtgcgttcccttttctttcttttttttttcgcccattttgtgtttctcgaaggtgggggtcaaagttgttacggagattttgataccgcatttcttgacagcatccatcttcacagcacagagtatggaccttgttgtttttcaccggaatatgcagttgttggttctgttgtgcgtggcttcgggaatatgaaggttaagagaatgagagaaacactatactcttctcttcttctgcagtgcccttattgtagaatatatcattttttgacaatgaaacagtatgagtggtggctggagaaattagttgacataagcttgcaacaaagtgctgcatatggagtttggaattttagctttaacattctttatcattcaactcaggttatcactgtgctgtttggaggaatgtctattctagtaggtcatatcacagctgagaaacttagaaggagttggagcaacaaagcaccaaaatctataactttgtcattcaattgcccatcatataaaaagttaagcataaccttgaaagcttccagtgggacatcccttaaagtaacttctgaggacatgctttcttttggggtaatattgcaatccataagctttttaaatatccctttctcgtcactaaacaactattggatcacttatttatgcatggatcttgtacacactgctaattcctatgttctcttcatcttagcataa

SEQ ID NO: 99064 - DNA, 937 bp, Glycine max
  Peptide Sequence Number=SeqID_215842
ctacaagtgtgatgcttactatgagatttcagactttgataaagcatgttacatgcattctttacttagtcttgaagatgaagactctgagtggctctcagattcgaagccttctggaggttcatctgagaactcttcaactcctattagctacaagtttgatgctgcttctgagatttcagatttttccaaatcaagttacatgcattctttactcagtcttgaagatgaggattcagagtggctctcagattccaattcttttggatggtcatctgagaacccttcaactcctcttaactccaagtgtgatgctttttctgatattttagatttgaacaaatcaagttacatgcatcccctaatcagtcttgaagatgaagactccgactggctctcagattccaagtcttgtggattttcatctgagaattcaactcctcttagctacaagtatgatgcttactatgagatttcagatttggacaaagcaagttacttgctttccctactcattcttgaagatgaagactctgagtggctctcagattcgagtagttggagtattgtggttcctccttcagtctctactagctcctcattcactggagtacagtgtggcaactcagaagaagagttcagtgctgatgaaccacttttttggccatttgaagggaaactcaattggaattctgaggaaccttggagcaatgaagctctatgcattgtgaactatgaaacgtcaaagttaagcatgtgggctaaaagttcagcaaagatagtgcctcttcttgagtgtgaacattttgattcaaacaaggaccagcttcttttgggaaaagagtattttgatttgtgtcaagagcttaccattgagacattggtggggctcaaggaatttgatggacatgaggggcttgattcggaattcgatgat

SEQ ID NO: 99065 - DNA, 171 bp, Glycine max
  Peptide Sequence Number=SeqID_215843
atggatatagatgagcctaaggagaagctatccattgccaaaaagggtgagggttacttacgtagacatagtgagtggtcaaagaaagagagaggaatggaatgcgacggaggtgcagcggacgacggaggtgacgacgagcagagaactaaagatgcgagactgcaatga

SEQ ID NO: 99066 - DNA, 880 bp, Glycine max
  Peptide Sequence Number=SeqID_215844
atgagtttgacagcaaatggcactgtcttctgcatggaacctgaacataaaatgacaggtcatcacttttgtaatcttagaaaccaagttgatgttattttcccgcgagtatcatcagacggcaacatgaaattgcggcattcgctatctgttgaggacaaaagttacgctgttaattcgtttcatctttttgctaatgtgttggtagctttttggttgttcctggtggcaatctctttctttctcttgagcaaagatgtcaatgtttttggcggttttagaggaaaacatgcagagaaagtttcttcatctgacagaagaaccatctcaaatgcaaccacagaggatgatacaaatgatacgtttagctggagtgagctatgcaccaagtgtgatgcttactgtgagatttcagattttgataagccaagttacatgcattctttacttagtcttgaaggtgaagattctgagtggctctcagattcaatgccttatgggctttcatatgaggacccttcaacacctcctagttacaagtgtgatgcttactatgagatttcagattttgagcaaggaagttacttccactctttactcagtcttgatgatgaagattctgagtggctttctgattccaagtcttttggatgttcatcagagaacccttcaactcctcttagctccaagtgtaatgcttactttcagatttcggctttggagaaagcaagctacgtgcattctttactcagtcttgaagatgaagacactgaatggctctcagattcaaagccttctgtacgttcatttgaggagccttcaactcctcttagctacaagtgtgatgcttactatgagatttcagactttgataaagcat

SEQ ID NO: 99067 - DNA, 324 bp, Glycine max
  Peptide Sequence Number=SeqID_215845
atgaagttccaccattgttgtgccctaacccctctccctcaaacctcactgtattgcctcaaacctcgctctccctcaaacctcactgtattgcctcaaacctcggtctcccttaatcgctctccctcaaacctccctcaattgctctccctcaaacaccactccctgaaggtccctcgaaacgtcactctctggccaacatttttgtgcagtggagcttacaatcgcgccgtcagtacgcatagtgaggtcgcccctgccgtgacctgtctgccatctcgaagaagtgtatctgttgtgcgccgtaggtcattgtaccagtaa

SEQ ID NO: 99068 - DNA, 871 bp, Glycine max
  Peptide Sequence Number=SeqID_215846
actacacgtcctcacctttagagggctgcatgccctcgccttcagagggctgcacgccctcactttcagagggctccgtactctcaccttcagagggctacacgccctcgccttcagaggactacacgcactcaccttcagaggactacgcgtcctcgcctttagaggactacatgtcctcgccttcagaggactacacgtcctcaccttcacagggctacacgctctcgcctttaaaggactacatgtcctcacctttagagggccacacgccctcgccttcaaagggctgcacgccctcgcctttagagggctatatgtctttgccttcagagggctgtacaccctcaccttcagagaactacacatcctcgccttcagagggctaaacgtcctcgtcttcagagggctacacgtcctcgccttcagagggctgcatgtcctcactttcagagggctgcaagtcctcaccttcggaggacaaaacgccctcaccttcagaggactacacgtcctcacctttagagagctgcatgccctcgccttcagagggctgcacgccctcgcctttagagggctccataccctcacctttagagggctggacgccctcgcctttagaggactacacggcttcacctgtagagggctacacgccctcacattcagaggacttcacgtcctcacattcagagggctacacgccctcgccgttagagaactacacatccttacctttagagggctacacgccctcgccttcagaggactacgtgtcctcggcttgagagggctacacgccctcgccttcaaagggttactcgtccttgccttcagagggccacatgccctcgccttcagaggactacac

SEQ ID NO: 99069 - DNA, 444 bp, Glycine max
  Peptide Sequence Number=SeqID_215847
atgggtagaggtagaggaaagggtaaaaaactaactgttgccaattttgaggatccagcgagtggcgaggatgaaaaagttcccacgcaaaagagaagagggaggccacaaaaaccgctaaaggacgactttgatgaagaagaggtagagaaaatagaagacgacagtgacaatgttaagaatggaaccgcttacaaagagatgaaaagccccactgcaactgaaaatggaaggaaaagaaagcgaaactcacaggtaaaagagaaattagactcagttgagaaagaaaatagcattggcaatggaacaagcaccactgatgagttgacaaaggccaatggttttaggcataatggaagcaggcgcaaaagcacgccccgtcgagctgctgaagcagtttcctttttcctcggtgagtctgatttgaggggctgcatttggtga

SEQ ID NO: 99070 - DNA, 144 bp, Glycine max
  Peptide Sequence Number=SeqID_215848
atggcaaacccactttcagcaagggacattggaaaaatacaaagagtgcatctaatgcttctcatagatatcaagtttcggggaaaccaagtaagggttagcaccacaatgcaggacctaggccagctatctttaagaaagtga

SEQ ID NO: 99071 - DNA, 207 bp, Glycine max
  Peptide Sequence Number=SeqID_215849
atgcgtctatcggggaaggagagtctgctgatgaaatctcccataaccataaatgagattttggatgttagcatttcgtttctaaatgaccatttagaggaaacaccgggttcgacaaaaatagaagaaatccactcaaagtgtatcaatctcgcacagtgcggggcgagaaaaaaggtcgctagcgcacgggattctggttggtaa

SEQ ID NO: 99072 - DNA, 342 bp, Glycine max
  Peptide Sequence Number=SeqID_215850
atggcatcattggcatgcaacacgtttattgttagcagcacgttaagatcagttgttactcgtgcggaaccacctaaacctggtcctcttttcgatcttagttcattcaatcgccacagctttccggcaggcttcactttcggggcatcatcttccgcgtaccagtttgaaggtgcggcaaaagaatatggtagaggaccaagtatatgggatactttcatcaatcaacatccaggtaagatagcagatggaacgaatggagatcgcgcacttgaccaatatcaccgctacaaggtacgatccgaattccgaatggtgctaggaagtaggaaatcaacttaa

SEQ ID NO: 99073 - DNA, 195 bp, Glycine max
  Peptide Sequence Number=SeqID_215851
gtttgtcaacaatggattattcaagatgagatcttgacgtcgaatttggtgcaatccttcttcacaatcaatggcggggatgagccgacgcaaaaggaatttgagcaagttcttcctcttaaagatggcaacatggggtctggcgataggtgggcatggattggacatttaagaatccaatccatatctatttaa

SEQ ID NO: 99074 - DNA, 147 bp, Glycine max
  Peptide Sequence Number=SeqID_215852
atggaagatggtaacgctccggcaatatcatgggaatggccatgtttaacacttaatgagaaaccaacctctaatctggatttggaaacatttgggcctcaccacgtgctccatctcggcggtgaactagaggtgctctccacctga

SEQ ID NO: 99075 - DNA, 407 bp, Glycine max
  Peptide Sequence Number=SeqID_215853
atgccgcctactaggcaccctctagaactagataagtctaacagggccctgggttttccagcattgatcacgggtctctgccagtcattcggggttcccgtcacacctagtaagggtgatgcaccacaggccgtagacgcaccgccaccacctcatcaggctgatccagctgggcggccaaccacagggggcaggtgcagatacatgagtgtctctactagccagggtttcgcttcttttgcgtgccctactccaaatcagttcaaggctgaggttacatggcccggagattggcctgaggcccaggcaggggaggcactagcagaggctcccagcggtgcagaggaggctcgcatggatgagaagatgacaaatttactcggtttcttgggagggagtggagccac

SEQ ID NO: 99076 - DNA, 582 bp, Glycine max
  Peptide Sequence Number=SeqID_215854
atgagagggttgcacgccctaacctttagtggaatacaggtccttgccagcagagggctggacgccctcaccttcagaggactacacatcttcaccatcaaagggttgcacgccctcatcttcagaggactccatgtccctgccatcagagggctgcacgccctcactttcagaggactacacatcctcgcctttagaggactacacgtcctcgccatgagagggctgcacaccctcacctttagtggaatacaggtccttgccagcagagggctggacgccctcaccttaagaggactacacgcccttgccatcagaggactagacattctagcctttagaagaccacatgacctcgcaatcagagggccacacgtcctagccatcagagggctgcacgccgtcaccttcagaggactacaggtcctcgggatcagagggctgcacatcctcaccttcagagaactacacggccacgccatcagaggactagacatccacgcctttagaggactagacgtcctcgcctttaggggactacacgtcctcaccatcagagggcagcacgtcctcaccatatga

SEQ ID NO: 99077 - DNA, 2037 bp, Glycine max
  Peptide Sequence Number=SeqID_215855
atggcttcaaatgcaggagaagaagagtctaccgtgatcgccattgatagcgaccggaacagcctacacgccgtcaagtgggctgtggaacatcttttgaagaagaacgcttcttgcaccctcattcacgtcagaaccaagactttgtattcacatgattttgaggttatccctaaacaaggtcgtctgccaacagaagaagaattgcaccaattttttcttccctttcgaggattttgtgcacgaaaagggatcgtagccaaggagttagtcctgcatgacattgacgtttcaaatgcgcttactgattacatcattgacaactctatcagcaatatcgttgttggcgcttcccgctggaatgctcttataaggaaatttaaagatgcagatgtggcaacaagcttagtcagatctgtgccagagacttgcacggtgcatgttatatcaaaaggaaaagtgcagaatattcgacctgcaggccattctcaaaatattagtaacgcactatcaaaatctttaaaaggcatcaaaggaagttttcagtctgaagatttaaacagaaaatcggtcaagtatggacataagcaaggctcaaacaatgatggggtatctttggtgacaccacgtatgaccaatggagagactacttctccaaaactatcagatgaaagttgctcctcacaaaattcatccaatcgaagttccctaacgggtgatacttcaaagctgcttggttatcaattgactgagatgtcacctgaaaaccaagatgtagtcgaaaattcaggcagttacacttttaggagcaattcttgtaaaatatcccaaaaaagcttggaaatagaaaaaaggaacccaaaactagaactagagagaaagacaaagaagtgtaattcgacccgtagggaaaccacaacaacacataaggcaatgaagcatgaaaagtttacgcaaaaagaagatgcagttaaagcttggcttcctgaagaggctacattgactttgacagaggtagaaaggaagaaaaccaaggcatctatggagtcagctgaaatgttaaaatgcctagcagaaatgaagagtcacaagggaaaacaaactggaataagagccatgcatgaggaagaagagaggaataaagcattaaatgctagtgcttgtaataacaaaattttatttaaaagatacaatattaaagaaattgaagttgcaactaattactttgacaatgccctcaaaatcggtgaaggtggttatggacctgtttttaaaggagtgcttgatcacactgaggttgcaatcaaggccctcaaaccagacatatcccaaggggagaggcagtttcaacaagaggttaatgttttgagcacaataaagcatccaaacatggttcaactgctaggtgcctgtccagagtacgggtgccttgtatatgagtacattgaaaatggtagcttagaagatcgcctcttccaaaaagataacactccaacaattccatggaaagttcgattcaaaatagcatcagaaattgccactggccttcttttccttcaccagacaaagcctgagccggttgtgcatcgtgatctcaagccagcaaacattttgttggaccgcaactatgcgagcaagatcactgatgtgggtttggcaaggctagttcctcctagtgtagccaacaaaaccactcaataccacaagacaactgcagctggtacattttgctacattgacccagaatatcaacaaactggactattgggtgtaaaatcagacatatattcattaggtgtaatgctgctacaaattatcactggaaaacctccaatgggtgtggcacaccttgttgaggaggctatagacaaaggtaaactccaagaggtgcttgatccaaatgtcacagattggccccttgaagagactttatcatatgctaggttggctttgaagtgttgtgagatgagaaaacgggatagaccagaccttcgttctgtcattttgccagagctgaatcgactccgaaatctgtga

SEQ ID NO: 99078 - DNA, 246 bp, Glycine max
  Peptide Sequence Number=SeqID_215856
atgagagggatggaagaaagaatgaatacaattgatagagagaagagaggaggaattttcaggcttaagttgctggagtgggttttggattttcataggctcgttcagcgcgatacccatcgcttagcgcattcagatcttgtgcttagcgagctcctctcgcttagcgtgttctgtgtcagttttgtccacttagtctgtgctgtgcgctgtgcgcgagtaacggattctgactctcgtgcttaa

SEQ ID NO: 99079 - DNA, 136 bp, Glycine max
  Peptide Sequence Number=SeqID_215857
atgaacatttggtatcattgctcattgggaaacgacctaggatcacttcctaatttactacattttaatgtttattttgattcgggtacggcctcgatcaaatttggcgccgttgccggggaagcagtgtccaaag

SEQ ID NO: 99080 - DNA, 996 bp, Glycine max
  Peptide Sequence Number=SeqID_215858
atggaagaagaagaagaagaagacacgtggccaccattctggacggaaagcggcggtggccgccgcctgcgccgctcttactcgctgttcctgagctccagtgcacttctcatgtgcattctggtgattgcactcgcattcactctggtcataattcccacgttgcaatttttcaccacccaaattttcaaacccaattcggtcgagaagagctgggattccctcaacttcgtgcttatcctcttcgtcattctctgtggcttcctcagcaggaacaacacctccgacacgccccacgaatacgacaaatcaacccctccaacactgcgaccatggtacgaggaatcagatcgaacgccgccgtacaaatcgtttaacaggctcaggagtttcaactcccacccggatctccggcaagattcgccgtggatggccgccgatgaacggtggcgattctacgacgacacgcacggaaagaagaagaaacgaagacaattaggaagcgttgaaagtgttaagagcattccttcacaagcttcctcagtttttcataatatgttttcttctaagaaaagcaagcgcaagaaacttaacaccgcttcatcatcgcatgtttcattatccaaaaccgaaccggttcgtgggggtgttgtggctacttcccttagaccaaacaagagagaggatttctatgctttggaggaaaatgcggttgttgctggtaatgagccgccgccaccgccattcaagatgccggcgtggaagttccgggtgcagggtgactttgttagaatagatagcattagtagctcgagtagtgattcgccagatttggaagatgaaattgtggactcaccgagcaatgaagatggcggagaacctgaaagtgaaatcttgttgttctatcctattcagagcaggtttaagggaggagaagcaagggattggtacgtccaatctacgttcttcaccaaaaccagaagctggaccaagtag

SEQ ID NO: 99081 - DNA, 864 bp, Glycine max
  Peptide Sequence Number=SeqID_215859
atggatcacacacaatcatgtcaatcaaatacctgtgtggatttaagccgctctggttcttatgatcatgcgaagcagttagcatcggaactccctgccaaaagctactccacatcagatggggaaagcaggattcaggagaacttgaatagtaatcaacatggagacaatgctattaccaaggaagaaaatccaattcaagctgaggaggatgttcaactgtcaagatctgaggattcacaaggaccactctactcgaagaaggatggctctgataaaggggtattatctcctaatgccagttcttatgccccttcatctcatacttcatctaaaactcatgagaagatgggatcacatggagatttgatcgagggttcagcatcgggcaaggctaatggggaaacgaaatctgtaaattcacgtggaataccatctgggtcagatttggttggaggcattgcagcatcttctgttcctggtttatctccaagttcatcagtttgttcactgtcttctgaaaaatcaactctgaatcccaatgcaaaggaattcaagcttaaccctaatgcaaagagttttattccatcgcctgctcggcctcccactccagtgtctgatggttccttctattttccaactaacgtaactactgtaccaagtatgccaggcatgcccgtgggtattggaattggacctacttttgctgggccacaacctatcatatataatcctcaggtagcacaaatgccgtctcaaggatattttcatccgaatgcaccccagtatggacagcttcttggtcatcctaggcaatctttatacatgccgagttacttgcctgtaagaactctcgtactttga

SEQ ID NO: 99082 - DNA, 255 bp, Glycine max
  Peptide Sequence Number=SeqID_215860
atgggaggtggaacgcaacagttgcaaggaagggagaatgattggctcacagaaaatatcggaacctccgacataggatgtcaaccgttaacagaattgattttagcaaagagtcaagcttttatgaaaagagaagagatggttaaggatggattactcattaaaggtatggaaggagaaaatcataaggagttgaattggagtaagttgaagattactaaacaagtacacctgggcttagtacgagctgtctag

SEQ ID NO: 99083 - DNA, 1086 bp, Glycine max
  Peptide Sequence Number=SeqID_215861
atgaacttgcaacaagctgggcagcctaaatcctccaatggatatggccaccgaaaatctgaaagagaaggggcaactaaatcggagaataagattctgtctgggaaattaaatgccaacagattggcaaatgcaggtgcagttactggcagtaaaggtggcagttatgagagtccttcacatgaccgattagtatatgtaacaacatgtcttattgggcaccaggtggaagtccaggtgaaaaatggatccatatactctggaatatttcatgcaacaaacacagacaaagattttggaatcattttaaaaatggctcgtttaactaaggatggttctttacgaggacagaaatctggcacagaatttgtcagcaagccccctttgaagattttaattatacctgccaaagaccttgttcaagttacagcacaggatgttgctattaccagggatggcttagctaatgaatctcatcatgatatgcatcaggaaatcatggttgattcattgatatctcaatctcgtcacgttgatctagggagagaattaaaaccctgggtacctgatgaagaggatccacaatgccctgaactggaaaacatatttgacggccattggaataggggatgggatcagtttgaaacaaatgaggcattgtttggtgtgaaaagcacattcaatgaggaactttatacaacaaagcttgaaaaagggcctcagacaagagaattagaaaaacaagctttaagaatagcaagagaaattgagggtgaggaaacccaagatcttcatcttgcagaggaaagaggccttcacttacatgaagcctttgatattgatgaagaaactagattctcttcagtctataggggtaaacatgttgatgacagtggatttgatgaggacatactgtttgattcacacaattctgaaacttttggtgatgaaacttttggtggtgtgtttggttcggtcgttaagaggcctggtgaaataagtggtggaaaaggaaatgatggagctcgaacattggcaaattcttcctccatggtattaaatcaattcatgcatttcattttctaa

SEQ ID NO: 99084 - DNA, 672 bp, Glycine max
  Peptide Sequence Number=SeqID_215862
atggaaactgaaggatggggagaggtttccagtactcttactcaagctcaccttcaccaacttcaatggttacatgctactagtgccatttctaacagttttgttgttcacttgatgcaacatgatggtcttgatgacaaactcactgagttgcttgtggatattgctcctgagatagcgaccttgttgcatacttatagcatggtttttcaaacgcctatgggtttgcctcctactagggatcagaaccatgccattcccttccacctgaatgcaaagcctgttaatgtaagtccatattggtacccacattgtcaaaatgagaacattgaaaaaatggtacatgagatgctagaccaaggcatcattcaaccaagcactagccctttttcatcacctattgtcttggttaagaagaaggatggcaagtggaggttttgtactgattatcgagctttaaatgctatcactatcaaggatagttttcctatgcccacagttgatgaattattggatgaactttttggtgctaagtattttctaagttggatcttagatcgggctatcatcaaattttggtccagcatgatgatcgatataagactacttttaggactcatcatggccattatgagtggcttgttatgccatttggactcacaaatgcactaa

SEQ ID NO: 99085 - DNA, 615 bp, Glycine max
  Peptide Sequence Number=SeqID_215863
atgaacgagtgtcaaaatgttcagccactggattctcagtataatgtcaaggatggacaagatgtgaaggagtttgtccgaacttgcaccacttgtcagcaagccaagtatgagcatgtcttacctactggtttattgcagccattacccattcctaaccaggtacgggagcatatcactatggattttatcactggattgcctaactctagtggatttactattattatggttgtgattgatagattgacaaagtatagtcattttgtttcaatgaagtatgattacactagtaagactgtggttgaagcttttatgtgccatatagttaagttacacagtgttcccaagttccttatctcggatagagataaggtgttcaccaaattctggtacaatacctctttccacagtagtttaggaatgacatcttttcaggctttatatggaagggaacctccagctttacttagatacaatggcagctctcaagatccgccagtagtgtgggaagcggataagaataggcttgatagaaagttccaagtgggagatgaagtgctagtaaaactccaaccatatagacaacattctagagccctaaggaagtattag

SEQ ID NO: 99086 - DNA, 891 bp, Glycine max
  Peptide Sequence Number=SeqID_215864
atgaaagcaaaagcatccatcaacatttctgaagacaataccctgatcgaatcattggaaatcgcaaaaagcagaatccagattatgatcgataaaggaatggataataaaaatcaggttcttcagggattgatcaataaagcaaacaaaagaattgcagagatcagatccggggaaaaaccggctttaactcctgatgcgaatgctaaatattacgctgaagttgttgtagatcttgatgttattgtagagccgatgatcgctgaccctgacgtaaacaatgaagacgtttccaaaagatatacacatgataccatcagagctctttcttattacggaggagagaaaaaggtagatcttggatttgtaggatcatgtatggttcataaaggagatttaaaaattgtttcccaaatgctaagaaaccttgaaaaacagcaaggtaaagtagaatttaatgctcctcttgtagtagctgctcccacttataacataattgatgaacttaaagctgaaggggattgggaactactggaaaaatattctgccttcgaatttgatgataatgctcctaagggagaagcccgtgtagaatataaaaacgtaatgtaccttgaacgtccgggatgtaacctttgcatgggtaatcaggaaaaagcagctaaaggagatactgtactggcaacttctacccgtctttttcagggaagagtagttgaagattcagaacgtaaaaaaggagaatctctgcttgcatcaacacctgttgtcgttctatcttctatcattggaagaattcctaatatagatgaatataaagctgcagttgaaggtattgaccttactaaatttgctccacctattaaagaacttgttcaggttggtcattaa

SEQ ID NO: 99087 - DNA, 411 bp, Glycine max
  Peptide Sequence Number=SeqID_215865
atgggagagggtaagggtgtagccaacgacgaaggcatggttggtgacgacaactatggtcggcatctagagcgtggggagatcggagatgatggagcggaggagggagtccatgagggcgaaggatcgggcccaggcgatctcttagttgttggagaagaatttgtcatgcacgatggtgacgagggtggaggaggtagtggcttcttggcggtcgcggcggagggaggattggatggaatcaaggagtgtcggttgagacagtgctcattcctatgcagagtagggactctaatcctgaggtacatcatcaatgcaaagttctgcactttagtattgctaaggatgggaaagaatatcaaggaaggatcttggataaagcatttgcgtttggaattcatattcttctaa

SEQ ID NO: 99088 - DNA, 282 bp, Glycine max
  Peptide Sequence Number=SeqID_215866
atgatgaacctaaagctaaaaagcttcgagaaatgggatgctcctgaggagaacagcagagaaagacgcaaaggaagattggagttcttttcggagaaagaaaaccaagaaacacaacaaccacaccctagagaagggaacgttccagagaagaaccctcactgtgtcgccctagtgttgccagagaaggacgcggggggccgtcaatttcttttgccattgtggtgttgtcagagaagaagcttgttgatgccgcacaacatagagtggagaagaccatga

SEQ ID NO: 99089 - DNA, 1263 bp, Glycine max
  Peptide Sequence Number=SeqID_215867
atggacaccacttcatcccctttgtccctccaaacccaaaaaaccaccttccaagaacttccagaagcttctcccaagccatacaagaagggcatagtagcaaccttaatgggaggaggtttattcaaagaagacaactactttgtgtcccttctgagatcctcagagaaaaaagcccttcaggagctgaaaaccaagctcaaagcttcatttgaagactctccctctgatgcatccatgtggggaattcccctccttggaggtgatgacaaagctgacgtcattctcctcaagttcctaagagcaagggacttcagggttggtgatgcacaccacatgcttatgaagtgtctatcttggaggaaggagtttggtgctgacacaatcttggaagaggaatttttaggcttgaaggagcttgaaggggtggtggcatacatgcaagggtatgacaaagagggtcaccctgtgtgctacaatgcctatggggtcttcaaggacaaggaaatgtatgagagggtctttggtgatgatgaaaagctgaagaaattcttaaggtggagggttcaggttcttgagaggggcatcaaggtgcttcatttcaagcctggtggggtcaattccctcattcaggtcacagacctcaaggacatgccaaagagggagcttagggtggcatccaaccagatcctctccttgttccaagacaactacccggaaatggtggctcgcaagattttcatcaacgtgccttggtacttcagcatgttgtattcaatgtttagtccgtttctgactcagagaaccaagagcaagtttgtgatctctaaggaaggaaatgctgccgagacactctacaaatttatgagacctgaagacattcctgttcagtatggaggactgaatcggcccagtgatttgcagaatggtcccccaaaacctgcatctgagttcacaatcaaaggaggagagaaagtgaacatacaaatagaaggaattgaggctggtgcaactatcacatgggacattgtagtgggagggtgggacttggaatacagtgctgagtttgtgccaaatgctgaaggaagctacaccatagctgttgagaagccaaggaaaatgggggcatcagaagaagcaatccacaactcattcacatcaaaagaatctggcaaaatggtactctcggctgacaacactgcctcaaggaggaaaaaggttgctgcatatcgctactttgtccgcaaaagcagcaccatttga

SEQ ID NO: 99090 - DNA, 243 bp, Glycine max
  Peptide Sequence Number=SeqID_215868
atgaaaattattattttggaacagaatggggttgcactttacacctcttcgttggtcttcgattccattttcactttgttccctgcaccaaagtcatcaatggtggtgttgggtggtgttgtttgcgtgttggtggttaggtggaggtggggctacggtggtggtggtggtgttggaggggtagttttgcctgcttggatttttgggaggtgcaagaaacaaaaaatggaatgtaggaagtaa

SEQ ID NO: 99091 - DNA, 207 bp, Glycine max
  Peptide Sequence Number=SeqID_215869
atgagggagtggggaaacgagaacaagagaggtttgaggcgagatttgagtttggaactgtgtgtgtttgtgacactttgtgttgtgttgtgtttgaatgagagtgagggagatgaaactatgaaagtggtgtttgaggaagaaacgaatttgaatgtggtgatgaggggagtgaatggagacaagggctcgtggcagagagagtga

SEQ ID NO: 99092 - DNA, 474 bp, Glycine max
  Peptide Sequence Number=SeqID_215870
atgcatttcttgatgagtctcaatgaatcctatggttcaattcgagtggttcaagaagaaaaacagagagaaattggtgcttctgtttctactttcaactccacaaatgatgcttcacaatctcatgcctttgctgtcaggactccaaatatcaatttgatcacaagtttaatgctaattccaagaatcgacccttctatgcacattgtggtcagcttggccatacttaagataagtgcttcaagttacatggttttccccccaaattacaagaagaataagccttcttcttctaatactaaaagcaaaatagtgaatcaagcctcaacacccaattttgttcctgatttttatctcactgccaaacaatatggccaactcatgagtttgcttcaagcacaaacttcaaatgttgttattcccaatattgagtcttctaacactggaaatgcctcattgcaagaagattggtag

SEQ ID NO: 99093 - DNA, 297 bp, Glycine max
  Peptide Sequence Number=SeqID_215871
atgaaaggggagggaaggggtaaggaaccaggttttggagtcttggggggagagggtggaggaggtgaagatgaagaagaaagcgaggaggaagatagagagggtgcagtagaaccagaaagagaagggttgttgttgggcttggtggtggaatttgtgagtgtgagtgtgtgggttgctctattcttctgtgacgatagccatgctcactactcactgctcactgctctaagcttcgttgtggctacaagactaaagggtgtgagtgttggttacagggacaacatcattgcatga

SEQ ID NO: 99094 - DNA, 484 bp, Glycine max
  Peptide Sequence Number=SeqID_215872
atgaagctgatggacattgacagtgagcaccttgggattcaagaggcatatcatgtcatgccattgttaagatgccatcctctgagtttgctaagatttgcaaggatctcagtagtattggaaggtgtaaagttttccaccaaaggagacattggaactaccaatatagtttgcaagcagaataattttgtggacaagcctgaagaagctattgtcattgagatgaatgagccattgtccaacacaattaccattagtctgtcaaatgagccgccatttgtagttgagtacaagattgctaagatgggttatgtgcggttctatttggctctcaggataaaagaggatgaaaaagatacgaaacctcaagttgtgggaattgaaggtgagaatgaagaatggataggtgctggtgttggattaggggctccgcaacatgatcgtggtgaccacgaccatgaacgtggcgacgccgaacaacaag

SEQ ID NO: 99095 - DNA, 294 bp, Glycine max
  Peptide Sequence Number=SeqID_215873
atgagtcacaagactcaatccaggattatcattggtttgtatgagaaaaggattggaatcatccatggcacccatgggggaacttcgaagaatcgaagaataggagaagaagagctagaaagggatcagagaaagcgtcacaagcttttcatgaagtcaaactctgattttgaaggtaaaataagtcttgacaaagctgggagcagtgaagatgagtttgggtttctttatcttttctcatgcttgttactgatgtatcatggcgctgcttatatgaagacaatcagctggtga

SEQ ID NO: 99096 - DNA, 945 bp, Glycine max
  Peptide Sequence Number=SeqID_215874
atggaagtaacagctgctccagtgccttatgtccaagaaattgcaaaggcattgaccatagtgcctgagcgttatgttcgaccagttcatgaacatcctatattatctaactctacacctttacctgaaattcctgtcattgacttgagcaaattgttgtctcaagaccataaggagcatgaactcgagaggcttcactatgcatgcaaagaatggggtttctttcagggagtggactcttcattggtggaaaaagtgaagagaggtgctcaaggattattcgatcttacaatggaagagaagaaaaagtttgggcagagagaaggagaagctgagggatatggtcaactcttcatggttttagaggaacagaagttaaagagtgggcatatttgtttttcatgttcactttgtcaccaaataagaaaagatggactgtggattccagttaaacccctccccaatgctttcatcataaaccttggtgacatgttggaggtgatgagtaatggaatctaccaaagcatagagcacggggcaacagttaactcagagaaagagagactttccatagccacattttatagcactgctatagatgcaattatatgtctagcaccaagctttgtaactccaaaaacaccagcaatgttcaaaccaatcagcgtgggagattacttcaaaggataccttgcacaagaaatttgcgggaaatatttccttgtgacacttacaagaaatcaaacagctttaatccttattcatcatggtgagtcgttatggaatgagaagaacttattcatagggtgtgttgatgtccttctaagcaagaagggtatagacgaggcaattgaagctgggaaaagaattagcagcattccttctgaagctggagtttatgcctatactagggctgcaatggtacttgcagacctctaccaatag

SEQ ID NO: 99097 - DNA, 351 bp, Glycine max
  Peptide Sequence Number=SeqID_215875
atgtctaagggcattaatgcttatggacccaaaaagacttgggtaccgaaatctcagattgtttcattggtaggaaaagaccagggggaaaggtctatgttcctcaacctaaagccagttaaaggaggagcaattgcctttgatggcatgggtaagggaaagatttctggtataggtaaaattgatattccatctttagcctccatagacaacatcttatatgttgaaggtctgaagtataacttactgagcataagtcaattttgcaatagtggttatattgtgtccttcaacaaagaccaatgtatagtcaagacaaaagatgacaagtccttttttacttccaaatga

SEQ ID NO: 99098 - DNA, 321 bp, Glycine max
  Peptide Sequence Number=SeqID_215876
atgatctgcggtctccatattgctaccacaaaggctgaacatggagacagagatgcaacccctcttttgcaaactaaaatcagtggggaatttattatgaatgagcctccacagcaaaaaggacttggatgggggtacaactgcactccaaatattctttccccaaggaacctcagggtcccggttcagaatacaatcaggaatacacttgtcatcctggaggaagtcagcaaccttagcactaagcttggggtggagatgttaggaatgtccaagaggtcaactagaggactggagagccatctatcagtccaaaagtag

SEQ ID NO: 99099 - DNA, 639 bp, Glycine max
  Peptide Sequence Number=SeqID_215877
atggaaaaacatggaggtccacgacaaatgttatatcctgaactgataccgaaactgcctcacagagatggtggcaatagagcaagttcatcaggagacaaacacttaagaggaacggagggaggtgatttcagaggggtgggtaacaacggggtcgagaatgaagatggtatggtcaaagggggtggtgaagaaatggggttcactctaccacgcaacgctcgtcggatcttcggggtcagtccagagatgaaacaactcaagaggaacgatggtggaagatcgattatcctattggccaaatcttcgaactcagagagcaccagtgggatcctcatactgaaagggtgcgaagcgcgtttgaagagcttaaaggaagactggccacgaggtgaattgaccattactggtcatccactgaaactaggccagagaacggccatccatgtagaaggaagcaatagtcaaatgctcatgtttagggggttgaatgatactaaaaaaaattggttgatcttgaagatccaaccaagtgggtttgtgccgttaaatcgcgaaacgtccaatttcgtgcgatgggaggtggaagtggatgtaagggatgtagtagctgtagaagaagatggagaagggttgtaa

SEQ ID NO: 99100 - DNA, 213 bp, Glycine max
  Peptide Sequence Number=SeqID_215878
atgcccagaacactgcaagatttaaaaacaaaatgcctatcgttttatgttgtggctaatggtgtgcatgcagattgggcttcccgtggcaaccccggtagagcgacgggggaggaggtattttcaggaattcccttggccttttcattggtgcttttgctgatttctatggggtttcatcctccctcatggctgagctgcttgcagcaatga

SEQ ID NO: 99101 - DNA, 363 bp, Glycine max
  Peptide Sequence Number=SeqID_215879
atgacagataacaacaataacaataatagtcaattcattgttgagggagcatccctcacgaggacactaggcttcacaagagaggactatccttatgggaaagatagaatggagatcttctctataaaaggaggaaaatttgtggatgacatgtttggaagacttcaagtgcttttgaatggtcttgaagctctaggagacaccttcaccaaagctgagataaatctaaagattccagacaactttcctaaggtgtgggaacaaaaaacaacaaccatccaagaagctagaaatctgaaaactctagcatgggatgaactattaggtatcctaagagttcatgaaattcaccttcagaactga

SEQ ID NO: 99102 - DNA, 810 bp, Glycine max
  Peptide Sequence Number=SeqID_215880
atgttgaatgttttgtcgcgtcctgtgtcgactaccaacatacgaaatataactaccagcataccaatatgggaggacctttcacttgatttcatcaccggcttactggcattctgcggtcataccaccattcttgtcgtcgtggaccatttttcaaagggcattcatttggggatgttacccacccaccacacatctcactctgtggcagttctattcatggatatcatcaggaagcttcagggaaggccacacattttgactggcgaacaaacagaggtattgaatcatgtcatcgtacaataccttcgtgcgttcgttcataaaaagtcgtcatcatggggtaaattccttaattgggtggaatggtcctacaatacttcatggcactacattgatggaacttccatggtggatgttgttgatgaattgttgactaacaaagaagagatattggaccaaattggttcagctacttataagcttcaattgcctaaaggagctcatattcatcctgtgtttcattgctccatgctcaaacccttccatcattcatcttccgacaacaacgttcctcctttgcccttaccagctacatccattgacaatcaacccatcatcacgcccttggctattttgagcactcgaaggaactctaattttttttattccaagttgaaagttttggtgcagtgggaaggattgtcaccagatgacacctcgtgggaggattgggaccaacttcgttcttcctatcaccttgaggacaaggtgattttggaaggcaaaggggatgatagcaatcatgag

SEQ ID NO: 99103 - DNA, 352 bp, Glycine max
  Peptide Sequence Number=SeqID_215881
atttaataaatggggagagaagagaatatccattgatgttcaacaagagacaagacagacgagagtggagaataaaccttctaaagcccaaaccctatttgccttaaaccacttcaaaggttcatcacgtgttatttcaaatggcattttctctactggtttctttgctgatggcgaaaatgcatattcctatgggtcctcgggtttctactctctgttcttcgacaatgacaacattctccgtcttctttacgatggtcttgaagtttctgccattactggccacatccatggctggcatcttggaaagctcattaggacgcagtgcatgctcgacgttgtagtgaagtga

SEQ ID NO: 99104 - DNA, 674 bp, Glycine max
  Peptide Sequence Number=SeqID_215882
gaccaagggaattgactggtgctgtggatcttataagtcatttcaaattactgccccactatgagtttttctgcaagaggcctctccctgtgtcaatcgcggacacacactaccttcacaatgttgtaggagacacagaaataagaaaaggagatgggatgcaattggatcaacttattcagaatacatctttcagagatacaaatgctcgtatacagccttttgacctagatgttctcaaggaagcttttcaattacgggaaacagctcccattgatttgcctgctgcagagaaagggattccaactattgcaggaaaatcaaaaagtgagaataaagacaaggagaagaagcataaaaagcacaaagacaaggacaaggataaggatagggagcacaagaagcacaagcatcgtcataaagaccgtagcaaagacaaggacaaggataaggacagggacaaaaagaaagataaaagcggacatcgtgattccagtgctgatcactcaaagaaacaccatgaaaagaaacggaagcatgatggagacgatgatgttaatgatgtgcacaaacacaaaaagagcaagcataagagctcaaagattgatgaattgggggcaattaagaggggtctttcaattgacattatcaaatttcttgaggagggtagctag

SEQ ID NO: 99105 - DNA, 180 bp, Glycine max
  Peptide Sequence Number=SeqID_215883
atgttaaaagcacctatgaaactgtatatttgggatctgctaacaaacagtgaagtaataaacatagttgcttcagcaccaaaaagaatcaaaacgaagaatgggatgctcttggagggttctccagagccaactttgaatcatagattgcaatcacctcagtacctcaaggagggttga

SEQ ID NO: 99106 - DNA, 204 bp, Glycine max
  Peptide Sequence Number=SeqID_215884
atggtggtgggtggtgctatttgcatgttggtggttgggtggaggtggggctacagtggtagtggtggtgttggagagccatcttctgggattgtgtcaaaagcaaaatcttctggccgtacaattgttaacttgttagtagcactagcccttggattcggggagtttctggctgagttagtgatcagcttcaaccctccttga

SEQ ID NO: 99107 - DNA, 501 bp, Glycine max
  Peptide Sequence Number=SeqID_215885
ttggtcaaggcagtgactgacgaggtagggaaatcactaataatggagcttactgatgataaactagtggacacatcacgaacagctgccaagaagtgggttagaatgtatcttgctcgacatggatgtgtacactctgatgcgatttctaaatctcaatccaaactttctgcttcaatccaaagcaaccaactgaccatacaagtactgattacagctggaatgccagtaatcaatcatgccggatatgcaccattagcaaggcaatcatccactacacttacagaatccaatcaacgcaaaacctcggcagcttctgaatcactttttgctcaggccatatcaactcaacttccccttgatagcgatgatgattattgtatcgaacagcttacgaatatcgacaatggaaacatggacgatgaattttctgctattgaaagtattatttctgaaattggcatgggtgcataccaatgggaaattgttttgggctttgcg

SEQ ID NO: 99108 - DNA, 285 bp, Glycine max
  Peptide Sequence Number=SeqID_215886
atgaaagccaacagaacaagaaatgaattgaaagcctctgattcgaaaacctatcggttgaagaacgaaaaacgaatgaagaacggtgaagaacaacggaaaaccttcacggatttgctcatagaaacttctcgaaagcgttacggaagcacctcagcttggattttcttcacggaaacaattttttcacccaaaacaactgaaatgcatagccaaaggggaaaaaggggaggaggttgccgcccagctcgcccaggcgagctgggttacttcctccttaagtaa

SEQ ID NO: 99109 - DNA, 386 bp, Glycine max
  Peptide Sequence Number=SeqID_215887
atgagcactcagttacaacaacacaacaaaagagaattcaagggagaagaagaagaagaggaggaggaagaagaaaaccatttgctacattcagaatgcgaaacaataccattgtcctcaccccacacatcaccctcagagtgggaacatggaaacagagaagaagaagaagaagaagaagagaaggacacggtgtatgcagccaaggacaaggtgcagatattcgacctggagtccgccagtggcgccagtgtggggtcaacggcggtgccgccattctcgtggaggaagctgtggctgttcaccggacccgggttgttgatgagcgtggcatttttagacccggggaaccttgaaggggaccttcaggctggagccattgcagg

SEQ ID NO: 99110 - DNA, 241 bp, Glycine max
  Peptide Sequence Number=SeqID_215888
tttttcatgcctactcagacagttcagggcagaggtagcatggccgaagattgaccgagcccaagcaggagaggcacccccagaagctcccgggcgatggagagaagcccacgaggatgaggagatggccgatttgcttgacttcttgggagggagtggagacacgtgtctgggagatccccagattcattgtagagttcttcgtttaggaacatcgtccaaaagtatatatgtaaaataa

SEQ ID NO: 99111 - DNA, 882 bp, Glycine max
  Peptide Sequence Number=SeqID_215889
atgttgtggttcaccattttcaatcctgttttttgtgtgaacagtttcttctttctatttctcgagaactatggagtgaggaaattagaaggtgtattcgcagttttcattggaactatgggcttttcttttgcgtggatgttcttcgatacaaatcccagtgaagaagaactactgatgggccttttgatcccaagagtaaattcgaaaacgcttcgtcaggctgtggaaattgtggggtgtgtgataaccccacacaatgtattcctccattctgcattagtacaatcaagggacattgatatccgtaacaaaggccaggttcaagaggctataaactactactcaattgagtcatcagttgcacttttagtaacattggtgatcaatctgtttgtgataaccgttttcgctagggtgttctacggtacagaacaggcgaaaggcataggattggtaaatgcagggcagtatcttcaggagaggtatggaggagggttgtttccaattctctatatatggggtattggtttgttagcagctggacaaagtagtaccatcacaggcacatatgcagggcagtttataactgagggctttcttaatctcaatataaagaagtggttgagggcattgatcactagaagttgtgcaattgttccaactatgatttgtgcaattgtttttaatacatcagaaggttctttggataccatgaatgaatggcttaatgtggtccaagcaatacagattccttttgcacttatcccccttcttactttggtgtccaaagaggaggtcatggggaccttcagaatagggcctatagtagagaaaatgatacagggttattcttgtatggctattatagcaaaaggatag

SEQ ID NO: 99112 - DNA, 512 bp, Glycine max
  Peptide Sequence Number=SeqID_215890
atgaagaagaatcaagtagtttcaatgatgccaaaaagcactttgatttatgaggtttttgggataaaaatggtcattgaccaatccttattctatgacttgacccaattatctagtgaaggtgtaccatttgaaggtgcactaaatgatgattggaaatttgatttctctatgcatgatgcccaccggttggtttgcaccaaccaagcggatatgaccggaaggctttttgtcggatcattggctcttgaaagccgcatccttcactatcttattgtgcgcattttacttccaagatcttcaaaccttgcacaatttaacatccctcttgattctgaaccttatgttccaatcaagagatccttcttgatcggtgctgctgtgattgcatcttttggttactgcaaagagcgtgatggctcttgggtaaaaaagggtgctcaaccccatgatgatgaaggacacttaccaataagagaggattcctctctccttcaaagtattttggacag

SEQ ID NO: 99113 - DNA, 588 bp, Glycine max
  Peptide Sequence Number=SeqID_215891
atgtccggccctctcaatgagtcaatctcttgctttctcaaaagggtggacccttgggtactagtaccctcaccttccgaggactacacgtcctccccatcagaggactacacgtcctccccattagaggactacacgtcctcgccatcagagggattcacaccctcgccttcagagggctacgcgtcctcaccttcagagggctacatgcacgccctcagagaactatgcgtcctcaccttcagagggctacatgccctcgcctttagagggctacacgccctcaccttcagaggactgcacgtcctcacctttagagggctacacgtccttgccttcagagggctgcacaccctatcctttagagggctgcatgccctcgctttcagaggactacacgtagtcgccatcagaggactacatgtcctcgccttcagagggctacacgccatcaccttcagaggactacacgtcctcacctttagagggttgcacgtcctcaccttcagagggctgcacaccttctcctttagtgggctgcacaccctcgctttcagacggctggacgccctcgccttcaaagggtga

SEQ ID NO: 99114 - DNA, 225 bp, Glycine max
  Peptide Sequence Number=SeqID_215892
atgggaaaactagaagatgcctcagaagatcaaggttcttcttcagaagttgctgatgcttctaaatcctgcaaaaaatttctgattctttatgaattacgccttctagaagtggcgttaatctccaaatcaatgggaattaaatcacccgcaatagatcttctttgcatacaagaaaacaaaacaacaattatccagttcaaaataacaatgaatgtacagtaa

SEQ ID NO: 99115 - DNA, 390 bp, Glycine max
  Peptide Sequence Number=SeqID_215893
atgggcctagtttttccagactcgcagagatccttcttgggaggatgtgtggaaaaaggcacaggccatccagaaacagaacactgccccccacattttgtctcgtggggttatgaatatttggagcagaagctcctggctgagaagaccaagaagaagctggaggaagctacacagtcaggaagtgttgatggcgtcatcgacctttcatcccccgtcagacgccacgtgaagtggaagatggcctgcacgaagaaaataggggagatgacgactgaggccgcaaaggaaatcgctgagaagatcgattcctttgaggagcaggcgacacagggatctttcacccccatggatgtcaagatgttctcaccgctgctattggacatctag

SEQ ID NO: 99116 - DNA, 852 bp, Glycine max
  Peptide Sequence Number=SeqID_215894
atgtcacatacacatgctctccatttcgtgaaaaaacgagatgcgatattcctttgggtcttgcttggctggctggcgttcgccctgctgccgagctggagcctggattacggcctgctggagtccaccggcgatgaaatcctcgcggcctacggctggtcacaccgcaatgtcagctggctatggtgcctgttgccgagcctgctgctgcttcgcgcctacaccccagcgggcggtgaacggcggcggcgccacgcgttcgatgccggctgggcgctgctatgcatggcctttatcgtcgtcagcgccacggtggcggggcgcggtttaggctacgccaccctggtgcaattgaccgcgctgggcgccatcatgacgctggcgctgacccgcctcgaatggctgggcggcgaccgtttcgttatcggcgcgctggtcaccatcgtggcgctgatcggcgtcttcatcgtctggccgagcatcgcaattttcattccgatgttcaccgaccagacgggtgcattcgcgccgctggcgtttatgaacgtgctgtcgcaggcgcatatcgttcaggtgatcctcaactccatcgccctgtcgatcgcggtgggcgccggctgcaccttcttcggcctggtgctggcgatttacaccacccgcatcgccaggcgcagcgccattatcggccgcatcttctccatcctgcccatcgtcacgccgccgttcgtcgtcggcctaggcgtcacgctgatgatggggcgctccggctacgtcaccgagtggatggtggcctggttcggcctgaccaacaccaactggctgtacggctttaccggcatctggctggcgcag

SEQ ID NO: 99117 - DNA, 273 bp, Glycine max
  Peptide Sequence Number=SeqID_215895
atgggttcaggaaaaggttctcccgaatattgggtagctggggttgaactggggaaaaatttttatgaagtggggggggtaccggaaaatatagcacgaaaggctgataatagcggagcacgcgaactgatgtgtattcgaatcctaggagctagtaatcgacgatatgcttatattggggacattgttgttgctgtaatcaaacaagcagtaccaaatacgaacttagaaagatcagaagtgatcagagctgtaattgatacgtacttgtaa

SEQ ID NO: 99118 - DNA, 159 bp, Glycine max
  Peptide Sequence Number=SeqID_215896
atggcaatgatgactttggaccatgaagaccagattgctttgctgaaagggtctgcggttgaagctatgttccttcgttcagctgagattttcaaaaagaaacttccgtctgggcattctgacctattggaagaaagaattcgaaatagtggtaagtga

SEQ ID NO: 99119 - DNA, 501 bp, Glycine max
  Peptide Sequence Number=SeqID_215897
atggtgaaagttggaacctcttacgtgccgatcaacgtctcattttcgccaaaagttggcccagggcttcccggtgctccagtggcttctgtttctatcagctgtccctcctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattgcatttaacattaagttagggactaatatgcaaaatgggaagcttggaacagatttaacatggaagaacgataagcagtacactgttgcgctatatgatggcaatgcgcgcgcggttgcgacgattcaa

SEQ ID NO: 99120 - DNA, 174 bp, Glycine max
  Peptide Sequence Number=SeqID_215898
atgatcgatggatcatcgtcccatgcccagctctggaaaagcgggaagcgcagctgggaggtaaatgacgcatgcctaatctaccctccgggggaagtcctacatcctcgtcctcttcatcctctgtctaattcgtttcctgctcgaaatcgatggtcgggtcccaggtattag

SEQ ID NO: 99121 - DNA, 353 bp, Glycine max
  Peptide Sequence Number=SeqID_215899
gatgccagaaggtacaagaggatgtacaagggctgatagacagcaaaaaattaatcatcaccaggaaagacaaggaagtgtgtgttattacccctgagttccagcagctggaaataagttataacagtgggagactagctactactccactagtgattagcttgccaagacccgtgccttatgcttctctaaaagcggtcccttacaagtataatgtcacaatgttggaaagtggacaggaggtgcctctcccctctctaactcctgcgacttatgtagacaacattgtcagtaacagcaaggttctgaggaatgggcgtgttatgttagacaagtggcctcagatatcttaa

SEQ ID NO: 99122 - DNA, 675 bp, Glycine max
  Peptide Sequence Number=SeqID_215900
atgactggcattaagggagccccttacagagcacgtattgatgccttgacagtcactaacgtctgttggatgccgtatgctgagcatcggggagttcggggctatgaattgatctccttgtacatggggcaagtcagatggggtccgatcatcgtctaccttcgaccagagagggtggttcagcagatggggtacattcagacagttcctccgccaccggttcgtgattcattgacaagtactgatatagacgaccagtgggtacagttttcagatcatgtaacgtctacaggggagctctgtgtagttcctgggcaggtggccctagactacatggagtggttttttcagatttcacacccctttgtgatgccgacggaggacactgctgaacccagacctgcgcctccccttcccactcatgatgatgacttcgtggatccacctgtcgcccaggttccagtcacgtcagatccccctgcgcattttgtggttggttgcacaacatgtgtcaggatgggaaggattgctgagcatttggagcgtgtcatcaacctcaggatggtgactgcatggactgacttatatgatatcatggatctttgcctaaggataggtagagatgacaacccagatgacagtcttaggccgcgacagagatcccgcatagattag

SEQ ID NO: 99123 - DNA, 300 bp, Glycine max
  Peptide Sequence Number=SeqID_215901
gcatgtttcaagatccatattcctatgcttgactccaatgatccttcctatgttgaatctgatagtgatgttcattttaatgtttctcctcaagcacttgataagctgatgtgttatttccttgcattaaaagtcaatgttcaaccaaacttcaagaatgttgttgttcttagatgctcaaatgacttacatttgatcagtgttgtgatggacatgcttcctgatgctaaggcatgctccaagatccatattcctatgcttgactccaatgatccttcccaagttgaatctataagttga

SEQ ID NO: 99124 - DNA, 381 bp, Glycine max
  Peptide Sequence Number=SeqID_215902
atgagggtaaggcttgaccattgcttgataaatttggagtggagattgagattcaaagaggccactttgatccaccaaggttggcttaagtcaaaccataggccactttgcttgtgtcttgagattccatctcataggaatcaacatagacgaccttttaggtttgaagcaacttgggtgatgcatgaaaaatttcctaactttgtgagagcttcagaatataagaagaattggagagagtatgaacaagtcttggatgaaaaagagcttcattggtttcagatgtctagagctaaatggttctatgtaggggaccaaaatgcaaagtattttaatggtattacaactatcagaatgaggaagaatatatttgagatgtag

SEQ ID NO: 99125 - DNA, 648 bp, Glycine max
  Peptide Sequence Number=SeqID_215903
atggcaatgaaggagcaggcagacactcaccgccgtgatgtatcctaccagccaggggactgggttctactgaaactgcggcctcaccgacaaaccacggctaaagggtctcagtctttctcggaaaaattgcctaagtggcttacccgcctggagctacctaatgaagctaagattcactctgtattccactgttcgatgttgaaaccatttcgtggaagttcagataacagggcagtcgcattgccggatcaattcgtgaaccatcaacctgtgatcactccaatgacaatcctggactatcgtcgaagcaatgaagcttgggaagtgctagtgcaatggcacgcgctatcaccagatgacacctcttgggaggattggactcaactgcaacaagcgtatcaccttgaggacaaggtgcctttcctagggccgtggagtgataagaaggaagaagaagacatgaatcaagttgagtcagaggcagcaactaatgaaaccattcaaggggtagcaacaacaaccacaacaggtacaagaagcaaagaaaatcaaaagagcagtgaagaagcccacttacctcaaggactttgtctgaagggtgggtatttccatagcagaatcatcaacagaatttcctttgcttga

SEQ ID NO: 99126 - DNA, 756 bp, Glycine max
  Peptide Sequence Number=SeqID_215904
atgggtgtgggtcgggtcatgggttgggtccgggtcagggtccagggtttctataagaacagggtcaggaggatcctcttcctctgcaagcagaagaaataccctagagacacaacggtggcctctatggtatttctcgtcacagctaaaacagaggtcgcgctcgcggcgagaggcaatctcctcggagagtgtgggggaaggtgggggtcgcaggggcggggagagaagagtctgaggagggttcgttcgaggggggttcacggagagtgggggtggagttgggggaggccggaaaaaggacaggggtgggcgagagtcttggagtttttcctcctgaaggcagacaaggcacgcggcctgggagagagtcaaaggttgatgggcctgtacctcatggaaaatctccggagtgaggctggagacatagcagctgaggaggaacggtgccggaagtcccacgatgtggtttgcaaggtcttcaaattcggaaaggtatgtggctactgttcccttctgcgtgagcttgaagagggcccttgttgggtcctcgtattgagatggcgcaaatctggtctggagtgcctggttaggaatggtgcgagggacagaggaggaaaacggaggggggttggtcagggaaggggaaacatggtgaatgaggttgtcgattttctggtttgtccgatgacgaagactgacaaggtcaggcatggtgacaacgagagcaccaaattggtacgctcagagaactaa

SEQ ID NO: 99127 - DNA, 222 bp, Glycine max
  Peptide Sequence Number=SeqID_215905
atggggcaagggcaatccaaagacgagttgctctatcagcaagtcagttatgggaacgccgaaggaatcaaaacccttcacagagaaggtgcaggcctagagtggagggacaaagatgcgaagacccccttgattgttgcttgtatgaatcctcggctttataatgttgccaaaactttgatagaacttggagccaatatcaatgcatttcgtcctgactaa

SEQ ID NO: 99128 - DNA, 500 bp, Glycine max
  Peptide Sequence Number=SeqID_215906
atgtctcgtctgaggctaggaaagaagctccaacctgctaagaaggcttggaagagcttcttcaacaaagtgcaatcaaaagtccaaaaactcaacattcccaaagccatcaaagccaccttcaaacgcctccttgcctccttgcactcccttcatcacctcataccctcaagagctcgtcatcgtcgctctctcgcttcgaataattaccatgttcatagcaagaagaacatatctgtcataagcatagatgatctctttactgagcctgcttcttcttcttcttcttctgtgatgaatgtgcatgcacatgcacatcatggggaaacaagcagaagcaaagaggtgaaaaaggatttggcagaagggagcagtgatatgaacactatagaggatgcatggaaggctttggttgctaagtcacctcaactgcaggtagatcagaaggcagaggaattcatttccaagtttcgtcaagatatgaggcttcagaaagagag

SEQ ID NO: 99129 - DNA, 657 bp, Glycine max
  Peptide Sequence Number=SeqID_215907
atgaacttgatttacgatttgcttttgcttcatctgttggcttcaactttcaactgttgtttaggtcgtcatggtgggactccactgcatcatgcagctaaaaggggctttgatagtattgttaagttacttcttttgcatggagccaatcctttagtcttgaatgatgattgtctaactgctcttgaggttgccaggaccaaaggacacagcaatgttgttcgtacaattgagagtcatctatgcttgttctctggttggctgtgcgagtttcatggacctgggtttctagaagtactagctcctcagttggtatcaaaaaaagtttgggtggttgttttgccagttggctcccgtactcttgccaagccttacaagttggagcttgccatatattctaggttgcaggacgcacaaccacgtaccgttattggactgtggaatgccaatttacaagatccaaagcttcaccagtctgatccgtcagtgacagttgttgatcgcattactaaaacacgcgttaaacttgggcctgcaagtgagaatgacaagcaacaacttacatggttttctaatgcttgcaaaggaattccacagccaagtcttatcccaccatgtgagattcatggattacatgacgtcattcgacttggttaa

SEQ ID NO: 99130 - DNA, 1710 bp, Glycine max
  misc_feature (3)..(3): n is a, c, g, or t
  Peptide Sequence Number=SeqID_215908
gtnactctagaggatccccgaaatcgcaggcggcgcttttaaacgcctaccagaaaaggctggacgtgggagtgtctggcaattcagacctgttaccgatccggctgcaacacgaccagtcagcctggcaattgcaacagcttgagttgcaaatccgccagaccgagcaaaagctcatgcacgatgctggcctgaccgaccagaataatactggcttgaacattgccgctgtcaatctttcgcaaatccttaaagcaaggtttgatcaaccacaagcgtatcaggacgccaaaacgatccagcattatgcactcacaaaccgtatggatatccagcgcagtctggcgcagtatgcaaaagcagagtcgcagttaaaactcgccatggcaaaacgctacccagacctatccatcagccctggcatgatgtatgactatggtgacaagatatggtctctaggcattaacagtatgttgaacctgtttaaccgctcttcggacctgtgggcgcaggctgaacaattacgccaaaacgaagctgcccgtttttatgcgttgcaacaccagaccatccagctttcggcacaggctcacctcaaatacagcaatgccgccaatctgctaattaccatgtcacagcagtatgaccagcagctaaaccgtaaaaaacagcttgaaaaacaatggaaacaaggcctgatagacaaaaccgagtacctgcaagctgaaatccagttttatactgcgcaacaacgcctgattacccagcaagcgaatgtcctgcgcgccctacaggaaatcgaaaacgtcatgcaaaaaccgattgtgctatcacagcgcgaaatggcatatgccaaacaaaagcaagaggtgccggtgatctttattgtcatcctgatctgggttatcgtatttcttggccgagatgagtatgaactgatacagaatgaaagcgaagaggaaatcgagagcccgatacatgtctcggaacaaaatggtttgcaggtagtgcaactcaatctggcgacccaaaaaaatagtggcatcagcgtgcagcccttacaggcatatgactatcacggcaatatcaaggtgttgggctccgtcatttcgattcagacgctggtcgactataacagccagtatcaattgcttaagtcacagctcgcgttagcagaaagtgtgttgccaaatcatcaacttcagtaccaacgctataaacaactgaatgatgatgataagaacgtctctgacaaggccttgcaagaagcgcaacttttggtgattaacgaccagacccacattaaaaccacacaggcacaactcaaggcattaaatgacaccattgtcgcccaatgggggcaacctttggcaatgcttgtcacgcagcatccctcccctggccctttgcatgacttgctgatgcagaagaaagtgctggtgcaggtcagttttccccttaactttaaagcgcctgaaggtaactcgagtattttaatcacacctatccaggacgagatcacacctatccgtgcagattacgtatcgcagtcaatacaaactgacatcagcaacattggcaaaacctacttctacagcgcgcctgcagattacttacgtgtaggcatgcgtgtcaatgtggtaccggctcaggcatcttcatctctgaaaggtgtgctcgtccccaatcaggcgattgcctggcatggcg

SEQ ID NO: 99131 - DNA, 432 bp, Glycine max
  Peptide Sequence Number=SeqID_215909
atgttcctcttcttcttctggcaccaccaccctgagccgctacgagaaccaaaagcgccgcgactggaacacgttcgggcagtacctccgcaaccacaggcccccactctcgcttgcacggtgcagcggcgcgcacgtgctggagttcctgcgctttgtccattcttcgggcacccgaaccctcctgcagcgtgcccttgccctctacggcaagcgtgggggagcctggatgcactcatagggcgcctcagagctgcctttgaagagaatggagggaagcctgaggctaaccctttcggtgctcgcgctgtcagactctaccttcgcgaagtgcgtgattcgcaagccaaggctaggggaattagctacgagaagaagaagcgcaagcgtccccaacaacctcctttgcctccctcaaataatgcaagttag

SEQ ID NO: 99132 - DNA, 1440 bp, Glycine max
  Peptide Sequence Number=SeqID_215910
atggataggtgctggtttaataagttcaagccaaaggataaaacacagtcttcaaaaaacaaggaaactaaaggcattgcaaaagaagggtcaaagcccctaacaaatgaagaagcaccttccaatgtgaccaaacagaaggttgcagctgcaaagcagtacatagaaaaccactataagaaacagatgaaggacttggaggagagacaggaacgattatgtgcaagaaacttctgcaaatggaaattgctacgtaatatgctagaaaaaaagttggctgatgctgaagtctctgaggaagagcagaacaatttgctaaaatattttgagaaaaaggagagggaatacatgcgccttaagaggcataaaatgggggctgatgattttgagcccctaactatgatagggaagggtgcatttggggaggtcagagtctgccgagagaaaacaactggtcatgtatatgctatgaagaaacttaagaaatcagagatgcttcgcagaggccaggttgaacatgtaaaagctgagaggaatctacttgcagaagttgacagcaactgcattgtaaagctttattgttcctttcaagatgaagagtatttatatctcataatggagtatctacctggtggtgatatgatgacgttgctcatgcgaaaggatatactgacagaagatgaggccaggttctatgttggggagactgtcttagctatagagtcgattcataaacataattatattcatagagatatcaagcctgacaatttgctgctagatagaaatggtcacatgaaattatcagactttggattatgtaaaccactggactgcagtaatcttcaggaaaaggacttctctattggtagcaacagaagtggagcccttcagagcgatgggcgtccggtggctcctaaaagaagccaacaggagcaactgcagcattggcagaaaaataggcgaatgcttgcctattctacagtcggaacacctgactatattgcccccgaagttcttctgaagaaaggatatggcatggaatgtgattggtggtccttgggagcgataatgtatgaaatgttagtggggtatccgcccttttattcagatgaaccaatgttgacttgtagaaagatagtaaattggagaagttatttaaaatttccagaagaagttaaactttcggcagaagcaaaggatcttattagtagactcctatgtaatgtggaccagaggcttggaaccaaaggggctgatgaaataaaggctcacccatggtttaaaggtattgaatgggacaaattgtaccaaatgaaagctgcttttattcctgaggttaatgatgaattagatactcaaaattttgagaagtttgaagaggttgacaaccaaactcaaccttcctcaaaatcaggcccatggagaaagttgcagtaa

SEQ ID NO: 99133 - DNA, 1836 bp, Glycine max
  Peptide Sequence Number=SeqID_215911
atgtcgaggggaagatctgatggatcacaaaaaaagcgtttagttgcttccatctgcgttgtggcaacttttcttggtttcctatcattgaaaagacttggctcatcatatttgggtgcagaagatgacactgatggcaagcaagatgaatcttcatcaagtttcaggcagggagatggggaggacaatattgttccaaagagtttccctgttgacaaactctttaagctcaagtatattagtttggtctgtgatgatcgtcattcagagttgattccctgcttagatagacatcttatctatcaaatgaggatgaagctggacctgtctgtgatggagcactatgagagacattgtcctcctgcagaaaggcggtacaattgcttgattcctcctccatctggatacaaggtccctattaagtggccacaaagcagagatgaggtatggaaagcaaatatcccacatactcaccttgcacacgagaaatctgaccagaattggatggttgtaaaaggtgaaaaaatagtatttcctggaggtgggactcatttccattatggagctgataagtacattgcatcaattgcaaatatgcttaacttttcaaacaataatctaaacaacgaaggaaggttgcggacagtgcttgatgttggctgtggtgttgcaagttttggagcatatcttctatcatctgatatcattgcaatgtccttggcaccaaatgatgtgcatcagaatcaaattcaatttgctctagagagaggaattcctgcatatcttggtgtcctgggaactaagagactcccttacccaagcagatcttttgagtttgctcattgttctcgttgtcgaattgattggcttcagagagatggattactacttcttgaactagaccggttgctcaggccaggaggttattttgcatactcatctccagaagcatatgctcaggatgaagaggatctaaggatatggaaagaaatgagtgaccttgtggggcgtatgtgttggaaagtagctgcaaagaggaaccaaactgttgtctggcaaaaacctccaacaaatgactgctatatggaaagagaacctggtactcgccctcctctttgccagtctgacgatgactcagatgcagtatggggagtaaatatgaaagcatgcataacaccttacagtgatcatgacaacagagccaagggtagtggattagctccatggcctgcaagattgactagtcctcctcctagattagctgactttggctattcaaatgacatgtttgaaaaggacacggaactatggcaaaggagagttgagaagtactgggatctcttgagtccaaaaatcacatcaaacacattgaggaatattatggatatgaaagcaaacatgggttcatttgcagctgctcttagagacaagaaagtttgggtaatgaatgttgtacctcaagatggaccaaacacacttaagctcatatatgacagaggccttataggaactactcatgactggtgtgaagcattttcaacatacccccggacatacgatttacttcatgcatggactgtcttctctgacatagaaaataaaggttgcagtaaagaggatctattaatcgagatggatcgcatgcttcggcctactggtttcgcgatcatccgggataaacagtcagtgattgattttataaagaatcacctaagtgctttgcactgggaagcaattgattccagttctaactctgtccaagatggcgatgaagttgttcttatcatccagaagaaaatgtggctaactagtgaaagctttagggacactgaatag

SEQ ID NO: 99134 - DNA, 189 bp, Glycine max
  Peptide Sequence Number=SeqID_215912
atggatttttcaagcctatatcatgttgtcaatagtggcactgtagtgccaaagcagtgtggagtgacactgggccgttacaaggaggccatagcatctcagtttagttgtgcggctgtcacaactgctatcacggagtggccgaaatcacggtggagcaggtgctttgtggacgctacattgaaataa

SEQ ID NO: 99135 - DNA, 777 bp, Glycine max
  Peptide Sequence Number=SeqID_215913
atgttggatgttaagtcattgcttgctgatgcaaaggcaggagctcctttgaatgcacttgagaactcaacaaatacaaatgctctgtcaatcaactctctaccttccttgtttcctgctgggagtacaccaccactttcaccgcgcagttcatctggttccccacgtaccacaaaacagagaaatagtccttcattaggatctccactaaaattagccagtgagcctgtaagggagagggaggtcattccacagttctacttcaaaaatggtcgtccacctccaagtgaaatgaaagagcatttcctatatcaaattgatagtcgattttatggtcatttggatggtctacaattacatgaatttaagtcttttacaaaagagctctgcaaacttccatcatttttctccactgcccttttcaaaaagattgatgtcaattttactggaaccatatcaagggatcaatttatagactattggattcggggtaatatgctagctatggatttacccacacaaatatataccatactgaagcaaccatatcgagcataccttgtacaggatgatttcaaacctgtcctgagggaactattgtccactcatcctggattggagtttttgcaaagcacgcctgaatttcaggaaagatatggccattatccaccttgtacagccttaggaaaggctgatggtggcttgggttcctttgagaaaccagctccatctaacaatctagaaagggagtgcaagaaaaagatggataacaaatga

SEQ ID NO: 99136 - DNA, 2637 bp, Glycine max
  Peptide Sequence Number=SeqID_215914
atggtactgggattaagatcaaagagtagaaaacgtgtttcaatccaagttcactacatcatccatgttctggagatcaagccgtggccaccttcacaatcactgagatctgttcaatcagtatttctgcaatgggaaaatggtgataaaaattctgggtctctgccatccactgctggcaatgggaaaattgaatttaatgaatctttcaggctttcagtgcttatgtgtagagaagcatccaagaaaggcaaacaccctgaaagtttccagaagaactgcttagagttttacttgtatgacaagacagtaaagagtcaactgttgggatctgccatagtaaaccttgcagattttggaattattaaggaaactaaagccttaagcattgtgtttaactgcaagaagagtttcaggaattcttcacaaccatttctttatgttactattcagccatttgatatagagagttccagctcatcaccaagcagcagcttatcaaaagaattgtcactagagaaggaaggaagcgaatctgtatcacagtcactaaaagatgatgacgatcttgaaattgcctcttttactgatgatgacagtgatgacatcccttcaaatacctcccaaactagcagatctgcttcagagattactggagaaacacaattgtctacttctgccatattaatagcctgcttccatttgatttcagacagcaccaaaatcagcagaggaagagaaggatctcatggagaatttgttctaccctcggaaagtactactgctagcttaaatggaaacacagagggtgaaccatccacacaattcagtggcatcaattctccctcttcgtctacagttctgagctcagatgtgggaattgctgcccatggaaggcctttattacctaaaatctccgaggaaattgttaaacttgctgatgcaagttctgaaattcaaaaaagcattcaacaatattctccttcatacatttcatcaagtatgaaacccaactttgaaagatctttacagcctcaagtgactcaagaggatagcatgactcaagaagatggcacaagagatcagagatttaataaagattctctggagaaagttagtaatgtttctaaaactggagttctggatgacaaagagaaaatgaaggagggaaggaaaggacaagaacagtttactatgaggaatgaacttttagaaaatgagctcgttaagaattcatctgatgatggttctataaagaaagggaaattcaatagtactactcttctgctaaacaagaaaacacatgaacatccaatgagtattttgatgaatgataaaacagaggatgtgacaaatgtgaagtctcctccacaatcttctgagaactatgggatgttcatcagcaatcagaactttgaaagatctttacagtctcaagtgactcaagaggatagcatgactcaagaagatggcacaagagatcggagatttaataatgattctctggaaaaagttagcagtgtttctaaaactggagttatggatgacaaagagaaaatgaagaagggaaggaaaggacaagaacagtttactatgaggaatgaacttttagagaatgagctcgttagtaatttatctgacgatggttctacaaagaaagggaaattcaatagtactacttttctgctaaacaagaaaacacatgaacatccaacaagtattttgattgatgataaaacagtggacgtgacaaatgtaaagtctcctccacaatctgctgagaactatgggatgttcagcagcaatcagacccatattcaggcagaggaaattaataccacaaatgatgttcatgttggtacttcttgccatgaagatgttaatgtgaatggaagctttcttaacaatgaaactgaattgaaggctgaagttgaaatgcttcaagaagagctaagggaagctgctgctcttgaagtttcaatgtactcagttattgctgaacatggtagctcatcaaacaaggtccatgcacctgctcgacgcctttctagattctatttccatgcttgtagagttgggtccccagatacaatggctagtgcagcccagagtgctgtctcaggatttgttttggtttctaaggcatgtggaaatgatgttccaaggttgacattttggttctcaaatttaatattgctgagagcaattgtgagcaaagaagttgaacgtgatggaaatggtaacactcttcacaaagaagaaaaaccttttcatagctgggaggatccagaaacatttttagttgcattggaaaaggttgaagcatggatattctctcgaattgttgagtctgtgtggtggcagactcttacaccatatatgcaatctgcagctgctaagagctctagctctaggaaagcctatgagaaaagatatcgtgttggtgatcaagatcagggaaatttttctattgatttatggaaaagagctttcaaggatgcatgtgaaaggatttgccctcttcgagctggagggcatgagtgcggctgcttgcctgtgatagctagattggcagatggtattgaatgcctttatagactgtaccagtaccctgtggttcctttttattgttgttag

SEQ ID NO: 99137 - DNA, 1164 bp, Glycine max
  Peptide Sequence Number=SeqID_215915
atggatgacgcactgagttggttacaggcctcaaggcaaagcgatattgccagcctgcaacgccttcggcagaccggcaaactcattaccaccgtcagcgagctggtgcatcagcttcagcgcgagcggggggccagcaatctgtggatatgttcagagggcaggctatacggcgagcagcggctcgccacccagccgggatacagccgcttctgcaacctgatcgccgccgcgctgcaggccctggccggattaccggcgttgcgccagcagattacgcaacagcagatcgcgcacgcgcaggccgttgcggcgttcagtaccattatccgtagcttactgaacctggtctttgaggccgccgacaccgccagccatcctgacattacccgcgcgctcattgcgctgttcagctttatgcagggcaaagagctggcgggacaggaacgcgccctgggagcggctggctttgctgccggacaattcagcgcggagcagcgcagcgccatggtggccttaattgaagcacaggaacaaagttttatgaccttccagcagtttgccgatgaggcagttttacaccactggcagccgctggcgcaggccagtcgtgaaattgaacggctgcgacgcattgcctgtaccgacggtcggcgggacgacagtggcgcgctgcactggttttcgctgctgtctcagcgcatcgaccaaatgaaattgctggaggatcaactgtcagccacgctgatgttgcgctgccgcgaggcgatcacactggcacagcatcaggcagctgaacccctgaatgtggcgcagtcgggctgcgattttacattatatgtctccggggtggactggctgcccaccgagtccggtgcgctgaacagcgacgggctggcaccccagctgggtcgttcactgctgtcgttgatcacggagcagtctcagcgtttacagcatcaggccaatgagctggccaccctgcgcgccacgctggaagagcgcaaactgctcgaccaggccaaaacctggctgatgcagcagcatgggctgagtgaagagcacgcctggcaacggctgcgtaaaagcgcgatggatcagaataaacggctaccggaaatcgcccaggcgatcgtcacggtggcagccacaatgaagagataa

SEQ ID NO: 99138 - DNA, 3061 bp, Glycine max
  Peptide Sequence Number=SeqID_215916
atgagcaaatcgccagtttcactgtctcgacgtcaactgctgttatccactgccgccgctggcgggctgtggctgttgccgggattgcgcaacgccgtatgggcggcgggttccgatgcgccagaaaaagccaccgtgcgggtgggatttattccactgaccgactgtgcgccggtcgtcatggcctcggtgaaaggcttcgacaaaaaatatggtctgacgctacagcccagtaaagaagccagttgggcagccgtccgcgacaaactgatctccggtgagctcgatgcggcacacgtcctgtacagcatgatctatggcctgcaactgggcgttgccggccctcagcatgcgatggcgaacctgatgacgctcaataacaatggccaggcaatctccctgtcgaaccagcttaaagcgcaaaaggtcaccgatgccgccagcctgaaaaagaccatcgacagcaaggccaaaggcagtctcacctttgcgcatacctttccgaccagtacccacgcgatgtggctctactactggctggcgaatgccggtatcaatccatttgatgacgtgcgcactgtcgtcgtgccgccgccgcagatggtgatgaatatgaagattggcaatatgagcggcttctgcgtgggcgagccatggaatcagcgcgctatcagtgatgatattggttttaccgtcgctaccagtcagcagatttggcccgatcaccccgaaaaaattcttggcacccgcgccgcgtgggtgaaagagaaccccaatacggcgcgcgcgctgacggcggctgtcctggaggcggcacgctggatcgatgcctccgatgataaccgccgcgaaacggcgcaggtgctggccggacgcgcctggatcaacaccaaacctgagattctgcagggtcgcatgctcggccagtacgaaaacgggcagggacagaaatggcaggacccgcatgcgatgcgcttcttccatgacggcagcgtcagtttcccgtatctgtccgatggcatgtggttcctcacccagcttaagcgctggggaatgctgaccgaggatccggactatctgggcgtcgcaaagcagatcaaccgaattgatatctacaaacaggcagcgagcgccgtcggcaacatcacgttgcccggcagtgagatgcgcagcagcaccctgatcgacggcaagactcgctccctgacgcagcctgagacgctgcccacccgggccacggtggtgccccttcagcgtgccattcccgcgctgtgcggtgtgatgcttctgcttctgatctggcagatcgcggccctttccagcaaaggctttcccggcccgtacgccacctgggaagcggcgaaaatcctgttcgcagatccgttctataacaacggccctaacgatcagggcatcggctggaatgtgctggcctcgctgcagcgcgtcgctatcggctttggcctggccgcgctggtggggattcccgcaggctttctgctggggcgttttgcctttgtggcacgcatgttcaatccggttatcgcgctactgcgtccggattacctcaatgtggcgcgcgtgctgcaactgtcggaatggaccatcctgcgccgcatcctgtttcccgccgttctgcctgcggtgctgaccggggtccgcctgtcgattggtatcgcctggctggtgatcgtggctgccgaaatgctgacgggaggcctggggatcggcttctggatctggaacgagtggaacaacctcaatgggaacactatgcaacctatcattcgtgtacagcaggtcagccagcgttttaccacttccggcggcgattttctggcgctcgataatgtcagctttgatattcatcagggggaaaccctgagcctgatcggccactccggctgtggtaaatccacgctgctcaacctgatcgccggtttaacccgacctaccagcggcgtcctgttatgcgataaccgcgaagtcaccggccccggccctgagcgcgccgttgtgtttcaaaaccactcgctgttgccctggctgacggcgtatcagaacgttgagctggcggtagagcaggtgtttaaaggcaagatgaacaaggcggaaatgcgtgactggatcgagcacaacctgaaccaggtgcaaatgagtcatgccatgcataaacgccccggcgagatctccggcggcatgaagcagcgtgtcggtatcgcccgcgcgctggcaatgaaacctcgcgtgctgctgctcgacgaacccttcggtgcgctggatgccttaacgcgcgcgcatctgcaggacagcgtcatgcgcatccagcaggcgctgaacaccaccatcgtcctgattacccatgatgtggatgaagccgtgttgctgtccgatcgggtactgatgatgaccaacggtccggcggcgcaggtgggcgatatcctgacgatcgacctggacgacaccatgagacaacggctgctggttgcgggtaacgggatggcgggcatgcacatggtagaaactctgttgcagctggcgccgatgcgttacgacatcactgtgattggccgtgagccgcacggcaactataaccgtgtgctgttgtcgccgctgctggccggagaaaccaccgttgagcaaacgctgatccacgaccctgactggtatcaccgtcacggcataacattgcgggtgggagagacggtggaacaggtgaatattgctgagcggaccttacgcaccgaccagcgcctgctgcactgggaccgcctggtactggcgaccggatcgcagccctgcaggccgtctgttccaggcagcgacctgccgcatgtcagcacgtttcgcacgctgcaggatgtgaacactttgctggccgggcacggtccggtagtggtggtcggtgggggctatctgggtattgaagccgccgccggacttcaggcgcagggacgtcaggtcacgctgattcatcgtcaccttgcggcgatccgcacggatagcgtgatcctccacgatggccgtgtgctggcggcgcagcaggtggtgatggccattg

SEQ ID NO: 99139 - DNA, 934 bp, Glycine max
  Peptide Sequence Number=SeqID_215917
atggatgacgcactgagttggttacaggcctcaaggcaaagcgatattgccagcctgcaacgccttcgccagaccggcaaactcattaccaccgtcagcgagctggtgcatcagcttcagcgcgagcggggggcgagcaatctgtggatatgttcagaaggcaggctttacggcgagcagcggctcgccagtgagcaggatgtgacgcgctgccaacgggatttttgccaggccttacccagggttgaagcccagccgggatacagccgcttctgcaacctgatcgccgccgcgctgcaggccctggccggattaccggcgttgcgccagcagattacgcaacagcagatcgcgcacgcgcaggccgttgcggcgttcagtaccattatccgtagcttactgaacctggtttttgaggccgccgacaccgccagccatcctgacattacccgcgcgctcattgcgctgttcagctttatgcagggcaaagagctgacgggacaggaacgcgccctgggagcggccggctttgctgccggacaattcagcgcggagcagcgcagcgccatggtggccttaattgaagcacaggaacaaagcttttcgaccttccagcagtttgccgatgaggcggttttacaccactggcagccgctggcgcaggccagtcgtgaaattgaacgactgcgacgcattgcctgtaccgacggtcggcgggacgacagtggcgcgctgcactggttttcgctgctgtcacagcgcatcgaccaaatgaaattgctggaggatcggctgtcagccacgctgatgttgcgctgccgcgaggcgatcgcactggcacagcatcaggcagctgaacctctgcatgtggcgcagtcgggctgcgattttacattatatgtctccggggtggactggctgcccaccgagtccg

SEQ ID NO: 99140 - DNA, 972 bp, Glycine max
  Peptide Sequence Number=SeqID_215918
atgggtatcgtcaaaatttcggatttaatgcatgagaacctgcgcatcgccagcacggcgctcagtcgttcgatcaacgcgcaggcggagcactggatgaaaatcggcatgctggccgaactttatccgcagctcagccatcaggaactgacacgcctgctgatgcgggtcgaacggaatcgcgcaatgagtattaaactgcataccgctgaagaaattgaacgggcgcgcgccgccggtcacgccgccgccaaagtcctggagatgatcgcgccctgggtgaaacccggcgttaccaccgatgaactggatcgccgctgtcacgactatattgtcagtgagctaaaggtcattccggctaacattggctatcagggttacacccgtaccgtttgcacctcggttaatcacgtggtgtgccacgggattccgggcgagaaaaagcttaaagacggtgacatcgtcaatatcgacgtggcggtcatcaaagacggctggtacggcgacaccagccgtatgtattttgttggtcagccgtcggtacgcgctaagcgcctggttgacgtgacgtatgaatcaatggtggcaggcattcgggtggtgaaacccggtgcaacgctgggcgatatcggtgcggctattcagcaggtcgccgaaaaggccgggttttccgtggtccgcgagtattgcggtcacggcgtcggcgagatctaccacagcgatccacaaatcctgcattacggcacgccgggccaggggctggcgctgcaggctggcatgatttttaccattgagcccatgattaacgccggcaaagcgggcaccagcgtgctgtccgatggctggacggtggtgaccaaagatcgctccctgtccgcgcagtgggagcacactatcgccgtcacggataccggcttcgacctgctcacaccctggccggagggtaccggtgattacgccgcgatcgtttaa

SEQ ID NO: 99141 - DNA, 249 bp, Glycine max
  Peptide Sequence Number=SeqID_215919
atgctgcaggatgaagagggcatccgtgtggccgtcagcagctacgtgttctgtaactataaaatcgccacctactcgacgttgctggtggccgcagagcaggcggaagagggggaggatgtcaggattgtgcggcgcattctgcagcaggaaagccagatggccagctggctgctgcagctgctgccacaggcggcagaggaagccattgtgctgcgcacggaacctgagctttccggcacggattaa

SEQ ID NO: 99142 - DNA, 1032 bp, Glycine max
  Peptide Sequence Number=SeqID_215920
atgaataacattacgcctcccgcacactgcacgtttgaacctgatgactggctgcgtctggcgcgacagtggcatccggttgcccgttcctgtgatatcgccggcgcgccgaccaaagcggtgctgcttgacgagcagctggtgctgtatcgtctgcagggtcaggtggtagcggcacgcgacgtttgcccgcatcgtggcgtcccgctgacgctgggttttcatgatgaagagggtatcgtctgcccttatcacggcttgcgcttcggtgccgatggccgctgcaatcgcatcccgtccagccctgaccagccgattccggccaagctcaatctgatcagttacgcggtggaagaacgctttggtctgatttgggtgtgcctcgcgccggatgctgaccagcccgcgccgctgcccaccatgccgcactgggatgatgccggttttcaacagatcaactgccccggttttgacgtcaacggctttgccggacgccaggtggaaggttttctggatgtggcgcacttcgcctgggtgcacacggaaaccttcgccgatcccaacaaccagctggtgcctgcctataacccggtcgagaccgagaccggttttgccgtggattactggagttcagtgagtaactttgccgctgacagtccgcagcaggcgccggaaggatttagctggctgcgtcatttcgagatgcatctgccgtttaccgccacgctgaccattcatttccccggcgaatcgcgcctggtgatcatgaatgccgcgtcgccagtatcggcgcgcaaaacgcgcatgtttgcgcccatcgcgcgtaattttgacctgcacatcccggtcgaagaggtgcacgccttcaatcagcgcgtgttcgaagaagatcgcctgatggtggaaacccagcagccggagcgtttgccgctcgacctggctctggaagcgcatattccggccgatcgcagctccattgcttatcgccgcggcctgaagcgcatgggcttcggcgaatttttcctggtgtaa

SEQ ID NO: 99143 - DNA, 318 bp, Glycine max
  Peptide Sequence Number=SeqID_215921
atgcactctccttatcctcacctcgtcaccatttttcttcatcatttcaaaattcctttggaagatgaaccatttgttcaagtaaaaaggtcttttgctattagtgctggtgcgattatctcgtttggttaccgtaaggatgatgatggtcagtgggttcggaaacaaaacttacctcaaccaatccctgacgaatgtactctttctcctccaccgcaaagggttgattcctcttcacttctgaacgatgttctctctgaacttcacagtgttcgagcttttgtgggtgaccgatttgatgctatggatactcgctag

SEQ ID NO: 99144 - DNA, 186 bp, Glycine max
  Peptide Sequence Number=SeqID_215922
atggaagaaaagagtgaagtttacaagcattactctactgatgctggtgattggagactggttgtggctaggcttctactgatgctagcttgtactgaggaacaatggcttacaattctgcagtacaaacacaaaatcagaaacaactattcaaagtcattttatgtttaccaacttggccaatga

SEQ ID NO: 99145 - DNA, 703 bp, Glycine max
  Peptide Sequence Number=SeqID_215923
atgggtagcttattcctaggacaaataaaaaagcagacatcaactttcctacaagaaaagttcaaatctgctaggatgacgtttactgatgttactgaagcagaaatgctggctgaggaagcaacaaataaggatgattgcagccctgatgccaaaactatgactagaattgccgaggcatcatttgacatagatgaatattggaggattgttgatgttcttcacagaaggttgtataacattgattgggatcaatggaggcaatcttacaaagcactagttcttctggaattcttgttgacccatggtcctcgagagtttgctccagaatttcaatgtgatgcagaagttattgaagaactaggaatttttactcatattgatgaaaaagggtttaactgggggtcaagaatgctaaaactgtcagagcaaatactcaagcttttacaggatgaagaagctctcatagaagcacgtttgaaggctctcaaaataacaaatgaaatacaaggctttggaagttcattcaactctccaacttcatcatcatcatcatcatcatcaccttggtctttatcatctgaagcgtcacaaggatcttcatctttctattcattttccaccacaagtacccctgcttacacatttgattccaatgatcagctaaacaaacaccactcaccaacctccatagcaaatgatg

SEQ ID NO: 99146 - DNA, 2838 bp, Glycine max
  Peptide Sequence Number=SeqID_215924
atggcatttgctcgtgctgttgctgctggttttgacattgactatataccgcctttgatgtcatttgctgaatgctttggtgcatctcgcatgaaggatgcatgcacaaaattcagggatctttggagaagaaaacatgaaactggacaatggcttgaaattgaagctgctgaaacgatgtccaatcgctctgacttttctccgttaaatgtttctggcattatacttcccagtatggcctctgcatcccatactgaattggactctgagagtaatgggaaagcaagttcagatgtgcctccaatggaccgccaaccatctgtaggcaaccatgataatattcaaggtcaatttccacaccatatgttccctccttggcctgttcattctcccccaggttctgttccagtcttttcaccatatccagtgcaaggcattccctactatccagcatatccaggaaacagtccatttatgcagccaaattattctcctatggaggaccccagactaactgctggtcaaaataacgggcgcagaaggcattccatggatagtagacacagcaatactgaaccagaaacgcaggatgaagtggatatggagagggaaggcttgcatactggagatcaaaggaagaaggataggcgatcagctagacagaaatctggcatggtggtcattcggaacatcaattacataacaaaggcagaaaattctggcagtggatcatattcagattctgcctcagaaactgatgaagataataaggaatctgtgaagacctctaagagaagggaacccggaaaagaatctttgaagaaattggattcatctgatatggaagaaactgagcatgggaaggatgctgatggaggccactggcaagcattccaaaattgtttactaagagatgttgatgaagatagacatgccattgacaaagaccaatttgatcaggaaaaggtgcatgacgtgagaagaaaaaaacatattgcaatcaatgatcctttagtttttaatgaccgggaaatgcatgaagtccaaggaagttctgctatagatatgcatagcattagcaaaggattgactcacatgcctaagacatccaatgatgatttattgttatctgcaagtgcaggacagtctggtgatggttggtctggagatgatgtacaatctttagaagcaaatggaaaaaggggtggttataggagggctgcccgtgatgatttcatcatttccaagcaagaaaatcaatttggcaatgcttacccttcctcagatgttgaaacttcactaggttattcaaacaataaactagaaaggaagttgtttcatgatatgaatgatgattcctacatattggagcatagatcaatggaagtcaatgatgcaggaaatgttgagagaaatgctattgacatggactctgagatcccaatggtgcagcgatcttcagatgagataaactgtatcaattatgagccagatgaattgagcatgttgcctgaacgaggagctgaaagtgcatcaatgagttatgaccctgctttagactatgaaatgcaggcccaggctggtggtactttacaaaataagaacaaagaggtattgactgacaccaaaccaggatctaagaggttggataaggaggcaaaatcaaaacttaccccaaataattctgataaaagaaagactggtgggccgataaggagagggaagacttctaaacctaatgctttggatgaagcacgagcacgtgctgagagcttacggaactacaaagcggatctccagaaaatgaagaaagagaaggaagaggaagagatgaaacgcctagaagccttaaagatggagaggcaaaagaggattgctgccaagagtagctcaatcactgcacagtcgccatcacagctatccaagaaacaacttccaacaaaactttcaccaaactctcgtaaagggtcaaaatttagtgattcagagccaggagcatcctcgccccttcaaagattccccgtcagaactgcatctgttggatctaatgattctttgaaagcctcaaaaaccagcagattgatttccggaagccacttggatagtaacaaattaagtcgatcagtgtcttcgttgcctgaatctaagatagagaaggatgatagcacaactgatactaaggcatcaatggcaaggattagaagattgtcagaacctaaaatgagtaacactcgtcagacttcctcagttaaaccacatggcactggaacaatatcaaagactaaagcagctgatgcacctgagagcaaaaagatttctgctattgtaagccatgataaaagcaagacagcagccctcccagaactgaaaatcagaacatccaaagcaagtgacgttcctcagaacagaacagcggtcaaagagaaggcacataagttgaatgataacaagtcttccatgaattcacgaggtaccatgccgaagaaaaaggaaattggtacttcatccaatgatgatggagatgataatcctgtagttgagaagactgttgtgatgcttgagtgcgagaaaccttatgttcctcctattcatggttctgaagaaaattttgatataccaaagaaacaatatgataatgatgaagtgacggaaaaaacagaaacaacatccaattatgctgctattcgtgctcctgtttcaccgtttagcatggatataacagataaagaaacctcagagaaccaatcacacctgcaacccatatctaccgagctatgtttcactaagcgcaaggatgtacttccaattcgatgtgcttattgcaaattgtggaaatag

SEQ ID NO: 99147 - DNA, 267 bp, Glycine max
  Peptide Sequence Number=SeqID_215925
atgctagcatgtcaatcaggaaatgcagcaggggcaaagcattctagaggctctgatctttccgttagaagtgaaaggattgattctgatactgagtttttgatattagcaagcaatggcatatgggaggtgatgaaaaaccaagaggctgtgaatctgataagtcacatagaggatccacaagaagcagctgaatgcttggcaaaggaagctctaattaggatgagcaaaagcagcatctcatgcttaatcattcgctttgactga

SEQ ID NO: 99148 - DNA, 574 bp, Glycine max
  Peptide Sequence Number=SeqID_215926
atgggattctatcttaatctcaaacgcaaggcgttccggcttaaacggtttctgctaggacatgaaggcagaaaaagaaaatacaagcaggcaaaaaaaccttcatggatgaggccaatgacatatggttatcaagtggtggagagtaatatggccagagatggttctgatgactctgattttgattcagttgtggcacagagagaggaaatggatcaaacagaattgtggtattttggaatctttgacgcactaattggagacaaagttaccaagtacatgcagtcttatttctttgacaagatgcttcaagagactcatataaggagaaaaagcaaggaagctctgaagagagcttaccttggtgtaagagcaatgatccgagagcaacacaaattagaggagacatgcagaatgggttcagcatctgttatgttgatcgatggagaaaaacttgtggtagccaacatgggagattacagaattgttgtctgcagagatggcatagctcatcagacaactggcacatacctacaatcagcgaaaatacattggtctcgcagattcttcgcag

SEQ ID NO: 99149 - DNA, 147 bp, Glycine max
  Peptide Sequence Number=SeqID_215927
atggaggtgactgttttcactcctgcactggaaggaattaagcttgtaaaatcagagcaaggagaaattttgacccagcctttcttggatgcttgcaagcatatacttcctgttataggaacatcaatggccctttacttcttttga

SEQ ID NO: 99150 - DNA, 351 bp, Glycine max
  Peptide Sequence Number=SeqID_215928
atgagggaaagggaaatgataacaacgatagacacattgcctgtgttctactatgagaagatggtgggatacatgccttcgagttttgtagatctagtatttgcaggcgagaggattgaggtacgcctaagaaggggcaaatttgattatgttgcttcaatgatttctggcaataggaggcctagggctggtggagaacagaaaaaggagggagacgcccatgccaagattgtagtacccacatggccaagctccccgcagacccctcacaaccccatgtatcagtatccccaacaccaatataattacttggcaaatatcggctctcccccttgcccaacgcccctctaa

SEQ ID NO: 99151 - DNA, 684 bp, Glycine max
  Peptide Sequence Number=SeqID_215929
atggatcctttttggttggatgggtctttggctcggaggatggagttattcaagtggaaagtgaaaccggtggagactcttatgctcataaggtgctcatggaggatagggaaagtagtgggaatcatgaaggatcacgagtggaaggagggtggtaagttaattgaaacgataatagacgaggaggatgaaaaggagatacaaatcgggtttccaacagacgtaaagcacttggcacacattggagctgaaaatgccaaagcaagtcaaccaagctggttgagcgagttcaaggaattatcagaaggtggaacagtgacgaagggcacatctgaaggtgatgcatcaggtattgtagaagatgatgctaatagcaaaggtgaaggtagcaggcgaagccgaaagtcaaggcctcgttctacagagagccagtcctcgatgactccagacatctgcaagccgagccgacgacaccactcggaatcttctagaaggatgagtcgtcactcgtcggaagaagagaaaacatcaaaacctacgcatcgcaggaagagcaagacgtccgaggaaaaagacgagaaagaaggttcctccaggagggctcccagatctcgaagacagcccaagggagattccttaactgatttctccttctcagattctgggcctagtgggcccaactag

SEQ ID NO: 99152 - DNA, 720 bp, Glycine max
  Peptide Sequence Number=SeqID_215930
atgtccttactgagcgccagtttcaccgcctcgacgccaattgccttggcctcctcgtcgtctctgtcatcaaggccaaccgcacgctctatactgggcgatggaaacacctctgattccatctccactgtgggtgtggctgactcttctccatcttcttctggctacgcaggaaacacctctgattccatctcctctttgaagctcaatctcctggaacttgaagctggtggaggatttgtgaatctctcgcttggtcttgagaatttgcaaggaagatggaaactcatttatagcagcgcattctcgtctcgaactctcggtggaagccgtcccggtcctcccataggaagactccttcctattactcttggacaggtttttcaacgaattgacatcttgagcaaagattttgataacatagtggagcttcaattgggtgctccttggccactacaaccccttgaagtaactgccacattagcccacaaatttgaactcataggatcttcaaagataaagatagtatttgagaaaaccactatgaagacagctgggaatttgtcacagttgcccccattagaggtgcctcgaattcccgatgcattgaggcctccatctaatacgggaagtggtgaatttgaagttacatatcttgactcggatacccgcatcacaagaggagatagaggcgagctaagggtctttgtgattgcttga

SEQ ID NO: 99153 - DNA, 231 bp, Glycine max
  Peptide Sequence Number=SeqID_215931
atgaagagagattgtcatcctttgctgagaggtggaagaagatgcaataaatacactcctcacattctttcttcagctgagatggaatcattatcaagcatttgtgaggctctattgcctcctctgcagttggactcaacaaaaagcaagactgtgcaacacttctggaaagcttctggctctcaattctctatccctcatgagggtcttgccaatcactcagaacactga

SEQ ID NO: 99154 - DNA, 2271 bp, Glycine max
  Peptide Sequence Number=SeqID_215932
atggctcccaccccttcttcgaaacaaaaccaccccactcaattgaagactccacagtccaagcaccgtctcaacttcaatgccctcaaatcagcgccacaaacacacccttctcccaaccctaattccgttgcaaacaaggaacccccaccagaacacccaattgaagtcattgccagaatccgtgactacccagatcgaaaggacaagcctttatccgttcttcaaaccagttccaactctagttccatacgggtacgcgcggatttcgggtaccgggactttaccctagatggggtttccgtgtctgaggaagaggacttggatgtgttttataagaaatttgtggagtcaaggatccatggggttaagctgggggacaagtgcaccatcatgatgtatgggccaactggttctgggaagagtcacaccatgttcgggtcctccaagcaggcagggattgtgtataggtctctgagggacattcttggagatggggatggtgcagatggagattctgggggtgggttggggacttttgttcaagtcactgttttggagatttacaatgaggagatctacgatctcttgtccactaatggaggaggtgggggaggaggctttggatttggctggcctaaggggggtagtgcttcaaaggtgaaactcgaagtgatgggaaaaaaggctaaaaatgcaacctatatatctggaaatgaagcagggaagatctcaaaagaaattcagaaagtggagaagcgaaggattgttaaaagcacactttgtaatgatagaagttccagaagtcactgcatggtaatccttgatgtcccaactgtgggagggcggctaatgcttgtggacatggcaggatcagaaaatattgaacaagctggtcaaactggatttgaggccaaaatgcagactgcaaaaatcaatcaaggaaatatagctctgaagagagtggtggagtccattgcaaatggcgattcacatgtgcctttcagggacagcaaacttaccatgcttctgcaggattcatttgaagatgataagtcaaaaattctaatgatactgtgtgcaagtcctgatcctaaggagacacacaagacaatctctacacttgaatatggagcaaaagcaaaatgcatagtccgtggccctcatactccagtcaaggacgatgaatcttcttcagctgtcattttgggatcaagaattgctgcaatggatgaatttatcttgaagctacaaatggaaaccaagcaaagagagaaagagcggaacgaagcccacaggaagcttttgaagaaagaagaagaaattgtggcattaagagctaagctaaacatggcagaaggcaaaggaactcctccaagtgaggaagaaattaacctgaaggtaaacgaacgaacccgacttctgagacaagagttggaaaagaagttggaagagtgccaaagaatgactaatgaatttgttgaattggagaggaagagaatggaagagaggatactgcagcagcaggaggaagttgaaactctgagaaggagactggaagagattgagttgcagctgtgttcaaagcaagggtgtaaagaggaaaatgagtcaaaagatgtggagtcaagtgggtttatgaggaggctattgcgtgtttacaaaagtgaggatgatcctggaatggtgaagtcaatggatttggacatggatgatcaagaaccccttggccgcgaggtaaacatcgttggtggagttatgtgcaggagtgattacaatgttaagcaggactcttcaaatcaacctggtccgaatgctttgactggtgtaaaagaagatgctcatgttttttcaccaaactttggccaaagggcgtgccttagtacagtatatgaggaagaaggagaaggagaaggggaagatgaggaagtggagaaaggaataatagaggaaaagagagtatgtagtgttgaaaagcctagtggtgcaggctccttgggaaccttaaacctgtctaacacaagtccaaacaaagaggaattttgtttaaaggtaagttcaggggataatgactctagactcctgagaattcaaaatatattcactctgtgtggcaaccatagacagctctcccagcacattggaacaccagtgtccacaaaaaagaggtctgatgaaacatttgagttttctccagccaatgacaaggattccattttcaaaacctccaacaaggagaactttgaaccacatcatgttctaggaaattag

SEQ ID NO: 99155 - DNA, 153 bp, Glycine max
  Peptide Sequence Number=SeqID_215933
atgaggggtggaggttgcatagcaacttgcccaggcaagctgcttgcttcctctagaagttaccttgctttcctaggcgagcttacgaaatgtgcgataatcgatgttaagcagcttaattcgactagcaagaatccaaatgtttgcaaatga

SEQ ID NO: 99156 - DNA, 768 bp, Glycine max
  Peptide Sequence Number=SeqID_215934
atggccgaaataatatctagcttctggggtccggtcacatcaacaacagattgctgtgaaaagaattatgcatattcatcttatattgcagaattttataacacaatatccaacattccaaccattcttttggctcttattggtcttataagtgctcatacacaacggtttgagaaaagattttgtgttcttcacctatcgattatggcatttgccattggaagcatgttgtaccatgctacactacaacatgtgaaacagcagagcaatgaaactccaatgatgtgggaaattctgctatacatctacatcctctattccccagattggcactaccctcgtacaatgccaatcttcctatgtttatacggtgccattttcgccatagttcattcagtgctccgttttggaataggcttcaaagtccactatgtaattctcagcctcctctgcattcctagaatgtacaagtactacatttacactgatgatgtgtgcgctaagtgccttgcacgactttatgtagccactcttctgttgggaagtttagcttggttaagtgatcttgttttctgcaacaagatatcaagttggccaattaatccacaaggtcatgctttgtggcatgtcttcatgggcttcaactcctactttgctaacacattcttgatgttttgccgtgctcaacaatgtggctggtctccaagaattgtccgtttaatgggtgttttgccctatgtcaagattcagaagccaaaacgacagtaa

SEQ ID NO: 99157 - DNA, 1812 bp, Glycine max
  Peptide Sequence Number=SeqID_215935
atggcccttcatcaacagcttctcaaatctttctttggacaacagagaaaaggttctgcagaaatgtgtgatgacaatggtgaaaacccagcatgggaagctataggatatcaagttgactctgatgggatcacaacaacaagcaatgttcacagagaaaggcctcttgaaaagggaatagtggaagcaatgaaagagagtaacttgagtctgcctaagtctcttattgagaaaggtcttgaagttgctatagattctaaaaacaataccctgaatataaaatgtgatgtagtaattgttggttctggttgtggtggaggagttgcagcttctattctagcaagttcaggcttgaaggtgcttgttcttgagaaaggaaactactttacccccaatgattattcttctctagaagggccttctctgaatgagctttatgagttaggaggaacttttgcatcaagggatgggaaaatggcaattcttactgggacaactgtgggtggtggttctgctgttaattgggccgcatctattagaacaccagattttgtgcttgaggaatggggaaaagaccacaagctatcactcttttcaagccatgagtatctttctgccatggacatggtgtgtaaaaggattggcgtgaccgataagtgcatcgaggaagggctgcagaatcaagttctcagaaaaggttgcaagaatcttggtcttccagttgattacgtgccaagaaactcatcggaacgtcactactgtggctcttgcaactatggttgtacaagaggggagaaacaaggaactgaagttacatggcttgttgatgctgtggatcatggtgcagtgatactaacaggaacaaaagctgagaggtttatattgggaaagaagaacaaaggagggggtgtgagaagaaagaaatgcttaggagtgatggcaaatgttgtaacaaacaacatcacttggagacttaaagttgaggcgaaagtgacagtttcagcatgtggagcccttttcacacctcctttaatgatctccagtggattgaagaacaagcacattggcaagaaccttcatctccatccagtgctaatgtcatggggatattttccagactcaaattctgaactcaagggtaaatgctatgaggggggaataatcacttcagtccacaaggtggtatcagaggactactccaaagtaaaagccatagttgaaactccagcattgggaccaggagccttatctacactgattccttgggtgtctggacttgacttcaaagacagaatgctcaaatattcaaggactgttcatctgatcacaattattagggatatgggctgtggagaagttaggagtgagggaagggtgcattatgagttggatgaatcagacaaagagaacataagggatggagtgaagcaggcactgaggattctaatagcagcaggtgctgttgaggtaggtactcacagaagtgatggacatagaattgaatgtaatgggaaaaatgaaaaggaattggagaggtttgtggaatcagtatatgcaacagaagggttaatgtcacatgaagaaaagtggagtatctatagctctgcacaccaaatgggaagttgtaggatgggaatgagtgaaaaggaaggtgcagtggatgaaaatgggatgagttgggaagcagaaggactatttgtgtgtgatgcaagtttgcttccaactgcaattggtgtcaatcctatgataactatacagtctactgcatattgtgttgccaagagaattgcagcctttttgaagatagaatag

SEQ ID NO: 99158 - DNA, 501 bp, Glycine max
  Peptide Sequence Number=SeqID_215936
atgggtccatctctcttggcctttttgccctcccaccgaagggaaggttgtgacagaaagggaagagaaaaacttagcttatttacaagggcgagggccacgggtggagcggaccaatcaagattacccgaattgggtgcaaccatgttccccagacttcaaattgaaaaattggcagatcatagagcaactggagatttctatttcgaatttgatgtagtcaaatctgataatgagtcctatgaaagcagtgatactaaggacttggatgttgactttgagaagccagtcaatcaagtcgaggaggaagaaggtgatgattggggattcccctcggatctgaaaagaatagtggaacgggaagaaagaaagataaagtcgcatcaagaagagactgaggttgttaacttgggcaccagtgaagagaaaaaggaagatattcctggtttgagcttagaaattgtgcaacacaagctaccaatgaatctcgagtgctccccg

SEQ ID NO: 99159 - DNA, 1362 bp, Glycine max
  Peptide Sequence Number=SeqID_215937
atgcagaaggatactagtaccaccgccccatcaaccacaagtggtcgggttaggcaccgaaaacgctcaaatgagaaattgatcctgaaatttgaagagaacatggaaaagtgtcaaaactcaaaagttattccggaagttagtaaagcaaatgggaccaagttactggttaatgacaaaagcaaatacaagtctatgctaattcgagcatattcatctgtatggatgattggcggctttgttttgatcatttatatgggtcacctctacatcactgcaatggtggttgttatccaaatcttcatggcaagggagctgttcaatctactcaggagagctcatgaagataggcagctgccaggatttaggctattaaattggcattttttcttcactgcaatgttatttgtttatggacgaattctgagtcaatgcctggttaacacagtaacttcagacatggttttatattggctagtgagcaatcttataaagtatcacatggttatctgctactccctgtacattgcaggatttatgtggttcattctcacgttgaagaagaagatgtacaagtaccaatttggccagtatgcttggacacacatgattctaattgttgtatttggccagtcctccttcaccgtggcaagcatttttgaagggattttctggtttcttctcccagcaacacttattgtcattaatgatattgctgcttatatctttggtttcttctttggaagaacccctttgatcaagttatctccaaagaaaacttgggagggttttataggggcatctgttaccaccatcatctctgcatttatgcttgctaacatcatgggtcgctctcagtggctaacgtgtccaaggaaggatttgtcaactggttggcttcactgtgatcctggtccactgtttaagccagaatcttatcccttacctggatgtatttctcactggttttcttggaaagagatatcaatcctaccaattcaatggcattctttatgtctaggcttgtttgcttcaattattgcaccttttggaggcttctttgcaagtggctttaaaagggcttttaaaataaaggactttggtgatagtattccgggacatggtggaattaccgacagaatggattgccagatggttatggccgtgtttgcatacatatatcatcagtcatttgttgtgccgcaaactctctcggttgaaatgattttggaccagatgtttaatttatggaactgccgctgttcgcttcagatatcgatgaacctaacattcgatgagcaacaagctctatattggaggcttggggaaattttacaacaggggtttgctaggatgtcttag

SEQ ID NO: 99160 - DNA, 117 bp, Glycine max
  Peptide Sequence Number=SeqID_215938
atggcaaaaataccattgaggcatttcatcgagcacttggtgggcgctcttttgggtaccaataacaagggaatgggggcaatgtggcttgccccattatctcagaacacaacctag

SEQ ID NO: 99161 - DNA, 561 bp, Glycine max
  Peptide Sequence Number=SeqID_215939
atggtgaagttctcaaaggagctagaagcccaactgataccagaatggaaagaggccttcgtcaactattggcagctcaagaagcagataaagaggatcaagctctcaagaattcccaagcaatcccaccaccacgctaaaccagactttggtctgtccattttcgattccttaagcttctttgtcaaaaatattgctcaaaacttttcagcttccgaccatcatgacctcaacatcattcaggtgaggaagaaaaccacaaaggatgacgaagaagaaatctacgaaacagaacttgcacaattattttcagaggaggacgaggtacgtgtattttttatgaggctggatgaagagctgaacaaggtgaatcaattttaccggagacaagagagtgagttcattgaaagaggagaaaccctgaacaagcagcttcaaatattgcttgacctcaagcaaattatcagtgactgtcgccggaaaaattctccgtcaaagccatatagcaccggagtatcccctcaatattctccaacccgggattctgattattccggttag

SEQ ID NO: 99162 - DNA, 654 bp, Glycine max
  Peptide Sequence Number=SeqID_215940
atggacgaagtggaatccatattcaccaagcactttgccaacaacgataggaaaaaggcaatgaaatttttaagaccccaacaacataaagattctcacatggtcaccttccttgtcgggttgtctacaggttgctttgtatccttgttttgtgtatatgcaatcttggcacatttgtgcggtatattctcctctaataacgagccagcttatatggaaacagtctaccccgttttcagtgtgtttacattgttaagcctgcacttgtttatgtatggatgcaacctgttcatgtggaagaatacaagaatcaattataatttcatatttgaattctcaccaagcacagcactgaagcacagagatgcgtttctgatgagcactaccttaatgacaactgtgattggggcaatggtcatacatctgcttctaagggctgcaaacttttctcctacggaaattgatgccattcctggaattcttcttctgtttttcgtagtattgctcatttgcccatttgaccttttttatcgccccacacgttactgcttcatccgtgttattcgcaacatagtatgctctcccttttataaggttcttctagtagacttttttatggctgaccaactaactagccagattcccattgcttag

SEQ ID NO: 99163 - DNA, 411 bp, Glycine max
  Peptide Sequence Number=SeqID_215941
atgttgggtggtcgttctttccctcccaaatggtcagctaaattctgtgactgtggagaagatcctaagacatgtttgataacttgctgtctaccgtgcgttacctttggccaaattgcagaaattgtggatgaagggcgtagttcttgctttggacaagggtgtgcctatgggttacttatgttggtgacgtgtcactggctctactcgtgcctttacagagagaaactgagatcaaagtttgggttaccagcggaaccttgttgtgattgctgtgttaatttctgctgcgaagcatgtgccttgtgccaagagcatgctgagcttaaagcaaggggtttcgacccttccaaaggttggattgggccaccaaatgctcctccacgaatgccaccttccatgtctagatga

SEQ ID NO: 99164 - DNA, 315 bp, Glycine max
  Peptide Sequence Number=SeqID_215942
atggaaaagacaaaacctgttgggattctggagtctcggcatgacaagagagtgagaggtaagggttcaagaggactacatgttatcgcaccaagtctagaagaattgcaacaaacttatttgtatatactgaataacaataatgaagttttgttgtacatagttcgtctcgaagctctagtcaaggaaaatataatctttggtgaccataatgcatctgaaatgttaaggaagttagcaggtgggcctaaaagaaatgttataacttggcaaggatatgatatcaacaagtattcattctacaagaaatcataa

SEQ ID NO: 99165 - DNA, 158 bp, Glycine max
  Peptide Sequence Number=SeqID_215943
cgccgccagaaccaccgcgttccgtggatctcggctgtgacagagaggaagatgccagcaaagatcgtgacggagatgagggacatggagaggctgtggacggcggggaatggcccaagagggatttgacaacggcgaaagaggagagaaagagagag

SEQ ID NO: 99166 - DNA, 465 bp, Glycine max
  Peptide Sequence Number=SeqID_215944
atgaattgtgttttcgttcttgggccctcacccttagagtttggagctatgcgtagtgattgcttagtgcaattctccattctcaacctttttcggagccccatgaattgcgtttttgttcatgtgtcctccaccttcgagtttggagctatgcgtagtgattgcttagtgcaattctccattgtcaacctttttcggagccccatgaattgcgttttcgttcatgtgtcctccaccttcgagtttggagctatgcgtagtgattgcttagtgcaactctccatgctcaacctttttcggagccccatgaattgcgttttcgttcatgtgccctccaccttcgagtttggagctatgcgtagtgattgcttagtgcaattctccattctcaaccctttatcggagccccatgaattgtgttttcgttcatgggccctcaaccttagagtttggagctatgcgtag

SEQ ID NO: 99167 - DNA, 348 bp, Glycine max
  Peptide Sequence Number=SeqID_215945
atggtgatcaaccttcccgaggtggccatgcagacaaggctccattcttatgctatagttgccaacttgctcattaacagggaaatgcttgcatatgcaactttgacatgtggaaaagagatgcatgcgcatgcattgagaactggtgttatacagaatgtgggaaaggagcccatgccactgctaaaacagccatgtgttgaaccccaacaccttgaggacaaggtgtatttccaagggccatggaatgacatgaatgatacgagcaagcccactaaaccagaaacaagggaaacaccagcaacaagggtgcaaaagggagaagagaccaagagaaggggtggttaa

SEQ ID NO: 99168 - DNA, 138 bp, Glycine max
  Peptide Sequence Number=SeqID_215946
atggaagagggatatgctgcttcttcatttgcctcacaagttcttcaagggaaggttgcgaaggagcctcaaatgtttgctatttctggggctgttgttgttgctgctggattggtggaggaacgtatggtctactag

SEQ ID NO: 99169 - DNA, 216 bp, Glycine max
  Peptide Sequence Number=SeqID_215947
atggtgggtccaatgacatgcgggggaaccttatggtcccgcatccttttttttcactatccagagacaatcaagtccgatagcacgcagagacaaattatggtcatccgcacgcttttgctatctggacagcgagtcgggtggtgggcggagataccttatggtcatctgcgcctttcatcgaccgagaggaacgaattcgaagaagttccgtga

SEQ ID NO: 99170 - DNA, 696 bp, Glycine max
  Peptide Sequence Number=SeqID_215948
atggcttcggaaaattttgttcaactgaatctcctacgatccaaggagttctggcaggttgttgcagatggtgtggcaacaccaagtaatgacgtagctcttacagatgcacaacaaaaagagtatgaagtgatgaaattgaaagacttaaaagccaaaaattatttgtttcaagccattgatcgttctattcttgaaactattctttgcaaagatatttccaaggaaatttgggattcaatgaagaaaaaatatcaaggctcctcacaagtgaaacgtgctcaacttcaagcgttgagaagagactttgaagtccttcaaatgaaagaaggtgagccagtaactaattattgttcaagaaccatgggtattgctaacaacatgcgatttcatggtgagaaaatgactgacacaaccattgttgaaaaaattatacgctcattaacaccaaaatttgattatgttgtatgctcaattgaagagtcaaatgatattgatgatctttctcttgatgagattcaaagttctttattagtacatgaacaaaagatgaacagaagttcaacaatgaaggagcacgcattgaaggtttctaccaatactcattccaacaactttaaaggaaggggtagaggtaaaggtagaggaagagggcatagagatcgaggagatagagatttcagcaataattcttaa

SEQ ID NO: 99171 - DNA, 246 bp, Glycine max
  Peptide Sequence Number=SeqID_215949
atggggggttaccttatggttacccgctcctttcgtcaaccaggggcaaacgagcccgttgacgcgcggagactaacatcgtcttctgcaccttttgtcgtcctgacccgtgaatcaggtgacatgcggggttaccttatggttatctacacctttcgtcaactaggggcaaacgagcccgtttacgcccggagactaaaatcgtcttctgcaccttttgacgtcctgacccgtgaagtcagatga

SEQ ID NO: 99172 - DNA, 754 bp, Glycine max
  Peptide Sequence Number=SeqID_215950
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttgaaaaaaaattttgccccccggtcaacttcgtggtttttgcccgttgttggcttggctagggtcggcggtgctgggttatggccccgtgctaagtttcggattggttggccccctcctcccccccgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtg

SEQ ID NO: 99173 - DNA, 1320 bp, Glycine max
  Peptide Sequence Number=SeqID_215951
tggatgagattgtggggccgtgtgctgaccgaaaaattccgtctcggtctgtttgaagagccgtatgtcgatgaaaacggtatcgatctgcaaaatgaagtgacccgccaggtcgcgcgggaggtggcgacaaaatcggtcacgctgctggagaacaacggcatcttacctcttggtggcaaaccccgcgtggcggtggtagggccgacggcagacgatccgctggcgttactcagcggctacagtttccccgttcatctgatcatcagcgatatggtcgaggagacctctcaggtgacgacgccgcgcgcggcgctggagcattacctcggcgcgtcgcaggtccgctacgctaaagggtgtcacatcatcgaaaaacggatggcgggtgcgccggtcttcccgggggacagtggaggcaaaccgatgcagcagtcgccggtttcgcaaagcaccgtcttgatccccgaggctgtgaatgccgcgcaggagagtgatgttgtcgtggcctgcgtgggcgatctcgccgggctgttccagagcggtaccgtgggggaaggttcggataccgactccttaaacctgccgggcgtgcagcaacagttgctggaggcgctggtggcgacgggcaaaccggtgattgtcgtgatgaccggagggcgtccttaccatcttcagggcctggaggacaaggtggccgcgctgatcgtggcgtgggcaccggggcaggaagggggctgggccattgcggacgtgctaacggggcgtgcggagccccaggggcgtctggtggtgagcgtgccgaaaagcgccggcgcgatgccgtactactacaatcacaagctcaaaagcggcggcacgccgtttgcgttccatttcggtgcacgttacccgtttggcttcggcctcggctggacgacatttagctgggggaacgcgagcgtggcttcatctgaggtgtcggtcgacggcgaggtggcactgagcgtggagatcaccaacaccggggaacgcagcggcagtgaggtagtgcaggtttacgtcagggataaggtcgccacgcaggttcggccgctccaggagctgaaggctttccagcgcgtcacgctctcaccgggggaaaccgccacgctcacctttacgctgccggtggagatgttcaacttcacccgtcgtgacgggaaacgcatcgttgagccgggcgagtttgagctgcagatgggcgcatcgtcggcggatatccgcgaggcggttacggttaatgtgacaggggaaacgcgggtgctgcctgctgagtggcggatgctcagtacctgtgag

SEQ ID NO: 99174 - DNA, 420 bp, Glycine max
  Peptide Sequence Number=SeqID_215952
atgaccactctagctcagacatggagcgttctttccttctcgaacctcattcccacctcccatacatcttatgtgaccttggacagagccaagttgatttatgtgacatttagaaggccaaggaagggtaggggtaagagatcagaggcccctactacttcagcaccaccagagacactagctccttcttcttccacagctccattacctcccactcagactccagttattcctcctacatctacatctgaggaggagacttctatagaccagatcctagagccatcctcagcacctatacctgatgatgccataccatctgcaccagtcacggagccagagcagcctatccaagaatcatcagtagctccagcactggatcttaatgaagatcagccacaggatgagcaggacatttaa

SEQ ID NO: 99175 - DNA, 339 bp, Glycine max
  Peptide Sequence Number=SeqID_215953
atgaagctgacattggtggttgtgacaatggaactagtgtcgacaatgatgatgtggtggtggtggcagccaatgatggtgacattgacagtgatggaggcgatattagtgatgatgatggtggagatggtgacaacaagtggtagcaatggtagttgtggggacggtgacaaaggtggtgttgttggtagcaatagtagtagtaataacaatattgatgacaatgattgtggcattaagtggtggcgatgtagtgacactaatggtggtaataatgttggtgatgtcggtgacaatgatgacagtagtgatgatggtggtggtggtggtgacaattag

SEQ ID NO: 99176 - DNA, 1149 bp, Glycine max
  Peptide Sequence Number=SeqID_215954
atgaagctatttcaatgggtgcatcgaaaacttcggcagaatagtatagatcctttcaagggtttcacacttggaaacccttgtacttgccttacagtgcagccaacacttgacaatcaatactcccagacaaagccaagcttcagctccataaatcaacccagtttctcaaagccacaccatcaggaaaatcaaacatcttactctgggttggtcgacagcagagaagataagcctcaagaagaaacacctgcaatagtcgctgagctctttgaaggttttctaacaattggaactcttggtgcagaaacagtcaccaatgaaccaggaacaccaacatttgctatgccttcagaaaacataacattgagaagtgaagaggtgacagaaaatgaactgaagctcataagttatgagcttgagaaatttcttgaggctgaaaaagaagaaagttcgtatgattcatcaggaagaaacagctatgttagcattatcacactttgtggaaaggaaatagatggacccaaagctgaagattacagaaacaaagatgactgtccactgcaaggatatttactggggtcctcatttgaacttccagaaacaaaacaagaaaggaaagaaagagcatcacttgctgagctactttataagataaaggcaacaagtcaagattgtatagagacaggaatacaaggagaaacacaagtcaagagaactactaagtcttctgccatgcatattatgagaaagatattgaaaagggtccacagttcttcaaaaagctgtaacacttccagggatgatgctgattctgcttcaaccaataaaaaactccacaaggttctacgtatgtttcacagaaaagtctatcctgaaagccctgtagatggaaacgattgcattcaatcccacaaaggtaagataaaaaatgtccctcatgaatgcctccaggaatatgatgatgggaagttcacaaacccagacaaaggcaaaagattttattcagataccaaatcaagaaagtggtcccaacactgtatgaccaattggaacccaccacagcatgggctaatttgcagtagctcaactggaaacaatgagcactggatcaaaacagatgcaaagtatttggtgctggagctgtag

SEQ ID NO: 99177 - DNA, 225 bp, Glycine max
  Peptide Sequence Number=SeqID_215955
atggttgatctgaccataaccaaacatgctaaggtttggcccaaatctgaccgtgagaagctttgggaattagaaatcaaagatgaagaactagatattggacattcaaacgtgcatcccgtagttgccaacgcgttaaagaacaacaccagtcatgctattggaaacgaaaagatgttggtcctggaaagtacgatgagggtgtcactcaacattgacacatag

SEQ ID NO: 99178 - DNA, 354 bp, Glycine max
  Peptide Sequence Number=SeqID_215956
atgattgggttgtctttgttatgggaaggggaatggtatctggggattgattttggcagggttggattgatgtgttcttctgttgtcgatgtcgagattacttgcgaaggactttctcttatcgttgtcagagaatctttcgttcgcaccatctatctctttctgacagtagaattaggcgtctcgtctgcatggttggatttcttgctgaaggtggatcaacacgatgctccaccagagtggaggatccctcctcaacaattgcagggtgacgacacaacgatgatggtggtcagggaggtgggtggtgcaatgatgtggcagcacggttctagtggtgcaaggtgggcctaa

SEQ ID NO: 99179 - DNA, 459 bp, Glycine max
  Peptide Sequence Number=SeqID_215957
atggaggcttcatcactgagatcattgaacgcaaatgcaagcacccttttgttgtttgggtctggcggtgtcagaaagttaggtgcttggtttgtgacatcggtggttgttcctattgtggagaagaaggagaagaacaaagtcatctttacttctttttttaaaaaaaaaattcctatgtataatcccactcagacaaagattacacatgacaccacacgtcgcatgtctatgtgttcgattaacgaccacattatgatcagaaccagaggattgcatcgtgctttgggcatagttataggaagaaccttagggacacaagttagttgtgatgcgaaagaagcccctcagcgtcgaaggccgataacatctgcacgtggacaacgggcagctgcaattattgctgaggatgttgagcatgtaaataattcaactaacgaggttcatgagcaagcttaa

SEQ ID NO: 99180 - DNA, 579 bp, Glycine max
  Peptide Sequence Number=SeqID_215958
atggacagtgtaagtcgagaggagcgtgcgtacttcgaaagaggagtaattacagttgattctgggaagcttgaacctgcaatcgcgagtatggttcagcgtgggaagcgcaacccaatcggtggctttaaagcggtgtatgtcgtcatacacggtggctccgggtgggttccgggttcagctacggctaaccggcagggtggggtgatgggaatatctgcttcaaactacagaaattttaacgaccggaaggctatgattcctcccaaactagcaagaccgaaatatgaggtggtgtggaaaggcgatgtaaatggagcagagttgaaggttgcagggagtattcacaacaatgcagctgaaggttggacgattatcattggcatgcaagtagcatgggagaggggcttcaaggatttgttcattgaatccgactcaaccacaataatttctcttatcaatgatgggtgttcatctgatcatgcttttaatcatgtggtagaagctataaaggattttgctaggaaagacgacattacgaatggagtcatatccttagagaagccagcatgtggttga

SEQ ID NO: 99181 - DNA, 138 bp, Glycine max
  Peptide Sequence Number=SeqID_215959
atgaatagtaagaatgaagagcaactctttggagcaatcccaagactagaaactcaaaaggagatggaaggtggaagtgcacaaagaggaattgtttcgactcattctctaatggtgagaattacattcagtccttaa

SEQ ID NO: 99182 - DNA, 635 bp, Glycine max
  Peptide Sequence Number=SeqID_215960
atgggcacagagacctcatcggtggatatttctgaacccttgctcgtggattctcacgggaacgaggaaaaggaggagtatttgcgcgaggaggttccggaatggaaggagcagataacaataagagggttggtggtgagtgctgtgttggggaccttgttctgcatcatcacccacaagctgaacctcaccgttgggatcattccttctcttaatgtggctgctggcttgttggggttcttctttgtcaggacctggaccgggttcttgaccaagatgggttttttcaccaaaccctttactaggcaagagaacactgttattcagacctgtgttgttgcttgctatggccttgccttcagtggggatggaacctgcgacctttcccatcttcccttctcccttaaccacccaacccatctctctctattagttacttgcttgattgttttggattcaattgttaagccttggtggttgaaaggagaaagggaggaagaagtcatgggaagggtgaaggaagaagggaggggggtgatgtcacggcttggtggtgctttgttggaagatatgtctcagcttggagttggttttgtgaaggttaaaggctttgagagttttgtggaagagataag

SEQ ID NO: 99183 - DNA, 681 bp, Glycine max
  Peptide Sequence Number=SeqID_215961
atgagcgatggcgatgtcaaggacatgaagatgaaaaagaaggtgaaggcggtggaaaatgacaacaacatggaggggcaagcgcattttgacaacaactttatgttcgaggtgttgaagcacgtggatgcgtggacactgacattggctgcagggagcaacaaccatgattcgtggtcctcatgctcggtggcttctgtcgcctctatgcgctttatctcttcccattctccaagccacaacaaacatcatcttcttcctccatattggctgagtctcatacttccaactccagaacgcgcacgtttcgttcgtggaaaagcatgtgacaagccccacttgaattttgcatcgagtgggggtgtaggagctggtgtcgtcgatggaaaccttctagtaggcgaggacccagaggtcaaagtgacaaaggaagggtcgcgcacaacacagactgcaccaagggtggtcgcaagcatttattggggtggcggcgcagttgcacgatcagtgatgcagggtggtggcgtaacgacggtggtggtcaaggacgtggggaggacatgggtgggtgcgtacacgaatttggtgggtcctccagggcgggtggtggtgggagtatgttatggaggagtttgtcgtggtggtgatgatgcacaaaaagaaagagagagattaggttag

SEQ ID NO: 99184 - DNA, 273 bp, Glycine max
  Peptide Sequence Number=SeqID_215962
atgggagtgatggaaatccgagtcaacctccagagcccttggtgccggaaagggttggtattgtcttccagtttcccgagagagttttattcaatttctgttgattattttgaggatcaagaaggatcaaagagggacttggttttgctttcaagacaggcatctgtggagggggttgtgttaagaaatctcacaccgcctgcctcagtttttaaggtgcaacttatgtatctattggataacttcactcagtaccaatcggttttaagctaa

SEQ ID NO: 99185 - DNA, 1494 bp, Glycine max
  Peptide Sequence Number=SeqID_215963
atgccttcttcccttttatgcagattctattttgacttcagtccaacctatgttggatgtggtcttatctgtcctcacctagtcaattgttctgttctccttggagctattatatcatggggctttctgtggccttttgtctctgagcatgctggcgactggtatccagctgaccttggtagcaatgatttcaaaggtctttatggatacaaggtattcatatctattgccctgattttaggggatggtatttacaatctgataaagattatactgataaccattagggaaatgtggaggacaagctccaaacagcttcctgttgtgacagaggttcaaggtgagttagttactttcatagtgacattgaatcttgatctgtacggcatcttggctatggataataaagaattggttgcattgtggaaaacgactgaactgaatggagttaattatcttctgaaaatcatatttgattatctactcccagagtcatctattgaaactagtgatgatgagaattctcaactgcaatcagaagaaaagaagagggaagaagtatttttgaaggacaggatacccacctggtttgcagcttctggatatgtgggcttggctgcgatatccatagcaacaataccaattatcttccctcctctcaaatggtacttggttctgtgctcttacatcctcgcccctgcccttgccttctgcaactcttacggtactggcctcacagactggagtctggcatccacttatgggaagattggtcttttcatcattgctgcagcagtaggccaaaacggtggtgtaatagcaggggtagcagcctgtgctgtgatgatgtcaatcgtcgcaactgctgctgatctcatgcaagatttcaagactggttacctgaccctctcatcggcaaagtccatgtttgtgagccaattgattggaacagccatgggttgtgtaatcgctcctctcacattctggatgttttggactgcctttgatgttggctcacctgatggcccttacaaagcaccatatgccgttatattcagggaaatggccatactcggtgttcagggattctcagagcttccaaagtactgccttgaaatgtgcggtggtttctttgcggctgccctggctatcaaccttctaagggatgtgactcctaagaaattctcacagtacatacctatcccaatggcaatggcagttccattttacattggtgcttactttgcagttgatatgtttgttggaactgtgatattgtttgtatgggagaggttgaacagaaaggatgcagaagactatgctggagcagttgcttctggactgatatgcggtgacgggatatggacaattccttctgcaatcctttctattatgaggattgatccccccatctggatatcgttcagttccttaactgtctcaggggaacccgaaaacagaagaaaagcaccaagagggaagggggtaccttga

SEQ ID NO: 99186 - DNA, 1011 bp, Glycine max
  Peptide Sequence Number=SeqID_215964
atgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 99187 - DNA, 273 bp, Glycine max
  Peptide Sequence Number=SeqID_215965
atgaagtttcaacatcaaggaaaactggtctgcttacaaggtgaacaaatttcagagaacatcatagaattggaagcgtccgctaagcgcaacactcctaggctaagcgcgaggaagactctggaagaagatgagttgtacaggttcgctaagcgcaccacttcagttcattcgctaagcgagaaaggcgcgctaagacaaaaatcactaatgtgcactaagcggtccatacatgcgctaagcgcacgagcacgaaaaaggccacctatttaa

SEQ ID NO: 99188 - DNA, 549 bp, Glycine max
  Peptide Sequence Number=SeqID_215966
ctggggttacggtgcccaactgcgcgctaacctagaccccacaaagggtgttggtcgattaagacagcaggacggtggtcatgggaagtcgaaatccgctaagggagtgtgtaacaactcacctgccgaatcaactagccccgaaaatggatggcggcgcgagcccgggcgagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaaca

SEQ ID NO: 99189 - DNA, 114 bp, Glycine max
  Peptide Sequence Number=SeqID_215967
atggttgaaaactttgttgacatccttgagatgcgtatccagagaaggccgcgaattgatattatgcttgtgatggatgatattggggcatatatccagaaacatgcactgaag

SEQ ID NO: 99190 - DNA, 303 bp, Glycine max
  Peptide Sequence Number=SeqID_215968
atggtcgaggtgaaagtgttacggagattagtgaatgaacaaaatgaaggcaaagctgatatgaatgaacaaaatgaagacaaagttggtgcgaaattaaaacatgttgattattctggtgtgttcaatacttctcaggtgtttgctatccgtgatgatattttgaattgtagtagcaagcttcatgatgatgaaccaaataattttgatgatgccaaaagcccaagtaattcattcaagacttcaagatcaaacatcaagaatccaatccaagattcaagagaagaaatcaagaagcaacaa

SEQ ID NO: 99191 - DNA, 141 bp, Glycine max
  Peptide Sequence Number=SeqID_215969
atgaggcagaagttgagtctttgtgagaggaatactatcagagagttgcaactcttgagagaaaggcttatgctctcactaaggaaaggaatacactccatcgagagtagaataaaaaaagtgatgcagctgctctcttaa

SEQ ID NO: 99192 - DNA, 489 bp, Glycine max
  Peptide Sequence Number=SeqID_215970
atgtgtaaagtctatgatctttgggagcaggcctattgtgtttccaatctatccacagttgtcgtcatgatgggcaagtttcttcaggatgaggagtcccaaatggttaaatgtcaagtagccataattgggatgatcaaatatgagtttgttttctccaatttcatcaattgcatgtatgcaattcctgttagctttaggagaagagatgatatccattccatagcgcctggtatcccagctatgcggagagaattctgcttcttggcagttttgatgatgacaaagatgatgacaaaaagcccaaagaatgatttcaagattgagtcaacaagttcaagatcaagattaatttcaagtttcatgagaagaaatcaagagaagtttgatttcaagattcaagagaagatgaattcaagattcaagagaagaaatcaagaagacttcacaagggaagtattgaaaagatttttcaaaaaacaaacatag

SEQ ID NO: 99193 - DNA, 549 bp, Glycine max
  Peptide Sequence Number=SeqID_215971
atgctggcattggagagcaagaacaactatcataggattttgaagttgaaagttttggaaaggctgatagacgcattgaaagttccactgcttcgtgtcaatgatggtagaattctaacaaatttatgtacctacagtggatcagaagccttgaaacagttaaggggggttatagctgcagcacccacagtgcttcaagcaatcatgtcacaagaaaacaagctccaagaagtgatgattggactagcggcaagtgttttcacattcatgacttcctatgaatcaagtctcgaggataaggaggtttgtgatagagctggcaatttggatgatgaaagaaagataagaaaacattcatactttcaaggatttgggaatagaggaggtgctggaagtgcgactgacgaagacgacgatgtcgataggttagggcttaatatcggacgcaagggaactttaccaataagccaatacttcgccaaaattatgtcttttgggaaagaacttacagaatacagacctgctcagatcacacatgcacttgtggtg

SEQ ID NO: 99194 - DNA, 402 bp, Glycine max
  Peptide Sequence Number=SeqID_215972
atgaaattaccagaagtagtgcaaagtttgcaagagaggaaatactcaattattcaaggtataatttgcaaaagggtacctttgcaaaggccttcagaagtcattcctttttacttttcaggaaacatctaccagcataacacaccttacattgcttgcaagaatggcacctactatgaattggtaaaagaaactttccaaggcctcaccacatgtcaggcagtgatgggtcagaattactatacccctatcaacattgcaattggtgctgagctcacagttccaatgttatgtgcttgtccaactgaaaatcagacagcaagagggtccattggaaaggcttatggtgtggatgaacaaagtgtgctagaggccaataagttcataacagatgaaccatga

SEQ ID NO: 99195 - DNA, 330 bp, Glycine max
  Peptide Sequence Number=SeqID_215973
atggcgcaagctctcgggcaagaaaggatgcacaggctagaaacgagtgcgatggagtcaggggcgtggggattgcacgtgacgtcgaacgttagccttcgacacagcatagttgttctccggttgccggagagcgggatgggagtgcacgacaacgcctggaaaatcagtgtccatggaaatgagagggtgggagacaatgacagaacggatgaactcaaactccgattcaaggttgaaggacaacactggtcgcgtgacaatcgaaggatgtgggaggagcatgatgatgattttcttgtttgtgaagaagaaaaaacacggaaatag

SEQ ID NO: 99196 - DNA, 162 bp, Glycine max
  Peptide Sequence Number=SeqID_215974
atggcaagcaacgacaactcatggtggccatcgatggtcgtgggtggtggaggaggagtttctagggtgatctcgcttagcgagctcgtctcgctaagcggttgtccacttttggcgctaagcgtgacaatttgtgctcagcgcaattccctctcggattga

SEQ ID NO: 99197 - DNA, 750 bp, Glycine max
  Peptide Sequence Number=SeqID_215975
atgatgttggtattggagatgaagaacaaaatcggcttcatggactgcatgattccaaaacctaatgagcaagatctgaactacagtgcttggaaacaattttctcctgacatcgcaactagcgttctatggctgaatcaagcctatgaggatgagttgtgcaatttttgtccaatccctacctgtgatgcgactcctgctgaatcttgcaaaagggttcagcttttcaagaattatcgtgattgtgatagcgttttatgctttcttcacggattaaatgagtcatttgcttatgcaaaatctcatatattgaacctcgatcctcttcctagtttggatagggttttctcaatgattcttcagcaagaacgtcaattgcatgttggtgttctgcctactcccattgctttcactgctcaggcgccatcaaatacatcacaaggtcgtagcaaggctcctttcagcctaaccaaggaccaaattcagagtttgcttgccttgttgccatctgctacacctattgccaatgctactaactcttcaaatgtgcaggtttctaaccaaaagatgattagcactgctagagagtttaagggactatattacctgatccaatctggcctaggatcttcttcatcaatggattcctttgcttcttggaagatgaatggcagcggaatggagaaggaagagagagaggagacgccacttcaaggagaagatgagtctagaagaagctcaccaccatag

SEQ ID NO: 99198 - DNA, 1020 bp, Glycine max
  Peptide Sequence Number=SeqID_215976
atgaacgaagatcaatggatgtatgatagtataatgtctgaagaagttgatatggattatcaaaatgaagaagaatgtggtgtgaatgaaccacatgttgattgttcggatgtgttcaatatttctcaagtgtttgacagccaagatgatattttgcagtgggctagatccgttgctcatgaaaacggatttatggcgatgattgatttgtttccactgtcctatttggatcttagactaagtgaggttgaccttatgcgtttgagttcatttgtggttgcattacttcagcggttcaagggtggcatcaccaacatctgttataatttgttggagttggggtttgaagggggtgctttgatttggggtgaggctaatagggatgttgacgtggatttgtctcttattgttgtcactgctgcacagggtttgccttggtttgtgttgagcttgttggccttgtattgcaagttcaagcagaagcaactcttagaagaaggttacacgcagatcaaaaggaagatgattttgttcctcttgagagtgtcattactccacttgaaggtgagattaacatatataggaatgagaaaatgtaaggggctacctttggcgattgtggccattggtggtctattgtcaacaaaatctaaaactatgtttgaatggcaaaaggcaaggatgcaatgtttgaaagataagctagctatatcagagacaacaacaaaggcagagtcacaattgaagcaacaatggaagcacgaaagcaaaagggacaagacgcttacctcaacctcgatggagcagcaccaacaaaagatgaacatgcaaagtcgaggtgaagaccaccaccaccacgccgccaacaatgttgaagaagaacgcgcaacaagaacgggctcaagaaccacgtcgccgatagccgaagaacgcatagaagaagacgaagtgcagtcgcagaaggaagaagaaacagaagagacgaggtgcagaaggaagaaaaagtgttgggtgcactaa

SEQ ID NO: 99199 - DNA, 304 bp, Glycine max
  Peptide Sequence Number=SeqID_215977
atggttcaagtacggtacaatttttctggtcctggagttcctaggaacttcagattgctggaggagcttgaacgtggagaaaaaggaattggagatggcacagttagctatggaatggatgatggtgatgacatttacatgcgctcttggactggcaccattattggcccccataatgttgaaccaaagaaatttggtcttcttgcaaattggcaaagagagtacaccatggaggacatactgacccagctgaagaaggaaatggctgctcctcataaccggaagcttgtccagcctccggaag

SEQ ID NO: 99200 - DNA, 213 bp, Glycine max
  Peptide Sequence Number=SeqID_215978
atgaagcatagctccaaactctttggggctctcgggacatcacatattgtgaaacaaaggatgccaagtatctcaaagcggccaatcaaaggttgcatatcatcaagtgttgagaaaaggattaatgagtttcaagaacctcgggatttgaggtcaaatccttttcaagggggagggaatgatgcaatcctaccccccaagggcattggatag

SEQ ID NO: 99201 - DNA, 310 bp, Glycine max
  Peptide Sequence Number=SeqID_215979
atggcttctagaaagagaaatagcattggtacaaggcccacatctcagtatgacacaaggagattttcttcattagatgcttggaccagatacactgacaatgttctgggaagaaacattttacctgaaaggaaagtagagttgtatcacactgagctagatgactttaaggccgagctggagaggcgtaatttccataaacacctcaccaatttagccgatgggagcatagacctggctttggtgaaagagttctatgctaatttatacagttctgaggaccgtccaccaaagcagtctagagttagag

SEQ ID NO: 99202 - DNA, 261 bp, Glycine max
  Peptide Sequence Number=SeqID_215980
atgttgcttttactccctttctcctccaccattgaagcctccatcaaagctccaaactttgcttaccatttctgctccaaatcgcaaaaggaagccattttcggagtcgtgaagcgcacctctacgttgtgggacttcaaatttcagttatttgtgaagaaatctgttgaaaacatgctaaacttgtcatgtttggtaaaactgatagagatgaagggtagagttaacctagggtttaaaggtgtgaatgtagtgatatga

SEQ ID NO: 99203 - DNA, 280 bp, Glycine max
  Peptide Sequence Number=SeqID_215981
atggacgaagatcaatggaggtatgactttgcgatgtcacaagaagttcatatggattatgattatgataatcaagaagaatgtggagtgaatgaatcacatgtcgattgttcaaatgcttttaatacatctcaggtattcgctactcgagatgatgttttgcaatgggctcgaatagttgcccatgaaaatggatttgttgcagtgattatgagatctgacacagagaccggtagcagaggaagaagttcatttgtgttaattgggtgtgaaaggagtg

SEQ ID NO: 99204 - DNA, 399 bp, Glycine max
  Peptide Sequence Number=SeqID_215982
atgatcacttctttctcttcagaaggtaatgatgaggaggatcaccatgagcactggaatggatctatgagtagaagtcagtcaaaacatcataatcaacaagcttcaccacttccgactaaacttccagctggagctcatataccctcttgtgcttggcctgaagagggtggatctgagtatcccagacacatgccaggagctgatcacaagcaacccaatcacaagggtggtgagacttcaagttcaactgagagcaatggtggcagtcaaaatgtccgttcgtcaataccaattttaccaaattccagttcttcattagtttcaatgacatactctccttctttcaactctagtcaacttgttggtcagaggaaactgtttgcagaatcccaatag

SEQ ID NO: 99205 - DNA, 339 bp, Glycine max
  Peptide Sequence Number=SeqID_215983
atgacattgacacaagccggggatctgcccagacatccacctgtcatgcaaaatgagaaatatgtggaaccggatatgcctaagttcccagtggcagcagcagctatggaggaagcacttgcacatggcccttttgatgtggagacccctagacatgcagtgaaggcttgccaaacaattacagaaaggttagagcatttgctcaacctaaggatagtgactgaaggcacaaaagcacatgatgtcatgcaagactacttaaggatcgctaggggtgtcacagtagagcgtaatgcttatgtcaggtcacgacgaaagcggcacacagatcatgcttga

SEQ ID NO: 99206 - DNA, 1944 bp, Glycine max
  Peptide Sequence Number=SeqID_215984
atggcagaacctagagccaggactgtcaatataacatgtaacaataagctagagcacaacaccaccatctttgttccaaattttgttgcaaccatggagaagatcagtgaacagatgcgcaataccggttatggaacagcagttgtaggtacaggaggacctgacaccaactacgggttggctcagtgctatggtgatctctcattacttgactgtgttttatgttatgccgaggcacgcacggttcttccccaatgcttcccttacaatggcggtcgcatataccttgatggttgcttcatgagggccgaaaactatagcttctatgatgagtacatagggccaggagacaaggctgtttgtggaaacacgacaaggaagagcacaagttttcaagcagcagcaaagaaggctgttttgagcgctgttcaagctgcagcaaacaataaagggtatgctaggaaggaggtttttgtggcaggaacaacaaatgatgcagcttatgttctggctaattgttggaggagcttggacacaaggtcttgtagagcttgtcttgagaatgcatcttcttcgatattggggtgcttgccctggtcagaagggagagcattgaacactggatgcttcatgaggtactcagacacagattttcttaacaaggaacaggaaaatggaagttcaggaggtaatgtactggtgatagtggttgcagtagtcagttcagtgattgttttggtggttggaatagctattgtggtttatatccgcaaacacagatatattcaaatgaaacgaagaggttcaaatgatgcagaaaagttagccaagagccttcaccacaatagcttgaacttcaagtattctacactggagaaggctactaattcctttgatgaagctaataagcttggacaaggaggatttggaaccgtttataaaggagttctggctgatggaagagagattgctattaagagattatatttcaacaaccgacatagagcagcagatttcttcaacgaagtcaacataattagcagtgtggaacacaaaaatctagtcagactcttaggatgcagttgttcaggacctgaaagccttcttatatatgaatatctacctaacagaagtctagatcgcttcatatttggtaataactcaactcatggaatagactgtctcctttcagatttaaaaatcccttcatttcatgataaaaacaagggtagagaactaaactgggacaagagatatgacattatcatcggaacagctgaaggattggtttacctgcatgaaaactccaacattaggataatccacagagatataaaagccagcaacatcttattggatgcaaagcttcgtgctaaaattgctgattttggtttggccaggtcctttcaagaagataagagccacattagtacagctatcgctggaactttgggttatatggctccagagtacctagcacacggtcagttaacagaaaaagctgacgtatatagttttggagtgttactgctagaaataattactggaagactgaacaatagaagcaaagcatcagaatattcggacagtctagttacaatgacatggaagcattttcagtcagggactgcggaacaattaatcgatccatgtctagtggtggatgacaaccatagaagcaattttaagaatgagattttgagagtgttgcacataggacttctatgcacccaagaaatcccttccttaagaccatctatgtcaaaggcactaaagatgctaacaaagaaggaggagcacttggatttggaagctccttccaatccacccttcatagatgaaagtaccatggaactccatgaccaaaatgatgacccattttaccctctcaatgcagaagattcattggctactatgtctcatagctcattttatgccaggtaa

SEQ ID NO: 99207 - DNA, 291 bp, Glycine max
  Peptide Sequence Number=SeqID_215985
atgatgactctcagcaacccacttgagatttccactatctttcctatccctcttaagattattgaggccacaaggtccaacaaagaatgtcctcagttaaagagaaaaatacattctatagacaagaaaaagaaaagtctgatggtaacttgggatgacttagatagtgaaaagagcagcaactcagacaatgagcaagctaccatttgtctgatggccaacacagatgaagtaataaagatgatgaagaagatatgccctatactgttcttcttcaaaacaattaaatga

SEQ ID NO: 99208 - DNA, 432 bp, Glycine max
  Peptide Sequence Number=SeqID_215986
atgggtccatcactgtacttctcagaggttgcagatgatgggggtgtgtcttcagaagaaggttttagtgctggagatggtgatccccaagatggccaattacggagtgaagatcgagagctgaaggataggcttttacgtaggtttggaagtcacgttggatctttgaaattggaattttcaaagaagaaaaagaggggtaagctgccgaaagacgctaggcaaacactacttcagtggtggaatattcactacaaatggccttaccctacggaaggtgataagattgcactggctaaatcaactggattagaccagaagcaaattaacaactggtttattaatcagagaaagcgctactggaaaccatctgagaacatgccgttctctatggtggatggtctgaccggtcggttccttactgatgaatga

SEQ ID NO: 99209 - DNA, 225 bp, Glycine max
  Peptide Sequence Number=SeqID_215987
atggcaagaccacaaaatagacaaatgcgatggaatgatataatcttaactaatcatttagagcaaatattaacactcataattggaaaacctaagtctcactccaaaagcaaaaagagtaaaggaagtcgttgggagaaattcttggagcatcatcatggaagggagcattatccgttcaaaggaggggggggaggggggttgataagaaaactaggaatttaa

SEQ ID NO: 99210 - DNA, 225 bp, Glycine max
  Peptide Sequence Number=SeqID_215988
atgatgtttcctcaggcgtcttttgtcgatctcattattacatttgtcatgcatagcataagaaaaaaacgtgctttacggtgcccttaccgaacacgtgccaaagctagagtgatgagtgaaatagaggaggtgcaagagcagatgaaggtcgacatggaggccatgaaagagcaaatgaccacaatgatggaagccataatgagtataaggaaaatgatggag

SEQ ID NO: 99211 - DNA, 303 bp, Glycine max
  Peptide Sequence Number=SeqID_215989
atgataaagatttcaaatggtggtggtgaaagagacacgtgtgaaattgttgacacgcgaggagcagtccctgttcgatgtcgttttggggacagcaaaagcgcgacattcgttttatatagcgtggttgaaatttgcattgtcggtaggggtcgtgttgtagtttcgtacttctcgtgtgccgcgcgagtttctcgtgcgtcatcaataaagcgcacgaagatacggcgccaagttaaaattaccgaacagcgctctaaatttttaactcctgggcttggctcccttttgccgcaagcctaa

SEQ ID NO: 99212 - DNA, 333 bp, Glycine max
  Peptide Sequence Number=SeqID_215990
atgggggacaaaccctgggatttcaatggattgattaaacgtcaaacggctccattatcgtcactccaaaatggtcaagtgactaaatcaaatagaaaatacactttgagggagttccaggagagatttgcaaaagataggataaggttgcatgacttatcacctctttcaaaaggacagtcaatctatgtttcccaaaaaaaatcaaatcaaaatcaaaatcaaaaaatagggaaagaatgtcatgaacatttccattacattgcattgttccatacgaagtccgcatttaccgcatttcaagacaaaggttgcatgcatcagcatcactaa

SEQ ID NO: 99213 - DNA, 282 bp, Glycine max
  Peptide Sequence Number=SeqID_215991
atggggtattggcaggttagtgttccatacagcagtttgctaaccatagtgacggttagatgtggacattgtgccaatttgttatcagttaacatgggagcttcacttcaagcatttccccctcaagaccctcagaaacagcacctaagctttcaagaaccaagcagcaaggaactgggatcatcttcaaaatgtagcaaaatagcgccatttgaggcagtagagcatgaactacctaggattcctcccattcgtcgtgagccctcactctctattaattga

SEQ ID NO: 99214 - DNA, 477 bp, Glycine max
  Peptide Sequence Number=SeqID_215992
atgggctcagaaatctaccctgaggttcatgagaaccctagggccttctttagcagctctagcccaatcctcttggagcctcttgctcatggctctagtgactggtcccttcctagggaggattgcatcacaccctcgccttcagaggactacacatcctctccttcagaggacgtcctcgcctttagaggactagacgttctcgccttcagagggctgcacgccctcgccgtcagaggactagacgtcctcgcttttagaggactagacgtcctcgcctttaggggactagacgtcctcgccttcagagggctgcacacccttgccttcatagggctacacgccttcgccttcatagggctacacgccctcaccttcagaggactacacgtcatcgcctttagagggctgcacttcctcgccttcatagggctacacgccctcaccttcaaaggactacacgtcctcgccttttga

SEQ ID NO: 99215 - DNA, 1497 bp, Glycine max
  Peptide Sequence Number=SeqID_215993
atggacgaagatagcagtaattcttggataaggagggccaaattctcccacacagtgtgtcacaggttgaactattccagttctggatttggctctttcagcattcagccaagggcacagcacagttctagtctgaaatcaaggcctgaagtggcttttgcctccaaggcttcttcacaggctcagaagaaaccaataatgaacaagcagagatctttgtcccctttgcctcaaacctctctctctgagaccttcaaggaagccagacatgagcagaagaggttctcaacacctggtccaaggaggaaagagcaggacaaggacaagagaatcatggggaagttgctcaacaaggattctcatgtgttcaattccaaatccaatcacagcagtccaattactactaaatccccttacagcagtccaattaggcaccttgcttcgatgaaattaagtgacaagtcgaagcagcaccgcaaggatttgggatggacaaagtactttgaccatggagggggaaaggttactgctgtggaaacagctgaggaatggaatgttgacctctccaagctctttgttggtgttaggtttgcccatggtgctcacagcaggctttaccatggcatgtataaggatgaagctgttgctgtgaaaattatcacggtaccggatgatgacgaaaacggaatgttggcggatcgattagagaaacaattcattagagaagtctcgcttttatcgcgcctccaccaccaaaatgttataaagttcgtagcagcatgcagaaagccacctgtttattgtgttatcacagaatatctatcagaaggttccttgaggtcatatttgcataagttggaaagaaaaactattcctctagagaagctaattgcttttgctctggacattgctcgtggaatggagtatatacactctcaaggtgtcattcatcgagaccttaaaccagagaacgtccttattaaagaagactttcaccttaaaattgctgactttggcattgcttgtgaggaagcgtactgtgacttatttgctgatgaccctggtacctaccgctggatggcacctgagatgatcaaacgaaaatcctatgggagaaaggttgatgtatatagttttggacttatcttatgggaaatggtgactggaactataccatatgaggacatgactcccatccaggctgcttttgccgtagtaaataagaatgtaaggccagttattccttcaaactgtccacctgcaatgcgagctttaatcgagcaatgttggtctttgcatccggacaagaggcccgagttctggcaggttgttaaggtattagaacaatttgaatcttcgcttgctcatgatggaactctgactctggtggaaaatccttgttgccctgatcataagaaagggcttctccattggattcaaaagcttggtcctgtgcatcataataatggccctgtgcctaaaccgaaatttacatga

SEQ ID NO: 99216 - DNA, 120 bp, Glycine max
  Peptide Sequence Number=SeqID_215994
atggagaacaaccctagttcatcaagaactgatacaaaatccattgagcagaatagaagaaatcaaatgaaggatcttttctccaagctcaactcagttgtgcctcatcaaagctcaagg

SEQ ID NO: 99217 - DNA, 321 bp, Glycine max
  Peptide Sequence Number=SeqID_215995
atgaaggataaaaggaacaacctaatagacattgaaaggtcaaaaaatgctagcatgaatatggggttgaagtctccacaatttaagatccaacaaatgggttcagccttagagattgttctagtaaccgggatggattgtcaattcatgttcaatgagaccattcgtgttcttcaagaagaaggatctgatattgttaatgccagttatacagttgttgaaaatgcagttttccatacaatacactgtcaggtagggggatctgctaatggagctttgaggatatctgagaaaataaagaagtatctcaatggttgctag

SEQ ID NO: 99218 - DNA, 1126 bp, Glycine max
  Peptide Sequence Number=SeqID_215996
gttcacattcacgatcactcttcacacggaaatgaaacgctgcaatgtcttcatctccaggctctgcaaggaaggcaaaatcgacaacgtacgcaaggtgttcgacgaaatgcctgaatgggacattggtctgtggaccacaatgataactgggtacttaaagtatggcatgatcagggaggccaggaagctgtttgatagacgggatgccaagaaaaatgtggtcacttggacagccatggctaatgggtacatcaagttcaatcaagttaaggaagctgagagcagaatgtcggagagagatgttgtttcttggaccacaatcatcacgacattggtgcaatgtgggacactctttgatcagatgcctgttcggaatgtggtttcttggaatgcaatgatcatgggtcatgcacagaataggaggttgcatgaggctctggagttgtttcagggattgcctgagagggacatgcattcatggaataccatgatcacgggtttcattcagaatgggaagttaaattatgcagagaaattgtttggtgaaatgcgagagaagaatgtcattactttgactgcaatgatgatggggtatgtgcaacatgggctaagtgaagaagcattgaaggtatttaacaaaatgctggctaccgatgggttaaaacccaacactggaacttttgtgactgctaagggcttggatttgatatcttggaatggtatgattgctggctatgcccaccatgggtatggcaaggaggcaattaatctatttaatgaaatgcaagaattaggtgtttgttctaatgatgtcacctttgttggacttctcagggcttgcagtcatactggaaggctgaaagaagctttcaatatcattgaggggcttggggaagaggcaccattgactgtttggggagtgctccttgctagattagggaaatggaaagaagctgccaacattaggatgaaaatgaaggacaaggggttaaagaagcagccaggttgtagttggattgaagttggcaatacagtgcaagtatttgtagttgatgataaatcacgttctcagtatgagctgctggggcatttacttcatggtctacatacagagatgaaataa

SEQ ID NO: 99219 - DNA, 375 bp, Glycine max
  Peptide Sequence Number=SeqID_215997
atgagtctgatcaatgcagctggcaacaattcatcgaattctaggccttcatgtacctattatgggaaagataatcacactattgatagatgctataggaagaatggtccacctcagaattatccttcaaaagggggaaagggaactcaaagcaattccggcaaaggaaactttggagcaagaggaaacaaagtttgcacacactgtggtctttctaaccatactatagatgactgctacaagaagcatgggtacccacctggacacaaattttacaaggtacaaaatccaaacatcaacaatgtcaatactataagggaagaagtgttagcaagactagccaagatgagtggatccttgattctggagccatag

SEQ ID NO: 99220 - DNA, 144 bp, Glycine max
  Peptide Sequence Number=SeqID_215998
atggttgatgatgataatgccttgcatgtgagagtggaggtggaggcattggacttagagaaacacttgttgtggaggtttgaagggaagaagctaagggaaaaagataagacatcatcgtatcatatggtagagtttgatcac

SEQ ID NO: 99221 - DNA, 670 bp, Glycine max
  Peptide Sequence Number=SeqID_215999
atggcaccccttgattttgttgcacttaaagacttgcacaattcagcaaacaaccttctccattctccaatggttcaacaagctattgtccatcaaacagaagaaaaatggtttgatgatgtgtcagagtcatctctgaggatgttggaggtttgtggcatctcaaaagatgttctcttgctagtaaaagaacacctccaagaacttcaattcactttgcgtagagcaagcattggtgatccaggaattgaagaaaaaattgcagcctacaattgctataggaagaaactgaagaaagaaacattgaagtggttgaagtggttgaagaagggtatgaagaagggtatgaagagtcaaacagccaccatgcaccctccaatgattaatgaacaaaagctagtgttggttgttgatgtgctaagagaagtgaggatgaccagcatttgtattgtggaatcacttttgtcccttgtttcctcaccttggttggatacaaaatcagggaaattaaggtccttcacatcaaagcttgtgcgtgcgagtttgcattgttgttcagatgatatgatctattatgatgccatggtgcttcaaagtgaaaacaaaaggttagcaggggttaggatggccatagaagatcttgaggtggagttggagtgcatgttcagac

SEQ ID NO: 99222 - DNA, 1161 bp, Glycine max
  Peptide Sequence Number=SeqID_216000
atgactggtaaaagttcaattactcagcggacagcgagacatggctcacgcaaaccgagaaaatttgatttagctgatctagaatggaccaatacgattcccgagtgtccaacataccacccatcagagcatgagtttgagcatcctttagtttatctgcagaagattgcacctgaggcttctgaatatggtatatgcaaaattgtttctccaattgcagcctctaacccagctgcttttgtcttaatgaaagagaaaaaagatttcaaatttgaagcaaatgtacagcctcttcgtctttctaaatggattgatgaaaaggatataatatccttctctctgagaggcagaaaatatacataccatgaatttgaggctcttgcaaacaaggcttttttcagtagatttcatagttcaggaggtcttccttcttcatatgcggaaaaggagttctggcatgagatgggctctggagagagggaaacagttgagtatggagtcaataatttctcacggctgccaccatccctgttacgtttagtcgacagggaaattcccggaataactgatcctatgctttacattgggatgctgttcagtatgtttgcatggcatgtagaagatcattatttgtacagcataaattatcatcactcaggtgcaaataaaacttggtatggcgtgcctggttatgcagcctctcaatttgaaaagactgtcttacaacatgtgtactctaataagatcttaacaaaacatggagacgatggagctttcaagtttcttgcacagaaaacaaccatgttcccaccaaatgtcatgttacaacatgatgtggcagtttacaaagctgtgcagaagccaggagagtttatcatcacctttcctagagcatatcatgctggatttagtcatggttttaactgtggagaagcagtaaactttgctaatggtgattggtttcaacttcgggctgcagctagcaggcgttatgcacatctcagaaggatgcctttaattccatatgaggaacttctttctaaagaggcaatgcaggtttacaagtcctcaagagtcagaagttccaagaagaagcctgaagacacagcatcttatcaaagctattatactgcctttcttgcatcttatgcaatcttataa

SEQ ID NO: 99223 - DNA, 1389 bp, Glycine max
  Peptide Sequence Number=SeqID_216001
atgaagctctccttctccgtcccatcatccaaaccccactcgaagcccaaagccgtctccaacaccttcgacgacaattccacctcccaaaacgacaccggcggaaccaaatacctcatcaccgaattcgacccttccaaacccgctcccacctccgtccccaaaaccctaattcccccaatccaaaaccaatggcaacccttcaagaagatgaagaatctccacctccccaccgccgccgacgtcgaatccctcgccttcgaactccacaccgacggggaccaacccgaatccgacatctcctacggcctcaacgtccgtgccgacaataatccagaaggaaacaacaaagacgacagtgatgctgccgcgccacggcgtcgagttccgctggaggccacggcgctgcagaagctgaaaagcgatctggagaggctgccggaggaccaggggatggaggagttcaaggatgtcgccgtcgagggttacggcgcggcactgctcgctggctacggctggaaggaaggaatggggattgggaggaacgccaaggaggacgtgaaggtggtggagatcaaacggagaactgccaaggaaggattagggtttgtcggtgatgctcctgccgcgctcgttctgagcaacaatgagaaggacaacaagaagaaggagaagaaggagaaggttgttaggattgttgggggaagagattctgggttgaagggtagtgttgtgtctaggattggggatgattatcttgttttggagctttcaaggagtggagagaaggtgaaggtgaaggtgaaggttggtgatgttgctgaattgggttctaaggaggaagagaggtgtttgaggaaattgaaggagttgaagactcagagcgaggaggataaagtgtcaaagagtaagcgcggtagggatgaggtggaggagaagagaggggatcttaataggagaaaggagaagagagttgatgttggtaggaaagaggagaggagagtggtggatcataggaaggtttcctggcttacaagtcacattcgtgttagggtgattagccgggatttgaaaggggggcggttgtatttgaagaagggggaggttctggatgttgttgggcctactacttgtgatatttctatggatgagaaccgggagattgttcaaggagtgtcacaagatgttctcgagacagtgataccgaaacgtgggggaccggtgcttgtgttggctggtaaatacaagggtgtctacgggagtctggcagagagggattttgaccgggaaactgccattgttagggatgctgatacccatgagctgctcaatgtgaaacttgaacagattgcagagtatataggggacccaagcttattgggacattga

SEQ ID NO: 99224 - DNA, 339 bp, Glycine max
  Peptide Sequence Number=SeqID_216002
atggcaaccaaaggaaatcgaagaagatcaaacttcaatccaaagaagaaaggagaagaatcttcctctgttccaaaatgctatgaatgtgatcaacctggacacataagagttgattgccctatcttcaaaagaagaatggacaaatctgacaagaaaaccttcaaagataagaaaggaaagaaagattacatcacctgggaagataatgatatgaattcatcaggtgattcagaaaatgaagtcgtaaattttagtctcatggccaaaaatcatgaaagcgaagaagagcattggaaaaatggtatgggttccaaaaggatctctagtcaaaactaa

SEQ ID NO: 99225 - DNA, 279 bp, Glycine max
  Peptide Sequence Number=SeqID_216003
atggatcctcttgtgattggacgtgtaataggagcctttcacaggttgcgtctctctgaggatatcgtctttaacaattgctcccaagttatcaactgctcaaaccctgaaggtcctgagttcatctccaccaactcagagggaatggtggattctgatgcacctagaccaggaaatccaaatcagagggaatatttgcactgtatattctttccatgtgaagaggctgtgagctatgaggatccaagcaatctacttcaacttaaaccctcaatttga

SEQ ID NO: 99226 - DNA, 249 bp, Glycine max
  Peptide Sequence Number=SeqID_216004
atggttttgctgcaatacttgatgaagatgaagcagcgaatgtttcaagtattgcatccgaatgtaatatccgttttcttaaacaaagaacggaaattacatacaacaaactcatggaatttccttgggttagagagaaatggtgtgtttccacatgactcagtatggaagaagactaagggtgaagatatcattattggaaatatagacacaggtacaattaatcaaacacttgggatatatgtatga

SEQ ID NO: 99227 - DNA, 324 bp, Glycine max
  Peptide Sequence Number=SeqID_216005
atgccgcattacagcgatgaggacaaggcttactacatcgcgaccttttgtacgctgacccatgacgggcgtgataacagcgcgcaggcgatgcagcagattattgaaggcggtaattcggattacgcgctgcagaagattcatttccagtccgggctggcagagcatctgcaaacggtgtggcaggatttgtcgccgcaacagcagcagcaggcacggcaggacgcgtttgtctgccgccagttgttttcagataagctgctgccgggccagccggataattgcacggtttgtagggtgcgcatttatgcgcaccgtaacaag

SEQ ID NO: 99228 - DNA, 730 bp, Glycine max
  Peptide Sequence Number=SeqID_216006
atgccgcacgccattttcaggcttttctccggcagattgagacgaggcttaacgggggatacaccgatcggttcaccctatgccgggattatgcgccatgacattgacgtacaggaataccgcgattttgccgaaaaccggggcaaatatgctatcggtgccaccgatattcccctctatcgcaaagatggcagctttgacggctatgtactggacgtgccgatgccggactttagcatggtcagcgacgagggtttcagctcatttatcgcgccatcttttgtcacaggtgccaaacatgttcgatatgttctgtcgctgaatttaggcaaaaaagccaaattttcgccgacttaccgtggcattaactacaataatgatcctacgcgagactttcatttaccgcgggttaataaggtggtcgtcgaaagcgcgccttcgccttacatcggcggtgaagaattattagcgaatcgcagtcgctataccgtatttgcccgcctgggtgcgggttatcagcaaatcgacgatccagaaagcggtaaattgatacctatcgatggcgcctacgtctataacaccggtggaacctttaaacccggcgccattacaactttctatcattactacataaagtggcgaaccttcgcgccagataatccggcattttctccgttgagcattggtacccgttcaggtgatagcggtagtccgatatttgcctgggaca

SEQ ID NO: 99229 - DNA, 242 bp, Glycine max
  Peptide Sequence Number=SeqID_216007
atggctaaagccttgttggcatcagtgccgcttttcctgctcctagcagtgagtagtagtgtggttgctgaagagcttgaaactcttccaccttcttaccctcaccctcactctcccacacaagcacctcttcacccaccagcaagtgctcctcacccccactttaactaccactcctgtagcatcttccagtgtaaaaccccactgataatgtggaaaacacatatccgtcggaccaaatg

SEQ ID NO: 99230 - DNA, 204 bp, Glycine max
  Peptide Sequence Number=SeqID_216008
atgagacatcaacaaaccaaaaagagcaacggaactgcgaaagtgatgctgaacgtgagactagtgagagtgtgtgagggtcgagcgagagagtgtgagaaagggttgagcgagaatgtgagggaagggtcacctgaacaatatgcgcaatccttgtttgtgcgccatgagaagtggaaggcaacgcctcaatgctatgaatag

SEQ ID NO: 99231 - DNA, 225 bp, Glycine max
  Peptide Sequence Number=SeqID_216009
atggctcttcctcttcacagatcgatcctgttgtcggcggtgggcaagagcgctaaagttgaaaagccggctgcaccggaagctgctgagctgctatcctcaaattggagtcaggtgaacttgcaagccgcgaatttagccgtggaggcaaaatcaggtgcaatgaaggagcaggatagttacaaggagattgaatcaagtgcgttgaaattgaattcagtttaa

SEQ ID NO: 99232 - DNA, 606 bp, Glycine max
  Peptide Sequence Number=SeqID_216010
atgcattatgtattcttggtcaggataaactttgaagtgtggactctggctcggatggttctccaccctgaaatccaagcaaaggcacagcgcgaaatagacttcgtttgcggatcctccaggcccgtatccgaagcagacattccgaacctgcgctaccttcagtgcatagtaaaagaaacccttcgtgtgcacccaccaggcccgctactctcgtgggctcgccttgctgtgcacgacgttaccgtgggcggcaagcacgtgattcccaagggcaccaccgcgatggtgaacatgtgggccataacccacgacgagagggtgtgggccgagcccgagaagtttaggcccgagcggtttgtggaggaggatgtgagcataatggggtctgatttgaggttggcacctttcgggtctggaagaagagtgtgccctgggaaggcccttggtttggcctcggttcatctttggctcgctcagttgcttcaaaattttcattgggtttcatctgatggtgtttctgtggagttggatgagtttcttaagctttctatggagatgaagaagccactgtcttgcaaggctgtgcctagggtttctgtttag

SEQ ID NO: 99233 - DNA, 189 bp, Glycine max
  Peptide Sequence Number=SeqID_216011
atgttgacgtcacatattgctccaggtctggtaaccattaccaatgttgataaggccatcaggaatcaagtgtctggaactcacattgatttgaggaaaaaagtcaatgtaaatatcagttctattgcagtgaaacgtactcaagttacttccagcgggagatgtgacggacttgcattttcaaattag

SEQ ID NO: 99234 - DNA, 531 bp, Glycine max
  Peptide Sequence Number=SeqID_216012
atggatccagacgcgttggcaaaggcattcgtggagcactactacagcaccttcgacaccaaccggaacggtttagcgaatctgtatcaggagggttccatgctgaccttcgaagggcagaagatccagggcgcttccagcatcgtcgctaagctcacttccctccctttccagcagtgccaccactccatctccaccgtcgactgccagccctccggtgtcaacgctggcatgcttgtctttgtcagcggcaacctccagctcgctggcgaacagcacactctcaagttcagccagaatatctgttggatatccaaaggcaagttggtttctttactcttcattgtgccctcaaccacactattaaccaggggaagtcctttaagctctcaaattttggatgctttcaacatgcttcttgatctcaaccttcctcctcatgtgctcttaccaatgactgttcttgtctttttcatttatatcaatttgctagcaaagttattgcacttttctttatcagtgctttggtag

SEQ ID NO: 99235 - DNA, 906 bp, Glycine max
  Peptide Sequence Number=SeqID_216013
atgtcaccagatttcacacttttgttcttcccggaactcatgcagtcccctatgatcactttccaagccaccctctgcgtccttctcttcaccctcatgttcacgctgctcttcactcctggtgggcttccttgggcctgggcccggcccagacccatcatccctggcccagtaactgccctgttagggatctttactggctccacgcctcaccgtgctttatccaaactcgcccgtaattaccacgcggaaaaactcatggctttctccatcggtttaacccgtttcgtcatctccagcgaaccggagaccgctaaggagattctcggcagccccagtttcgctgataggccggtgaaggaatccgcctatgagcttctcttccaccgcgcaatgggttttgcaccgtatggggagtactggaggaatttgaggagaatctcagccctacatctcttctccccgaagagaatcaccggctctgaatccttcaggagcgaggttggattaaaaatggttgaacaagttaagaaaaccatgagtgagaaccaacatgttgaggttaagaaaattctacactttagttcgttgaacaatgtgatgatgacggtgtttggtaagtcttatgagttttacgagggtgagggtttggagcttgagggtttgggtgtgaggaagaggtgtaggtgtttggttgaaaaggttaatgtttttgttggaggggttattaaggagcatagggtgaagagggagaggggtgagtgtgtgaaggatgaaggaactggggattttgttgatgttttgcttgatttggagaaggaaaacaggctcagtgaagctgacatgatcgctgttctttgggatttgcttcttttcaacatgcatgcaaaaacgttttcaggataa

SEQ ID NO: 99236 - DNA, 2316 bp, Glycine max
  Peptide Sequence Number=SeqID_216014
ggaaagctcagttctggagctggggcacaattgtcaccaagttcctcttctgtgtatactcagagtcctagcccatattctactcagaatccagggtcaacatccatacttggcgattcatatgaacctaatcagagtttctccagtccagggtctacagaagttacgtctgatatgttcgtactgaacaataaaatgggtcacatggatgggacagatacagaatcaggaacctcgcctgaactcgaggttactcaagctttgcgccgattggaggtgcagttaagtttgaatgaggacaactttgaagatattgtttccttcggaagtaagcacgaaactacacatgattcaaaccctcagcacgaccaaagggtgatcagcaatcaagagcaatctgctgctttctctggacctgatgatcaagggctattttatgatggatataatggaaggcaaggtgatggtggtgaattttatcatgaattaatagaccatggttaccctgatggaaatgaaaaggctttatggacagaggtgctggaatcatctgttttctcacaacctcaaggtgttgatgaagtcaaatttcctgtctattcttctatggtggaaacacaagtaattaattctgactactatgaaacattgtttgaccaaagccaaattggagcacctccagatgcaaattcaagcttgactgttgcacaaaaacagaaatttacaattaagacaatctccccagaatggggttatgccactgagactaccaaggtcattgttgttgggtctcttctctgtcatccctcggattctgcatgggcttgtatgtttggtgatgttgaagttcctgttgagataattcaggatggtgtaatctcttgtgaagctccatctcaccttcctggaaaggttactctgtgcattacttctggaaaccgggagtcctgcagtgaggtcagagagtttgaatatcgtgataagaccaatagttgcactcaatgtactcaatcagaaacagaagccactagaagtccagaagagctgttattacttgttagattagagcaaatgcttctttctgcatcaacaataaagaatgacaacatagaatctggaattcctctcataaaacagaaagctgatgatgactcgtggagccatattatagaggctcttctagttggcagtggaacgtcgactggtactgttgattggcttcttgaagagcttctaaaggataagcttcaacagtggctttcttgcagatctcaggaaaaagatgaagagacaggctgctctttgtccaagaaagagcaagggattattcacatggttgctgggttaggttttgagtgggccttgaaccctattctcacttgtggagtcaatataaatttccgtgacatcaatgggtggactgcccttcattgggctgcacgttttggaagggaaaaaatggttgcttcacttatagcttctggagcatctgctggagctgtgacagatccaaatgcacaagatccaaccggtaaaactgctgcatctattgcagccggcaatgggcacaagggactggcagggtatctttcagagatagctgtaacaagccatctgtcatctcttacactggaagagagtgaattatctaaaagttctgctgagcttcaggcagatatgactgttaacagtgtctccaaggaaaatcttactgccagtgaggatcaggcatcactcaaagataccttggctgctatcagaaatgtaactcaggcagctgcgcggatacaatctgcttttcgttcacattcttttagaaaacgaagagcaagagaagtagctgctagtgcaggtggcattggtaccatttcagagatttctgctatgtcaaaacttgcctttcggaactcacgtgaatataattcagctgcttcagctgctttatcgattcagaagaaatatcgaggttggaaaggtcgcaaagatttcttagcgttgcgcaaaaaagtagtgaagatacaggctcatgtgaggggctaccaggttaggaagcattacaaggtaatatgggcagttggaatcttggacaaggttgtcttacgatggaggagaaaaggagctggtttacgaggtttccgacaagagatggacatcaacgaaaatgaaaatgaagatgaagatattctcaaggtgttccgaaaacagaaagttgatgtagaaattgaagaggctgtttcaagggtgctgtccatggtcgactcaccagatgctcgtgagcaatatcatcgcatgcttgagaaatatcgtcaagctaag

SEQ ID NO: 99237 - DNA, 126 bp, Glycine max
  Peptide Sequence Number=SeqID_216015
atggtggtggtggtaatggcatatgaccatggtggaatggtgaccggcgacaacaataatggcagtgacaatgataatactagtggcttgtgttatgaaaatcgactcgataatcgattcagttaa

SEQ ID NO: 99238 - DNA, 348 bp, Glycine max
  Peptide Sequence Number=SeqID_216016
atgatgatgatgatgggaagggttctaaattatttgacgtatttatgttgtgaggctcaagcaagatggttgaagcctgcagaagtgatgtacattttacagaatcatgaaaagttccagttcacccaagagcccccacaacagccaaccagtggatctctgtttctgtttaacaaaagagtcctgcgtttcttccgtaaagatggtcataactggcgtaagaaaagagatggaagaactgtgggagaagcacacgaaaggctgaagttgtccatgaaaaaggaaaacctgttagctagtaagtgtctagaggggctatcagttgtagaaatgcagtccataaattaa

SEQ ID NO: 99239 - DNA, 909 bp, Glycine max
  Peptide Sequence Number=SeqID_216017
atgggagttggtaatttatactcaatgaaaatgtccttctccaatgctaatggagctccatcgtacaaggacacgattgttgggattagacctacaactgtgggacctacgactgaagaaagtatgactgctgatgagatcattaatgtcgtgatagaggaaatctgtcctactccttttatggatgataatgagatagagaaagtaaagcccattaatcctttccctgagatagaagttaatgttgaacaatatgagcgttggtgtggttattggaagcatcccctgttagtgaaattaatgggtaaaaaagtgaacctcaacttcatatcggctagactccaaaaattatgggcttgtataggcactgttcaagttttggatctgaaccatgacttcttcctgtttcgtttctctcatgaggacatctatgggggacgacatctatgggggacgacatctatctttatctctatggtgttttcttctacttatcatgtccatctacatatcaacccgagatctctcaatttgtgggttttcactactatttatgctagcccccaattgggtaatcttgttatcctctgggataagctttgtaatatcgataatgatggttctaatccttggattgttgctggggatgtcaaccaagtgttgtatcagagtgagaagcatggaggaggtttcctcaatttgtcttccgctactctcttggtcgattgtcttaatgattgtaatattagtgaacttgggttttctagccctcctttcaccaagaaaagaggcaccctctataagcatttggatagggttgtggctaatgttgtggcagtagaaattccacaattccaaagtggtttatttactgtcccctcttatgaccattgttggcaccctctataa

SEQ ID NO: 99240 - DNA, 306 bp, Glycine max
  Peptide Sequence Number=SeqID_216018
atgtctcttgctaggtgtataactttagctcaatcctcatttttgagcattctggggtacattatgcaatcaactctccttttggcttctgttggtaaagctattgagaaattatgcaaagatttcatatgggactcttctcatgataggaaacaatttgtaaaccaaaacacaaaggtttttgaagattatcccatttggagtttctctaaggatagggaattttccatcaagaaagcttatgttatgttatccaacgaggatgagtttcttcctcatcctattaggaatgaaagaaatgaatga

SEQ ID NO: 99241 - DNA, 402 bp, Glycine max
  Peptide Sequence Number=SeqID_216019
atgtcggattggggtccagtgtttgtgtcgttggtgctgttcgtgctcttaacaccagggttgctgtttcaggtaccagggaggtcaagggtggtggagtttgggaactttcaaacaagtggtgctgccatactcattcactccctcctctactttgctctcatatgtgtcttcttgctggctggtgtgatggcagcagattggggtccagtggtgatatcagtagtgttgtttgtgcttttaagcccagggttgctgtttcagcttccagctaagggcaaggtggtggcatttgggaacatgcaaactagtggcttatctatcttagtccacaccatcatcttctttggactcatcaccatctttctacttgccattggtgtgcatatttactctggataa

SEQ ID NO: 99242 - DNA, 225 bp, Glycine max
  Peptide Sequence Number=SeqID_216020
atgccgcaagctgaagaagaagaacacgaacacagcaagggacgtgacctcaacaagaagtggaccaacacaccacgacggcgcaggaatgcactgggtgaagaagcttgtcatgacaaaaaagaaagaaagaagaagacgaagcgggagctgcgtgaggaagaaaggaagaagaatgccaaaagtcgaagagaaaaacaagctgggtgcaccaaaaccttttaa

SEQ ID NO: 99243 - DNA, 261 bp, Glycine max
  Peptide Sequence Number=SeqID_216021
atgtgccactcgttcgtagagaccgtcgtcaaccacaatgaagtgagttgtggaagatggagctttggggctgacaaatcaagggtttgtaagttggaggagctacaagaaactataagagtcactaaagatgccaagaatgatgcagctgcaggagaggcaactccttgtgctattcatttagctgattttgtgaacactcctttatatgtggttcatgtaatgagcattgatgtaatggaagaaattgcaaaggcctag

SEQ ID NO: 99244 - DNA, 204 bp, Glycine max
  Peptide Sequence Number=SeqID_216022
atggggaagaagaagctggagataaagcgaatcgagaacaaaagcaatcggcagataacattctccaagaggcgcaaaggattgatgaagaaagcccgcgagttatccattctctgcgatgcgaagttggcgctgctcatcttctccagcaccggcaagctctacgagctttgcaacggtgacagaaaacactttaaagtgtag

SEQ ID NO: 99245 - DNA, 510 bp, Glycine max
  Peptide Sequence Number=SeqID_216023
atggaccaattaaagcgcctaagcatcccctcagaaatgattagattctctaaccacgcttgtcacccacgtctgggtcattcgacaagaaaaatcagcatgcaacagggacagacagttatcctcatagctaggtttcctgaccctaactatggtgttaaaacaagttttattgcaacaattgatgaaatcaaaactcttacttcattccaagaagctctgaaatatgagtgggttcaagccatgaatagagagataaggacattggaaagaaactcaacctcagagatagttgacaaaccaaaagataagaaggcagcgggattagagaagctgacaaaaggacttttagccttgtctccaaacaagatcattgctaatgttattaatgtggtcatccaatttatgcatgatccttgtgaaaggcacctgcaagaagttgatagaatccttcaatatccaagaaaaggattgttgttcaagaaaagtacgttcatacattatcaatag

SEQ ID NO: 99246 - DNA, 492 bp, Glycine max
  Peptide Sequence Number=SeqID_216024
atgacacatatttgtaacgtgttggatgagttaagcagtcaacaggagtacttgaagctgaaggcacgttatgaggccctacaacggtcccagaggaaccttatgggagaagatcttggtcctttaagcagcaaagagctcgagtctcttgaaaggcagctagattcgtccttgaagcaaataagatcaaccaggacccagttcatgttggatcagctctctgatcttcaacgtaaggaacacttgctaagtgaggctaacaggtctctcagacaaaggcagttggaagggtatcaaataaatccactccaactgaatcccggagttgaagagatgggatatggcaggcatccagctcaaactcatggtgaagccctctttcaacaaatggagtgtgagccaacgttacaaattgggtatcagcctgatccagtatcagtggtgacagcaggcccaagcatgagcaattacatggcaggatggttaccatag

SEQ ID NO: 99247 - DNA, 711 bp, Glycine max
  Peptide Sequence Number=SeqID_216025
atgaagaacattattcctggttgggattttgagactgatgcatgtctcaccaaacaaacaaagctcatagggccagaccaagaacttgtacaactcctatggcaaaatgggcaagtagtgaggcacaaccaaacatataggaagccacttgggaattcatctaacttgagacaggtgcagaaaacggatcattcaacattaaggtctagtggtccctatggaaactcaagcaacttggatcaagaagaggccaccccatggatccaattcccacttgaggacccattggaacaagacttttgttcaaaccttttatctgaactaccaccaacttgtgaatttgaatcttacaagccaatcaagcaattggaagaggacaagtttaccaatttttttgcttctagatttgctcccaatgctcaagataacagggaggggcttgttttactcatggatgccattgagaaggctggttatactggctttggaaggttttcttcgagccacggttccaagagcagcgtaaggggttctgtgggttcgagcgaagggttttcgacagtattgaaaacaatgtgggtgtcgagggagcggtttccagtagatttcaggctggaggagaaagagaagagcgatttcaagcaggaggagaaagtgaagagcgagtgcaaggttttcgagcgcgcgggttgtgaaatgtcaacgttttaa

SEQ ID NO: 99248 - DNA, 186 bp, Glycine max
  Peptide Sequence Number=SeqID_216026
atgtccatttgttcttgcttgaggcaaggctcccttgtaatgtgttcaagcccccgtagatcgatattcacgttgcttatgctgtggggatcagagttagataaacataaaccatcttgtattcttcataggattctaatgcccagattgggttctgctggggcattggcgttgatggttttgtag

SEQ ID NO: 99249 - DNA, 114 bp, Glycine max
  Peptide Sequence Number=SeqID_216027
atggaaaatatggtctcaacggatttcaaaggtgtcctcgtcatagaggagatcataggagcaccggtggtacctagagggaggaagcatatggggagtgtattagttttttaa

SEQ ID NO: 99250 - DNA, 234 bp, Glycine max
  Peptide Sequence Number=SeqID_216028
atggtattttttgaaagaaaaaaagagttagaaaaacgcaaaaacgagtcttcaaagacacacaaagagttgacaattgtactagcaaaggaaaaagagttagaaaaaggcaaaaacgagtcctcaaagaggcaaagagttgacaattttttcgaaaggaaaaagagtcagaagaacgggaaaatgagtcttcaagaacacacaagagttgacaagtgcactggcaagaggtaa

SEQ ID NO: 99251 - DNA, 516 bp, Glycine max
  Peptide Sequence Number=SeqID_216029
atggacccccttgttcttggacgtataataggagatattttggatcccttcacgagttctgtttctctgagggttgtttataacaaccagtcatcggttatcaatagttgtgagttcaaaccttcccaaatcgtcaacaaaccaagaattaatattcgtggaaatgacctagggatcttttacactctgataatggtgaaccccgatgctcctagcccaagtgacccacatatgaaggaatatttgcattggttggtaaccaatattccagcatctacaggggcaaccactggagaagagattgtggagtatgaaagtccacgaccaacttctgggattcatcggattgcttttgtgttgtttcgtcaatttgatagacaaattgtgcatgctccaagatggcgccaaaatttcaacactagagattttgctgaggtttacaaccttggatcaccagttgctgctgtgtatttcaactgtcaacgtgaaggtggttggggtggacgaaggagatga

SEQ ID NO: 99252 - DNA, 454 bp, Glycine max
  Peptide Sequence Number=SeqID_216030
gagtaccgggctttagctcacctatatggaccgtcaccgacgtcgcttcacttgttccccgcgctgctcagcacgcaccctgacacctgccgcaaggagtcattgatggaatttctcttcgacccctcaatctgggcgggtttactgacgctgatcgtgctggagattgtgctcggcatcgacaacctggtgtttatcgccattcttgccgacaagctgccaccgaaacagcgcgataaagcgcgcctgattggtctgtcgctggcgctggtgatgcgcctcggcctgctgtcgctgatctcctggatggccaccatggaactgcacgagcggctggaaaaccgcggcatggagcatcagggcaacaaagcctatgccagcttctgggcggtcgtgacgcagattgtggtgctggacgcggtgttctccctggatgcggtgattaccggcgtcg

SEQ ID NO: 99253 - DNA, 422 bp, Glycine max
  Peptide Sequence Number=SeqID_216031
atgctttcttttaacttccggcatgtcgcggaacttcacggattgcctaaccatgggtgccaagtacctcgaaatggtcaaatgagggtttcatcccaacaacaagatggtccccagacgaaattagggtatgacaaaccccttaaggctagtatgcaagagaagactaactccataaagtgctttaaatttaaatgtcttggaagaaggcacattacttctcaatgccccaccaagaaaaccatgattatgaggggccaagacatttatagtagccaagatgagcttactacttcaccttcctctagtgaaagtgaagaagcaaaaggggaagaatctagtgaagaaatatacccccaagaaggaggacaacctttaatggttaaggaggagtgtaaggatctaagtgtctcctccaagag

SEQ ID NO: 99254 - DNA, 666 bp, Glycine max
  Peptide Sequence Number=SeqID_216032
ccggtcatcatcctgaccgcgcacggctcgattccggacgcggtagccgccacgcagcagggcgtgttcagctttctgaccaaaccggtcgatcgcgatgcgctatacaaagcgattgacgaagcactggcgcagcgcgcgccggtcagcgatgacggctggcgcgaagcgatcgtcacgcgtaatccgctgatgctgcggctgctggagcaggcgcacatggtggcgcaatctgacgtcagtatattgatcaacggccagagcggcaccggtaaagaggtgctggcgcaggcgattcatgctgccagtccgcgcgccggcaaacctttcattgccatcaactgcggcgcgctgccggaacagctgctggagtcggagctgtttggccacgccaaaggcgccttcaccggtgccgtaagtgcgcgcgaagggctgtttcaggcggcggaaggcggcacgctgtttctcgatgagattggcgacatgccgcaggcgctgcaggatcccggcactgcacgaacgcgccgaagacatcccgctgctggccaaccatctgctgcgccagtcggccgatcgccacaaaccgtttgtgcgcagcttctcggtcgatgcgatgaaacggctggtgagtgccagctggccgggaaatgtgcgccagctggttaa

SEQ ID NO: 99255 - DNA, 669 bp, Glycine max
  Peptide Sequence Number=SeqID_216033
atgactaccctgacccagatatggatgacgttgctgctcagcaacatccagcccagcgatcataattccaacctccccctgccgaagtatcagctagtgtatgccactctgacatggatgagcattcatgtggctcagttgatcactgatgccatttgtctatttgcaggtatgccacctaccaggcaccctttagacccagataagtctaacagggccttgggttttctggcattgatcacgggtctctgccagtctttcggggttcctgttgcgcccagtaaggtgatccgatcgccgatcactcgcgctttcatagagaaatactgcacaactagacaggcacagggtggtgaccctcaggccccagatgcaccgccaccacctcctcatgctgacccaactggcagacggccaaccaccgggtgcacgtgcagacccatgactctctatatcagcttagcctcagccctgcagagccagggttttgcttcttttccatgccctactccggatcagttcagggcagaggtcgcatggccaggagattggcttgaggcccaggcaggggaggcatccgcagaggctcccgacgaggcagatgaggcccacgaggacgaggagatgaccgatttgcttgatttcttgggagggagcggagccacatga

SEQ ID NO: 99256 - DNA, 351 bp, Glycine max
  Peptide Sequence Number=SeqID_216034
atgtcgatgacactgtatgcaaaaagtatgacattagcaaggagaaatgggcccaattttgtcagagccgcagagagacccttcgtgggaggatgtgtgaaaaaaggcacagaccatccagaaacaaaacaacccctcacgtgttgtctcttgatggaggagaagaaaaagaaacaactagatgaagctgctaaatctagaagcacatacactgtcattgatcctccatcttccatcagacgacacgtgaagtggaagatggcccacactaagaaaattggacaaatgacttatgaggcagctaaagaaattgctaacaagattgattccttggaggagcaagcctcatag

SEQ ID NO: 99257 - DNA, 321 bp, Glycine max
  Peptide Sequence Number=SeqID_216035
atgggaaggggaagagtggagttgaagagaattgagaacaagatcaacaggcaagtgacctttgcaaaacgaaggaacgggcttttgaagaaagcttacgagctttccgttctttgtgatgccgaggttgctctcatcatcttctccaatagaggaaaactgtacgagttctgcagcagttcaaggtttgagggtttctgcaaacgcgttgctgttagatctgcaactggaaacgctcttgagctttctctttctttcccatttttggtgctaaacccagcatttgagattgccgtttttctgctccgtcaaacagatcag

SEQ ID NO: 99258 - DNA, 609 bp, Glycine max
  Peptide Sequence Number=SeqID_216036
atggtcaacgagggtcgcatcccaacaacggatggacaaagggtaattggagagccagctgcctctgggttagtccttgatgaatcttggctttggcatcttgactttgagacttctacaaagttagtccccctattaggaaatgaggacatgataaggccgcaactaaggactgaggctacaaatgttgcaaagattgtaactactttcttaaaaagtggtgtggttccaagtcagattggtgtgataacaccttatgaggggcaaaaaacttatattgtgaactatatgtcaagaaatggtgtttccaggcaacaactttacaaggagattgagctactacatgagttttattcttttccggttgctagtgttgattcctttataggaagggagaaatactacatcattttgtcttgtgttagaagtaatgtacatcagggcaaaacaattggtgttaatgtagaagatgatgattcatacatggacacctatgttagtcctttgaccgctcaaatcactcgtaacgttgtcggagaagaagaagctgacgacgttcattctaatcgaaatgatcatgatgaaggagaattgattaacatcgtctaa

SEQ ID NO: 99259 - DNA, 1165 bp, Glycine max
  Peptide Sequence Number=SeqID_216037
cgacctgctggacaatcgcatcattctcgtgaccggcgcttccgacggcatcggccgcgaagccgccctgacctatgcgcgctacggtgcgcgcgtgattctgctcggccgcaatgccactacgctacagcaaaccgctgaggcgattaatcagctcaataaacagcccgccgctacgctgctgctggatctggcgcacgccacaccggaaagctgccagcagctggcgcaacaggttgccgcgctggtgccgcggctggatggcgtgctgcataacgctggcattctcggtgagatcgtgccgctggcggaactcgatccggcggtctggcagcaggtgatgcaaatcaacctcgacgccaccttctatttaacgcaggcgctgctgccgctgctgctaaaatccgacgccggttcgctggtgttcaccacatccagcgtgggccgcaccggtcgcgcaggctggggcgcctatgccgtgtcgaaattcgccaccgaaggcatgatgcaggtgctggccgatgagtataaaaaccgccatctgcgggtgaactgcatcaatcccggcggcacgcgcaccaaaatgcgcgccagcgccttcccggaggagaatgccagcctgctgaaaaccccggccgacctgatgccgctctacctctatctgatgggcgatgacagccgccgtaaaaccggtaaaaccaccgccgcttttggcaccgcgctgcgcgcctgcggccacggtaaaaacgtggctgccgtgcagtttattaagggcgaatggcccaatggtgaacgtaatctgctggcgcagcacggcgtggagtttcaggtgatggccaccggttttacctgggagacgcaaaaccgtgccagcgatacggccgcctgccagcaggtgtggcaacacgccagacgcatgctgcaagacgcgtcgctggatctggtgatactcgatgaaatcacctacatggtgagtatggattatctcgatctggatgagctgatcgctgcactgcagcagcgtccgccgcagcaaagtgtgatcattaccgggcgcggctgtcaccgcacgctactggaactggcggataccgtcagcgagatgcgtccggtcaaacacgcgttcgatgccggcattcaggcacagcagggaatcgactggtaa

SEQ ID NO: 99260 - DNA, 216 bp, Glycine max
  Peptide Sequence Number=SeqID_216038
atggagatgcataaacaggctaaacaacctcacactatccctagcaatgaagcattcagggatgaaaatatgtggagaaatggaaggaagatgagtggggaggtattcagtggctctcaatggttgtcttcttcttcgagctttaggttttttgttctgctcccaatcagaagtcccctatttcctcctattctttcacttgaaaaaccattatga

SEQ ID NO: 99261 - DNA, 273 bp, Glycine max
  Peptide Sequence Number=SeqID_216039
atgtcgtctcaagtttcgaagcatgttacagagcaagagtctggtcaggacctgttcgaatcgaaaagagagaagagtcttttgaaagggattcccaggttcaaggaagtatttgcgaagtacaaggctaggacaggaaagagggcttcgaatcattgggcgattcgagttggtgtatggtcgagtcgaagtcaaggcagcaagatttctggacttagcacaatttctgacaaagcttcacaaagccagttcgacttcgagcaatgtggataa

SEQ ID NO: 99262 - DNA, 120 bp, Glycine max
  Peptide Sequence Number=SeqID_216040
atggaggtagaactttgtacacatagggggtgtcagaaactctaccattttaaggagaacaacatctgcatcaacataatagcacgtggaccttattccaaatttggcacttccctttaa

SEQ ID NO: 99263 - DNA, 1347 bp, Glycine max
  Peptide Sequence Number=SeqID_216041
atgttgaaatctttgcggaaaagcctaagccttcaacagaagtgtctccagcacaagaaccaagttgataacgctgagtcagtgcatggtgcaaacctggcaaattgcattttttgcgtggaggaaactaaacaatgcaagtgtgaccacaacaacattgaggatacaaagagtgcagaagggggcaccaatttagatgcagagcatgactccgaagccaattgttctttcactcatgctgtcatcaatatggtcgggatgctcataggactcggtgtgatatgtgcatatagttctcatttacttgggaaatgcctagaaaagaacaccaagttaagaagttacgtggacattgggggtcatgcatttggtgcaaaaggaagaatcatggctacaactttcatctacatggagatcttcatggcccttgtttcctacaccatctcattgcatgacaacttgaattcaatcttctcagggatgcatctgaagctccaattggcaaaactatctacattacagctcctgaccattggtgcagtgttgattgctctgcctagtttgtggctcagagatctctcttccatatctttccttttaactggtggcattctcatgtcccttgtcatttttgtgtcaatagcatccactccaatttttggaggtgttcaaattaatcataagatacccctcctccacctccacagcattccttcaatttctggcctttacatcttcagctatggaggacacattgttttccctaatttgtataaagccatgaaagacccctcaaagtttaccaaggtatctatagtgagcttcacattagttacattactttacacgaccttgggtttcatgggtggcaaaatgtttgggccggatgtcaattctcaggtaaccctcagcatgccaccaaagctttttgtaacaaagattgctctgtgggcaaccgtggtgacgcctatgaccaaatatgcccttgaatttgcacctttcgctattcagttagagaaaaggcttcccaagtttaacagtggcaggacaaaaatgataattaggagtagtgtgggttcatttttgcttttggttatactagcccttgctctttcagtgccatattttgaacatgtactctgcctcactggttctctagttagtgttgcaatttgtttgattttcccatgtgctttctacataaaaatttgttggggtcaaatatcaaagcctctctttgtcctaaacctctctatcatcacatgtgggtttcttcttggggtcatgggcaccatttcctcctcaaacttgctagtgaaacattttctacaagctcaatctgcttga

SEQ ID NO: 99264 - DNA, 1332 bp, Glycine max
  Peptide Sequence Number=SeqID_216042
atggagatcgttcgtcctcagaatcgcagaaacttgttgtcctcctccaacgaagccgtttctgctcccaccattcccctctatcgctctgctcccccacttgaagtcaggctcgaggatttcgagtccttcgccatcgatcgcctccgagttctcaaggggatttctgatggtaaaggacctgtggaaagtgaatatgagacatcaagaggcaactcaggttctgaacaaggatattatatctcattttgttctacgtctggtgtattgcagaacgacttgaggaaatggtttctttccatggaaactgcactctttcgctaccgttttcgtcttctgaatgctgaagctcagaggacagtcatggaagaatttgaccttccttacagggccgttagcaatgtggaatttgagagcataaaagagaaattgggacaagttgcacgttctatgggtcagccttcacctactgctgatgctatcttctacaaggtaccgtttgaagaagttccagagcttgttgctggacggagagtgtttataaatcaaggatatgcatatgttgcaatgaatcagagtattggttatagtaaatcttgtttgtgtttcaactttgccaccttcctagattgtttcacttgtagccacacaattccgcagtcagctgtcaaaggcacttatccttacaaacagattcttagagtttcatctaattgttgcagaaaatggacatcttcaattagagagcaagagaaacataggttgactcctattgtggaagccctgtcctcaagttatctgggtcctgattattctcagtcaagagaatatgctgatatatcattaaaggacatagatcaagttgccaagagctcatttcctttgtgcatgcgtcacctatttgataagggtgttggcttaaatctggatgatgcacttgcattttggaggtcagagttctctaaaaaggttggtttggagaagtttgagaaacaatatgcatacaacatacgccataattatggaaaggaagggaagagaactgattatactccctattcttgtcaaaagattatttcatcaactcctggagctggggatcatcatggttgcccctatcgacatttcagtgaagagaacctaagagctgctcttagcggaatgggggtaaacagtcaagcaatggaagatgtgatggacaaagtgagaaatagacattatcagttggcttgcaccttgacatttgaagctcttcatggcatgccgtgtgatgcagggattaaccatccaaatcaatacttcagtgacagtcaaaagatattaaagccaaag

SEQ ID NO: 99265 - DNA, 676 bp, Glycine max
  Peptide Sequence Number=SeqID_216043
gtttagaatgtctgctgctgtgtctgcaaccaaggatgttcccttcaatgctcatctggaggaagatatcaaaaacaaaggaagcaacaaggttgttggggaagcagaccggcttccttacaatgatgatgccgaaggaactgattcagagacagaggaagaccccaagttggaattggatcttggtcctcagttttccctcagggaacagcttgagaaagataaagatgatgagagtttgagaaaatggaaggagcaacttctgggaggtattgatgtgtctgctgttggagaaaacaaagagccagaagtgaagatagtgagcctcaccataatatgtccagggaggcctgacctcattctgccaattccatttacttctgaatctaagaatagtatcttcacccttaaggaaggaagtcaatatcgcttgaaattctccttcactgtctccaacaacattgtttctggcctcaaatacaccaatgttgtttggaaaactgggcttagaggggaacctattcagcaagaaccaagggatgggggtggaaatggaccccatgtggataaaggaacagaaatcaacaaatatcctcaactactgcttgtgctttatcaagcaaatagccaaaaggtccgtcaattctttgatggtccagaagcttttgtcatatga

SEQ ID NO: 99266 - DNA, 798 bp, Glycine max
  Peptide Sequence Number=SeqID_216044
atgatgagaaaaattgactttaagaaacaatttcaaaattttctcgcattttgtttggttaaggagaaaacacatgtaacaatgcttatagaggtggtaagtgaacaaaaacctgtggttggcatgcgcatgtacttggagggcaggaaatgtgacagacttgctttacatataaatcatctttcaagcctcccaaataaaatgatcctctcttcaggaacctcaaccttgagtacaccatcgatgtggcgaggatctgatgataatgaatccagtgatcaatttctggaacgaatcagatggaagagattctcaaatgtgtgcacagcagtggttaagcatgatcctaactggttgaataattctggaggtgtttatattgtaacaggtgcacaactccttagcaaagggagctggccaaggaatgtgcttcatctgcggcttctctttgctcatacacctaattgcagtatccggaagtcagagtggactgctgcaccagaggcttcaagaaaatcatcttttctcacaaatttgagcacaacattttcgttcacacagcacggaaacactggtcctccaaaacaggctccaactgtacttaactctggagtttatccagatggtccacctgtgccagttcgtgccggtaaactacttaaatatgtggagacagctgaggttgtgcgaggcccacatgatgctcctggccattggttggtaacagctgctaagcttgtgactgatggtggtaagattggattacaagtgaagtttgcattgttagattattggtga

SEQ ID NO: 99267 - DNA, 222 bp, Glycine max
  Peptide Sequence Number=SeqID_216045
atgacaatgatccaaccctctttgaccaccgttgtctgccatattccagatttgaggcatttctccgacgcgccactgcaagacggtattttggaggcgatggtgatgtggttgcaatgtgttggtgggcttggacgcatatctgttgggtgtggcgaccacggccacaaatcggagtgtagccgggttctaaaggagccttggagcgaggttgaagtttaa

SEQ ID NO: 99268 - DNA, 462 bp, Glycine max
  Peptide Sequence Number=SeqID_216046
atgagtgaagatgctcatatgagtgaagatgctcctcagatgattgcggacgtagatgcgactgttgcagaggacttaggtcgtgatgatattgaggggtcacatgctgatgagggatttcctggtaacgttctgctgttgagaaacaacttaaatttgagtccagatattgctgaagtctcacaggagaaattgctttcattggttgctgaaagattaattgattcaaatagtagtgtgaatggcaaagatgcaggctatgttgaaaatcaacaacagaacattgctgatgcaattgacttactccctaggcttgctactggaattgatgtaaatataaaatttaggagaatagctgattttgaattcactcgagagtgtgccatatttgatctgctggacattcctttgtatcatggctggatggttgatcctcagttgcctccttgtgccacatcttaa

SEQ ID NO: 99269 - DNA, 822 bp, Glycine max
  Peptide Sequence Number=SeqID_216047
atggtgttgtggagaggaagcacagacattgaaatcagaaatcaacctaatggtgctctcattctcactcagtccatgtatatcagggacttgttgacaaagactaagatgaatgaggtcaacccggtctcatcccgtatggttggtggctgtctgttgtggctgccttgcagtatgcaacaatcatcagacctgagatcagctctcattctcacacagtccatgtatatcagggacttgttgacaaagactaagatgaatgaggtcaaccccgtctcatcccgtatggttggtggctgtaagttgacaaaatcagtttatgaatccttctctgaccccactctttacaggtctgttgtggctgccttgcagtatgctacaatcaccagacctaagatcagcttctctgtcaacaaggtctgccaattcaagtctgatccatctgaacagcactggatggcagtgaaaagaattctcagatatctggctgtcaccataaactttggtttgagttttcatcctcactcctctggacctcagtttccattacatgcttactttgatgttgattgggcttctgacccaggtgacagacgctccacctctagggctgcaatcttttttggccccaatctagtgtcatggtggtctaagaagcagacagttgttgcttgctccagcacagaggccgaatatcgcagcttggctttggcagctgcaaaagtcacttggattttttttttgatcagcaaagataatactttttatatagataaaagagtaccagaggtactagtttatataaggttagctacccgatga

SEQ ID NO: 99270 - DNA, 1158 bp, Glycine max
  Peptide Sequence Number=SeqID_216048
atgcttttctaccactctgagcttggtcctgagcagcatgaggaatctgaagctcagaaattagggatcttattcaatattgtggcggaggcactgactggactagtgagagaggcatgcatcaatggagaatgtgaagcaattctgaggtcttttgaacttgcatcgggcttgaaaattaattttgcaaaaagtagtcttggtgcaatcggtgcaaatcaaaggagggggcagttgtgggaacctatcattaaaaagtgtgagaaagccttatctaagtggaagcagagacatctttcctttggggggatccccaagaaggtgaacgacgaattagtcagactgcaactaagattcttgtggggaggaggatcagacacaaacaagattgcttggatcaagtgggacacagtatgccttccaaaagaaaaaggtggattgggtatcaaagacataagcactttcaacctggctatgcttggaaaatggagatggaacttatttcatgatgagggacagctttgggcaaagatattggtgtctaagtacggcgggtggaggggcttagaagagaatggtggtaatagctttgagtcattgtggtggagagacctaaagtccatcttccaaacaacacaacaaggtgaggatgcaataaaaggtgtaaaatggagggtggggtgtggggacagcataaaattttggcaggatacgtggttagatggagcgacatcactgctattcgaaaacgagatcccaatggctgttaattttctacaagacattgaagggaagactatctacacacagagaagagatgagtgggaatggatggcagatccaattgaggggattcaagatcaggcttttgaggagctgtggagattgaaggtgccacttaaatatggggtgtttgcatggaggctgcttataaataggctgcctactaaagcaaacttacataggagacaagtccagcttttggacaggagatgcctattttgcacaaacatggaagaggagccaggacacatgttcttccactgcagcaaagttatacctaattggtgggaaacattatcctgggtgaagaagtctacaaccttacctgacatggacaatttggcagcaaaggaacaagatgatattctccaatga

SEQ ID NO: 99271 - DNA, 1951 bp, Glycine max
  Peptide Sequence Number=SeqID_216049
atgacatatgcttacattatcccaagattatatcatgtccaaactgatttgtcttgtctactaatctatgatttgtttatgagtgatgatttctcatctttctcacggattgagcaacagtttcctcatctgaagcaatggcttggctttaaagctgctggcactgtggagcttggtcatatagttgagtcccctgttattcgaactgcaacttcaattgttcctttgggatggaatgatggactaggagcaaaaaatggagaacctctgaaagttgatattactggttttgggttgcatttatgtacacttgttcatgctcaagtgaatggtaactggtgctcaactactgttgaatcatttccttctccaccaaactattcttcaaatcaaggtatccagcctgagttacagaagttgaggatatttgttggtcctcctctaagaagtccaccaaagcatcaaactgtgttagactcattgatgcctgcttttacttctgttgactctgagactgcaagcagttcagcacctgctgacaaggataaattcatccgtccagaaaatctaaataacttcgtaatattttgcaccagtgattttacaactgtttctaaagaagttcatgtgagaacacgtagagtacaattagttgggctagagggagctggtaagactactcttttaaaggctgtcttgcataaatgcaaaccaaatactgctgccaatgaggatgcagcttcagaggttgtgcgagaagttattgctgatggtttgtgctattgtgattccaacggaataaatatgcaggagctgaatgttgaaacctcccgcttcagggatgaactatggcttggaatccgagatctaagtcggaagacagatttgattgtttttgttcataacttatcccatagcatacctcgatgtagtaattcaaatgatactcaacaaaggccagtcttgtcacttttcttggatgaagctaaatctcttggaattccttgggttcttgctatcacaaacaaatttgcagttagtgcacaccatcaaaagacagcaattgatgccgctttgaaagcataccaagcatctcctagctctgctgaagttataaattcttgtccatatgttatgcctggatttgttggggcttctctttccttggatgcaaccaatacagattctaatagaagggtgggggctgaaaagcttatatttgctcctattaactttattaggaagcctttcctgaaaaaggagattgtttttccagttgaaggcgtaaattctctttgtcagcaaatccactgtatactccgcagtcgtgaggagtcttcctttcaggaatttgcaagagataggcttctgatggagttggcacgagaacaagcaatgtcgattgaggcaagtagagatgctcaagttaaggcaaattcattgaattctgctgctgtgggagcatccgttggtgctggtcttggccttgtcctggcaattggggacgaggtggttgtggaaaccgaggaggacgagttggaagaggaggctgactatgaagagtatctccagctaaaagttgccaagaaatctctaacatcatctactataagtggtcataactccattgtttgcatttcccaatctggtagtaatcaaagttcatggataattgattcaggtgcttttgatcacattgctgataatagttctttattttcatccctctctcctcctaaaattccccatttcattactttagatgatggttctagagttgcagcaataggaatcaaccatatatcacccacttcttctttgtctttaaactatgaacgtggtacgggttggacgattgacgtaggacatgaatctcatggtctttactacctcaagtctaatctttcttgggtttgcagtgctgccacatcaccaaagctccttcatgaac

SEQ ID NO: 99272 - DNA, 297 bp, Glycine max
  Peptide Sequence Number=SeqID_216050
atgggaagattacaaagtttgaatacaagcttcatggccatcacacagggatgtccaagtctagagtgccaggtggcaagggaaactgcacttctagagacagtgtttacaaaagaagccttattggatctgtttacaaaatctgaaacagaatttgaacaaatgacgcttggtacagggtgtgacttgctgaatgttttgagaaacattggtgacatgatgagatgcccgagtcaggataccagttttgtgaaggtacagattgaacaatggttaggtgagtttgtggaagaatga

SEQ ID NO: 99273 - DNA, 339 bp, Glycine max
  Peptide Sequence Number=SeqID_216051
atgtgggatgctaccgtgttcggggtgtttaatcaagacttcccattgtacatcaagcacgaagatctctctaaaatttcacacggtggtcaatgtctcagcatatctgttatacagttgtggattctacatctgactaagacaagtatgcgagcggggaattccgatgtgaatggattcctcgagccacaatccattcagagatctgggcaatcacagtttgaatcagaaagttacatcaagagttggatgcagagctcaaaacacgatatctaccttggagcctacctgaatggaccattggaagcagagagattgaaggcgcttcgcatccagtag

SEQ ID NO: 99274 - DNA, 363 bp, Glycine max
  Peptide Sequence Number=SeqID_216052
atggatgagatatttggatataagtatctgagaaggcctaacaacaacgacatcaatcacctactacaaattggagaggcacatgggtttctagatatgttgggttctattcatttgacattatgcaaggtcgagctcctccagtacaatttacaattaatgaaaccacacacaatagggtattaccttgtaaatgacatttatttggattgggccacattaatgaagactttcccaatgccacaaggagagaaaagaaagttatttgcaaaatgtcaaaaagcgacaagaaagaatgtggagagaacatttggtgtgctcaaatttggttttgcaattatatgtggtccattgtgtaattga

SEQ ID NO: 99275 - DNA, 231 bp, Glycine max
  Peptide Sequence Number=SeqID_216053
atgattaatgcaaactgtccgcaagaatccttgcattcaatctcaaacgggaatctaaggaactgtgtagggagatgttcgattccacagagattgctagggaagggtaaagggaggaggtggagcatgaggctgtttcttggtcttctttcttctcaagtagttggaataggaagttgttctgatggtggtggtggtgatggtggtggagatcctcgtgtccctccatga

SEQ ID NO: 99276 - DNA, 162 bp, Glycine max
  Peptide Sequence Number=SeqID_216054
atgggagaaaattgtcatgtggaaatcgacccaagtggtcgatatggcaggcttttggcagctagtgccttggaggaaacaaacatatttcaaaacaaattgctaccggagacaatatctaacggcaccaacatttgggatattcaactactagaaggttag

SEQ ID NO: 99277 - DNA, 297 bp, Glycine max
  Peptide Sequence Number=SeqID_216055
atgaatttgatgaagtatgagaagttaggattggtgaccaaacatcacataattaagaatgaatacatgtgtttgtcataccctaattttgtccagggatcattgtttgtcggcatgcgacctccgtttgagcacttcaaaatgtttaatacctattgccgtggaatccgtaaagttttgggacgtttcggaaagaaaacaaccaaaaacacaaaagcggggggtgaacttatcaaacacaggggtgcactcaagaaacttcatctagaaacactctggaaggtgggggtgaactaa

SEQ ID NO: 99278 - DNA, 495 bp, Glycine max
  Peptide Sequence Number=SeqID_216056
atggacactgatgatatcaaaggaaaaggaaaaaagatggatattgatgccatcgaagtaaagaaagaaaggatggatactaatgccatcaaagaaaaagggacaaagatggatactaatgtcattgaagaaaagaaagaaaggatggatattgatgtcatcaaagaaaatgggaaaaagatggataagtatgaagatatgtatgaactcaatagagaattggtagaacatagattagctatttgtgaagggaaaaaaccagtaaagcagacaccaagaagatttgttcctaatatcatagaggccgtcaaagtaaagatagaaaggctactgaaggaacatcaagaagcctttgatgacatcaagagatatctcgccaatccaccagttttagtatctcctttgaaaggaagagacttgaaattgtacattttcacatcaaatttgactattgcaagcatgctagtgcaagaagatgataatggcatagagtga

SEQ ID NO: 99279 - DNA, 498 bp, Glycine max
  Peptide Sequence Number=SeqID_216057
atggaaggtgttgtcacttatgatggagatatttttaagctaactactgaaaattactcctattggaagccgatgatggaagaccatttatactgcaaagatttgcatgagctaattacccaaaaggataagtcggaggagaagatcactgacaaagagtgggagctccaaaattggaaggcaagttggtacacgttaatagttactcgaagtaactcagccccagaagggaagctcaccatggataccgttgttgatagcttgttgaatgaacaagctaggaggaaggaacgaggtatggttgtccaatttgaagctaacattgtagaaaaccgcataagaagtgagaatcacacaagaagtgcaggtagaagtcgtaatcttgaggatgatctaaatctctctcttctaggattacctgctactattgtggcaagccaggtcacaagaaatttgaatgtcgacatctcaagagagacaaaaaatcggcattgttaa

SEQ ID NO: 99280 - DNA, 306 bp, Glycine max
  Peptide Sequence Number=SeqID_216058
atgggagcaaagggtcacataactgagaggattggccaacttagggggcttagaaagcttagccttcatgataaccaaattggtggttcaatcccttcagcacttggacttcttctcaatctaagaggggttcagctcttcaaaaataggttcacagggaccacccctccttcgttagggtcatgtcctttgcttcagtctttggacctcagcaataatttgctcactaggacaatccccatgagccttgggaatgccactaagctttattggcttaactttagctttaactccttggggtggtag

SEQ ID NO: 99281 - DNA, 984 bp, Glycine max
  Peptide Sequence Number=SeqID_216059
atgcttaatgagtcatgtcttgtgaagacatgcaaaccttctatcatgttcactagggttcctgaggtcgatctctcggaccccgaggccaagtcactcattatcaaggccagcaaagagtgtggtttctttaaggtagtccaacatggcgttgcgtttgagttgattacaaatttggagaacgaagtccttagatttttccatcaaccacagccacaaaaggacaaggtggttcctcctgatccttgtggttatggaagcaggaaaattggagccaatggtgatgaaggttggctcgagtacctcctcatcaacactaaccctgatgatccaaagtcacttcacctttttcagcaaaacccagcaaatttcaggtctgctgtggaggattatataggagcagttaagaatttgtgctctgatgtgttggaacttatggctgatgggttgggagttgagccgaggaatgtgtttagtaggcttacaatggatgagagaagcgattgcttattaagggttaatcgctaccccgtatgtgcagagcttgatgaatttgaagcattgagtgaacaatatttaattgggtttggcgaacacacagacccacagataatatctgtactgagatcgaataacagtcacggactacaaatctgtctccgagatggaacttgggcttcaattccaccagatcagacttctttcttcgtcattgttggtgacctcttgcaggtgatgactaatgggagatttaaaagtgtaaagcatagggtattgactgactcaaccatttcaagaatttcaataatctactttggaggaccacccttgaatgaaaatattgctcctttaccttcactcgtgctaaaggaagaagagagtttgtataaagagttaacgtggcaggaatacaagactgctacgttcaagtcaaggttgtctgataataggctaagactctttgagaaatttcctagtgagtga

SEQ ID NO: 99282 - DNA, 767 bp, Glycine max
  Peptide Sequence Number=SeqID_216060
ggtacatctacttgggtttgactgagaacaagagagggtacatctcttgtggattagttctagtggacggtacatccactaggttcaaagagaacaagggagggtacatcccttgtggatctttgcttgtaaaaggatttttacaaggccactcgatccaacaagcggaagtctccaacagagaattgaagaaaatcttggagaagaccatagcatcaaataggaaagactgggcaagcaagttggacgatgcattatgggcctatcgaactgctttcaagacttctattgtcctatcttcatttcaaatggcagcatcaggggaacaaagaaagactcaactgttggagttggaggaattgagatggaatgcgtatgagtctgccagattatacaaggacaaagtgaaggcctaccatgataagaagctgctcaagaaggagttcagagcaggacaacaagtattgatgtttaattccagactgaagctatttccgggcaaactcaaatctaaatggttaggaccatttactatcaaagaggtcaggccgtatggcactgtggaattgtttgaccctcattcatcaacttcagacagaacatgggtagtcaatggtcaaaggctgaagttgtaccatggtggaaacattgacaggcaagtcacttcccgtgctaacggcctcgctgagcaagccctgtgcgctaagcccaaaaacttctctagaatttcatcttttggaatggggctaagcgagtcatcttgctaa

SEQ ID NO: 99283 - DNA, 753 bp, Glycine max
  Peptide Sequence Number=SeqID_216061
atggatagggcgaggttggtttatgggatggtcatgaggatggatatagatgtgggctcactcatatcacaccagatttctcagatgggccagcccaactcctcgcggctcggctttcctgcactggtcatagctttgtgcatcgccagaggggtcatattcgattctttgacctttgagtccctcagccatgccattaatttggcatatattaagaagaattgctggaacctggacgatcccacaatcatttttccagggacccgcaagtctagggctagaggacctgattcaattgttcctttctcctctactccagttgatcctgcttctacctctactccagctccttctacttcagcaccaccacttccatcagctctagttcagaccggtacctctgctccaccatcatcagatctagtaaagtgtcgatgctccgaggtcatagtgccgatgctgcagagcctccaccatggcttgcgcctggtggcttggccaggagtccagccttctcctttggggggaggtaaggcttctgcagcccaggagcctctaccagagccgaaggttgcacgcgaggccacgctagagacgactccacaagtttcacctgctacttcacctattgtggaggtctctgagggtagagaaggcatcgaggacacagactatgcaaaagatttacaggcggcgcatagtacctcggatccctggcctccaactgcacgggagacacctcagccagcctag

SEQ ID NO: 99284 - DNA, 261 bp, Glycine max
  Peptide Sequence Number=SeqID_216062
atgggttggtggatgaacccactcgcctttaattttccccaactaaggggctggttaagcgggacaggtcaggagtcaggacaggctgagttatccaccgcgtcctactatattgatcgatggtgggccaacccacctggacctgcttgttttcccatccctactaacatcatcctccacctgggccataacaagagtaaattatactttcttgaggtttggaaattggacttattacacttgatatccatccctttttga

SEQ ID NO: 99285 - DNA, 363 bp, Glycine max
  Peptide Sequence Number=SeqID_216063
atgtcgacaactttatgccttacaatgatcacgctatttggtctttctctctctctctttctcttggttgtccaccatgtcggtgtcattatgcctcacattcacgcactctcacgtcgatgccattgtgcttcccagtcacatcttttgatcattttctctctctctctctccctcttgatccttctttgtgcacacttcgatgacactcacagagtccaagcctctcgctctcagtcacagactcacggtgtgcctctcgctctcaatctcatgctgatgacattgtgcctcatagtcatgctattcgatctctctctcttggttgtccaccatgttgatgtcgttgtgcctcacacttaa

SEQ ID NO: 99286 - DNA, 294 bp, Glycine max
  Peptide Sequence Number=SeqID_216064
atgacaccaaaagtttgtattttgaaaaatctcaacggtcagattgtggagacgtgtcttaggaagctccggacgaaatttgaagacgatgcaacagttaacgaatccgggtgttacatatgcaataagagagagaggagacgccacttcaaggagaagatgagtctagaagaagctcaccaccataggaggccatggataagagcttggaggaagaaggagatgaatgaagggagaggaagagaagagcacgaaattttgtgctctaaaagagctctgaaatctgaagtttaa

SEQ ID NO: 99287 - DNA, 3000 bp, Glycine max
  Peptide Sequence Number=SeqID_216065
atgtggggtcctgccaatgctttgtcagatggcaattcagcaagtgatcaacaaggccttgcgcctcgtgtttttgaaagactctttgcctgcataaatgaggagcaaattaagcattctgacaagcaactcaagtatcagtgccactgctcttttctcgagatatacaacgagcaaatagcagatctattagatccaaatcaaagaaacctacagattagagaagatgtcaaatctggtgtctatgttgaaaatcttacagaggagctagtgtgtacgaagaaagatgtgactcagcttttgataaagggtttgttaaacagaagaattggtgcaaccagtataaattctgaaagttcacgttctcatactgtttttacttgtgtggttgaatctcgatgcaagagtactgcaaatggtgtaagcagatttagaacaagtaaaataaatcttgttgatctagctgggtcagaacgacaaaaattaacgggtgcagcaggagaccgtttaaaggaagctggcaatattaatagatccctttcacagcttgggaatttgataaaaattctagctgaagtttctcagacaggaaagccgcgacatataccatatagagactccagttgtaagagtgaaacttttagtacattgagatttgcacaatgtgtaaaggatatcaagaataaagcagttgtcaatgaagtaatgcacgatgatgtgaatcaattacgagatgtgatatgccaactcagggatgaactgcatcgaattaaagcaaatggttacagtccaagtgatggaagtcgaggtcattcagcagctttgatcagaagaagtttgaatttgttgaagcctaccctcaatcgcccattatcactacctcatgttgatgaggatggtgatgaggagatggagattgatgaggaaggtgtcgaggatcatgctgtagttctccacaactcaaatggaggttttgctggtttttcagcccctaatggatctattggttctcctagtgctgcaatgaatggtgacagccttgctggcggcatggttaaatgcaaaacatcccccatcctcaaatcccctccttccagcctttcaccaacaatcagcagcagcaggaaaagtttgaggacctcattaaagcagtctccttctgagaataatattcatggtgaaagtgatttaggcacaaacaccgttaaccagaaatgcttgtctactgctctctctagccagacagctccaaatttcgtaactaaaactgaaaatttagcagtaagcatccgccatggtcttgaaattattgatagccaccatcatggtacatcgttatcgagtctctcattgagacccaaagattccaggctaattattcctgtggaaaaagttgatgtcggagtccagacttttcttgatgataatgccaaaaaggaagattatgctatgcttacctgtaataactgtaaaagcagaatgcagcttgatgtcaatgagattgacaatagctcaaatgtgcagcagttactgattgattgcccgcagtcaactggtaaaccaaagaagcaaattctgaaagcagtagagaaggttttggcaggatcgataaggagagaaatggcactagaagagttttgtgcaaagcagacttctgatataatgcagctcaattgcttgttgcaaaagtacaggcaagagagggaatgcaatgccacaataacacagataagagaagataaaattctacgccttcagagccttattgatggtgttttatccaccaaggagtccatggatgaagagcttgtgtccctcacacatgaaaacaaggacttgcctgctatcaaaattcaacagcttttaaaggagaaccatgagcatcatttagaagttctgaagatgaagatagagttaaaaagagtacaagatgagttacaagagtatcagaatttttaccaatttggggagagggaagtgttgatggaagagatatgtagtttaagaaaccagcttcacttttatgttgactcttcatccacagccgcaacaaagcaatatcctccattgcaattgacttattcatctgaacctagtttggaagcaaacctcactgccattccagatttaacagaggctagcactaaggcaaacgcaaatccagaatcaactgaagacagtgccaaagtaaaacttgagcaggaaaaaagtcaatggaccgaggcagaaagcaggtggatttctctaactgaaaaactgagagctgaacttgaaactagcaggttactagctgaaaagaggaagcaggaactagatactgagaggaagtgtgcggaggaactgaatgaaacaatgcaaatggctatagaaggccatgcacgaattttagaacagtatgctgatttagaagagaaacacatccaattgcttgacaggcatagaaagatccaggatggaattgatgatgtcaaggaagcagcttccagagcagcaggagtaagaggtgcagactctaaattcataaatgcccttgcagcagaaatttcagcattaaaagcagaaaaagaaaaagaaatggaaatcctaagagatgaaaatagaggacttcgagctcaactgaaggatactgctgaagcagtgcaagctgcaggtgaacttcttgtgcaacttaatgaagcagaagaagctgtcattaccgcacagaagcgggcgatggatgcagagcaggaagctgcaaaggcctacaaacaaattgataaattgaagaagaaacatgacaaggagattagcacacttaataagctacttgccaaaacacatttgcctaatgaagaaatacgacctactttagatgaccttgtaatgcctacttgtgatgacaccaaggtgccgaacaatgttaatggtcaatttgagttattttgtagcgaagaggatattgaactagcaaatttggcagaccaatcatggttgtcttcttatgacacatgcaacatatag

SEQ ID NO: 99288 - DNA, 711 bp, Glycine max
  Peptide Sequence Number=SeqID_216066
atggtgattcccgttcgctccctccctcgaccaccaccgccgccgccagatcaacctccccaagccccaccgtgtctccgatttcctccgcaaaacgcccaacctcttcgaactctacaaggaccagaagggggtgctctggtgcggcatgaccccaaaagccgagaacttgatggaacaacaacaaagggtcatcgaagaacacgccgacaaagccaccgaacacgtcacgagctttttaaggtggtgaagtcacttgatggggttgagtttttggagcttgtatcttggaaccctgattgggcaatcactgagttagagaaaaaaggtggtgacagaaacaaccgaaactaccaaaatttcactattgagaagaggttggtcaccgatcacctcacacactttcgttgggagcttgtgatgcctcagaagctgatgaggcttctgctcaaggactgtgggatcttctatgtatccaagagggggaagaggtttagtgtgtttttgactgaggcttatgagggttctgagctcattgagaaatgccccttggtgctgtggaaggagaaggttttggggcttgtgggttatacagggaggaagaagaagcttgaggtatgcaagaggaattctgaagtgggggacttacatgtgcagattgagcctcggggtactttgcattacgaggatcctttagttggggatgattga

SEQ ID NO: 99289 - DNA, 1557 bp, Glycine max
  Peptide Sequence Number=SeqID_216067
atggcctgcaacacagtaggatgtttctctttgttttttcaattcattcttttaatccctctagtcactttctcttccttatttctaccaactaccacggccaagggattctcaattgaagaggcaactgtctatgatctccaacttgctttccgtagaaaccaattaacctctaggcaactagttgagttctaccacaaacaaatacaaacccaaaacccagttctgagaggggtgttggagttaaacccagatgcactagcacaagctgacaaagctgaccatgagagaaaggctaatgcaccagggactcttccagcattgcatggaatacccattttggttaaggacaacattgctaccaaggataagatgaacaccactgcaggctcttttgcacttcttggctctgtggtgcctagagatgcaggtgtagttaccaggttaagagaagctggtgctatcattttaggcaaggccaccctgagtgaatggtcacattataggtcgaatgatgcacccagtggttggaatggcagaggtggagaaggaaagaatccatacacaatggatggtccctgtggatctagtagcggatcagcaatatcagtggccgcaaatttggtggcagtgtcacttggtagtgagactgatgggtccattttatgcccttcaggttctaattcagtagtgggcattaaaccaacagttggcctcactagtagagcaggggtagttcccatcaccccattacaggacacagttggaccaatttgcaggactgtatcagatgctgctcttgttcttgaaaccattgcaggcatcgacgtcaatgataacgcaacaatcaaagcatcaaagtatctcccaagaggtggctatgctcaatttctaaagaaagatggactgagaggaaagagattaggtgttgtaagaacattctacggttttggaaatgacacttttatgcatgatactttcgaactgcacctgaaaacaataaggcaaaaaggagcagttttggttgacaatttggagataaacaacattcaggaaatctttaatgaccaaagtgaagacattgctatggcatatgaattcaaattatccttgaacgcatacctcagagacttagttgcttccccagtgagaagcttggccgatgtgatagccttcaacaagaaacacccaaaattggagaaacttaaggagtatggccaagatctcatgttgatagctcaaaagacaaatggagttagggaactgaaggaagcagtgttaaacatggcaagattgtcacataatggatttgagaaattaatgataacaaaaaaacttgacgcggtggtagtacccttttcattctttgttagtatacttgcaaggggaggttatcctggagtaactgttccagcgggatatgaaaagggtgcaccatttggaattatctttggaggtttgaaaggctcagaaccaaagctcatcgaaattgcatattcctttgagcaagctactttgatcaggaagcccccaccactccgaaagttaaaggtttaa

SEQ ID NO: 99290 - DNA, 267 bp, Glycine max
  Peptide Sequence Number=SeqID_216068
atgggggagatgttgatggctaagtgtacaaccctagttgaggaaaatgaggagattgggaatcaagcttctgagggcaaggtaaagaagagagtagttgatcctaaaactagccaatcaactaggaagattaagcaccctaattctttacttggagttgtacatgttttagtgagcaagtctaaagtgaatgtcattgatgttgttgggcgtttcccagatgatgacaccaatgacatagatgactatcggcagggaatgatatga

SEQ ID NO: 99291 - DNA, 612 bp, Glycine max
  Peptide Sequence Number=SeqID_216069
atgatgaactttgacggcttccagaaggctctggcggagtttcagggccgctgctccacgctgctgggcagcctgacccgtctccagcccaaccgcgcgaggccaccatgggctcggatagcccagccctggggaggcaggcccatggccatgacggtggaggcaatcgaggagcgcttagagggaattcccgtttacgccctcagcaacgcttccgaggagtttctcttggtctcgggctcttcctccgggaaaaaccttggcctcttctgcttcaacaaggacgacgccgaggctctcctcaaccaggttacgcttatcgacccccacgctcgccagggctccaaagttgtccccgttgctttgaacaaggtgtttcagctcaaggtgaacggcgttgcgtttagattgatacctgagttctctcaagtaaagaatgccctgcaattggattcgctcaaaccatgctctgcgactctgcgtactgttataccgaaatttaaaaccttgcacacacctaaaccctacaaaaaccctaaggggcgtttggtaggattttttttgtcatgtccgggaattatgaatcctgggaatcatgtttattgggaatga

SEQ ID NO: 99292 - DNA, 207 bp, Glycine max
  Peptide Sequence Number=SeqID_216070
atgtggacaacgggtaaacatgtcatcaatgtacaacacttagtgtgcacatgcgctgcacgtgcctcggcccgttacgaccattccaccgctgcggagagtggaaggggttacatggctgtgacggtagggagaatgacggccaatgaggttggtggttggagtaaaatctctgtgatgtgtagtgtgtacggtctatccatgtaa

SEQ ID NO: 99293 - DNA, 501 bp, Glycine max
  Peptide Sequence Number=SeqID_216071
atggccccaagaaagcttccatcaaagaggtccaggaaggacgccaccgaagaaggctatagcgctgccccacaggttgacacggactttgacgagcatcgatttcggagcatagatcatcaacaacgctttgaggaggagatagcccacaggtgctgggcaccacttgtgacacacatggctaaattcgacttggagatagtcatggagttgtatgccaatgcctggcctaccgaggagggaggccagcagtgtgagtacagtcagaggaggagacaggtctttggctttgatgaggaggccattgcccagctattgtgcatactggggcaagattttgcctggaccgctgtagggagacatgtgtggatcatgcgcaccagcatgaccatccttacccaaatatggatgacattgctactcagcaacattctgcttggcgaccataactctgaccttcctctaccgaagtgtcaactggtttatgccatcttgacacag

SEQ ID NO: 99294 - DNA, 630 bp, Glycine max
  Peptide Sequence Number=SeqID_216072
atggcctcatcaaactacttgttccccgaaggcaattcaattaataggcctcctatttttattgtaaagggttaccattattggaaaacccgcatgcaaatctttatagatgctatagatttaaacatttgggaagccattgaaatagggccttatgttctcaccatggtggctggaaatattacatctgccttaggaatggatgagtattttaaggtatcaaattgtaaaaatgcaaaagataagtgggacaccctacaagtaacacatgagagcacaacaaatgaacatgaaatggaactgttgagattaaatcaacatgaagaaaatgataagaagaagaagggaattgcttttaaagcctcatcttcaatccaagaagaaagtgataaggaaggttcaattgacttggatgaagatgaagatcttagtctctatgtcaaaagattcaacatattccttaggatgagaagaattcaaagaagacaaaacttcaagcctaaaagaaggactcaagaatcatcccaaactccaagatgctatgagtgcaatcaacccgaacatctgagcgttgattgtccaatctttaagaaaaaaatggagaagctcgaaaagaagaacattggataa

SEQ ID NO: 99295 - DNA, 463 bp, Glycine max
  Peptide Sequence Number=SeqID_216073
atacaatccgggttggaggaatcatccaaatctaagatgggcaagtcctccacaacaacaacagcctgtccctccctaccagaatgctgctggtccaagcaagccatatgttcctcctctaatgcaggaacaacaacaacaacaacaaagacaacaagcaactgaggccccttctctaccttccttagaggagttacagccccctatccctcttccatttccacctagagcaattccaaacaaaaagatcgaagaagtggataaggagatcttggagaccttcaggaaagtagaggtgaacataccactgctagatgccatcaaacaaattccaagatatgccaagtttctaaaggagttgtgcacccatgtcgcaacctacccttcgacgggagggcgacgcgaggactcacgagtgcgtcttccatgggaggaatacgcacggagtcgccaccaacgttaa

SEQ ID NO: 99296 - DNA, 468 bp, Glycine max
  Peptide Sequence Number=SeqID_216074
ccgttctacaagcctagagccaaaatcccgatttaccataaaccttgccctcagaagaaaacaaaagagaaaggaacttcccaatcaaaagagtgggagaaagaaaaaagagaaaaatcccaatcaaagaatgagagaaagcagaaacacaaaaaagggaagaaaattctcgatcaaggatcggaagaaaacagaagaaatatgcagaaaggtcttctgaccagacgatatctgaacaatacagatttgtcaccaagaaaacatgaaaagaaaggaaaccacgacctaaagtggtcctctctttttgattgccaaccaaaatcctgtgcatcggtgacttgtttgcctcgcgctaaacaaaaaaacagaaaaggaaaaggccaaaaatattcaaagccaaaatcccacaaaaaacaccattcccaaggaaaagtcctactgatccatgatcacgcatgtagtctttga

SEQ ID NO: 99297 - DNA, 621 bp, Glycine max
  Peptide Sequence Number=SeqID_216075
atgagtgtagagcagttcattgagaaggtggcctggcctggagcccgaccttcttttgtgggggataatgaaagttttacagcccaggcacctcaacagcatgagccagaaccagaaaacgatcactcatctgaagccaccatccctagagttgttgattttgcaaaaagaagattagagacgagatccaatgaggctgctcatcctggaccaatgccagcatcagctgatgcaccatttccaggagtagatccatcttcacctcagcacgcaacagactcttccactcctgtcttagagatacatgagggccagaccataccagtcctgactttggacacttctcctccaactactccacttaaacacttgtgcttgagtgaaacagtagccgtgagactgtggtttaagctactttccttgatatctgtcttatgcctaactccatctaactattcaggttacattttattcttctctttggataactgcataccttgtgatgcaaccctaccccgcagggcattgggtagaagactccaagtagattgggctagagatccaagggaaggccctaggattctcatgagccttagggttgatttcgagcccatgggctaa

SEQ ID NO: 99298 - DNA, 393 bp, Glycine max
  Peptide Sequence Number=SeqID_216076
atgggtcacttagacaaatgcaggttgtacatcgaagaaaatcctccctgcctggttgccctgggaagagtttataagggatccacaaccattcataacatccctttgttgcatgatcaagtgaaggtcggtgttaaggaggttagacatacagatgctcccattcctatacccgctgaagagtttaagttagtggggcagacacttaacacctttcttgcttggccgacacatctcgtcatgtttatcaaaatagttgtgggaccagcaaaacctatagataggtcgaatcatgaggtcgatgatcccctatatctgatgacattgaccatccaacagctttttctgaagccattgcagaaaaatagacatatgattgagacaagtatgtga

SEQ ID NO: 99299 - DNA, 891 bp, Glycine max
  Peptide Sequence Number=SeqID_216077
atgaaaaaaattattccctcactgctggcgctgtcgctggtagccgccttctccgcgcaggccgccacgccgaaagatacgctggtgattgcgcagtctacggatgatgcggacagctttgatccggcccagggctttgaactaaccacggtgcaagcgttcactaacatttatcagcgcctggtgcagtccgatccggccaatccgaccgatctcaagccaacgctggcgacgtcgtggcagccgggcagcgataaccgcagcctgacgtttgcgctgcgcaaagacgcgaaattcgccagcggtaacccgctgcgcccggaagatgtcatcttctcgctgggccgcgtggtgaaactcaacctcgatccgtcctttattctgacccagctcggctggaacaaagacaacgtcgacagcttcctgaaaaaggtcgatgaagaccacgtgcagattagctggagcgccaatgtcagcccggcctatgtgctgagcctgctgtccgcgccggtctcctcgatcgttgatgaaaaaaccgcgcaggccaacgccaaaaacggtgatttcggccacgcgtggctcggcacccactcggccggcagcggcccgttccagattcgcaaagtggtgctgcatgaagcgatactgctcagcgccaacccgacctcaccggccggtgcaccgaagctgaaaaacattctgatcaaaaacgtgccggagccggcagcgcgccgtctgctgctggaacagggcgatgtcgatatcgcgcgtaacctcggtgctgaccagatcgctgcgctgaaagggcaaagccggcgtgaagaccgaagcgattccgatggcgtcgctctactacattcagttcaacgtcggtgccaatcccggtactga

SEQ ID NO: 99300 - DNA, 122 bp, Glycine max
  Peptide Sequence Number=SeqID_216078
atggtgacaaaaagggttaagaaatatgagaaaatgatgacacatcaactgtcatcaagcgagtcggagacccaacatgaccacagatcgacctccactccttatggctcacatagacccgg

SEQ ID NO: 99301 - DNA, 216 bp, Glycine max
  Peptide Sequence Number=SeqID_216079
atgactaagttcgggaggcctgctccagagattgaagagatgactatcaccttggatgatgtggcgtcgttgctacatttgcctatcgtaagggcatttcatatcttcgagcaacttcatgtcaacgacgttgtcgatatgttggtggaattacttgaggtcagcactacagaggcaagagttgagatgattcaatgtcatgcctcttatgtttga

SEQ ID NO: 99302 - DNA, 246 bp, Glycine max
  Peptide Sequence Number=SeqID_216080
atgaatggctcttctttcttgggagatcccactgttccttcttatgagggcaaggatggaaattctcttcctgggtcaagccctctgaaggcaaaggtgtgcagccctctgaacgcgaggacgtgtagtcctctgaaggcaaggatgtgtagtcctctaaaggcgagggcgtccagccctttgaaggcgaggacgtgtagtcctctgaaggcgaggacgtgtagtcctctgaagacaaggacgtag

SEQ ID NO: 99303 - DNA, 206 bp, Glycine max
  Peptide Sequence Number=SeqID_216081
atgaggggtgtgctcaggaaacttcatgcagaacattctaggtggggggctgttttgggtgaaaaaacgtgtttccatgaagaaaatccaagccgaggtgctaccgtattgcttctgagacgtttccgtgagcaaatccatgaagattatccgccattcttcaccgttcttcgtctgatcttcgttcattctttggtcttcaaccg

SEQ ID NO: 99304 - DNA, 375 bp, Glycine max
  Peptide Sequence Number=SeqID_216082
atgaatatctcgatggcacacgatcaagggtcctttgtagaggctaaaactcaagagaaaagtcctataaaagagcatgagtcaagagaaaaagatgaggaacaagcacaacaacaatgggagaagtactcaatagtagaaaaccaacaagaaaatattttccaaagcaataaccttcctcatcaactgattgacaagaaaggaaggcaagaagagcatgaggaaaccttaagtgccattctttctataataactaacacctttcttgaaatgatttggaatgtccttccagattatatgaagttcatggaatttctagctaaaaggcgaaacttcaaggaagatgtgttctttgtgactttcatgccaccttga

SEQ ID NO: 99305 - DNA, 2274 bp, Glycine max
  Peptide Sequence Number=SeqID_216083
atgtctctccccaaaaccctactttctctctcccttctcttcgcgatcgcgatcaccgcagtaaccggcgatgacgcggcggtgatgtcgaattttctcatatccctcactccaccgccctccggctggtctcaaacaaccccattctgccaatggaagggaatccaatgcgattcttcgaggcacgtgaccagcataagcctcgcttcgcagtccctcaccggaacactcccctcggatctcaattccctctctcaactccgcactctctctctccaagacaattctctctccggcaccctcccttccctctccaacctctcattcctccaaaccgcgtacttaaaccgcaacaacttcacctccgtgcccccctccgccttctcctccctaacctccctccaaaccctcagcctcggctccaaccctaccctccaaccctggtccttccccaccgacctcacttcctccgttaacctaatcgacctcgacctcgccaccgtaaccctcaccggtcccttaccagacattttcgacaaattcacctctcttcaacaccttcgcctctcttacaacaacctcaccggtaatttacccgcctctttcgccgtcgccgacaatatcgcaaccctctggctcaacaaccaggccgccggcttgtccggtaccctccaggtcctctccaacatgacagcattaaagcaggcctggctcaataagaatcagttcactggttccttaccggatttgtcgcaatgcaaggctttgtctgacttgcagcttagggataaccagttaactggtgtggttcccgcttccttgacgagtcttccgagtttgaagaaagtttctctggataacaatgagcttcaggggcccgtgcccgtgtttgggaaaggtgtgaattttactctcgatgggattaatagcttttgtcttgacactcctgggaattgtgatcccagggtgatggttttgctgcggattgccgaggcgttcggttatccgattcggttggcggaatcgtggaaagggaatgatccttgtgatggttggaactatgttgtgtgtgctgccgggaagattatcactgtcaatttcgagaaacagggtttgcagggtaccatctcccctgcatttgccaatttgactgacttgaggagcttgtttctcaatgggaataatttgactggttctatacctgagagtttgactactttgtctcagcttcagactcttgatgtgtctgataacaacctctctggattggttcccaagttcccgccaaaggtgaagttggtgactgcgggaaatgctttgcttgggaaagctcttagtcctggaggtggaccaaatggaactactccttcagggtcttcgactggtggaagtggcagtgaatccgcaaagggtagttctttgttgtcgccgggttggattgctgtggtgttgtttgtgtcttggaagtgttttgtcaacaggcggcaggggaagttcagtagggttaatggtcgtgaaaatgggaaaggaatttttaaacctgatgctgcccatgtttctaatggatatggtggtgttcccagtgagttgcaaagccagagcagtggtgatcgcagtgaccttcaggctttagatggtccaacgttttcgatccaagttcttcaacaagtgacgaataatttcagcgaggagaacattttaggcaggggagggtttggagtagtttataaggggcagttgcatgatggaacaaaaattgctgtcaagaggatggaatctgttgcaatgggtaacaaaggactgaaagagttcgaagcagagattgcagttcttagtaaagttaggcatagacatttggttgctcttttagggtattgcatcaatggcattgaaaggcttttggtctatgagtatatgcctcaaggtacgttaacacagcacctgtttgaatggcaggagcaaggctatgttcctttgacttggaaacaaagggtagtaatagctttggatgtagcgcggggggtggaatacttgcacagtttagctcagcaaagcttcattcatagagacttaaaaccctcaaacatactactaggtgatgacatgagagcaaaggttgctgattttggtttggttaaaaatgcaccagatgggaagtattctgttgagacacggttggctggaacatttggatatcttgcacctgagtatgcaggttactacttcaatatcatgctttggtgtccagcaaatttaagtagttcaatagagtaa

SEQ ID NO: 99306 - DNA, 132 bp, Glycine max
  Peptide Sequence Number=SeqID_216084
atgcatgggttacatgaacacgcaatggctccaaagaagcttctcactaaaagggcaaggaaggacgccgcaggggagggatctagtgcagccccacaagcagagattgagtttgacggacaccatttttga

SEQ ID NO: 99307 - DNA, 462 bp, Glycine max
  Peptide Sequence Number=SeqID_216085
atggacattcctatggtgggttatcctttcacttggtcacatagcaagggtactattaatgttgtggaagaaagattagatcgtgccttggtcactagtgactggttagactatcatcttgatgtaaaattgcaaaattcaatagcatttatatcatatcatagtcccattattctagctacccaggaagcatcaaaccatcaaactatcacccataggaggagaatgtttaaatttgaaaatgctttgttgttaaaggaagatgtagaggagatggtgaaaggcaacaataataattttggtgagattgatttcactagtaaaattcaaaccttcaaggagaaattggaggcttgggggaggtgcattagaatgagatttcaaaaagatattaaaagaaacaaacataaattaaaggatctgataagagctattgaggaggaaaaggttgaggaattttaa

SEQ ID NO: 99308 - DNA, 939 bp, Glycine max
  Peptide Sequence Number=SeqID_216086
atggcgacaattcctatcacctacaaccatgcttggaccttctctcatcctcatcatgcactttcccgcttcctttcaccctgcaatttctctaggatcacattttctcgcagaaaatatggtgttggtggccctgccccgtcttctccactctctcattttcgcgtattttgccaatccaagcatgagaaagaaaaagaatctttagctaagacagagatattggagataagaaagtgctccccttttcttgaaagttcattacttcttggtaatggtggtgtggcctcagatgagtggaaagcagttcctgatatttggagatcttctgcggagaagtatggtaataatgtagccttagtagatccatatcatgatcctcctacaactatgacgtatacacagttggagcaggcaattctggattttgcagaaggtttgagagttattggggtaagacctgatgagaagcttgcactttttgcagataattcatgtcgttggcttgtagcagatcaaggtatgatggcaagtggagcaatcaatgtggtaaggggctcaaggtcatcagttgaagagctattgcaaatatacaaccactctgaaagtgttgcactagtggtggataaccctgaaatgtttaaccgggttgcaaatacattttattcaaggactagcatgagatttattattttgctttggggagaaaaagcagagctggttggtcaagaaaacaagcatgtgccagtgtttactttcatggaagtcatagatttgggacgacagagtcgcagggcattatctaatgctcatgatgctggtacgtcacctcgctttctcggattatatcatattactagacatgacaaccgaccggaaataatcaatcccgactctccaacatatactcgtatccattctcgatatccgacgagttaa

SEQ ID NO: 99309 - DNA, 2121 bp, Glycine max
  Peptide Sequence Number=SeqID_216087
atggatacgcacgcggtgcatttggccttggcggcgatcgtcggagcctccgtcgtggccgtgtcggcgtattacatgcaccgcaagacgctcgcgcagctgctggagttcgcgcgcacggtcgagagggaggctgacggcggcggcagttccgacaccgaaccgcctacggcgcatttgaagaagcgccttggcagctccaggaggcgtggcaacggcggataccggcgtggctccgcgtcgctgccggacgtcacggcgatctccggcgggttcgacggggaagagaagcggaacgggccagtgcacgtcgacgggattcctgtggggttgccaaggttgcacacgcttcgtgaaggaaaatcatctcaatctggttcctttaagagaagtcttttaagaccaacttctcccaagtcccctgttgcaagtgccagtgcctttgaaagtgtagaaggatcagacgatgaagataacatggcaggcgaagttaaactggatactacgtatctgcacacaaatgggactgttgtgccagaaggtaaaatcccatttgagactttacccaatcatgttaatgctaacggagagcagatggctattactccaagtatgatccgctctcatagtgtttccggtgacctgcatggtgtgcagcctgacccaatagctgctgacattctgaggaaagagccagagcatgaaactttcacaagattgagaataactcctcttgaggctccgtcacctgatgaagtagaagcttatgtggttctgcaagaatgccttgaaatgagaaaaagatacgtttttagtgaagctgttgctccatgggataaagaagttatatctgaccccagtacacccaagcctaatccagatccatttttatacattcttgaaggaaagtctgatcattactttgaaatgcgagatggggttattcatgtatatccagatagggatgcaaaagaagagctttttcctgttgctgatgcaactacatttttcactgatcttcatcacatacttcgagtcatagcagcagggaatataagaactttatgccatcatagactcaatcttctagaacaaaaattcaatcttcatttgatgttaaatgcggatagagaatttcttgctcagaaaagtgctccacatcgagacttctataatgttagaaaagttgacactcatgtccaccattcggcatgcatgaatcagaaacatcttttaaggttcataaagtcaaagctgagaaaagagcctgatgaggttgtaatatttcgagatgggacatatctaacattggaagaggttttcaagagtttagatttaactggatatgatctcaatgttgaccttttggacgttcacgcagacaagagtacttttcatcgctttgataagttcaatcttaaatacaatccttgtggtcaaagtaggctgagggagatatttctgaagcaggataatctcatacaaggtcgttttcttggtgagttgactaagcaagtgttttcagatcttgctgccagtaaatatcagatggctgaatatagaatatcaatatatggtaggaagcaaagtgagtgggaccaactagccagttggatagtgaataatgatttgtacagtgagaatgttgtatggttgattcagcttccacggttgtacaatgtgtacaaagaaatgggaattgtgacatcattccagaacatgcttgacaatatttttattccactttttgaggtcactgtcaacccagattcacatcctcagctgcatgttttcctgaaacaggttgttgggttggatttggtggatgatgaaagcaaacctgaaagacggccaacaaaacacatgcctacaccggagcaatggactaatgtattcaatccagcattttcatactatgtctattactgttatgcaaatctttataccttaaacaagcttcgagaatcaaagggaatgacgacaatcaaattccgtccacattctggagaggctggtgatattgaccaccttgcagcaaccttcctcacggctcacaacattgcacatggaatcaatttgaaaaaatctcccgtgcttcaatatttatattatttagcccag

SEQ ID NO: 99310 - DNA, 327 bp, Glycine max
  Peptide Sequence Number=SeqID_216088
atgggtaaatgtctaacaaagaataagaagcaggcttcctacgcgtattcaatgttggactggctgtgggcaagaactattgccacaatattacttccacttcatattctggcaaagaaacttgtctacagtaaaatccattcagctattggaatatcaaaggctggaataagtggtggtggtagtttgccttgggaagtggataaattttttgaggcaattggtgtgaaagtacagaatggatatggtttaacagaaacttcaccagttattgctgctcgacgacctagatgtaacgtaagcaatgtaccaaatcaaatgcattga

SEQ ID NO: 99311 - DNA, 570 bp, Glycine max
  Peptide Sequence Number=SeqID_216089
atggatcatggaagacaacagaaagctaaaagcacaaagaaagtaattctaagaaaccctccattggcaactaaaactagaatcggtattcaatcagtccccacttgcacaacccttgcacccacagtgaacacactctatgaccttctcctccctaagttgcttgggaactctgcaaacacaagtggtggcaaaattgtgatcacgtggctgcatgcacctcaggcagcaaagaccggagcggcacccatccacgacgaagagggtcgtagcggcgcggttcaacgtcggggccgctatcgcagcagggtagggcggagcggcacgggatctggaccggattttcgcgccgctacactgacgccgtggaaatttcaaaaatgccttcacttaatgtgggaaagtgaggctctccgtccaaaccactcgaaaaccctagtctccactgcgaccggcgaagctgcgaggacgacgacgagtctacatcccacgaagctgcgaccccgacacctgcgtcctgcgtccggcggccccgatgacgagtctgcgctgcgccgccaccttgcttga

SEQ ID NO: 99312 - DNA, 147 bp, Glycine max
  Peptide Sequence Number=SeqID_216090
atgaagatcgagccagggttgaaagacgaagtcggtccgtctaacgtgcaaccacaacgctctgttccaccatcgtcactgtttggcagcttcaaccaaccactagccacacgtcaagccaccacgcctgacccaacatcatattag

SEQ ID NO: 99313 - DNA, 220 bp, Glycine max
  Peptide Sequence Number=SeqID_216091
ggaaggagagtctgctgatggaatccccataaccataaatgagattttggatgttagcatttcgtttctaaatgaccattcagaggaaacactgggttcgacaaaaatagaagaaatccactcaaagtgtatcaatctcgcacagtgcggggcgaacaagtcaccgatgcacaggattttggttggtaatcaaagggagaagaccacttttaggttatga

SEQ ID NO: 99314 - DNA, 3399 bp, Glycine max
  Peptide Sequence Number=SeqID_216092
atggaagacgacgacgagttcggagatttatacaccgacgttctccgccccttcgcttcttcgccctcattatcctctgcgccgcagccccaccaaccttcccctgcgcccccctccctcgatctcagtcccaatccggacgatgcacagatcccctgcgatgcgccccacgctaattcccctgcaccaaccaatcccctccctgagccagacccacgcgaagcgcccacggagccgcctaaaattccggacgccaagcctacgacggattcaaacctcgccgccgccgccgttgccgttgatccgatggacagggaggtgaaattcgacatcgaggaggacgaagaagacggcggagagccggttattccggggcttacaggcgagttggcagcgccgactgagggcgagggcgatgattgggacagcgatagtgaggatgatttgaagatagtgttgaatgagaacaaccacatggccatggaaagaggagggatggcggatggtgatgaggaggaggaggatggggatgaggagcttgtgattgtggctggcggcgatccgaatcagggcgcggaggagccggagtggggcgagaatgccaccctggccgctggagacggcgagaggaaggatgccgccggggagttggccaaggccggcggtgcggctgtgcccccgaagattgggtatagcaatcaaggatatcacccctttcattcgccttttaagtatcagtatgttaggcctggtgcagcactaatgcctggagctgctgcttctgctccaggagggcctcctggtcagattcgtcctcttgctaacatggctggtcgaggcagaggggactggagaccgcctggaataaaaggtggtgctgctatgcaaaaaggttttcatgcaggtcccggattacctggttggggcaacggtgcagcagggcggggttttggtggtggattggaattcacacttccttctcacaagactatatttgatgtagatattgagaattttgaggagaaaccgtggcaatatccaaatattgatacatcagattttttcaactttggcctgaatgaggagagctggaaagattattgcaaacagctggagcaactacgcttggagtctacaatgcaaagcaagatccgtgtttatgagagtggtcgaacagagcaggagtatgatccagacttaccccctgaattagctgcagctactggtatacatgatagtcccgtggaaaacacaaattctctaaagtcagatgtcggacaaagcgatgttatgaaaggttctgggactggacgtgtgcgaccaccactaccaactggtagagcaatacaggtggaaggtggttatggtgaccggcttccctccattgatacccgccctccccgaatccgcgattccgatgctatcattgagattgttttacaggatacagaagatgaccagtcctctgcaggagttgctcaagatccgccagagggtggagaaccccatagagaggattttagagaagaccatgtagctggagatgaaattccaaggttggaacccgagtattttgatggttttccacaggtttataatggtcggaagaaagagattgcaggaagaagaatgtcatttataaattccagtgctgctaacatgcctaatggggatgaaaaattgttcttcccacaggaagagccgattgagtactctggttcaaagggccaaaatcgtaggtcctatggtggcaattgtagctcctctcatgacgaaaggcagatgcaaagaagagtgggtggtcagtctccttcaattactcccattcaagaattggcaactgataacagtctaaaagaagagtcagcagaaagcatggaaggtagacatagatcatcccctgctgttaaggatataagggagtccagtgtggaggagaaggatattgaacttgaggatactgggacagctgatggaagttccagattggaaaaggaggaaacagtagacaaagtagatgcccttgaggatggggtagcaaagagacagaagttgacatctcgagttgagccacctttgcttgatgaagttgatgattgggaggactcaaaagctgcaaaaagtagtgataacagcaaagcaagatcagccagcagtagggataaccaaaagcggcgagagggttttgaagaggaagtagttcaagatccacgatcagcacaactgagtagcatcagacagcacccggatgaaattgagcagggattttatagaagagagcatgatgcaaagcaagaacccggaagaaatctcatgatgcttaaaggcagagagagaccatacccttacaaggaccggcatcctagctcagctactcagttgaacacaaatgctgatggatttgatggacaaaaagaaagggacaattctgaaatggattggtcacgaagagatgatgatctctataacagaagggttagaaatgatgaacctagaaagagggatagggctaaggttcgagaaaatgagaaaaacgacaaagaagatagccttcattcaagaaaacagttggataatggtagctacagggtttcctatgaaaaggatgttgggtctagagactcaagacaaagggaaagagatgagggcttgaggattaggtacgaagcagtagaggattaccgtggcaagaagaggaaggatgaggaatatcttaggagggagcatattgacaaagaagaagttctgcatggctacagggaaattgctagtagtcggcgcagacgagaaagagatgaagtattggatccacgaaagagggatgacctgcaaagagctagagataaccctgatgatcaatatgctactaggcagaaagatgaggcctgggtactgaaggagaggggtgataggcagagagatagggaagagtggtgccggatgaaacagtcccatgaagaacacctacccaagcgtgaaagagaaggacggagttctgtaagaagtggacgaggggctgaacataaactttctgagaaagaataccaatcccgagaagcaatgcgacacaatgaccaattgaagagaagggatcgaattcaggatgaaagtccacatcataaggggcgagatgatgcttctgcccgtggaaatcaatatactactgaggaaaggcgatctaggctagaaaggtcaagtagtcgtagtgatcgtgttgctaatgtttctgataaccaaaaagtcaagcatagagaaggctcaaggaaaagcaaagaacgtgatgttagtgaccttaatagtttaggcctgtccaagagaagtcaagaaaatcaaagtggtccaaccaatgagaaggtatgcacacttgcatgtaaaaacgtgaaactatctggagagtaa

SEQ ID NO: 99315 - DNA, 348 bp, Glycine max
  Peptide Sequence Number=SeqID_216093
atggaggaaccaaggacacctcacctcttggcaggcaaaagaattctaaggtatgttaaaggaactttaaattttggcataatgtttcctaatgatgagaggtatacaaaggcaaagttgtttggatattcagactctaatgagtgtgatgacaaaagtgatcaaaatagcacaacagggtgctcaaagaagcaaggtgtggtagccttgtcttcatgtgaagcagaatacatagttgcatctatggtagcttgtcaagctttatggctggaaaccttgttagaagagttgaatctaagagagtctaaaccaataaagttgttggttgacaaacaagtcaactattga

SEQ ID NO: 99316 - DNA, 243 bp, Glycine max
  Peptide Sequence Number=SeqID_216094
atggagagtgtatccactcttgtgtattgtgatgttggcattattccatcagatgaagggataatgtttgaaagccctagtgatcctaaagtcatcacaataagtgaggacatgtcgcttgctgccttaaggaaaacaattttttatgccaacagagatgaaatccttaccctgttgtacaaaccaaggaaaccaagaacgactggtgagataattgctttgataaataatgaatccatgtaa

SEQ ID NO: 99317 - DNA, 1165 bp, Glycine max
  Peptide Sequence Number=SeqID_216095
atggagttgcgaaaatccttcatctgccactgggttttcctttttgtcatcgtctttgttcaagtagtcaatggtttttatctccccggaagctatatgcacacttactcaaataaagatctcatatacgctaaagttaattcgctgacttcgattgaaaccgagcttccctacagctactatgacctcccttactgccagccggatggcggcataaagaaaagtgctgagaatcttggagagcttctgatgggagatcagatcgataactcgccataccgattccggatgaatgttaatgagacactttacctctgcactacgtccccgttgaatgagcacgaggtgaagctactcaaacaaaggacacgggatctgtatcaagtgaatatgatccttgacaacttgcctgttatgaggtttaccaaccaaaatggggttaaaatccagtggacagggttccctgttgggtacactccagctgatggcggtgaagattacatcattaaccaccttaagttcacggtcttggttcatgaatatgaaggaagtggggttgaaattgtggggactggagaggaaggtttgggtgttatttctgaatctgacaacaaaaaggcatcaggttatgaaatagttggttttcaggttgtaccttgtagtattaaatatgatcccgaagtcatgacaaagcacaacaggtatgatactctttctcctataagctgcccggctgagcttgacaagtatcaagtgataaaagagcgggaaaggatatcgttcacatatgaggttgaatttgtgaaaagtgatataagatggccatcacgttgggatgcttatttgaagatggagggttcccgagttcattggttctcaatcttaaattcacttatggttatttctttcctggctggtattgtttttgttattttcctaagaactgtgagaagggacttgacgaggtatgaggaactggacaaagagactcaagatcagatgaacgaggagctctctggatggaaacttgttgtgggtgatgtgtttagggagcctgattgctcgaagcttctctgtgtgatggttggagatggggttcaaattcttggaatggctggtgttactattgtttttgcagcacttggattcatgtcacctgcatccc

SEQ ID NO: 99318 - DNA, 267 bp, Glycine max
  Peptide Sequence Number=SeqID_216096
atgttgtatatgatgcattacaacatctattcttatagaaccaatgttgttaccgcgtcgcgtggcaccgttaaggacggtgtagttgaggagcaggagggtgacgattatgaggctataggcgatggaggtgtcaatggtgtaaaggtagaagcaaagcgagagaaggtaggttaccttgctacgacgttgttcgatgccaacagtgagagtctagatccttcgatgacaatggctcaagcggatgatggaaagcaactccattaa

SEQ ID NO: 99319 - DNA, 381 bp, Glycine max
  Peptide Sequence Number=SeqID_216097
atggaaactaaacaacatcctcgacaacaaagcccaccaattgttgctagcatgcatgatgaaggattacaaccacatgctcaatcatatgaattcatgccacaacttcatcatcatcatcaagaagattatgggtacaatccacaattcttcaatgctaggagagaagactttatgagcaaccccatgggtacagttgttcgaatatcggagtctgcttatacgtacatccaaattattctactaatgacttcgtctaggaagagcaacttgttcctgatgaacaacttgaaccacaagaatatgaatgagtatgtcgacgaatggcatgaaataagcaacctcccagataaaggaattggtagacatagacgacattga

SEQ ID NO: 99320 - DNA, 636 bp, Glycine max
  Peptide Sequence Number=SeqID_216098
atgtgcactttgaagaagagaggcaacatcttcatcctaacactcaccggggagggtgagcaccgtctcaacccgacactccttgattccatccaatcctccctccatcgcgtcccccaagaagccactgcctcctccgccctcgtcaccaccgtgcacgacaaattcttctccaacgcctacgacattgcctgggcccaatcatccgatgaggtcaaagaacgcatgatcctcatggactccctcctgcactctgttattctccaatctcctcatgctcccaaagccgactatagccgccgtcatcggccacgcctctgctgcaagctacaccctcgccttcgccttcacccacgttcttttggttttggagggcaagagaggggaatagaggtggaggaggaatgtggagttgggggcagtagttgcgtcggggagaaggtggaaagtgggcattgggaagaggaaaggaacgggcaccgcgaggtatgtgaagaggaacaggcgcaagggatgaaattaaaattgctcacattcaaagacgggttcatgaaaaccatctttgaaatgttagcagtatttacaaaattgccactactacacaaacaaagacggttttttgacaactgtcgttga

SEQ ID NO: 99321 - DNA, 255 bp, Glycine max
  Peptide Sequence Number=SeqID_216099
atgaatgaaggaaaagatgtagtcttcttcgagatagtggccagaattgaaggtttgaggattgggagaaggctcagtgagggagttagggtcgaagagaacgccgaaggaggagtagttgctgttaaccgtgccttggttgtcccattggggctcttcagtggcaaggttctagcaatgatcgtctttggggactcatcggttgatgttgggaacaacaataacatagcaatggttgctcggagccatttctag

SEQ ID NO: 99322 - DNA, 429 bp, Glycine max
  Peptide Sequence Number=SeqID_216100
atgagggttttgaataggttgttccataatggactattggcaaataaaaaaattggttgtgcaagatgcaaaaagggaggtgggggagcggctacacaaagggaaggaggaaagaagggttgtcgtccgttcatgtttaatgacggcatattcaatgatcgtaactctcgatgcatagccaaaatcaacctttatgccaatccagtctacaccacctttgaaaagccgagatttgcaagctcactcgtgtctctccacctctttatgtttaatgtcataagaaaattagaggaaagaagagagagggaggagggcaaggtcgcacagtcggaacagagatggtggacaaggccagcggtattggaggaagaaggaggatggagcatttttgtccattcaatccccaaagttctttgggaggtgcagtaa

SEQ ID NO: 99323 - DNA, 219 bp, Glycine max
  Peptide Sequence Number=SeqID_216101
atgatgttccgtggttgcggcaacggtggtattgggtggaggcagaacttgcttgggagaggtaggggtatttgtgtccatttcggtcttttgggagatgtaggaagcggaaaaggagaagcacgaacgcggaacttcatcggtgtgtcctgcatcggacccgcaccagacacgcatgcgggtaagactccggtgcgacgcggtgtccgttgcttctag

SEQ ID NO: 99324 - DNA, 618 bp, Glycine max
  Peptide Sequence Number=SeqID_216102
atgaccagtaaacccaatccggcgccggctgccagagagcgcggcagaccgcgcaattttgatatcgacgaagcgctcgacagcgccatgatcgtgttccgccagaagggttttcatgcggcctcgattgccgatttaggtgaagcgatgaacctgacggcgggcagtatttataaagcgtttcaggataaacgttccctgtttctgcgggtgtttgagcgctacatcctgctgcgcaacgtggacctgcgcgcccgtttgcaacagtacccgaccggccgggcgcgcattgctgagctgctgcagttttatctcgactcagccagcgagatcgagggcagacgcggctgcctggtggttggcagtaccgtggaactgcaaacgctggatgaagagttatcccagctggtgcgtgaagcggtattacgcaaccgcaacttcctgacttcgctggttgagcaggggcaagaggacggatcgatttcgccacgactggatgccgacaccgccgccggactgctgctttgcgtggcatttggtatgcgtgtggtaggcaaaattcaggatgtgactaatggcaaagaaaccattaatatggtgctcagcattctggactga

SEQ ID NO: 99325 - DNA, 255 bp, Glycine max
  Peptide Sequence Number=SeqID_216103
atgaacggaactcatgggaccttgtacttcagccttctcacgcttattcacagcaaaagaggggtggaggttgcacagaagcttgcccaggcgagctcagctcacccagacaagctgcttgcttactctagaagtaacttgctcgcccatgcgagttcagctcgtccaatcgagctcgttacttcatctctaagctttctagtgggcccaggggttgaaaattttccaaaagtcaccccttgccctttcttttga

SEQ ID NO: 99326 - DNA, 414 bp, Glycine max
  Peptide Sequence Number=SeqID_216104
atgcactatattattgttcgaattttgcttcctcgttcttctaatttggctcaagcctctgaggaggacttgattttgatgtgggcttttcttaccgatcgtcagatcgactgggctcacttggttaggtaccgaatgcataaggcattacgggccaatgcacctctcccttatcctcagttggtcactctatttctccgtcattttcaaattcctcttgatgatgaaccttttgttcaagtcaagcgttcctttgctatagagttacggggcctccgcacctatgttggtgaacgattcgattctttggatggtcgctttgaaggcatggatatccacgtcacccagcttgaggaggatgtgacttatattcgtcagagcttcaatcttcgaccaccaccaccaccttcttag

SEQ ID NO: 99327 - DNA, 597 bp, Glycine max
  Peptide Sequence Number=SeqID_216105
atgcacttacacagaaatctagaatcagttgatgaacaagaaactgccacatttgctaaatggattcttgacattggagatggaattatagatgatgaaaatgatggttatgctacaattcaaattcctgctcatctacttattactcaatatgatgatccaatcagtgctatagtcaaatcaacattcccagacttagatcagcaccacaataatcctgaattctttaaatcgaaggcaatattggcttcaacaaatgaaacggtagaacaaatcaatgattacgtgctatccttcattccaggtgaccacatggaatatctaagctctgattccattgataaatcagaaactagtgagaattcgtatttccaatcaattactactgaattccttaattcattgaaaacgtccggtttgccaactcattctatcaaacttaaaattggaagtcctataatgttgttaagaaacctcgaccaaaatcaaggtctatgtaacgatactagattagtggtaaaaacattggcatggctgtttatattccaagaatgtcaatgtctccttcacaatcaccctggccgtttaaactattaa

SEQ ID NO: 99328 - DNA, 4139 bp, Glycine max
  Peptide Sequence Number=SeqID_216106
cgaccgttacacacacaaggacccgttacaacgacccggcatctccgttgtcatttcgctggtccgatatctccctcagcctgctttgtgcgggtgcgttgctgttgcccgtcgccgcgcatagcgccgatgacagcaaaacgcagctaaagtccattcagcaggacatcgccgaaaaagagaaaagcgttaaagcgcagaagctgcagcgcagtaagctgctcgatcagctgcagagtcaggaaaaagtgattgcccaggccagtcgccagctgcgtgaaacccgcaacagcctgagcgcgctgaacggcgaaatcgcccaaaccaccgccgccattgcccggctggaaaagcagcaggcgcagcaggaaaaactgctggcgcagcagctggatgccgcgtttcgtcagggccagcacaacggcgtacagctgctgctcggcggtgaagaagcacagcgtagcgaacgcattctggcctattttggctacctcaatgccgcccggcagaaaaatatcgatgagcttaagcagactcagcaggagctggcgcagcagcgtcaggcgctgcagggcaagcaggagcagcaaaagtcgctgttagcgcagcagcagacgcaacagaacaaactggaaaccgccagcgccgcgcgtaagaaaacgctgtccgcactggagagcgcgctggagaaagaccaggccgatctggtcgagatgcgtcagaacgaaagccgcctgcaggacaaaatcgccaaagccgaacgtgaggcgcgcgaacgggcgcaacgcgaagcgcgcgaggcggaaaaagtgcgccagcgtcaggcccaggcaaaagccaaaggctccagctattcccctacgcaaagcgagcgcgagctgatggcgcgcaccggcggccttggccggccggacggacaggccatctggccagtgcgcggtcgcattgaacatcgctttggtgaagcaatgcagggcgaactgcgctggaaagggctggtgattgatgccccggaaggcactgaagtcaaagccattgctgatggtcgcgtgctgatggccgactggctgcaaggctacggcctggttgtggtcgtcgaacacggtaaaggcgatatgagcctttatggctacaatcagagcgcgttggtgagcgtcggtgcgcaggtgaaggcaggacagcctatcgccctcgtgggcaccagcggcggccgcggcacgccctcgctctactttgaaattcgtcgtcagggacaggcctcccaaaagcttagcgccgccctgtgcgggctgtttttaacctttgccgcccatgcgggaaaactggctatcgtcattgacgacttcggctaccgcccggctgaagagaataaagtactgcagatgcccgccgcgatttctgtggcggtgctgcccaatgcgcctcatgcgcatgatatggcaaccaaagcgcatcagggcggtcatgaggtgctgattcacctgccgatggcaccgctgagcaagcagccgctggagaaggatacgttaacgccggagatgagcagcgaagagatcgcgcgcatcgtgcgtgacgccagcaacaaagtgccgtatgcggttggcctgaacaaccatatgggcagcaaaatgacctccagcctgcccggcatgcagaaagtgatgcaggtgctcaatcactacaactactacttcctcgatagcatgaccattggcaacagccagtcgatcccggccgcacagggtacgcaggttaaggtgctgaagcggcgcgtattcctcgacgacagccagaatgaagcggcgattcgcacccagttcacccgcgcagtgaagctggcacagcgtgatggctacgctatcgccattggccatccgcatcccaccacggtacgggtgttgcagcagatgttgccgacgctaccgggcgatatcaccctggtccgccccagccagttgctcaacgaaccgctgcgccagggcgctacgccgccggccagcacgccggagaaaccgcgtaccccggtattccgtgcgcctggcgtgtgtaagccgggtcagccgctgccagccgtaccgcagagtcgtgcggtggaggcgcagcgggctgcgccttatttaacgccacaccttttccgcgcaaggatatcggaacagatgacgtcaaccagaaagaaaattctgctgctggataccgggcgcgaatggggcggcggcaccaacagcatgctggaattactcaagcgcatcgatcgccagcgtttcgctatcacctgctgtttttatcagaattatgcgcgtggcaatcaggagaccattgcctcggtattagacgcgatcggcattccggtgctatttattgcgcagcgccgccagccgctctgggcaaaaatcaccaaagagttgctgcgcaccctgctgttttttaaccgcgcggtgaaaaaaaacgccatcgaccgcatcgatcgccagtggcgcatgcagcctaacgcccgccaaatcgcgacgattttacgcgacggtggctatgatgcgctgtacatgaataatcagcccagcaccaacgttgaaggctatctcgccgctgaacagactcacgtggcgttaattcagcactgccgcattgatccgttactcaataatgcgctggtcaagatgattaatcggcattgtgatgcggtgattgccgtgtcacagggcgtacaccgcaccttaagcgaaagcggtgttgatgcgcagcgctgctttaccgtatccaacgctatcgatattcatcagccgctgccggtgcgtgaggcggtgcgtcagcgctttgattatcccgcggatacctttattttcggctccatcggttccctgattgcgcgtaaatccaaccatcatattttgcaggcgctaggtgcattcagccgcgcgcatcctgccgctaaatggaaaatggtgatcgtcggtgccggcccggagcagcagcacttacagcagctggcacaaaaagaagggattgccgcgcaggttatttttaccggctttcaaaataacgcgctggattatctggcggcattcgatacgtttattctcgcctcagccagtgaagggctgccgcgcgtggtgctggaagcgatgctggtgaatacggcggtgataggttcgaatgtcgtcggtacgtcggaattaattcaacaccgcgagaccggtttactgtttgactatggcaatacgcaacagcttagtcagcatcttagcgcgctgtggcaggatactgtactgcgtcagcgtttaatcgccgccgccgccgcccgggtgcgcgagcgctacagcattgaacattacgtgtcgggcgtggaaaacattctggaaaacggcacaattgccgtcagttctgtggtcattccctgtaccggcgctgattacattgaagaagcggtgctcagcgcttattttgccagccgctgcgccgacaccatcagcgaaattgtcatcgtcagcgatcagccttccagcgcttttccgccgctgccggcacgcgtgcgcgtggtgacgctggaagtgccgtttcgagaagaaaactaccgttataaacagatctaccgcagccgcctgataaaacttcaggcccccttgcaggcgaccggtgaaggtatattgatgatcgattccgatctcaatttattgaaaacgccggatattgcgatgcgtgagcatcatctgtatagcagcttccgtcagggcaagatgatcgccaaactggccggcgcaccagaagaacatattccggcctattaccaccacaccgttcgcccttatttgcaggatcacgtgaatggcgcctacctggcggcctcccgtcgcacatggcagcgtatttgtccgctgtggctgacgttatttaatgatacctgggaattgatgaacgacgaccagccgccaaccgatcagctaccgctcgctgccctgctcgacctgctggatgtccgcacggtcaatctgggcgaatgggctaactggccggtgtcgaaacgcattggtggtcagtcggccgtgattccaccgcaggatccgcaccagccgctgagcttcaaaggccaggactacacgcgtaaggtgcgttacctgaccgatgcggaaaaacagcaatcctga

SEQ ID NO: 99329 - DNA, 1283 bp, Glycine max
  Peptide Sequence Number=SeqID_216107
atgagtaaactcgggttttacctgctgctgctggtgcttgcaccggtcgctgcggtaatcgtcatcacgcctatggacagccagaaacagtatatttttggtttgatcagtattggcatgatgtttttactgggcttcagtaaaagccgtaaaataaccattgtgatggtttttctttccgcgctgatgtcgacccgatatatctggtggcgcaccacggaaacgctgcagtttaattccgagattgaagcgattctcggtatcggcttatatctggccgagctgtacgtctggctgatcttaattctcggcttcctgcaaaccagctggccattaaaacgcaccatcgaaccgctgccggatgatacccgcttgtggccgacggtcgatgtctacgtgccgacctataacgaaagcctcgacgtggtgcgggataccgtgctggcggcgcagtgtatcgactacccgcgcgataagatcaaagtttacctgctggatgatggcaaacgcagcgagttcgcggtatttgccgccgacgttggcgtcggctatatcacgcgtgacgataaccgccacgccaaagccggcaacctcaatcacgccatgaaaatcaccaaaggtgagctgatttgcgtgtttgactgcgaccacgtggcgacgcgcacgttcctgcaggccaccgtcggtccgttcctgaaagatccgaagctggcgctgctacagacgccgcactacttctattcgccggacccgttcgaacgtaacctgcgcgccgcgcgcagcatcccgaatgagggctcgctgttttacggcccggtgcagcagggcaacgacaactggaacgccacgttcttctgcggctcctgtgcggtgatccgccgcagcgcgctggaacagattggcggcttcgcggtggaaaccgtcaccgaggatgcgcataccgcgctgaaaatgcagcgtctcggctggggctcggcgttcctggcaattccgctggcggcgggactggcgaccgaacgtctgggcctgcacgtgattcagcgtacccgctgggcgcgcggcatgacgcagattttccgcgtcgacaatccgctgctgggccgtgggctcaagtggcagcagcgtctgtgctacctcaacgctatgctgcacttccagtttggcctgccgcgcgtggcgttcctcactgcgccgctggcttacctgctgtttaacctgaatattatccactcgtcggcgtcgctcatctttgcctacgtactaccgcatctggtgatgtcgct

SEQ ID NO: 99330 - DNA, 1263 bp, Glycine max
  Peptide Sequence Number=SeqID_216108
gctctgatcatgaagaactacgacgatctgcagcgtttccaggaaaaaacgcaaacgctggacattgcttttaaggatatgtccgggcaatcgctggaagccgatcacagccagtgggcgatcatccgtcagctggcgacggatgatgagccggagctgggtagcggccagcgcgtcgatctgccgcagccgcagccgattcgcggcgatgagtttgtcgcgccgccgcaggctcttaatccggcgcccgtcgcccgcagtgaaaaggcgttgctgctgcagagcctcgccgccagcgcgccggcacccgacaaagaaacaccgcgcagcgcccacgcacgtagcgcgtcaggcggccacttcactgttcccaccgccgccggcggtcgcccctgctgccgcagcaccggccactgcgcccgccgtggtgcagccggagcctgctacgccctcgcgctttggcgcactgttccgctcgcgtgcggcggaaccgggggagtaggaaaaaccaccatggcggccaacctggcctggagtctggcgcgtgccggcagcaaagtgctggcgatcgattttgacgtacaaaatgcgctgcgcctgcattttggcgtaccgctgcacgacagccgcggctttgtggcgcgctcggaagagcacgctgactggagtcagtcaatccttaccaccggcagcaacatctttgtcatgccttacggtgaagtgactgaagcgcagcgtgagcgcttcgaacacaacctggcgcacgatgcccatttcttaaaacgcggtctggataccgtcctgaattatccgggtctggtgattattgcggattttccgccgggacccggtccggcgctgaaagccatgcaggagctggccgatatgcatttagtggtgatgctggcggataccgcctcggtggcgctgctgccgcaaattgaaaaccatcgcatgattggccagccattaaataatcagcacggtcattatttcgtgctcaaccaaagtgataatcgccggaatatcagccgtgaagtaaccgcatttatgcagcaacggctgggcgataatttactcggcgtggtgcaccgcgatgaaagcgtggctgaggccaatgcctcgcagcagtcaatctatgatttcagcccggcttcggcagcggcgtttgatattgaactggtggcaaaacgggtggcgaatatcctgaatatcaacgtaggcaacggcgaagttcaggcaccgatccgcagtcattattaa

SEQ ID NO: 99331 - DNA, 141 bp, Glycine max
  Peptide Sequence Number=SeqID_216109
atgactttcactagaagcgagctacctagtggaaaaaactcatacttgagtggaatattgttagagtccaagtgtgaagtgtttagcccatcgattgtacaacaattggtattagagccgatgattcaacatggtgattga

SEQ ID NO: 99332 - DNA, 413 bp, Glycine max
  Peptide Sequence Number=SeqID_216110
gtttggggtgtgcgggttcaaatgtggagaggatgaagagaaggagggtggtgaagaggaggaggaagcatatcgagatagttgattgggctttggagagaagggcattgttggaattggaactaattctcttgaaggaatgtggagagggagaagaagagattttggtagcaatgattggagtgggagtgttattctcctctgggaagaaaacccatggttgtccgtgtatgagggagggatgttgtatcccattgcccagaggctcttcgctatgcgaaggtatgggggagggatgttgtacgcagccttacccttgcatatgtaaagaggctgtttccggattcgaacccatgaccaacaagtcaccaaggcacaactttaccgctgcatcagggctcgcaagaaactga

SEQ ID NO: 99333 - DNA, 3621 bp, Glycine max
  Peptide Sequence Number=SeqID_216111
atgaaaaaacagctgataagtgccggtattcgtcaggcgttcctgctgggcggcgcgctgacgttctcacagccgctgctggcggcggagagcaccaatccggcgttacaggcactgttcgaccaggcggcctactggcatcagaaagcgcatgacgatctggcgaaagcctcgctgcaaaaaatcctgatggtggagccgaacaatacccaggcgctgtatctgctggcgctctattcacagcaaagcggcagcgcggccgatgcggcacagtggcgcgcccgcctgagtgcggtatcgcccaacgatccgcatctgacggagctggacaacgcgcggcagctgcagagcattccgcaggcgcagctgtcgctggcgcgtcagcaggcgcgcagcggtaacatcgccgccgcgctgcaaacctggcgcaacaccttcagcggcaacgagccgccaccgagcgtggcggcagaatattatctgaccatggccggcgaccgcacgctgctgccccaggcggtggaggcgctgcggcagtttgccgctgatcatccgcaggataccggcgctcagctggcgctgggcaaagcgctgacctatcaggaagcgacgcgccgccagggtattgatgtgctggccagcatggcggacggtaataaagaggccgatcgctcgctgcgtcaggcgctgctgtggctggcgccgcaggcgtcggacgccgcgctgtaccagacctggcagcagcgccatccgcaggacagcgccgtggtggattactaccgcaaaaatgtcggcggcgcggagaagggcgcgggctttagcgcgctgaacagcggcgacgtcagcggtgcgcagaacaactttgaaaaagtgctgcaggccaacccgcttgacgccgatgcgctggccggtatgggctacgtggcgcagcgcgccggacgctacgccgaagccgccgattatctgacgcgcgccgcacagctgggcggcgatcaaagccagcagcgtcagcagcaggcggccgacgcccgcttttacgcgcagctggcgaatgcccagcaggcgctgaaaaacggtgacagcgcgcaggcgctggcgctgagtgagccgctgacgcaggccgagggcgaaaaaggcatatcggcgaagctgtttcgcgctgatgtgctgcgccgcagcaatcagctgcagcaggcggagcaaacctaccgggccattctgcagagcgatgtcgataaccgcagcgccaaagagggactgttttacgtgctgcgccagcaaaaccgcagcgccgaagccaataccctgctggcatcattgcccgacagcgtgcgccagagcgtggcaccgcgcggtaacagcagcgatccgctgcgtgcgcaggcaaaacgcgagctggcggcaggcaaccgcagtgcagccatcgccacgctgaacagcgccattcagcgctatcccagcgacggctggctgcgactcgatctggcgcgcatctaccgcgcgcagggcgataatttactggccgccaacgtcatgcagccgaccctgcgcagcgttgccagcaccagcgagctgtatgccggtgcgcttaacgccagcgagagcggtgcctggcagcaggccagccagttgctggcgcgcattcccaacggcagcaagaacagcgagatgcgcgaactggcgcagcgcgtgaatttcaatctgcaaatggccaccgccgatcgctatctggcacagggctctgacgcggcggcggccaatacgctgcgcgcgctggccgccacgccgccagccaatcctgtcgatgccggtaatctggcgcagaaactggccaaagccggcgatctcaccacggcggtgacggtggtgcgcggcaacatgcagcgcggcgtgcagggcaacgccggtgattacgccgcgcaggtggcggtactgaatcaggcgggactgacgaccgaagcacagagcttcctcagcagtccggagctgcaggcgcgcagtacgcccacgcagctggccggcatccgcaatggttatctcatcaatgaagtcgatcgcctgcgcgagcagaagcagtacgccgccgcctatgacaagctggtgggcgcgctgcagcacgatccgcagaaccgcgatctgatgtttgccatggcgcgtctgtatcagtccggcaagatgaacaaagaagcgggcgtggtgtatgactatctgttaacgcaggatacgcccactcaggatgcgcgcactggcgctattgatgtggcgctggcgcagaacgacatcgacaaagcgaacaccttaacccgcggcctgcgcaatgagcagacgccggatcgcctgttactgctggcgcgcgtggcggaagctaacggcgagcacagtcaggcgatgagctacctgcgcagcgcgcgcggccagctgattggtctgcagggcgcacagagcggcagcgtgccgactgttggcggcctggcgctggcggacaatccgtttatcaaccgcagcacctcgccggtgtccggttcgccttccagctatggcacggtaatgccgtggcaaacggcaccggccaccagcagcagcgcgcaggacgtcacgctggcgagcaccacgccggaggtccggcagagccagacgctgcgccagattgacgagatgatggataatctgcaggagaaaaccggcacctgggtacaggggcagatgcaggtgcgcggacgcgacggcgaatcggggctcagcaagctgaccgaagccaaagcgccgctgaccttctcgaccgtgccgttcggcgagtcgcgcttcgactttactatgacgccggtgtcgctcaccgctggcagtgcggctggtgatgcgtggcgtcgcttcggcagcaacgcgctggtgcagggcaatgtggtggcatccggcgcggccaaaatagacgacacgccgtcttcgtcgaccgattcgcaaaaggccaccggcgtggaactgaatatggcgctgaagggcgacagctataagatcgatctcggcagcacgccgctcggccaggatctcagtacgctggtgggcggcgtgcagtggtcaccgaagctgaccgatttcctgacgctgatcctcaccggtgaacgccgcgccatgaccgacagtctgctgtcgtacgttggcgtagaggacaagaccagcggcaagcgctgggggcgcgtcaccaaaaacggcggcaacgccatgctgagcttcgataacggcgacgcgggtttctacgtcggcggcggcgcttacagctatctgggcgagaacgtggcgagcaacaacagcgtgcaggccacggctggcgcttacgtgcggcctttccactacgacgaccgcgagctaaaggtcggcatgagcctgtcgtggatggatttctccaaaaacctgagttacttcagctacggtcagggcggctatttcagtccgcagaattatgccgcggtgtcgttccctgtcgacttcagccgcaagtttgatgacctgaaagtcaacgttggcggttcggtcggctatcagtcgtacagccaggacaagagcgcgtatttccccaacgatccgtcgctgcagtcccagctgcaaagcctcgccgatcagggcttt

SEQ ID NO: 99334 - DNA, 510 bp, Glycine max
  Peptide Sequence Number=SeqID_216112
atgcaaacggaaccggagtttgagtgggataccaccaaggcggaaacaaatttccgtaagcatggtatccgctttgaagttgcagcccgcgtgtttgaggatcctttccacctgtcggtgcaggatcgttatgaaaatggggaatatcgctggcaaaccattggtaatgttatggggcatgtggtcattctggtggcccatacggtgcgcttcgaaacagatgttgagcgaataaggattatcagcgcacgccatgcaacgcgtattgagaggaggcgctatgagcaaagtcaggacagcgacatccagtgtgatgatattgcgccgttagacgacagtttctggcaggctgccgaacgggggcgtttttaccgcccggtaaaaacccaggcttcgatcagaatcgatgcggatattcttgagtggttgaaggcgcctggcaaaggttaccagacgcgcctcaacgcgatcctgcgagccgcgatgctaagagaactgcagggtaaatag

SEQ ID NO: 99335 - DNA, 2796 bp, Glycine max
  Peptide Sequence Number=SeqID_216113
atgatcggcgcggcctttgtgctgctggtgatttacctgttcgtggcgcagtggattcgcgtcaccgtgctggtgtcactggcgctgatctggctgaacgtgctgacgctcgccggcccggcggtcagcctgctgcccagcaaagctgccgcaccgccggtggcgctgaatgacaaaccggccgccagcccggccgcggcgggactcgatcaaagcgcaccgcccaccagctccaacctcaccgcgtggctgaatcgcttttacgacagcgaacgccagcgcgtcacgcacttcccggatgcgctgcccgccgattcgcagccgttcgatattctggtgatcaacatctgttcgctggcgtggtcggacattgatgtggcgcagctgcgcgaccatccgctgtggaagcactttgatatcgtgctgaacaactacaactctgccaccggctacagcggtccggccggtattcgcctgctgcgtgccagctgcggccagacctcacacagtaacctgtataaagccaccgaccagcgctgctatctgtttgataatctggcgaagctgggctttaagcagcagctgatgatggaccataccggcgtgttcggtaactacctgaaagagctgcgcgaggacggcaacatgcaggcgccgctgatgtcgcaggccgggattgcgccggagctgacgtcttttgatggttcgccagtgtacaacgacgggcagctgatgcagcgctggcttgatgaccgcagcaaaagcagcgatgcgcgcagcgccaccttctacaacctgattccgctgcacgacggtacgcgcgagctgggcagcacccgcaccgccgagtggcagccgcgcgcacgggtgctgttcgaccagctcgataccttcctgaccaatctggagaagtcgggacgccgggtgatggtgctggtggtgccagagcacggtgcggcactgcagggggataaaatgcagatgtccgggctgcgcgacattccgagcccgggcatcacccacgtgccggttggcattaaatttgttggcatgaaagcgccgcatcagggccagccgctgaccatcgatacgcctgtcagcctgctggcaatttccgagctggtgtcgcgggtggtggacggtcaggtgtttaacgcaccgaacgtcaacatgtcggtgctggcggataacctgccgcagacgccggtggtgtcggaaaatgataacgccgtggtgatgatgtatcagggcaaaccgtggattcgccttaacggcggcgactgggctgacaaaatgctgaaaccgcgcgcaaagcggggcagttgcgtgattttcgcctttatcccggcgcaaaaaaatgctgacctgggatatacttgctgcgcattccggcaactgtcacggcccccggcggccaggagaggttttgttgcgcgtcagtcgttcgttaacgataaagcagatggccaccgtgtccgccgtggcgctggtcaccatctggtggattacgcccagcagatggagaacgtcgcgcataccgtgcgtcagccgctgtccgaagcggtgcttaaagccgatatcccgcaggccgaacgcattctgaatacccttaagccagcgggcattctgtcgcgcgccgatgtggtgttgccgaacgccttccaggcgctgcacgctgacttcgcgccggagaaaccggtgccgcgctttgtcgcccggctgttcgaactgccggtgcagattacgctgccgctctattcggtcgagcgcagcgggctgccgaagccgattgcctatctgcacgctgtccaccatgatcaccacctatctgctgctggcgctgattctgtccgtggcgatcagctggagctgccgccgcccgccattctcactcataagctggcgctgccgcacaatcatcgcgacgatgagatcggcatgctgattcgcagctacaaccgcaaccagcaggtgctggagtcgattcacgatgaaatgagccggctgaccacccatttcgcggtgaccgatttgcccaaccgcgcgctgtttctggcgctgcttgatcagcacatccgccatcgccacagccagcagccgtgggggctgatggtgatccgcatcgaaaccctgcaggaagccaatggcgtcctgagcgatgagcagcgcgatacgctgatgctgacgctggtggaaaaaatccgcagtaccattgatgaccataccctgctggcacagaccggaccgagcgactttgcgctactgatgaagcgtgcgcacaacccgtttcgcgccatgcggctggcgcgcaacctgatgctacgcatcaaccagccggtgaacctgtatcagctgcagctgcgccccaacgccagcattggcctggcgctgcatgacgacaacaccgtgtccgctggcgaacagctggcgcgtgccacgtcggcgatgatgtcggcgcgccatcagggtaaaaaccagattctgttctttgacccggcgctgaccgagcgggcgcagaagcgcttaacccaggagcacgacatcctgcagggtctgcaggatggccagtttgcgctctatctgcagccgcaaatcaatatggccaccggcgacctggccggcgcagaagcgctgctgcgcatgcgtatgccggacggcagctatggtttatccgaagagttcatcgccagcgccgaagagattggcgttatctccgcgctcggccgctgggtatttgaagaggcgtgccgcattatcgctggctggcagcgccacggcatcaatctgccgctcagc

SEQ ID NO: 99336 - DNA, 3159 bp, Glycine max
  Peptide Sequence Number=SeqID_216114
ggactgctggagccccaccgcattgcgccgggtaacttcgtgctggagatcaccgaaaccgcgcagattggcgatgctgaacaggcgatggcgctgctgcgctcgctgcagcaaaccggttttgtcgccgcgctgccggatgatgacaccatggtgcgcatcgtggcggcaattgccgatatcatccacctcgacgtgatagccgaaggcgtcgaaaccgccgagcagcgcgactggctgctggcacgcggaattaccattgggcagggctacttatatgctgaagccctgccaattgcaccgttatggggtgctgaagcgtttcagttcatagcggcttgccgcatgcgtttctccataacaatggcggtgaatgccgtctatacctggacacctgttatgaaactgttcaaaagcctctactttcaggtgctggttgccatcggcatcggcgtcctgttaggccactactaccctgagttaggcgcgcaaatgaagccgcttggcgatggcttcgttaagctgatcaagatgatcatcgcccccgtgattttctgtacggtggtgaccggtattgccggcatggagagcatgaaagcagttggacggaccggcgcagtggcgctgctctatttcgaaattgtcagcaccatcgcgctgattatcggtctggtggtggtcaacgtgatccagccgggcgcgggaatgaacgtcgatccggcgacgctggatgccaaagcggttgcggtctacgcgcagcaggctgagcagcagggcgtgattgccttcctgctggacgtgatcccgaacagcgtggtcggtgccttcgccagcggtaacatcctgcaggtgctgctgttcgctatcctgtttggctttgcgctgcatcgcctcggtaacgccggcaccgtgatgttcaacgtcatcgagagcttctcgaaggtgatttttggcgtgatcaacatgatcatgcgtctggcaccgattggtgcgttcggcgccatggcgttcaccatcggtaaatatggtgtcggatcgctggtgcagctcggtcagctgattatctgcttctacatcacctgcgtactgttcgtggtgattgtgctgggcattattgcccgctgggccggcttcaacatctttaagtttgttgcctacatcaaagaagagctgctgattgtactgggtacatcttcttccgagtcggcgctgccgcgcatgctggataagatggagaagctgggctgtaagaaatcggtggtcgggctggtgattccaactggctactcgttcaacctcgatggcacgtcgatttacctgaccatggcggcggtgtttatcgctcaggcgaccaacgcccacatggatgtcttccaccagatcacgctgttagtggtgctgctgctctcctccaaaggcgcggcaggggtgaccggcagtggctttatcgtgctggcggctacgctgtcggcggtgggacatctgccggtggccggtctggcgctgattctcggcattgaccgcttcatgtcggaagcccgtgcgctcaccaacctggtgggtaacggtgtggcgactgtggtggtggcgaagtgggtcggccagttggatgaagcgcagatgaaagcgacgctttcttcagcgaaaaagggcaccagaattcggcttttggttggcggatggctgcttgcggcatctggcttcggcgtccacgccgaaacacttcagcctgatcccgcctggcaggaaggcaaactggacaatggtttcagctggcagctgctgaccacaccacaacgtccgagcgatcgcatcgagctgcgcctgatagttaataccggttcgctggtggaaagcgcccagcaaaccgggttcagccatcttttaccgcgtctggcgatggtacataacaccgcgctggataccaatcagcagcgcgcactgtggcaacaggcgatggatccacagcgaccgctgccgccggccatctcgtcttatgatttcactcaatacaatctcagcctgccgaacaaccggccggagctgctgaaagaggcgctcagctggctggcggccaccgccggtaaaatgaccatcaatgagcaggtggtgtcgaccgcgctgaccgccaccgatcccatcgcgacctggccgcccaatacgcaggatgtgtggtggcgctatcgcctgaaagggtcgaccatgctggcgcatgatccgggcgaacagccgcgtgcgccggtggatatcgcgcagcttaatgcgttttaccagcagtggtacacgccggacggcatgacgctgtacgtggtgggcaacgtggatagccgcagcatggcggagcagatcaacaaagcgttctcgccactgcaaggcaaacgggtggcgcccgcggcgctgcccacgctgtcgccgctgccgcatcagccaatcaacctggttaacggcggcatgatacaggatcgcctgtcgctggtgtgggatacgccatggcagccgatccgcgactcgcagaatctgcagcgctactggcagagcgatctggcgcgcgaagcgctgttctggcacgtccagcgcgcgctggccgacagcaaagcgcaaaacgtgcaggtaggcttcgactgtcgcgtgctgtatcagcgtgcgcagtgcgccattaacatggattcgcctaacgcgtcgctggcgcagaacctgaaccaggtggcgcgtgagctggccaccgtgcgtgacaaaggtctgccgcaggaggagtttgatgcactgatggcgcaaaagctgctggaactgaacaaactgtttgctacctacgcgcgcaccgataccgatattctgatggggcaacgtctgcgctcgcagcagaattccgtggtggatatcgcgccggagcagtaccagaaactgcgtcaggcgtttctcagtgagttaacgcgcgaccagctcaaccaggagttgcgccagcagttaacgcaggagctgaccatggtgctgattcagccgcagggcgagcccgaaaccaacgtcaggatgctgcaggacagctgggacaaggtgatgaaggttccggatgcgcccgccgccgccgctaccccggatgaggctaaacccgaaaataatggcagcgcgagcgcgaccgatccggctcaaccctcgtcataa

SEQ ID NO: 99337 - DNA, 1704 bp, Glycine max
  Peptide Sequence Number=SeqID_216115
atgacgcagaaaaccatcgccattattggcgaatgcatgattgagctgtccgaaaaaggtgagaacatcaaacgcggctttggcggcgatacgctgaataccgcggtctatctggcacggcagagcgattccagccagctgcgtgtggagtatgtcaccgcgcttggcaccgacagcttcagcgaccagatgatcgcggcctggcagcaggagcaggtgcacacgcagctggtgcagcgcctgccggacaaaatgcccgggctttacttcatcgaaaccgatgcccacggcgagcgcaccttttggtactggcgcagcgatgctgccgcgcgcttctggctggatagcccgcaggcgggggccatctgtcagcagctggcgcattacgactatctctacctgagcggcatcagcctggcgattctgcctgaggccagccgcgaaaagctgatggcgctgctcagtgcctgccggcaaaacggtggcaccgtgatttttgacaacaattaccggccgcgtctgtgggcggatagcgccagtgcgcagcaggcgtatgcggcgatgctacgccacaccgatatcgcctttctgacgctggatgatgaacacctgctgtggggcgaacagccgctggcggacgtgattgcgcgcacgcgcgccgccggcgtgcaggagattgtgatcaaacgtggtgccgactcctgcctggtggcgcgcggcgacgatccgctgcgggatgttgcggccatcaaactggctccggcacagattgtcgataccaccgctgcaggtgactccttcagcgccggttatctggccgtgcgcctcgcgggtggcagcgtggagcaggccgcaacgcgcggccatctcaccgccagcgcgagtgactcgcgcgctcagccgcagatcgtcgatttggccagagagttcgaaccttacgaccgcgccgccaccggcgtgcgctgcccggagatggcgatctggcatccggaaacctcaaacggtatcaccctgctggtggcaccgggcggcgggtatcagcgcgtgctgatcgaccgcgaaggcagcgccctcgccacctttttcacctcgatgggctacacgctggcggtaatgacctatcgcctgccgtacgacggccatcatgaagggccggatgcgccgctggccgatgcccagcgtgcggtgcgcgtgctgcgcgagcgctcacagcgcggcctgaacggaaagtacatcgtgatgatgggcttttccgccggcgggcacgtggccgccagcctcggcacccgctttggcgaaaaaatctatccgctgcaggatcaggccgacagcctgtcaccgcggcctgatgcgatggtactgctctatccggtcatcagcatgcgcgacggtctggcgcatgaaagttcacgcacccgcctgctgggcgcgtggccggatcagaaaagcattgaggcttattcgctggagacgcgcgtgcacggccagacgccgccgacgctgctgatccacgccgctgacgatgagacggtttccgttaataacagcatggtgttttttagtgccctgcgggagcacaaggtaccggcggaaattcacttttatcagaaaggtggccacggctttgggattcgtggcgtggcggatctgccgctggccagctggccgatgctggtgaccgaatggctgcgcgcaaagacctga

SEQ ID NO: 99338 - DNA, 488 bp, Glycine max
  Peptide Sequence Number=SeqID_216116
atggtgatgaagaatttgagtcatcggctgcctttttctcccgaacttgagcaacaacaggaaacccgtctctactggcagcagtgccaacggtgctacactttccagccgatttaccaggtttctggccgcttactggctattgaactgcttaccgccgtggtgcatcccgccgcacctgagcaaaacgtgtcacccgaagactatttcgaggcgctgaccattgcccagcgtctcgacatcgtccaggagcagcttgaactgttattacagtgggcttccttcttcagccagcgtcagctggtggcctccgtcaatattgatggtcccacgttactggccattcagcagcatgcgcccgtgcgcgcgctgatcgtccagctgccgtgggtgcgcttcgaactgaccgagcaccacgcgctgccgcaggaagagatggtggcgcagatgccggactgggcccgctatggctggatgactttgggtcg

SEQ ID NO: 99339 - DNA, 384 bp, Glycine max
  Peptide Sequence Number=SeqID_216117
atgttggataaatatggagctgtgggaccggcaaaacctacagataagctggatcatgatgttgatgatcccctatatctgaaaccggcgaaacctaccgtgtttggggtgtataatgacaacttccccttgtacataaagcatgaagatctatctgaaatagcacacggtggtcaatgtctcaacatctctgttatacaattgtggattctgcgtatgaccgagacaagtatgcgagcagggaatgccgatgtgtatggattcctcgagctacagtccatacaaaaatctgggcaatcacaatttgaatcagaaagttatattaagaactggatgcagaattcaaggagggatgtgtacctaggagcctacctgaatgagtaa

SEQ ID NO: 99340 - DNA, 240 bp, Glycine max
  Peptide Sequence Number=SeqID_216118
atgcaatcacagggactcgcacttccttctgagcctgaggttggtccttcaactgctcgtgggtccacaaccattcacaatattcctttgctccttgaccaagtcaaggttggtgatgaggagattagagatgcagatgctccggttcctatgcccactgaagaggttaagttagtggagcagacacataacaccttctttgcttggccgagacatcttgtcaagcgtttatcaggatag

SEQ ID NO: 99341 - DNA, 288 bp, Glycine max
  Peptide Sequence Number=SeqID_216119
atggaggtcacttatgatggggaccacagagaaattatcaagctgctagctaccttagaactcaaagttgaagaatgtattcaaaaggtgaagattagcaaaactggaggtgctgcctctggaaacaaaaaagcaggatgtgaacgaaatgctttgctcaacactttttgggagtggaaatttaggtgggaaaaacaaatagtggtttgcaacagtggaaatttgatgcttgtagcaggatctctacaagtggaaatttgcaacagtggtctgcaacttccagcctag

SEQ ID NO: 99342 - DNA, 420 bp, Glycine max
  Peptide Sequence Number=SeqID_216120
atgttggcactccaactggggtggatattagcattttccatatatatgttcatgccagagaacgccaccacctacggaggaaacctcgagtttggatgcctcgagagaaacctctcagttaggatcatgtctccttcttgctttgtcaccatgttaccacgcttgtactgtagatccactttgcctctaacatgtgagggtgtcagaatattgtttgccaagggacggctcttactatatgggatggaggacgactgcccactgtccctcaagtgctatggtgcaagcactttagtcatgagttggctttccaaggagggatgcgtccctctagttctaaggatgttaagacgtaaacacttaagtcatgaatcaacctctaaggagagagagattgacgataatgttttgtacttttaa

SEQ ID NO: 99343 - DNA, 147 bp, Glycine max
  Peptide Sequence Number=SeqID_216121
atggggaacaacttccactgtgccgagcaccctcaggtgcttcgcaaggtcccttgcaaaggcattgaaggaatcgtcgtaggactagctcccgatgccgaagatgatgaagcggtagtgggagaggaggagggagtcggcgagtga

SEQ ID NO: 99344 - DNA, 288 bp, Glycine max
  Peptide Sequence Number=SeqID_216122
atgacatttatcaatcaatcaaaatactacaaggagttgctaaaaatatttggaatggacattggaaaggaaattgctactcccacgagcactgcttgttacttggacaaggatgaaggaggcaagtcagttgacatcaagaaatatagaggtttatggtatcctaagggcacctcatatagtttaatatggcatcctaattataattctgattttgctgggtgcaaaattgatagaaaaattactagtggaacatgtcactggattggatctacattagtttcttga

SEQ ID NO: 99345 - DNA, 276 bp, Glycine max
  Peptide Sequence Number=SeqID_216123
atgacccgcttacaaccttatttcaaggaagagaagttaagaaatgcaactacaagtgatcaagtaacagaagaagtggtgcttgaagttgtcaaagtttctgaagaggagtttcataaaatcgaggtggatgctagaatccaattagttttggaaacaagtgttgagatcttttctgtagtttatgttgaaagagacataaagctccaacgaactattgttcaagagaaaataaatgaggaagaaatggaagctctagttgctgcaatactttag

SEQ ID NO: 99346 - DNA, 666 bp, Glycine max
  Peptide Sequence Number=SeqID_216124
atgaggaagaggatagacgagcgaatcagaactctcatagagaatggcgtcaaaacaaggcataggtccatgtttgtcatcattggcgacaagtctcttgatcagattgtaaatcttcattacatgcttagcaaggcacagatgaaatccaagccaactatgttatggtgttacaaccacaagcttcaactaagcagtaaaaaggaaaagcgtcataggcagattcaaaaattgaggctgaggggtcttttggatcacgaaaaagttgatgcattttctttgtttatggaaactaaagatataacttactgtttatataaggattcggaaaaaattcttggtaatacttttggaatgtgtatacttcaggattttgagacattgacacctaatctcctagcaagaaccatagagacagtggagggaggagggttgattgttctgctgcttggttctctatcttccctgaccagtctgtacaccatggtcatggatgtccataaaagatttcgaaccgaatcacactctgaggcagctgggcgctttaatgaacgcttcctattatcaattgcttcgtgcaaggcatgtttggtcatggatgatgagatgaacatattaccaatttcatctcacataagatctattacgccagttcttgtaaatgag

SEQ ID NO: 99347 - DNA, 2412 bp, Glycine max
  Peptide Sequence Number=SeqID_216125
gacgctgagggactctcaaaagcaaaacagggcctgaagaagcttaaagaacaactgagtgaaaattaccttgttggattgattaggaagtgttgcacattggaccagggtcatgctgttgttacatttctggatgcaattttgagcaaaacacttcgtggtaccgttgccttgttggctggtcgtggctgtgggaaatcagctgcccttggtttatctattgctggtgctatcgctgccgggtattcaaatatctttgtaactgcacccagccctgataatttgaaaaccttgtttgaatttatactcaaaggttttgaggcacttgactacaaggagcatattaatgtggtgaaaagtgggaagaatacgtatatactgccacacgagcatgaaaagctttcactagctgaactgttggttgttgatgaagctgctgctattccactgtcgatggtgaagtctttacttggaccatatctggtcttcctctcttctactgttaatggttacgaaggtactggacactctttaacactaaaacttttgcatcaattggaagcgcaaagcaatacattttccaagagcacagagggcactgattcaggttatctgtttaagaaaatagaactgagtgaatccatcagatatgcttctggggatcccattgaaagctggcttaacaaattactttgcttagatgtttcaaatgccatccctaatcttagcagcaggttcctccctccatgtagtgagtgtgatctatactatgttaatagggatactctcttttcctatcacagagatagtgaattatttttgcagcgaatgatggccttatatgttgcatcagattacaagaattctccaaatgatatacaactgatggcagatgctccagcacaccacttatttgtgctacttggacctgttgatgaatcaaagaatcaacttcctgatattttgtgtgtgatccaggttagccttgaagggcaaatatctcgtcagtcagtaaaacaaagtttgagcaatggtcatataccttctggagatcaaataccatggaaattctgtgagcaataccaagacacagtttttccttcactttcgggcgctcgcattgttcgcattgctacacaccctgatgacatgaagcatggatatggttcgcaagcagttgagcttttaatacgctactatgaaggtcgacttactcctatctctgggattgacgttgatgatgaagtgcagacttcgcaaattagggttactgaagctgcagaaaaagtttcactacttgaagaaaatataaaaccaagaaaagaacttcctcatttgctagtacatctgcgtgaaaggcgcccagagaagctccattacattggcgtctcctttgggctaaccttggacctttttcgcttttggaggaagctcaaatttgctcctttctacattagccagattccaaatactgtgactggtgagcattctattatggtcctgaaacccctaaacaatgatgaaattaaagttgatggatcaaatcagtggggctttgtcagcccattttaccaagattttaggcaaagattttttagacttctagcttccaattttcgtggcatggaattcaagcttgctatgagcatcctggatccaaaaatcaattttgaagagcaagatccttcaaagactgcttctcataaatttatggggtcagtcagggaatatttatcaccacatgatatgaagcgactaaaggcttatgtttccaattttgctgactttaaccttcacctgattttggatttagttcccatccttgcacgtctctactttgaagaaaagcttcccgttaaattgtcatatgttcaagcttctgtgttactctgcattggcctgcaaaatcacaacattttgtacattgagggacaaatgaagttggaaaggcaacagctattgtctgaatttaggaggataatgaagttgttctacaattatctaaatggccttgcatccaaggagattgaatctaccttgccccgaatgaaagaaatcgtcatggaacctcatagtgtgtctgtggatgatgacctcaataatgctgctaaacaagttgaggatggcatgaagttaaaagcagaagcacccgttactcctgaattgctccagcgatatgcgattgtggaaggagaatctgacttggagacagttttacaaaacaacagaggaaaaatacccattggtggtcttatcagtgtaaaatccagtagtaagcctgagatgatgaagagaagtcgaaagaatgataaaaaacggacaagatttttttggtcacacaaccattttttttggtggaattgctcatacaaccataagctaagcaaaaggagaagaaccatacaagattga

SEQ ID NO: 99348 - DNA, 189 bp, Glycine max
  Peptide Sequence Number=SeqID_216126
atgtatcgattaccagcaacgaaactcttgaaattcaaattcaaaacccttttcaacagctatttctcaaccttcccttttgaagcaaacatctcaagactagaaaacatctatggagttgatagaggactatccaagaaggaagagtttggcttgggtgggctcaacatagatggaccaatcacttga

SEQ ID NO: 99349 - DNA, 276 bp, Glycine max
  Peptide Sequence Number=SeqID_216127
atgaagactcaacagcttggttgttgcccgcaagacctcaacctcaaacccaacttgaacgagtggttatttcagacaaaaatgtcagactctatcttggtttcagaggatacagactatttgagggctccattggagcttgtaggcctaggatcttcttcatcaatggattcctttgcttcttggaagatgaatgacagcggaatggagaaggaagagagagaggagacgccacttcaaggaaaagatgagtctagaagaagctcaccaccatag

SEQ ID NO: 99350 - DNA, 1488 bp, Glycine max
  Peptide Sequence Number=SeqID_216128
atggtgggtgagtttagtgttcctgaagaaggagacccaacattggaaaagtacaaatttcattggctgtatgcaaatggattgctgggtattatattcacctttggccttctctacacttctttaaaaagcagaagagcaaggtcatggttatatgggacagggtggttcagaagtttcattgcagattatggagtgcctttcatggtggtggtgtggacagctctgtcattcacagtaccaagaaaagtgccttctggagttccaagaaggctcacttctcctcttgcttgggaatccacatctttacatcattggacagtaatcaaaaatatgggggaggtttctccggcatatgtttttgctgcttttattcccgctttaatgatagcagggctttacttctttgaccatagtgttgcttcccagatggcacaacagaaggaattcaatctcaggaaaccctctgcttaccactatgatatattgttgctagcattaacgacattgctttgtggattaattggcttacccccttcaaatggagttctgcctcaatcccctatgcacagcaagagcctggctgttctcaagaaacagttgatccgaagaaagatggttaaaagtgccaaggaaagcataaggcagaaagctagcaagtctgaaatctatgggaagatgcaagcagtgttcatggaaatggataactgtccagataatcattcagtggtcaaagaactagaggatttgaaagatgttgttctaaacggtgaagacaaaggactcaacaataagagtacctttgatcctgagaaaaacattgatgcatatttgcctgtcagagtaaaagagcagagagtgagcaatcttttacaatcactcctagtaggagcatcagtctttgctatgcctgccataaaaaagataccaacttcagttctgtggggatattttgcttacatggccattgatagtcttccaggaaatcaattctgggaaaggatcctatttctttttgtaacacctaataggtggtacaagttgctggagggggatcatgcttcctttattgagtcggtaccttacaaatacatagtcttcttcacactcttccaatgtatatatttcttggtttgttttggagtgacatggattcccatagctggaatactgttccccttgcctttctttttgctgatcacattgaggcagcatatactccccaagctgttcaagcctcaccatcttagggaactagatgcggctgaatatgaagaaatagttggtgctccagcattaagtttcaataaatctttcagggaagtggaatcaccccgagttggatcaaaggaaataggcaatgctgaaatattagatgagttaactactaatagaggggagttgaaggtcagaactgtcagctttggggaagaaagaaatgaccaggtttaccctgatgaaaatggatcgccactcacagatttttag

SEQ ID NO: 99351 - DNA, 231 bp, Glycine max
  Peptide Sequence Number=SeqID_216129
atggaaagcttaaaaaaacctttcaagggtgttataaacgatcttcgaggaagagctgggtactataaagatgattggacttccggtttctattcaggaactgggatattggccccaactacctatattttctttgcttcttctcttcctgtaattgcctttggcgagcagctaagtagagacacagcacaagctttttgcacttgtggcatattccctacagaaatgtga

SEQ ID NO: 99352 - DNA, 276 bp, Glycine max
  Peptide Sequence Number=SeqID_216130
atggaggggatacaggatagggcttttgaagagttgtggaagctaaaggtgccaatcaaatttgctgtattcgcttggaggctccttagagataggttgcctactaaaaaacatggaagaggaaacaggacacttgtgttttcattgcatgaaaatcatccctatttggtgggaaacgtcatcatgggtgaacaccactggagcttttctgaaagatccaaggcagcacttcctccaacatggtatgataatggtggatgggataagatcgactag

SEQ ID NO: 99353 - DNA, 170 bp, Glycine max
  Peptide Sequence Number=SeqID_216131
atgggatcgagtcaggcgcctgggctcaaaaagaggttctatcaggtcaagatcaagagcctaggagtcgccagtctgaaaaagtgcttcaccattggggactttcagttaacacccacggcggaagaatttgaagagatcctgggatgccctctgggaggaaggaaacc

SEQ ID NO: 99354 - DNA, 333 bp, Glycine max
  Peptide Sequence Number=SeqID_216132
atggcagaacccgatcccaatgatgtggtttccacaccaattttatctactctgcaaaccgatgagcctgatcctgatgatcaagagtttcagaggataaatgacaccacgactgctgtttgtaaccgtttgtctgaggctctggaaatgctaagaagtgaagttagtgcaatgcaagctacttcaatcctccaaactctcctaaaaataatcaggaatgtgattgaacaccctgaggtggaaaaatacaagagattacggaaggctaatccagtcattgagaggaatattgtaaataataaaggtttgcatcttctgaccattgggttttaa

SEQ ID NO: 99355 - DNA, 192 bp, Glycine max
  Peptide Sequence Number=SeqID_216133
atgggtcattgtcacactaaaaactgttatcctttaaatcagttctcccttctatgcttctatcaaagcgaagatgttatgtttgacaatcttggaaaggaaaatgcttacttggtgttgaaacggaatgatcctggcttattgtggcttgctaaggcaacccttgaatcaagcacaagcttaacttgctag

SEQ ID NO: 99356 - DNA, 284 bp, Glycine max
  Peptide Sequence Number=SeqID_216134
gtgaagactcatggtcgttggtaagcacccatctgcttaaagaacttgagaaattctcatatgagtatatgaagctctttggtggcaaggagagatttgaggaattaaggatgtcactacttgttgatggattaaccaaggtgacaacggataagtggatggatataactgacatgggatatgtcatttcatcaaggtataatgtttatttaaaagaccgttgtcctttaccgcctgcagcattgttatggtctaccaattgtcatcctcaggtgaagcagtga

SEQ ID NO: 99357 - DNA, 966 bp, Glycine max
  Peptide Sequence Number=SeqID_216135
atgaaagagtacgattacattgtggtgggcggcgggagcgcgggctgtatcgttgccgcgcgcctggtcagcgaaggaaatgcacgcgtgctgctgctggaggccgggcgcgacgaataccatccagtgctgaaaatgcccgccggctatatgaagtttctcgccagcgaccgttttctgacgatgcatcaaaccgaagcgcagccgcagctcaacggacgcggcgtgatcgtgccgcaggccaaagtgctgggcggcggttcgactgtcaacgccatggtctacatgcgcggccataaacaggattacgccgactggaaccaggcgctgggccatcagggcatcgactggtcgtgggaggcgctgctgccgcactttaccgccatcgaagataacgatcacctcggcgcacccaatcacggcgttggcggcccgatgaaagtgtcgcatctcggccacttcagtccgctgagccgcgcctatgtcaaaaccctgcaggggctgggtattccctacacgccggattttaacagcggcaatccgtctggcgtcggcttcatgcagcacaccattgacggtcagacacgacagcgctgcagcgtggtcgatgcgtttatcaacccgctgcgccatgacgcacggctgacgctggtcaccggtgcgcaggttgaagaggtgctgtttgacggcacctgcgccagcggcgtgcgctatcgtcaggatggccagccgcaacaggcgcgcgccagccgcgaagtgattctggccgccggtgcctatcagacgccaaaactgttgatgctctccggcatcggtccgcaggaacagctgaaacaacacggtattaccgtgcgccatgccttgccgggcttgggtaaaaacctgcaggaccattacgaagtaccggtggttgccagcacgcgcggtgcgtttggctactacggccaggatcgcggctggccgatg

SEQ ID NO: 99358 - DNA, 300 bp, Glycine max
  Peptide Sequence Number=SeqID_216136
atggtccatgacatcttggtcaaagtgaaactggaagtaacagggacatcaacaatcctaaatgtgtttggcagtagacggagcagcgatgtttatgatcccaacatgaggaaaatgcaaggatcatgcatgagtaaacatgaaaataaaaggtatgcaaaaagcatgtgctccatgtgtgcagttaagaaggtgatatggaccttccagcttcccgtgaaaaaagacgagaccaacatacaacgcatgcgtgacgacatgatgcagatgcgcaaaagtggaacagggggatgtacatag

SEQ ID NO: 99359 - DNA, 201 bp, Glycine max
  Peptide Sequence Number=SeqID_216137
atggaacaattgttagtgctaatggatgatggttatgtgccatgggagacgttcaaaggcgtattcttgtcaaaatatcttcccactgatttgtgcaagcagaagcataaggtatttttggacctcaagcaaagagggatgtttgtgggcgagtataccaccaagttcaatgagttgctgaagtattggcctcaatactag

SEQ ID NO: 99360 - DNA, 1949 bp, Glycine max
  Peptide Sequence Number=SeqID_216138
gcgtggtggagcaggtgggcacgccggtggaggtgtatgagcgtccggccagtcagtttgttgcgtcgttcattggtgcgccggcgatgaacctgctacccggtcagatcaatagcgatggctcgcgctttacgctcgacgcgctcaacagcctgccgctcggcgccggcaaagcgcgatgggccaaccgtccgctgacgctcggcattcgtcccgagcatattcagctcagcagccgtgaggccggcggtgtgccgctggtggtggatacgctggagatcctcggcgcggacaatcttgcgcatggccacattggcaacacgcggctggtgcctgtggctacaactgccgccagatgcgttacacttcttcgattctacccatggaaagcgtctggaatgagtgtaaaaaactggccctatccgcacattgttgcgcatcgcggcggcggcaagctggccccggaaaacaccctggcggcgattgatgttggcgcgcactacggtcataccatgatcgaattcgacgctaaactgtcacaggataagcagattttcctgctgcacgatgacacgctggaccgcaccagcaacggctggggcgtggcgggcgatctgccgtggcagcagctggcgcagctggatgccggcagctggtttagccgtgaatttgacggtgaaccgctggcattgctgagcgaggtggccgcgcgctgccgccagcatcagatgatggccaacattgagatcaaacccagcagcggtaccgaggtggaaaccggacgtgatgtggcgctggccgcccgaacgctgtggcagggacaaacggcaccgctaatgtcctcgttctcgtacgcggcgctggaagcggcgatgcaggccgcgccggagctgccgcgcggcctgctgctggatgagtggcacgacgactggcaggcgctgaccgccgcgctcgactgcgtctccatccatttaaatcatcgcttgctggacgccagacgcaccgccgcgcttaaagccgccggtctgcgtattctggtgtataccgtgaatcagcccgcgcgggcgcgcgagctgctgagctggggcgtggatgccatctgtaccgatcgcattgatgctatcggcccggacttcccttgcgctgcatctcctgattttgctgctgctgatcctgacgcaactgctgctgctgttgctgctgctggacctgcatgcgcgtctgcatgcgctgctggctcgggttatagccggcatgttcgccatgccgctcagcggcatcagtgccgcgataacaatcagccattttttcatggtgttcctccatcagtgcggcctgctgatgaggataaagagcggtgtgcgccagttcggctgggcgctgttaatgagttttaccgtggtgcagggggcgcaggcggcgccggccagcgccccgccgtggacgcgatggccacccgggtgggcgtggatattctcaaacagggcggcaacgcggttgatgcggcgattgcggtgggctttgcgctggcggtcactcacccgcaggcgggcaacctgggcggtggcggctttatgctgctgcgcaccgctgccggccgcaccaccgccattgatttccgcgagatggcgccggcgcgtgcctcgcgcgatatgttcctggataagcagggcaacgcggatagtaagttatcactcacttctcatctggcttccggcacgccgggcaccgtagccggttttgccctggcagcgcaaaagtacggcacgctgccgctcagcacgctgctggcgccggcgatcaaactggcgcgcgacggcatcatcgttaacgatgcgctggctgacgatctcgctacctacggtaaagagaacctgatcaaccacgacaacagtcgcgccattttctacaaagccgacggtcagccgtaccagaagggcgatcgcctg

SEQ ID NO: 99361 - DNA, 468 bp, Glycine max
  Peptide Sequence Number=SeqID_216139
cgagcccgttgagacgcagagactaacatcatcttctgcacctttgtcatccagagacggcgagtctgatgacattcgagagtaccttgtggttatccgcaccttttgtcaaccagaggcaagcgagcccgttgacacgcagagactaacatccgagtccgatgacatgcgggggtaccttgtggttatccgcaccttttgtcaactagaggcaagtgagcctattgacatgcagagactaacgtcgccttctgcacctttgtcatccagagacggtgagtccgatgacatgtgggggggtgcaaatagcaacaaggcccacttgggccttcttgagggttccaaaagaaggcagtgccttctagtggaagcaacccagctcgcctgggcaagcagggcggcaaccacctccctcttttctcctataaataggggaaggagggcagagcaaatggttcagcccttctg

SEQ ID NO: 99362 - DNA, 1197 bp, Glycine max
  Peptide Sequence Number=SeqID_216140
ggcgccgagactattgatatagcctttgcgcgcgtcaccgttgagcagtgcccacagctttctcgcgccgcgatccgccagcgtgcaggcgggattgacggagccgcgcaggttaatgacctcttcggcactgtaaggacggcagtatctccagagtcagggcagcaggcggtagcccggcagggtgaggaaaggaaccagttgttcgtcggtggtgatttgcgccatcagcgcagccgcatcttcatagcgaccggcgtcaaagcgcgtgtcacccaggctgtggcgcagggccgccagctcttcatcaagaaactgttcgaacagcgcggcggtcaccagctgaccatcgctgaggatttgcttgtggtgaatccactgccagatggaggtgcgggcaatctccgcggtagcggcatcctccatcagcccatcaataggcacgcagccattgccgctgatccacgcttccagatattgcagcgcaacgcggatgttggcgcgcatcccggcttcggtgcgctgaccacggcacgggcgcagcaggcgctcggcggtgatcggcgtatcctgttcacgactgacgtgcagctgattggggcgatcgcccagctgacggtcaaactccgccatggcgatatccgccaggccgggatgggcgacccaggtaccgtcatggccgttgcccgcttcccgtgctttgtcctcctgcactttctgcatcacccaggcgttgcgttcagcgtctttggccgggatgagcgccgacatgccgcccatcgccagcgcaccgcgccggtggcaggttttgatcagcaggcgcgaataagcctcgaggaacggctggtccatgctgatctgctgacgatccggcagaatgcggtcaccatgctggcccagcgttttgatgtagctgaagatgtaatcccagcgaccacagttgaggccaaccacgtgatcgcgcagttcccacaggatctcatccatctggaataccgcgggcagcgtctcgatcagtaccgtggctttgatagtgccgcgcggcagatcgaaacgatcttcactgaaacggaagatttcccgccaccatgccacttccgccgcatgctcggttttcggcagatagaaccacggagcgtggcccttctccagcagcgcggtgacgttgtgaaacagatagagcgcaaagtcgaataa

SEQ ID NO: 99363 - DNA, 204 bp, Glycine max
  Peptide Sequence Number=SeqID_216141
atggtgcagtggtggtttgggcgagcatatctgatgaaagtggtggtttggacgaacaaatatggtgaatgggaagttggtggtggcccgggggtggttttggagagtcgatctggtgaagaggaggctagtggtgctgcggttgtggtttgggtgagcaaatctgatgaacaggaggctggtggtggtgtagtggtagtttag

SEQ ID NO: 99364 - DNA, 186 bp, Glycine max
  Peptide Sequence Number=SeqID_216142
atgaagatcgaatgctgggaatgtgaaatgtcgttgaaatttggtgtggaactaaaggatacaactttgtctaagttaatcactactggaagagaggaagttggttgcagtaccttcctatgcagggttgttattgcacttgttgttgtaggcaaggaggaaaagattgtagaagagaaggagtaa

SEQ ID NO: 99365 - DNA, 234 bp, Glycine max
  Peptide Sequence Number=SeqID_216143
atgacggaagggtgtggtgaagggttttgccttgcaaaccttcccggtgatgcttttagtctatgggggaacttctttgaggcaaagaaacaaatgatggctgatgccaaggtcggcggtgctgggttatggccccgtgctaagtttcggattggttggccccccccctccccccccgagaacagttttgttgccaggattttggccaactttggcttgcgccccgttggctaa

SEQ ID NO: 99366 - DNA, 315 bp, Glycine max
  Peptide Sequence Number=SeqID_216144
atgaatcgcatgaagacagtacaagtggaggttttcaatcccttctccgtctctctgacgtttgggaactctatcggagcagtcggaagaataactgaaggaatctcagggaaccgggttggacctgaatcaaaagggaaaggctttgacggactcttcggagcattctcgcaaaacagcgtgaccctgactggtcatcctatgattttacttagtgagaatgacctgacatacccattttgtggtgtgtcttgttatgtactcctatgcgccccaaggtggtttttcactgacatggtaccacattgcatatag

SEQ ID NO: 99367 - DNA, 534 bp, Glycine max
  Peptide Sequence Number=SeqID_216145
atggccggtttttcaccaccaggccagcgcgttatgctggttttttcagcgatcgatgctggcttactccacaatcctggcaaagtaagggttatgaagctcactattcagcgcatcagcacgctgacgccgcaggatcgactggacttagccaaagtctggccgcagcaggatatcgcgcagctggaagccagcctcagtgaagcgcagcggctgtatgcagcgcgctttaacgatcgcctgctcggcgcgctgcggctggagattcgcggcacgctgggcaagattacgcagctggaagtgcgtgaagtcacgcggcggcgcggcgtagggcagtatctgctggaagagacaatagcgcagaacagcgcgctggatcactggtgggttgccgatgacggcgaagacgatcagcgcgtacgcgcggcgtttatgcaggcgtgtggtttccgcgcgcagagcgacggagcggtgcgcatggatgcgcgccctacggggattgcgaacgagcgtacagattgcgtggggtcgtga

SEQ ID NO: 99368 - DNA, 600 bp, Glycine max
  Peptide Sequence Number=SeqID_216146
atgagtaaatccccccgcaacagcggcgcggcaggccagattcgcctgattggcggacagtggcgcggccgcaaattgccggtgccggacagcgccggcctgcgcccgaccaccgatcgcgtgcgtgaaacgctattcaactggctggcgccggatatccagcaggcgcgctgcctcgattgctatgccggcagcggcgcgctgggcttagaagcgctgtcgcgctatgccgcctccgcgaccctgctggaactggaacgtcacgtggcgcagcagctgacgcaaaacctgcacacgctgcgcgccagcaacgccagcgtcatccagaccaatacgctgcagtggctaagccagcccggcgagccgttcgacgtggtgtttgttgatcccccgttccgcaaaggcctgctgcaggagacgctaacgctgctggagaataatggctggctcgccgcccacgcgctgatttatgttgagagcgaagtggagcacggcaccccgctggcaccggctaactgggatctgtatcgcgagaagattgccggtcaggtggcctatcgcctctatcaacgccaacaggagaccgatgatgtggcttaa

SEQ ID NO: 99369 - DNA, 2803 bp, Glycine max
  Peptide Sequence Number=SeqID_216147
atggcaaaagagaaaaaacgcggctttttttcctggctgggctttggcaaagaagagcagcagccagcggaagagcaggcgcagcagcagccgaccgatcaaccggcacccgccgctgaagagagcgcgttagcaagcgccgaagcgcaggccgccgaaaccgtgatcgtcactgaacaggtggcagaacagcaggccgaatcgtcggttcacgccgacgctgaaacgcatcccgttgcggaagcagaaaccgcagccgaatccgacgctaacgctgatgacgcagaaaccgctgtcgtcagcgcgattgaagaagaggtactgccggaagatcatccgcagccggagctgatgccggttgaggaggaaccgcaggctgaagaactgattattgaagcaccggttttatctgaggcgcctcagccagaggacgcagacgcaccgctgagcgatgaagagctggaagcgctggcgttagcggaaacctatgccgaagacgcggcagaagagcttgtggcgacagacaccgtgagcgatctgccgctggcggccgcgccgattgtggctcaggagcaggagcgccccaccaaagagggcttctttgcccgcctgaaacgcagcctggtcaaaacgcgtgaaaacctcggatccggctttatcagcctgttccgcggcaaaaaaatcgatgacgagctgtttgaagagctggaagagcagctgctgatcgccgatgtcggcgtggaagccacgcgccgcatcatcaccagcctgacgcaacaggccagccgtaagcagctgcgcgatgccgaagcgctgtatggcctgctgaaggctgaaatggccggcattctggaaaaggtcgatgccccgctggacgtggcgggcaaaacgccgttcgttatcctgatggtcggcgttaacggcgtgggtaaaaccaccaccatcggtaagctggcgcgtcagtatcaggcgcagggcaagtccgtcatgctggcggcgggtgaccccttccgcgcggcggcggtagagcagctgcaggtctggggccagcgcaacaatattccggtggtcgcgcagcatacgggcgcggattgtgcgtcggttatttttgacgccatccaggcggcgaaatcgcgccacgttgacgtgctgatcgccgataccgccggccgcctgcagaacaaagcgcacctgatggaagagctgaaaaaaatcacccgcgtgatgaagaagctggacgaagaggcaccgcatgaggtgatgctgacgattgacgccagcaccggccagaacgccatcagccaggcgaagctgttccacgaagcggtcggcctgaccggcatcaccctgaccaagctcgacggcaccgcaaaaggtggcgtgatcttctcggtggccgatcagtttggcattccgattcgttatatcggtgtcggggaaggcatcgaagatttacggccgtttaaggccgccgactttattgaggcacttaaggcttatctgggaggacgccaggcgctgcagggcgtggatttccatttgcgtcccggtgagatggcgtttctgaccggccactcaggcgcggggaaaagtaccttactgaagctgatttgtggcattgagcgcccgagcgccgggcaaatctggttcagcggtcacgatatttcccggctgcgtcacagcgaagtgcctttcctgcgccgccagatcggcatgattttccaggatcaccacttgctgatggatcgttcggtctacgacaacgtggcgatcccgctgattatttccggcgccagcggcgaggatattcgccgtcgcgtgtcggcggcgctggacaaagtcggcctgctcgacaaagcaaaaagttatccgattcagctctctggcggtgaacagcagcgcgtcggcattgcccgcgcggtagtgaataaaccggccgtgctgctggcggatgaaccgaccggtaacctcgataacgcgctgtcggaagatattttgcgcctggacgtctgcacggaggccacgatggtcaataaacgtaacaagcgtccggctgcgccgaaagcggcgaagcagccgtcaaagagcaaagcgctgaagggcggctggcaggagcagtggcgctacgcgtggcgcggtacgctgtccgacatgtatcgtcagccgctggcgacgctgctgacggtaatggtgatcgcgatttcgctgacgctgcccagcgtgtgctacatggtgtggaaaaacgtcagccaggctgccgcacagtggtacccggcgccgcagctgacggtttacctcgacaaagcgctggatgacacggcggcagagaacgtgaccgccgagctgaaaaagctcgatggcgtggacaaggtgaactacctgacgcgtgaagaggcgcaaagcgagttccgcaactggtccggctttggtggtgcgatggatatgctggagcagaacccgctgccggcggtggcgatcatcacgccgaagctgaacttccagaactccgataccatggccaatctgcgcgatcgtgtggcgaaagtgcagggcgtggatgaagtgcgcatggatgacagctggtttgcgcgtttagccgcgctcaccgggctggtggggcaggtggcgtcaatgatcggcctgctgatggtggtggcggtgttcctggtgattggcaacagcgtgcgtctgagcatttttgcccggcgcgacaccatcaaccggtgcggtgctgtcgctgattctgtcggaagtgctggtgctgcgcctgcagtcggtggtggcgcagtcgcttccgtcttcg

SEQ ID NO: 99370 - DNA, 640 bp, Glycine max
  Peptide Sequence Number=SeqID_216148
atgagcaaaccaccgctaatcttttttatcgtcctggctgtaattgccatcctggcaacccgtcagtttatcaagcagcgccgcgaagccgcagtcaacgacgcttcaccggtgcgctcaatgagtgtggaagtgaaaaccaagcgagagtttccggcccccaatcgccgttcgcgtcagcgcgaagagattgtggcggaagagatgaaatatgaagcctggttccatccgctgaacggcgccggtgattttaaggtcaacgtcagcgccagcgattatcaccagatggacaaaggcgtgaagggcgagctgaaaatgcagggcacgcgctttctcaaatacaccaaagaagaagattttcgcctgcgtggcgcggctcagctttggcgcttccttcggctgcgtggcacgcagcagcaccaactgcaggccgtgcatcaccaccataaagaacagcgcaacgtggacaaagtagcgcagcggcgtcgggaagggatgcaccaggcgataggccacctgaccggcaatcttctcgcgatacaggtcccagttagccggtgccagcggggtgccgtgttccacttcgctctcaacataaatcagcgcattggcggcgagccagccattgttctccagcagc

SEQ ID NO: 99371 - DNA, 417 bp, Glycine max
  Peptide Sequence Number=SeqID_216149
agccggcgtggtaacgccctgttcgatagccggtcgtatatcgctgtgcgcctccaccagcagattgtcactggcgaatatcacccgcgcgctggcgacctgcggcagcttttgcacggcggtttcgattttgcgggcgcagctcgggcagtccatgccggcaatctgccagcggaactgataggacgcggatgcgcgcctgtcactgtcggcgtcgccgccgccgggactgtcgtcatcgctggcgcagcagccgcaatcgctggacgcggccaccggttgcgcggcggaaatcttcagggatgcaggctgaacgctgcgtaccgcgcacagcggttttggctgacgaagcgggccgatgcccgcagtctgcatgctacactctggagtggactccagagtcaagcggtgaggtaa

SEQ ID NO: 99372 - DNA, 684 bp, Glycine max
  Peptide Sequence Number=SeqID_216150
atggatctcattgaaaatatggctgcaagtgacattgctattttgagagatagagctcacattcctactaaaaagagtttattggagctaacttcccaagatgcattgttggcacaaaataagttgttgtctaagaaacttgaggcattgactgaaacactaagatgtaccatctatgggggagctcatgaatctggatgttgtatccctattgaagaacaacccactcatgaagtcaattacatgggaaatcaacccgtaaacaattttaatgcaggaggattttctggattccaacatggccaacaatacaatcaacaacagggacaatggaggaaccaccctggaaatcaattcaatagagatcaaggtggaccatccacaaggctacagcaactagggcctagtatctatgatcacacaacaaagctggaagagactctagctcagttcatgcaggtttctatgtctaaccagaagagcatagagtttgccataaagaatctggaggtccaagtgggacagcttgcaaagcaattggcggatagatcatcaagcagttttatagctaatacagagaaaaatcccatggaggagtgtaaagctatgatgactagaagcaaaaaggcaatccatgtggatgaaagtgaagctgagaagaagatggaggaacataaaaaatag

SEQ ID NO: 99373 - DNA, 1254 bp, Glycine max
  Peptide Sequence Number=SeqID_216151
atgaagcatccatcaaagccatggaagccattaaccacaaactgctgcacaattcaaaaccaaactatctttggcaatctcaagccctcaagttcagatatatccaatgatattgcacaattaccaaattcatttcattggatgtctttctctgatcttggtcatttttcgtccataagatcaaatgaagatcaaattgcaaagtcgtttgcttcggatttatatgattttcagctcagtgacctgcgtgccattactcagaatttctcgaacagtttctggcagggtgaaggagggtttggaacagttcataagggctatatagatgctaacctgagaccgggtttgaaagctcaacctgttgctgttaagattctcaacgttcaaggtttacaaggacaccgtgagtggcttgcagaagtgatatttctcgggcagctaagacacaaaaatttggtcaagttgattggatattgttacgaggacgaagaaaggctacttatctacgaatttatgccaaggggaagcttggagaatcacttgttcagaagaaaaacatcactgccttgggcaacaagattaaaaattacaataggtgcagctaaaggtcttgccttcttgcatgcagctaagaatccagtcattttccgagacttcaagacttccaatatcttgcttgattcagatttcacagccaaactttcggattttggacttgcaagattggtgtcagagggatcaaagtcacatgttacaaccagagtttggggcaactatggctacgcagccccagaatacatctccaaggggcacttgacaacaaaaagtgatgtctatagcttcggggttgttctgatagaactgctgacaggaaggagagcaatagacaaaaaaagaccaaagactgagcaaaacctcgtggattggtcaaaaccttacttgagcaatagcaagaggttgaggtgcattatggatccaaggcttgttggccaatattctgttaagggtgcaaaggagatggcccttttggcattgcagtgcacaagtttgaatcccaaagacaggccaagaatacaaactgctgttgaaactcttgaaaacttgcaaaagtttaaggacatggcagttacatatggacactggcctcaatgtgctagaaatggagcatcaaataaggtgaaaattgatcttagagctggtggtaaccacaagaggctttctcctctggtttcaggcagaacaacttggttttag

SEQ ID NO: 99374 - DNA, 771 bp, Glycine max
  Peptide Sequence Number=SeqID_216152
atgaggggcactgtgcatgagcctcaaggtggacccttgggtactagtaccctcgccatcagaggactacacgtcctcgccatcagaggactccacgtcctcgccttcagaggactgcacgtcctcaccttcagaggactaaacatcctcatcttcagaggactacacatgctcatattcaaaggactacacatcctcaccttcagagggctacacatcctcacctctagagggctacacgccctcaccttcagaggactaaacatcctcaccttcagagggctacacgctctctcctttagaggactacatgtcctcgccttcgccttcgtagggctacacgccctcaccttcataggactgcacgtcctcaccttcagaggactaaatatccctatcttcagaggactacacatccacatcttcagaggactgcacatcctcacctccagaggactaaacgtcctcaccttcaaagggctacacgctctctccttcagaggactacacgtcctcaccgttggagggctacacgccctcacctttagaggacagcacgtcctcgccttcagagggtcatataccttcaccttcagaggacaacacgtcctcggctctagaggactcctatcctcgcctttagaggactacacgtcctcaccttcagagggcttcacgtccacgccttcagaggactacacgtactcgccatcagagggctgcacgccctcaccttcaaaggactgcacgtcctcaccttcagaggactaa

SEQ ID NO: 99375 - DNA, 373 bp, Glycine max
  Peptide Sequence Number=SeqID_216153
atgggaacaaatcacactggaaaaagattctatcaagtcaagattaagggcctagatgtcaccagccttaaggagttggggcggttgatgggacctctccagatgcaagccttccgcaaggcgtacggaaagattttagatttgaccatagcagagatatccacggaagtcgttgatgtcctcttgggggaaggaaaccgtatcttttctccgggttgtggcaaggcaagggaaatggagaatcaagaggagtgggtcccgtttatggatgtattagcattgctaatctttggggttgtcctctttccaaacgtgcatggtttggtggacctagccgcaattgatgctttccttgcatatcaccatagcaaag

SEQ ID NO: 99376 - DNA, 324 bp, Glycine max
  Peptide Sequence Number=SeqID_216154
atgacactgggtggttcctttgaaattattttgtctggtgtggctgatgatgcggttatggaagaaaggtggagttctcttggtgagttgagggtgtcagggtcttggggaaagcaaaagagccaacaagtggtagatgagggtgccggggtcttggggaaagctttatgcatgattttggggaaagctatattaatgaaatctaagggttcaattgcatgttcagaatttatgttaagcaaatctaaggagttggacagacagggtttgaaaaaggtgagattggatgaaagacactatttgattctagcgttaaatgtttaa

SEQ ID NO: 99377 - DNA, 435 bp, Glycine max
  Peptide Sequence Number=SeqID_216155
atggcgtttaatcacgattacatgaaacacattttacgtcgagccttcattccagtgcactccctcctgaaaggaaatgatgatttgaggaaaaagattgaggggtctagtagtcaacatcctggccagaggaatagctctgagcttgcttctggacttttaagtcgatggctgtcttctcatcatcatggtggagtacatgatgagaaatctgttgctcatcacactgtgaacttgcttacatcaacaattaaagtagataatgaccaatcagatttgaggttttgcttccggatcatttcaccaacaaagaactatactttgcagttagtttacagcttcctgcgcaaggtcagatcttttcatgaatcttttctgcattctgcaggaatactagattatgtgaagttggggaccaaaccccataaattttga

SEQ ID NO: 99378 - DNA, 173 bp, Glycine max
  Peptide Sequence Number=SeqID_216156
atggaggcttgggggctgctgctctcgtggttcccgggttgctcgcccaggcgagctaacctgccatttttttttgggggaaacataaccatgccccccctctttacagggttactgggctgccttgcagcaacattctctgcttgtccagcaccgggaagggatgacgatcg

SEQ ID NO: 99379 - DNA, 1134 bp, Glycine max
  Peptide Sequence Number=SeqID_216157
atgatgaagaatcaacagtcacagtggtggtggcttgagagccacaaccacacaagacgatccccatggcttcaatccactcttacagagctaaatgagaagaccaaggcaatgttaaagctaattgaagaagatgcagattcctttgcccaacgtgcagagatgtattacaagaagagaccacagcttgtgagcatggttgaagatttctataggacacaccgctcattagccgagcggtatgatcaagtcactggaattcgccagcagaagacaggatcacctttttctccaatcaagaatcatcaatcagagaagttgatgagttttacacatgacagttatgatagctattctgagtgttttgatgtagaggagtctgtggaatctgaagttgatgatcctgagcaagaagaggaagaggttaccaaatttgataactgtatagaagaggaggaagttaagattgtggctgcaaatgatgaagtgatggggctgaggaaagaaatcaacagacttggtgaagagaacaaggatcataaagatcaaattaaggagaaatataacgtttatgatgaagttatggtgttgagggaagaagtagaaggactcagaaaagagaatagagtgcagaaggatgagctcaaccagaaaagtatcatttgtggtgaagtaatgatattgagggaagaaatagaacgactcaaagaagagaatagagagcagaaggatgaactcaaccagaaagatatcatttgtggtgacgtaatgatgttgagagaagaaatagaacgactcagaaaagagaatagagtgcaaaatgatgaactcaagcagaaaggtaccatttatggtgaagtaatgatgttaaggaaggagatagaaagagtcagcgaagagaatatggtacagaaggaccatctcatgcaaaaagacctagagaaaatagaggtgattagacacctgagtttagctatagatgtgctgaagcaggagaatgtaaagatgagaagcttcattgctaaggaatttaccaacaaatggaacaacccatttgagtttaaaaaactcatgggatcattatcgatgaagttgtttaatggaaagaatcaacctagtattgtagctctatag

SEQ ID NO: 99380 - DNA, 549 bp, Glycine max
  Peptide Sequence Number=SeqID_216158
gattctgtaactgttgtgggatatcctcttggaggagacacaatttcagtgacaaagggagttgtatctcgtatagaggtcacatcatatgctcatggatcgtctgatttgttgggcattcaaattgatgcagcaataaatcctggtaatagcggagggccagcattcaatgaccaaggggagtgcattggagtagcatttcaggtcctcagatctgaagaggctgagaatattggatatgtgattcctacaactgttgtatctcattttttgaccgattatgaaaggaatggcaggtatactggtttcccttgccttggagtacttatacagaagctagagaatcctgcactacgtgcatggttgaaagtacagtctaatgagggtgtattggtacgtagagttgaaccaacttctgatgcaaataatgtattaaaggagggtgatgtgattgtcagctttgatgatgttcgtgttggtagtgaaggaacagtcccattcagatcaaatgagcgaattgccttccacttcctcattagtcaaaagtaa

SEQ ID NO: 99381 - DNA, 1281 bp, Glycine max
  Peptide Sequence Number=SeqID_216159
atggtgggtgaaacggcaacggggaagtcggttggtttaggtttgggatgtgacccagtggtgggatccttgacttgttcgaagaagagggaatacagagtcaccaatcgcctccaagagggaaagcgccctctatatgccgtcattttcaacttcattgactcccgctacttcaacgttttcgccactgttggtggcaatagggtcactgtttatcaatgtcttgaaggaggagttattgctgttttgcaatcttatgtagacgaagatgatgagtctttttacacagtgagttgggcgtgcaatgttgatggcaccccatttgttgtggctggaggaatcaatggggtcatgcgagtcattgatgctggcagtgagaagatacacaagagtgttgacaatgaaattatcttgtgggaacctaaagtgaaggaacaaactccaggggagggtgtagttgacatccttcagaaataccctgttcccgagtgtgatatctggttcatcaagttttcttgtgatttccatttcaacatagccgcagtaggtaacagggaagggaagatttttgtttgggaattgcagtcaagtcctcctgtacttgttgcaaggttgtcacaccctcaatcaaaatctccaatcaggcagactgctacgtcctttgatggaaggcatcaatacgttgctaatgttgtttgtgtgctattgcagccatctgttagaaagcagcacaatgcaggttacaaacacaaggcaaatgtgaggacctactaccagcaatttgaagaacaacaaacacaaagtttaattgatcaaaggatcaaagaacatcttgggcaagctgcagcgtttcagcaggttggtgtggcttataatcatctaatggttcagaggcctaaccttcctcctgtattgccaccaccaagattgcctattcctggaaatgcacaaatacctggaagccaaccactaatgccagggatgagaccacctgtctttcctagacctcctggtgcaccaggatatgtttctgcacctaccatgcctccaatgttacctccacctggtgctccccaggcaccaggtcaactaaataccataccaaggcccccttcattagctccccctccagcagttcctggaagcactgctgctccagcttccaatggtgctccctctatggtatcatcagcaatgtatcaagccaatcctccggcaccatcatctggaagttatgataattacaatgccagtgctcaagcacctgagggtaatcactga

SEQ ID NO: 99382 - DNA, 942 bp, Glycine max
  Peptide Sequence Number=SeqID_216160
atgtctgggaattcgacctccaataattcgccaccttcaggatccggaaatgataagaagcagaactgggctgcgtcaccttccactgttttcaaccactttgctacaagtggactttccgtggcggttgcaactgcaattactcaccctttagatgtattgaaagtaaggctacaaatgcaacttgttggccagacaggtcctttgagtggaatgggaaagttatttttaagcgcggtgaaaaatgaaggaccaaagtctttgtatcagggtctgacacctgcattaacaaggtcatttgtttatggaggacttcgcttaggcctgtatgaaccctctaagtatgcctgtgatcttgcttttggctcctccaatgttttagttaaaattgcttcgggaatgtttgctggagccatttcgactgcactgaccaatccaatggaagttctcaaggtgcgtttgcaaatgaatccagacatgagaaagagtggaccgattatagagcttcggaggactgtatctgaagagggaatcaaagctttgtggaaaggggtgggccctgccatggccagagcagctgccttgactgcatcccagctggctacatatgatgaaaccaagcagattttagtaagatggacatctcttaaagaaggatttcctctacatctgatctcaagcactgttgctggcatactgagcacccttgtaactgcaccgatagatatggttaaaacacgtcttatgctacaacgagaagccaaggaaattagaatctataaaggaggatttcattgtgcataccaggtactgcttacagagggtccaaggggactttacaaagggggctttgcaatatttgcaagactagggccacaaaccacaattacatttatattatgtgaggagctaaggaaacatgctggattgaaggcaatgtag

SEQ ID NO: 99383 - DNA, 633 bp, Glycine max
  Peptide Sequence Number=SeqID_216161
atggcggttgcactatcgagttgcacttccttatcctccgtgctgttctccacagttaaattccgctactcactcagacacagacccatcgtcgcctctttccattgcaataatcacccactccgagtctcctcctcctcctcctcctcttcttcctccaaatccaatcgaaaaaaggaaggtgcagggcacaagaagcagtcaaaagatgagagacctgcaagagggaatgtgctcgaatcccaaccaacttcttctaaaccttttggcattcagaggaaaaataaggaccttatcttcgactccaaggatcagcaggttgaacagagtattttacaagattcggctttccttaatgcagttgtgaaggtatactgcacccatactgccccagattattcacttccttggcaaaaacagagacaatacacaagtactggaaggcaagattttgaaaaccttgactgtagagtagtcaaagtcaagaaaagaggggatgactcaaaatatgtggctaaggttttggcaagaggtgttgattgcgatatagctttgctttcagtagaaagtgaggagttttggagagatgtggaacctctcagattaggacgtttaccacatcttcaggtttaa

SEQ ID NO: 99384 - DNA, 360 bp, Glycine max
  Peptide Sequence Number=SeqID_216162
atgaagcacttcactgacaccctcatcagtgccaacatagtaagccactggcacgacaggtttcccgactggaaagcgggcagtgagcgcaacgcaattaatgcatctagtccgttacaagtgaagtatgcagatggcgaattggaaagattagaacacaaactctttatcggaatgcttccaaagaatatttctgaagatgaggtctccaatcttttctcaaagtatggaactataaaggatttacagattttaagaggttctcagcagacaagtaaaggatgtgcatttttgaagtacgaaaccaaagaacaggcctttactgctcttgaagcaatcaatggaaagcatacaatggag

SEQ ID NO: 99385 - DNA, 387 bp, Glycine max
  Peptide Sequence Number=SeqID_216163
atgaaccctagaaattatcctgcgcctcctgcaagttacattggctcttaccctgctgttccaggtgggaatagcaactcttcatcttcaggtgccagtaaaagttccagtggtcagattgaaggaccacctggtgccaatctatttatttatcacatacctcaagaatatggagaccaagagctcacaactgcatttcaaccgtttggtagagttttgagtgctaaaattttcgtagataaagtaacaggagtaagcaaatgttttgggtttgttagttatgatactccagaagctgctcaagctgccattagtacgatgaatggttgtcaattaggtggcaagaaattaaaggttcagcttaagagggataacaaacagagttaa

SEQ ID NO: 99386 - DNA, 201 bp, Glycine max
  Peptide Sequence Number=SeqID_216164
atgcgatcagagaagaaaccatggtcgccactcctctgtgacgaactcatcgaggaaatcttgtctcgtcttccagtgaaacctttgatccaattcaagtgtgtgtgcaaaggatggaactccctgatgtcagatccctatttcatcaaattgcaccttagtaaatctgctgcgaaggacgatttggacaccttcaactga

SEQ ID NO: 99387 - DNA, 837 bp, Glycine max
  Peptide Sequence Number=SeqID_216165
atgtcaggttcggttcaggcaattcgcctcgttcccggtgaagtggacctcgccaccttacgccgtatttatcaggagaaggtgacgctgcagctggcagaggaagcgcgggcggatattgaccgcgcccgtgaaaccgtcgaggccatcgtcgcctccggcaaggtggtgtacggcatcaacaccggcttcggcaagctggcgcagacgcagattcccgccgaacgcctggcggaactgcagcgtaacctggtgctgtcacacagcgtcggcctcggcgatctgctgccggacaacgtcacccgcctggtggtcgccagcaaaatcatcagcctggcacgcggccactcgggcatccgcatggaactgattgacacgctgctggcgctgttcaacgctggcgtgatgccgtgcatcccggcgaagggatcggttggcgcatccggcgatctggcgccgctggcgcatctctccctgatgctgctcggtgaaggccaggtgcgcattgacggccagctggtgcccgccagcgaaggcctggctcgcgtcggcctgcagccgattgtgctggggccaaaagagggtctggcgttgctcaacggcacccaggtctctaccgcgctggcgctgcgtgggctgtttgaagccgaaaatctgtttgccgccgggctgatggccggcgcgctgtcgcttgaagcgatcaaaggctcggttaaaccgtttgatgcgcgcatccatcaggcgcgcggccagcacgggcagattgccgtcgccgctgcggtggcgacgctgctcgaaggcagcgaaattctcagttcgcacagcaactgcggacgc

SEQ ID NO: 99388 - DNA, 189 bp, Glycine max
  Peptide Sequence Number=SeqID_216166
atgaaaactctacacggtttcggaatttcaacaaacattatcgacaataacgaaggatcccacggtcatgtggctccgcatgccactggactcttgggtcacggtaacaaaaggtggggtggtcgacaaaagcagggcttttgctcctacgtatcctcaatttgtgatgaggaactcagacctgcgtag

SEQ ID NO: 99389 - DNA, 126 bp, Glycine max
  Peptide Sequence Number=SeqID_216167
atggtggttgtggttgtagaagtgggagacattgtgtcggggttgttggcggtgcagcggacaacatgttttatctcccttaaggtgttggtgttggctaatggtactgtgttgtttgtgatttaa

SEQ ID NO: 99390 - DNA, 400 bp, Glycine max
  Peptide Sequence Number=SeqID_216168
gcggcgggctcgatgacatgcggggagccatttggtcccgaacttttttcacctttgtcatccaaaggcggcgggcccgatgacatgagcagcgagtcgagtgataaacgcgcagagacaaattatggtcattctgtgccctttgtcattcagatttcgcaagtcgaggacagtaagtcgagaggtgggcggagacaaattatggtcattccccacaccttttcgccatccagaggtgatcgtgtctggtggcacgcagagacaaattatggtcattctgcgccttgccacccaggctcgattgtgtccgagggcacgcagagacaaattatggtcattctgcaccttgtgtcaaccaagaggaacgaatttgacaatatcaggatgatgttggtcatcg

SEQ ID NO: 99391 - DNA, 336 bp, Glycine max
  Peptide Sequence Number=SeqID_216169
atggtagacaacattgacgacaacaatgtccgccaggatctgcttactacaaagaaaagcaacgttgaaatccctcttcttctggctgctgataagggacacacagaaatcactcgctttctttacgaaaaaactcccacggatgagctcagccaacctgatttagttttgctgcttgaacgatgtatcaaggccgaaatatttgaacaaacagaaaagaaaaaaccaactagactaactaatcctagtgtcagtcacaccaatataatcagcaaagtagagacaatgaagatcatttgggcactcgttaaaaagaaacagggtatgatgaagtag

SEQ ID NO: 99392 - DNA, 206 bp, Glycine max
  Peptide Sequence Number=SeqID_216170
ctcgtcttcttcgtggagacttactggatctccaagagacaaaagtcgttggaaaagagggtgaagagcttgctagagtgggagatgaagaagctcgtcttcttcgtggagacttactggatctgcaagagacaaaagtcgttgaaaaagagggtgaagagcttgctagagtgggagatgaagaaggtggacttgggagttggtag

SEQ ID NO: 99393 - DNA, 1920 bp, Glycine max
  Peptide Sequence Number=SeqID_216171
atggcagcagcaaaaacaacaacaacatcagcacaacagacctcctcggccccactccgccttgacgcgccacgcattccaccgctcgcatactcgggccgggtccagctcaaggcgctgctggaccggcccgagtcagtggtgggacgacacgtgatcgttggtggatgggtgaagtctgctaaggaggtcaagaagaaggcggcggcgcctccatcatttgcgacggcgacggaagaaaccaccgacgccggggaaggagggaagggcaaggacgtgtcgtgcgtggagattctgcagtcgaggataccgctgcttcggagcttattggatgtgttcggaggaggcggttacgtgcagcgcaagaaacgtgagaatgtaattgtgccgaatcataaggttttgcctcccaaagcttctacggcgtatctgcttctaacggatgggtcgtgcgttccaagccttcaggttgttgttgattcttcagtagccacccctagcagacttttgcctactggaacgtgtctattagtggaaggtcaactagaaagagcagaagggaagcatgctattgagcttaaagctgaaaaagttcttcacattgggacagtagattttgataagtaccctttatcaaagaagcgaattccactagataccttaagagattactcccaatttcgacctcgaacaaccacggtggcaactgtggtgcggatccgtagttctctttcttttgcaacccacacatttttcaatgagcatgcatttattgatgtgcaagtacctattataactagcacagactctgaagggtttagcaacatgttgaaggttaacaccctggaacagaaagcagagaaggagaaactagacacaatttatgagactgaaggtgttagccttgaacatgtgaaggcagctgcaaaggagaaaagcaacattattgagcatttgaaaagaactgagagcaatagggaagcactggctgctgcagttcaggatctgaggaaaacgaatgaactcgcatcgcaaatggaagcaagagaaaagagaaagttaggagcttcttttaaggacgatgacaaagtagactcttccaaagagtttttccctttccaaacttatttgactgtctctggacgcttgcatctcgagagttatgcatgtgctcttggaaatgtctactcatttggtcctagatttctagcagataaaacggattctgctaaacatgctgcagaaatgtggatggttgaggttgaaatggccttttcgctattaaaggattccatgaattgtgcaaatgactttttcaagtacctctgcaactgggttctgatacattgctctgaagaaatgaagttcgttgccaaaagaatcgacaacacctgcgtgaaccgtcttcagcagattatattaggttcacctgtaatgatgacctaccatgaagctatagatgttcttagaaagttgtcctaccaggctgaagataagaaatttgaaacaaattttgagtcagggtttgcactcacttcagagcacctaagctatctaactgataccatctaccagaagccggttgtgatatacaattatccaaaagaagctaagccattttatgctcgccagaatgatgatggaactgtagctgcgtttgacttggttgtcccaaagcttggaacaataatatctggtagccaaaacgaggaacgtcttaacatgataagctccaggattgatgagttaggcttgccgcgagagaagtatgaatggtacctagatcttcgtcgaaacggaacagtgaagaactctgggttcactctaaggtttgacctgatggtcctcttcgcaactggccttggcaatgttagggacgttatccctttcccaagaagctatggcaaagccaataactaa

SEQ ID NO: 99394 - DNA, 243 bp, Glycine max
  Peptide Sequence Number=SeqID_216172
atgttgggtgatacatccaacagtgaggttagcagaaaagagttgcaaacagcaaagcccaagaggcaactcgtcttcttcatggagacttactggatctccaagagacaaaagtcgttggaaaagagggtgaagagcttgctagagtgggagatgaagaaggtggacttgggagttggtaggagattggacaacaaagagaagggagaatcagggacatatagggaaagaaaaaaaacataa

SEQ ID NO: 99395 - DNA, 204 bp, Glycine max
  Peptide Sequence Number=SeqID_216173
atgaaatgttacaatgacgtgcatggtgatggtgggtttcatgcagtgtggtggttgaggtggtggttttgggtggtgatggggtgtagtggtcatggatgtttggaagaaaggtatttgaatcttacacccccttctgcaaaaattggcgacgcactagatgacttatggcaagcccgtccggctaatccaataggccaatag

SEQ ID NO: 99396 - DNA, 2367 bp, Glycine max
  Peptide Sequence Number=SeqID_216174
atggatgtcaaaacaaaaaggagagctcatgtagagaatggcgacgaaggagaagacttagttctagctactctggttgccaatggtgatgacattagtcctcttgtcaggcacgccttcgaaatggggcggccggagggcctcctacgccagctcgattttgtggtgaagaaaaaggaagctgaaatcgaggcaatgtgcaagactcactatgaggaattcatccttgcagttgatgaacttcgaggcgtgttagttgatgctgaagagctcaagagtgagctccaaagtgataattttaagttgcagcaggttggaactacccttcttatcaagcttgaggagcttcttgaatcgtataccatcaagaagaatgtgaccgaagctataaaaatgtcaaagaactgtataaaagtgttggagctttgtgtcaagtgcaacaatcacatttctgaaggccagttttatcctgcactgaaaactgtggatttacttgagaaatgttacattcagaatattcctgccagggctctcaaaaaggtgatagagaaaaaaataccttccataaaattgcacattgagaagaaagtatgcagtcaagttaatgaatggatggtccaaataaggagttcttgtaaaaaaattgggcaaacggcgattggtcgtgctgcacaagttcgccagagggatgaggaaatgctggaaaggaaaagaaaggctgagggattaaacatttcagaagttgatgatcaagcttataatttggtggttgaagaagatgaggattctgccatgaaattcgatctcacacctctttatcgcgcttgtcatattcatagttgcctggggatcctggagcagtttcatgactattactataagaacagattgttacaattaaattcagatttggagatatcttcagctcaaccttttgtagaatcacatcagacatttttggctcaaattgcagggtacttcatagtggaggataaggtcctgaggactgctggtgggctccttgtacctgataaggttgaaactatgtgggagactgctttagcaaaagtaacatcaatgttggacatgcaattctctcatatgaactctgccacacatcttctcctagttaaggattatgttacacttcttgcctctactcttagacaatatggatatgacattggccaacttcttgatgtgcttgataatagccgcgataaataccataggcttcttttgcaagaatgtcagaaacaaattgttgatgttcttggcaaagactcatatgagcaaatggtgataaaaaaggatactgattatgagaataatgttctgtcatttaatattcaaacatcagatattatgcctgcttttccatatgttgcaccattctcctcgatggtacccgatgcttgtcgcattgtgagatccttcatcaaaggctctgttgattacttgtctaatggtgtacgtaccggtttctttgattttgtgaggaagtatttggataagttcctgatagaagtattaaatgaaactttacttgatacaatcaatagtggaaatatcagtgtgtctcaagcaatgcagcttgctgccaacataactgttcttgaaagagcctgtgactttttccttcgacatgcttctcaacagtgttgcatctcagttcgatcagttgagaagcctcaagctactttaaccgcgaaggtgctactcaagacttcgagggatgcggtttatattactctactgagtttggtgaacacaaaattagatgagtatatgaatcttgtagaaagtatcaactggacttctgaggaggcaaagccaaatggaaatgactacataaatgaagtgatcttttaccttgattcactaatgtctacagcgcaacaaattttacccctagatgctatgtacaaggttgggacaagtgcaattgaacatatttccaatacaattgtggctgctttccttagtgataatgtcaaaaggtttaatgcaaatgcagttatgaatttcaacaatgatcttaggatgttggagagttttgcggatgagaagttccattgttctggcttggctgaattttactctggagctagttttaagagctgtatgatagaagcacgacaattaatgaatcttctgtcaagtagtcagcctgagaacttcatgaatcctgttataagggagaaaaactactatgcgttggattataagatggtaggctccatttgtgataaattcaaggattctccagatgggatatttggaagtctttcaaataaaaacacaaagcaaagtgctaaaaagaaatcaatggacatgctcaaaaagcgacttaaggatttcaattga

SEQ ID NO: 99397 - DNA, 507 bp, Glycine max
  Peptide Sequence Number=SeqID_216175
atgcaacaatctatttcttttaatacattagatacaagtaagttcattgatgaaatagatgatgtagggaggctaagaggtacaggtatagttggaggaaatgatgaaagagagcaaacattgaatcagttgctcactgaaatgaagaagcttgacaaggatgtctctcttagtgtcattgccatgagaactccgggattcagtggtgcagacctagcaaacctcatgaatcaagccgtgattcttgccagtgaagatccatccctcatctctaagaaccaactatttgctagaatagttggagggttaggggaaagagcagaagaggaagtcatatttggtgaaactgagataaccacaggagctgcaggggacttgcaacagattacacaaatagcaagacagatggtaacaatgtttggcatgtcagagattggaccatgggcattgactgatcctgcagtgcaaggtcatgatgtggtactaaggatgctggctaggaactaa

SEQ ID NO: 99398 - DNA, 331 bp, Glycine max
  Peptide Sequence Number=SeqID_216176
taacctagctcgccagggtgagctaggtggccaccacatcccttgttttgttgaaaaatgggattccggggcttccgggacacccgtaatgcttccaacgttttttgaagctgggttgcttctgaagcaacccagctcgcctgggcgagctaaggatccctcagccccctggctatgtatttcagctgttttgggtgaaaaaaattgtttccgtgaagaaaatccaagccgaggtgcttccgtaacgcttccgagatgtttccgtaagcaaatccgtgaaggttttcgtccgttcttcatcgttcttcatccgttcttcgttcttcaacgg

SEQ ID NO: 99399 - DNA, 551 bp, Glycine max
  Peptide Sequence Number=SeqID_216177
ggttatgaaaatccccgagaagcaaccggtcgtattgtctgtgccaattgccatttagctaataagcccgtggatattgaggttccacaagcggtacttcctgatactgtatttgaagcagttgttcgaattccttatgatatgcaagtgaaacaagttcttgctaatggtaaaaagggagctttgaatgtgggggctgttcttattttaccggaaggttttgaattggcaccccccgatcgtatttcgcctgagattaaagagaagataggcaatctgtcttttcaaaactatcgtcctacaaaaaaaaatattcttgtggtaggccctgttcctggtgggaacaggggaaggggtcagatttatcttgacgggagcaagagtaataataatgtgtataatgctacagcagcgggtatggactcagaacttcttgtttcagaaggtgaatctatcaaacttgatcagccattaacaagtaatcccaaatgtgggtggatttggtcagggggatgcggaaatagtacttcaagatccgttacgtgtccaag

SEQ ID NO: 99400 - DNA, 336 bp, Glycine max
  Peptide Sequence Number=SeqID_216178
atgccaaaagtaaagacaaatcgtgttaaatacccagagggctgggaattgattgagcctacactccgtgaacttcaagcaaagatgagggaagctgagaatgatccacatgatggcaaaagaaaatgtgagacattatggccaatatttaagattgcacaccagaagagccgctacatatttgacctctaccatcggaggaaggaaatttctaaagaactgtatgaattctgtttagatcaaggatatgctgaccgcaatctaattgcaaaatggaagaaggaaaagtctctgaaaaaggagcactccccatctcaacttcctctcaaaacttga

SEQ ID NO: 99401 - DNA, 174 bp, Glycine max
  Peptide Sequence Number=SeqID_216179
atgtaccaaaggggattatattttaacaactatgatttatcttctttttggtggttgttgaaaaagaatgaggtggggtgggccattttgtcaagcttcacaaatctccagccaagcatagctcagttttttgagtttgacattggcatttggcacatggctagcggctattga

SEQ ID NO: 99402 - DNA, 564 bp, Glycine max
  Peptide Sequence Number=SeqID_216180
atgatcctcttccttctggctttctctctactcatgttcctcttctctctctcccctctgcaccttttctcctccttccaccacccatttccatgttcccaatgcacaaaccttgtttctggcctccctcgaccacttcctcacccacgctcaaacgtcacgaaactcgacgacgctgttttttgctctgagacggacaggctgtactcggacacaaagtcatcaccacccctccaacccctttcttccaccaccattcttcttcttcaccgtcaccaacaaagtcatcaccaccacccccaaaaccacaacaaccccaatcacaatcccactcaaacccatagccaaaacaaatcggcttcggtccactctatcactcgtggagaaaccgtcaaagctttgtgtttcagagtgacttcgtgtttcagactcgccagaattgcggtgtcacaattgggggttgcgaaaaattgggatagggagaacaacaagaacctcgtggggtgggtgggttttagaggaaccacgctcctcaccgttaacctcgtggggacatggatttga

SEQ ID NO: 99403 - DNA, 168 bp, Glycine max
  Peptide Sequence Number=SeqID_216181
atgacaccctcaccaaatctggctttcttccagattgagttggattggatcaccccattatgctctagccccatgaaatcccatgatcgagtggtgtgtagctttctcccacggttctcgaacactgacaacactttggggtgctctagaagcagtatggacaacagg

SEQ ID NO: 99404 - DNA, 987 bp, Glycine max
  Peptide Sequence Number=SeqID_216182
atgatcacagcgttgagcgccaagaacaaagtgaaatttgtagatggaagcgcacctgaaccatttaaaactgacagaacgtatggagcatggtgtcgatgtaacaacatggtagtatcttggatcgttcactcagtagctacttctatcaagcaaagcatcctatggatggatgaagaggaagaaatctggcgtgatttgaagtcgcgatacttgcagggagatctcttgcaaatttctgatctccaacaggaagcatcgacgatgaagcaaggcgtactctccgttacggagtattttaccagattgcgtataatttgggaagaaataaaaaatttcaggccagatccaatttgctcctacagtattagatgctcttgttccgctctcaccattatcgcacaacgtaagcttgaagatcgagcaatgcagtttttgcgtggactgaacgagcaatatgccaatattcgatctcatgtgcttcttatggatccaatacctgcaatatcaaagatcttttcatatgtagcgcaacaggaacgccaattgctaggtaatgtttcttcgaatcccaatctcgaatccagagatatttctatcaatgctgtaaaggttgtttgcgatttttgcggacgagttggccatatggaaaacgtttgctataagaagcatgggatgccttccaattatgatggaaagaacaaaagtaataatatgagatatggaaaaatatgcactcattgcagtaagaacggacacaccattgatgtttgttacaggaaacatggctttccaccgggatgcaagacttacaatggaagaacaaccgcaaataacgtagtggcagtggatagtaaagccacagatgatcaaactcagcatcatgagtcccaagatatcgttcgtttttgtcccgagcaatacgaagcactacttgccttaatccaacagccatcttctggaaacacaactcctagccaatcatag

SEQ ID NO: 99405 - DNA, 379 bp, Glycine max
  Peptide Sequence Number=SeqID_216183
atgttttacaaggactgctattaccctataaaaccaaacaggttgtgtttctgttacattcaaaacaaggcaaaagcaaaggaggacttcctagagaggcaaagcaatgaggccaccaagttcttccatccactttctccttcaaattcttcttgtctttctactgcacagacccagctttgcattgaaaaagcccactcacacaagccagaattatcctcagttgacttcaatcaagttacacagtcccaccatgagtttctgggatctttcttaggaagttctaatacaaccaaggactccatcttttactcatacacaaggcacatcaatggttttgctgcaattttggaagaagaagtagctgctgagatatcaa

SEQ ID NO: 99406 - DNA, 213 bp, Glycine max
  Peptide Sequence Number=SeqID_216184
atgaagagcaatggtagtgtatcaatggagaagatgatgggtgttgtaatgaagagcactgatagtgtatcaatggagaagatgatgggtgctgtaatgaaaagcactggtagtgtaccaatggagaagatgatggttaaatcattgactctgaacaaatattttcactggttggatgatgagtcggttctagagaactggcagatggtgtga

SEQ ID NO: 99407 - DNA, 800 bp, Glycine max
  Peptide Sequence Number=SeqID_216185
cacatcgacaaaagcttgatcccaaagcccatcgatgcatcttcattggatttaaatcacatactaagggatatctagtttatgatcttcattcgcatagcattacttcttcacgaaacatcatattttatgaagatcacttcccatcttttcatgaaacacaacattcgaacctcactcccacagttccagctccgggatcattttccagcaaccacctcgacccacccgttgaaaccacaccaccacatcccataattcaggattcttctagttacgatccaccagctaacacttcttccctacagttatgccgttccacacgaacaaagcatgccccgacataccttcaggactaccatcgtgatctcagttcactcactgccaacacctctactactgtttggtatcctctaaactcagtcttatcttattctcgtctttcaccctcacatcgacattttgtcatgtctatctcatcaactaccgaacctacttcctatgctgaagcttcccatcatgactgttggattaaggtgatgcaggttgagttacaagctctacaactgaacaatacttggactcttactactcttcctcctcataaaactgccattggttgtcgttgggtatataaaatcaaacaccatgctgatgggtctgtagaaaggtaccaagctcgtttggttgaaaagggttatacacaaatggaaggtttggattatcttgataccttttctccagtcgcaaagctcaccaccgttcgacttctactagcattggctgctcttcatcaatga

SEQ ID NO: 99408 - DNA, 612 bp, Glycine max
  Peptide Sequence Number=SeqID_216186
atggcattcacctatgtcaacgaaaatacactcttgacattctctgacccaggcatgcttggttctcgtccaaattcaacccctatggattactccacacggttacaagctttatcgggaactcctctatcagcagattcttcctcttcgtatccaaggctgggcaaaccaggttcgagtctcttcttcgctgctcatggaactcctcaacttcaagctttcagtgactcggactgggcaggttcttcagaagctgagtatcgggctttagcatccaccacttgcgagctacaatggctcacatatgttcttcaagattttcgtgttcctttcattcaaccagctactctttattgtgataatcaattcgccattcaaatcgcgtcaaatcctgtattccacgagcgtactaaacattttgaaattgattgccaaattgttcgacacaaggtcaactccggtctaatcaagctccttcccatttcttcctccaagcaacttgctgacattttcaccaaagccttgtctccagctgttttccaaggtctttgttccaagctgggaatgatgaacatccattcccaacttgcggagggctctcaacagcaacaa

SEQ ID NO: 99409 - DNA, 510 bp, Glycine max
  Peptide Sequence Number=SeqID_216187
atggatcagcatttaggtcaaagggattcaaaattggctgccatggaatcagaggaagcagaggaatgcacctctaccactggagatgcctcttttgcatctgttgctgatgtctcagaagtggacacaaaagttgaatttgatttaaatgaaaggctcaatgcagatgatgggaaatgtagtgagatacctgggtctacacctgctgcaagattggttagtcctgttcaattttatgcttcatccatgtcttttgcccattaccccaggccttacattgttagtctccgagatggtagcaatagtatggtgctgagaacagcaagaaaaggacaaggcagggtttcgatcttaatgctggacctggaacctaatggggggtgggatggctacaagcaaccattatggcagttgtcgcaacctacccttcggcgggagggcgacgcggggctcgcgggtgcgtgttccaagaaaggaatatgcgcggagtcgccaccaacgtttatttga

SEQ ID NO: 99410 - DNA, 147 bp, Glycine max
  Peptide Sequence Number=SeqID_216188
atggcaatacaagtgtttgctgatatgtgttttacaggagtgaattttgtaatggattgcaaatcagtgcaagaagcatggtgtaatgcagcagaggaagtgaaacttggattcatatgctcagggactgcccagcccgtgagctga

SEQ ID NO: 99411 - DNA, 1470 bp, Glycine max
  Peptide Sequence Number=SeqID_216189
atggaagctacccattataggaaatgtaccccatcttgttacatctgcaccacaccgaaaactaaaagacttggccaagtctatggacccttgatgcatcttcaacttggagaggtcttcacagtcattgtttcctcagcagagtatgctaaggagataatgaaaacccatgatgtcatctttgcaacaaggcctcacattctagctgcagatatattctcctacggctccacaaacactattggagcaccctatggaaattattggagacagctgcgaaaaatatgcacagtggagcttctcacccaaaaacgtgtcaattcattcaagccaataagagaagaagagctcaccaatctgatcaaaatgattgattctcataaagggtctccaatcaacctcactgaggaagtacttgtatcaatttataatatcatttcaagagctgcgtttggcatgaaatgcaaagaccaagaagaattcatatcagcggtgaaagaaggagtaacagttgcaggaggttttaacgtagcagatctgtttccttctgctaaatggcttcaacctgttactggtttgaggcctaagatcgagaggctgcatcgacaaattgatcggatactattagacatcatcaatgaacataaagacgcaaaggcaaaagccaaagaggaccaaggtgaagcagaggaagatttggtggatgttcttctaaaattcccggatggtcatgatagcaagcaggatatttgcttaactattaacaatatcaaggctatcatcttggtaaggccaagagtcagaagatcctcaaaagtgaaccctcactttgaaagggacatatttggtgctggaggtgagacagcagcaactgccataaattgggcaatggcagagatgattagggatccgagagtattgaagaaagcacaagctgaagtgagagcagtatacaatatgaaaggaatggttgatgaaattttcattgatgaactccagtatttgaaattagttgtcaaagaaaccctaaggctacaccctcctgttcctcttctagttccaagagtatgtggagaatcatgtgggattggtgggtatcatataccagtcaaaagtatggtcatagtgaatgcttgggcaattggaagagatccaaactattggacccaaccagagagattttatccagagagattcattgatagctctattgagtacaaagggactaattttgagtatattccatttggtgctggaagaagactatgcccgggcattacatttggtttgaaaaatgttgagctggctcttgcatttttgttgtttcactttgattggaagcttccaaatggaatgaaaaatgaggacctggacatgacccagcaatttggagtgactgttagaagaaaagctgacctattcttgatacctattacttcccgtcctatcctggtaagaaaactaccttaa

SEQ ID NO: 99412 - DNA, 195 bp, Glycine max
  Peptide Sequence Number=SeqID_216190
atgcttcagagagaagtgagcacaaagaggaaccatgaagacatgaagcttacctcgaacccaatagcgataatggtagcgagactggcagtgagaacagtgagactggcaatcgtgaaaggaagacgtacacggaggggcggagttgcgatgaagactggtattaacacggagttgcggcagagacataattga

SEQ ID NO: 99413 - DNA, 405 bp, Glycine max
  Peptide Sequence Number=SeqID_216191
atggggctgtttttaaagattttccaccatgggtttgtttttgcacgtagggtacgttgcatgcaagtaaactcgccatgcggttggcgagttaaaggtgggacgggcacgtggcatgtcgccactgccactggcgacttagccagtgtcaaactggcgagtcccatacagcgtcaccctaggcctgtagcagcagcaagaaggcttgcaaaggagcaggggcagctaatggtgtcgccagtcatgctggtgatttgcttttcaaagggcatatcaccactcctcctagcgagttggtttggagttggtttgcaactatataaagaaccttggacatgcatgatcagaggaaacctttgctccccttctgccttccttgcttcgtctgtcgccttccttgcttag

SEQ ID NO: 99414 - DNA, 919 bp, Glycine max
  Peptide Sequence Number=SeqID_216192
gtgtatcaagtgggttcaggaggcgtttcctcctggcggagacagctcggggctggtggtgatttatgagcagtgtgtgcgtgccttttggcactcagagctctataaggatgatcttcgctacctcaaagcagataattgctttgatgcagacgtcatctatgcttttctggatgcaaatggaattggaaaaactcattccattttctacatttcatatgctttgcatttggaatctaagaacaagtttaaagctgccaatcagatgatggagcttggcatatctaggaatgctcaaccggttgataaattgaaggctgcttatagacaattttttgcacgctcaatggcaaggcctatagctatagatgatgcagtagaaaaactggcacccacgcgtagctttggaactgttcttgccaagggagaaaatcgtgcaccgctgtccattttgaactcgaaccgtgatccttgtgctaagaatgataggacccgagcagctccactttccatttataaagattcagctgacactggtgatactgatcctcataagccagacctgtcgcactcttggcacacacttggagctcgagctgacagaaataaggaaaacaatgcaattcctggcaagtggaagtcctataagattccacagcgacctgggactagaactggaggggctactgcaagtgcctttatcccagtgtttgttgatgaagaatgtcaagattcacagagtaagaaagcagagggttgcaagtcgtcaaatttgaagattaggcaagaggacgacaaggaactgaaaaggggtcctcatgaattgacacctatctgtataattgttcctttcagggaaacagagctactgaggaagaatccattacgcaactttcctcaaaacagcctccctagataa

SEQ ID NO: 99415 - DNA, 342 bp, Glycine max
  Peptide Sequence Number=SeqID_216193
atgcatgcatatcgccagcatgcatggcgagacaagcctgcacgggatccgccaggggggctggcgatttggcacccctttgtcgccactatgcctgacgatttgtctttggcgtgcccacttgggccttctagattcttcctccagaaggctgttgcttctggagaaagcaaccttgctctcctgggcgagctgggtggcaagctcctcccctattttgctataaatagggggaggagtgaagagagaaggggttcaaccttcttggcacttcttattctctcgaaattgctgaggaaaattgtttccgtgaagaaaatccaagccgaggcgctttcgtaa

SEQ ID NO: 99416 - DNA, 760 bp, Glycine max
  Peptide Sequence Number=SeqID_216194
taccggtccacagctttttgccgttgcgcagatcgaccaggcgagcggctacggtaacgcgggtttcgctgaaggtttcctccactacagcgaccggcaacacatagtaaccggcctcggccagcggcaaggtggcgctggcgagcacgctgtggctggctttgacgtccggcgactggttaaccggcggcaagaccaggatcgacttcggcttgctctcatggaacgccgcatagtcataaggcgtctgcttggcacagccgctaagcaacagggtggcggcaacggcgaggaaagaaattcattaaacggcgccgactccgggaacagcgttttttccgtgttgaattcattcatggcttgtccgtcgttgccgatttttgctgtacagcagccccagctgcgcatgcagacctggcggtacggctttatccttggcgcgggatttctcgacgatctctttcagcgcggcgatctgctgctcagggctttgccccctcctgctggtagtattgatagagagaagtctggtagccatcccaattgtaaagcgttttcggcgcggcgcagccggccagcaggggcgccatgcgccgttttcgataccggtgaccaggttattgacggcttcacgcacggccagatccagcaccttgccgttgagggtggagtcgtagctggcggtgcccccgaaaccgatgatttcgcgattggacagttcgtattcaccggcaccctgagcggaatagacgacttctga

SEQ ID NO: 99417 - DNA, 792 bp, Glycine max
  Peptide Sequence Number=SeqID_216195
atgacattgcgcgatcggctgttggcgctgttggtggtggtgatctggggcgtgaatttcgtcgtgatcaagtttggtttacagggcatgccgccgtttctgctggccgggatgcgttttttgctggtggcgttgccggcgatcttctttatcccgcgcccgacgatcccgtggaaatggctgctgctgtacggcatgaccatgagcttcgcgcagtttgccttcctgtttgtcgccatcaaggtgggcatgccggcggggctggcttcgctggtgctgcaggcgcaggtgttcttcaccctgctgttgggtgtcgtgctgatgggcgaaaagttgcgcgtcaaccatttcgtcggcatcgctatcgccagcggcggcatgctggtgctggcgcaggccagcctgcataagccgggcagcggcgcggtccccctggcgggcctgctgctgacgctggcggcggcgttttcctgggcgctgggcaacctgaccaacaagaagatcctggccggtttcccgcagcgcaacattttgtcgctggtggtgtggagcgcgccgatcccggtcgtgccgttcctggcctgcagctggctgttcgacggcccgcaggcggtgctgagcagcttgggccatgtgcaggtcggcacctggctggcggttgcctacctggcgtttgccgccacgctgttcgcgctgtcaccggcgcagttcggcggcgcattgctggtgctgggcggcatggcggtcaacaccttcgggctgccgcgccgccgggcggcgatcgcgcgttaa

SEQ ID NO: 99418 - DNA, 111 bp, Glycine max
  Peptide Sequence Number=SeqID_216196
atggcgctttccaaccataggtttattcccgtcgattgccctgccgcaacggcaattttgccgcctggctcacaaaatcgcaccggcgacgcccactcctcccccggcggg

SEQ ID NO: 99419 - DNA, 408 bp, Glycine max
  Peptide Sequence Number=SeqID_216197
atggggctggaaaacctggcgcgtatgcgcaaacaggacattattttcgccatcctgaaacaacacgcgaagagcggcgaagacatcttcggtgatggtgtgctggagatactgcaggatggatttggtttcctccgctccggagacagctcctacctcgccggtcccgatgatatctacgtttctcccagccaaatccgccgcttcaatctccgcactggtgacaccatttctggcaaaatccgcccaccgaaagaagaaaacgcccgtagcaagattctgtttgaaaacctgacgccgctgcacgcgaacaactgtctgcgcatggagcgggaacggttcgaccgaagacctgacggcgcgcgtgctggatctggcatcgccaatcggcgtgctcagcgtgtctga

SEQ ID NO: 99420 - DNA, 2463 bp, Glycine max
  Peptide Sequence Number=SeqID_216198
atgcagtttgcaagcaatcaccccatccttagtctggcatgggtcgctttacttattctggtgattgtaaccaccgttaaaggcatgttctctaaggtaaaaaccatcagtcgtggtgaagcaacccacctgatcaacaaagaggacgcggtggtggtagacgttcgttcacgcgacgactatcgcaaaggacacatttcaggggctattaacatcgccgcagccgatatcaaaaaaggcagctttggcgagctggaaaagcacaagtcgcagcccataattgtggtatgtgccaccggccagagcgccgcagaaccggcagccacccttagcgcagcgggttttgataaagtgaccgtgctgaaagatggtgtgagcggctggagtggcgaaaacctgccgctggttcgcggcgtgtcataccaggagattcccattgatggggacgcggtaaagcgcgaagagatgatcaaacgcagcggccgcaccacggtgccacagatctttattgacgcgcagcacattggcggctgtgacgatctctacgcgctggacgggcagcatagcagcaacgaaatgcagttccagattcaacgcgtttacaccaaagacgtctcatttgaagcgccaaacgcacctcaggttttccagaaagagtgggaaccggaagtgaagctggatctggacaccgcctcttctcagctggcggatgaagtgtatgaagtcgtgctgcgcgttactgtcaccgccaccgtgggcgaagacaccgcgttcctgtgcgaagtacagcaggccggtatcttcaccatcagcggtatcgaaggcacgcagatggcacattgcctcggcgcttactgcccgaacattctgttcccgtatgcgcgtgaatgtgtcaccagcctggtgtcacgcggatgcctgatgactacactcaacgcttcgattagcgtcatcggtgccggctcgtacggcaccgcactgggcattacgctggcccgtaatggccatccggtgctgctgtggggccacaatccgcaaagcgtggcgcagctgcaggctgaccgatgcaataccgctttcctgcccgatgttcctttccccgataatctcgttcctgaagccgatctggcccgcgtcgtcagcgccagccgcgatctgctggtggtagtgccaagccatgtgttcggcgacgtgttgatgcagctcaaaccgctgctgcgtgccgactcacgcattgtctgggcgaccaaaggactggaaaaagagaccggacggctgctgcaggatgtggcgcgcgaaatcctcggcgacagcattccgctggcggtgatttccggcccgacctttgccaaagagctggcggccggtttgccgacggcgattgcgctggcggccactgacgcgcagtttgccgacgatctgcagcaaaagctgcactgcggcaaaagcttccgcgtttacaacaatccggacttcatcggcgtgcagctgggcggcgcagtgaaaaacgtcattgcgattggtgccgggatctccgacggcattggctttggtgccaacgcgcgtacggcactcatcacccgcggtctggcggagatgagccgtctcggtgctgcgctgggtgccgatccgacgacctttatgggcatggcgggtcttggcgatctggtgctgacctgtaccgataatcagtcgcgcaaccgccgtttcggcatgatgctggggcagggcgaaagcgtggatgaggcgcaacgcattatcggacaagttgtagaaggctacagaaataccaaagaagtcaaagcattagctgctcgtgtgggcgtggaaatgccaataaccgagcaaatttatcagcaaacagcaatgtcgtctgaagagttagaactggtctggaaccatatcaaagccgaagccagagcgctggccgattgtgaaccgatgctggccagtttttaccatgcgaccttgctcaagcacgaaaatctcggcagcgcgctcagctacatgctggctaacaagctcgctaacccgatcatgcccgctatcgctatacgcgaaattgttgaagaagcctatcgtcaggatcctgagatgattgtctcggccccgcgtaccgtattggccactggctgtggaaagagggacggccgcgcgctggcggtgtatctgcaaaacgaaatctcggtctcattcgccgtggatattcatccggcggcgcgcatcgggcgcggcataatgctggatcacgccaccggcatcgtgattggtgaaacggctgtggtggaaaatgacgtctccattctgcagtcggtcccgctgggtggtaccggtaaaaccagcggcgatcgccatccgaagatccgtgaaggggtgatgattggcgcgggggccaaaatccttggcaatattgaagtcgggcgcggtgctaaaatcggtgccggttcggtggtcttgcagccg

SEQ ID NO: 99421 - DNA, 611 bp, Glycine max
  Peptide Sequence Number=SeqID_216199
atgaagggaaaagcgaccgttacacacacaaggacccgttacaacgacccggcatctccgttgtcatttcgctggtccgatatctcccttagcctgctttgtgcgggtgcgttgctgttgcccgtcgccgcgcatagcgccgatgacagcaaaacgcagctaaagtccattcagcaggacatcgccgaaaaagagaaaagcgttaaagcgcagaagctgcagcgcagtaagctgctcgatcagctgcagagtcaggaaaaagtgattgcccaggccagtcgccagctgcgtgaaacccgcaacagcctgagcgcgctgaacggcgaaatcgcccaaaccaccgccgcgattgcccggctggaaaagcagcaggcgcagcaggaaaaactgctggcgcagcagctggatgccgcgtttcgtcagggccagcacaacggcgtacagctgctgctcggcggtgaagaagcacagcgcagcgaacgcattctggcctattttggctacctcaatgccgcccggcagaaaaacatcgacgagcttaagcagactcagcaggaactggcgcagcagcgtcaggcgctgcagggcaagcaggagcagcaaaagtcgct

SEQ ID NO: 99422 - DNA, 228 bp, Glycine max
  Peptide Sequence Number=SeqID_216200
atgcgctacttaaccgccgtcgtctttgcctcagcgatggttctcagtcacgccagcgcagaagcagcagacacgacgacgattgacgagatgcatcataacggcggattgacgacaggcagtatgacgcaaaatccgcaaagccacatgttcgatggcattgagctgactgaacaacagcggcaacagatgcgcgacctgatgcagcaagcgcgccatgaacgcccg

SEQ ID NO: 99423 - DNA, 1098 bp, Glycine max
  Peptide Sequence Number=SeqID_216201
atgattcctctggcgttaacggacgaaaatcaggcaggaggcggcgagcaacgttctcgctttcctcccgggcttttttcccgccgtgtaaccgtcagaggacggtcggtcactctcggaccagcatctcgcgatcggaaccctagtgacccattgcaaattgtgtggcgacgtcggttgcccgcgatcgctcctgcatctgccagtaagcaggcaatatcaatgccaggttgctatcagcctgaattacatgcgttattgcacagcgctgcgctcgcaggcaggctgcgctgcacagttgtgcagcaggcacgcaccagcgtgaagcactgcagaccagccgtttgtacagccggggccattgcactattctttaggacctttcccagcgaatcgaatttagccatcgtcacaacaggagttgaattatggcgtcaggaatttcccgcatctctttccgcctgcggcgataaagagggcgatcagcgcaaagcctttactgattttctgcaaaacaccgtgatgcgcagcggtgaacatctgcccagcctgagcgaaaaccagaagcaaaccttcggtaattacgccagtgattacgccatcctgtatggcttctcgcagcaggtgaatcaggcggtggatcagggcatgcgcccggtggttgatgagctggcggccattcgcgtgccgcaggattacctgacacgccgcgacagcctgcgccaggcgagcggcaatctgagcgtgctgacgcagcagattcagagcgccaaaatgcaggccgacagcagcaaagccacgctgaagcagccggacgatctgaagaaagtgtacgacagcgtgtacgccaaagtggtgacgcagccagccagcacgctgatcccgctgctgccgcagctgcaggcgctgagccagtcggcagttcaggccggcgattatctgcagtcgcagggcgcacgcgtcagcttcaatgacggcggcgttcagttcccgacccaggagcaggccacgcaatacaatacgctgatgagcaatctcgccagcaacacgcaggcgctgacccaggcacaaaatgccgtacagggtggtttgcagtaa

SEQ ID NO: 99424 - DNA, 1700 bp, Glycine max
  Peptide Sequence Number=SeqID_216202
atggctaaattcgattcgctgggaaaggtcctaaagaatagtgcaatggccccggctgtacaaacggctggtctgcagtgcttcacgctggtgcgtgcctgctgcacaactgtgcagcgcagcctgcctgcgagcgcagcgctgagcgatcgcgggcaaccgacgtcgccacacaatttgcaatgggtcactagggttccgatcgcgagatgctggtccgagagtgaccgaccgtcctctgacggttacacggcgggaaaaaagcccgggaggaaagcgagaaccgtcgccctgttcagcgttccgtcgctggccgccgctaaaccttcctttaagctttgctggtccatctacgctggctggatgccgtgggattacgcccagcaaagcggcatcgtgaaaaagtgggccgataagtacggcatcgatattcagtttgtgcaggttaacgactatatcgagtcggtcaatcagtacaccgcaggtggctttgacggctgcaccatgaccaatatggatgcgctgaccattccagccactggcggcgtcgacagcaccgcgctgattgtcggcgactactccaacggcaacgatggcattctgcttaaaggcgcggacagcgtcagcgcgctgaaaggcaaacccatcaacctcgtcgaactctcggtctcacactatctgctggcgcgcgcgctggagaaatccggcatgagcgagaaagacgtcagggtggttaacaccgccgatgccgatctggtggcggcatttggcactgctgacgttaacgccatcgtcacgtggaatccgctgctggcggaagcagaaaaacagccggacagccatctggtgttctcctcagcgcagatcccgggcgaaatcctcgacctgctggtggtcaacaccgccacgctcaacaaatatcctcagctcggcaaagcgctgaccggcgcctggtacgagacgctgcacagcatggccggacagagcgacagtgccaaagcggcgcgcacgcagatggcgcaggcatccggtaccgatctggccggttttgatcagcagcttgccgcgacacacctgttcagcgatgccaaaaccacgctggattttgtcgacagcccgcagctgaaagccaccatgcagctggtggctgaattctcctttaaacacggcctgctgggtgaaggcgcgccgggggccgatgcggtaggggtcgctaccccggccggtaactggggcgatgccggcaacatcaaactgcgctttaccgacaccttcaccaaactggccgccgccggtcagctacaagctgctgccgggattcaacgccatgggcgaggccatcagccggatggcgtttcagcccagcccgcgcaccggcgagtatctgctgtggagcgataccgccgccagcctgctgcgtttgctgagtggtgtcgctatcagcgcgctgctggcactggcaattggcctgttcaccggcgcgctaccggtggtgcgcgcggtgctggcgccgctggtgacgctgtttgcgctggtgccgccgctggcgattctgcccattttgtttatctgctttggccttggcgaagtctccaaagtggtgctgatcgttatcggcatcacgccgctgatcgcccgcgatctgcagctgcaggtgcagaaaatcccgcaggagcagctggtcaaagcgcagacgctgg

SEQ ID NO: 99425 - DNA, 2685 bp, Glycine max
  Peptide Sequence Number=SeqID_216203
atggcctgcagggtacgaatgatacgcacggcaatcgcgccacgagaatcaccacacgctgacggcaatcggcgtcgggttgtaaccgttacagggattgttgagctgcggacagttggagatcagcaccagaatgttcatctgcgccaccatctcaacatacttacccggcgcggagatgccatcggcaaacgtcaggccgccgtcgtgggtcaccggcacattcataaagaagttaatgttgtgcgtgatatcgcggcgcgtcaggccagactccggatgcgcggcgaccgccagcatccagctgtcacggcaggagtgcatgtggcgcttttcgaggtcataacgcaccgtattactctcgcacgagcaggcgccgccgagcgtatcgtgacggccacaggtatcggcggtgatggtcagcatcggccgatcaagattagaacgcagcacgctgccggccgtgagaaacacgttgtgctggccgcgcagcgtctcgctcatgctgtagcgctcggcggtatcgtcggcgttgaaaaacagcgtatccgccgcctgattgccttccagatcggtaatgcgcagcgtctcgccggcggcaatgcgctgcagccagtaatcaccggcgtcgatctgctgttgcagacgcgcctgcgccggacagatttccggcagcggcgcacgctgcgcatccagcgtcagctgcagcggctggcgcggataatcgctcgccgggctgagcgggtgcggacagcgcccgctgtcatcggcgcgtacctgcgcaaacagattgaggcaggctgccatgtcgcgctggccaaggccatatttcgccagctcgaccaggaagctgtcgtagccgttttgatggcgcaggttgcgcgcctgctgatagtcgctgaccccatagcgcgcggccgtttgtgccgcgttcagcgtgccgcacacactctcgtgccagccgaaactgtcgtgttcaataccgcagaaaatgcgccccatgtccgagtagagacagtggccggcggtgagccggaaagtgtgctggcacttgagcgtgtccggcgcgttatagcgctccagcaggttttccgggttataaaacaacaggctggcgctggcgccgccctccacatcggtcagcgtcagcgcgctgccgctgcgcatgacaaaagaccagtgcgccccggcgggcagcaggcacttcagcggcgggctgagtgcgatccagcggcaggtcccctctttcagatcgtgggtgatcatgaaaatggtcagctgatgctgctgccacagctgggtgatcagctgatgcatctcgctgcgaataccgggatcgagcgcgccaaaaggttcatccagcagcagaatgcgcggctgtttcatcagcgcctgcgccagggccagacgttgctgcatgccgcccgacagctgatgcggatatttgctctgcgcctgttccagtccgacctgcgccagcattgcctgcgcgcgctggcgaatcgcctgacgtttgcgtccccagacgcgtcccagccagcgtgcgctgctgaactcgtcagccagcatcacgttgccgagcaccgtcagatgcggaaacaccgagtagcgctgaaacaccacgccgcgatgggcatccggctcgtcgggaatcggtgcgccatccagcagcagctcgcctttggtcggcgcttcggtgccgagcagcatattcagaaacgtggttttgccgcagccggaggcgccgacaatcgccacgaattcgccgcgctcgacctgcatattcagccgctccagcaccacctgatcgccgtagtcgagggcaaaggccagcagggtgatccacgccacgtacggcagaatcacatccatggccagatagcggcgcatcaggaagatgcgataaccgaggccttccgtggccgcaatcgcttcggcagcaatcaggaacagccacgccgaacagagcgacagccgcaccgcatcgcacaggcgcggcatcagctgcggcagaatcacccgccacagaatctgcgcgctatgcgcacccagcgtctgcgctttgaccagctgctcctgcgggattttctgcacctgcagctgcagatcgcgggcgatcagcggcgtgatgccgataacgatcagcaccactttggagacttcgccaaggccaaagcagataaacagaatgggcagaatcgccagcggcggtaccagcgcaaacagcgtcaccagcggtgccagcaccgcgcgcaccaccggcagcgcgccggtgaacaggccgattgccagcgccagcagcgcgctgatagcaacgccgctcagcaaacgcagcaggctggcggcggtatcgctccacagcagatactcgccggtgcgcgggctgggctgaaacgccatccggctgatggcctcgcccatagcgttaaatcccggcagcagtttgtctgccgcgttcaggctgagacgcgcatccgacgcgaacagatagaccagcagcaccgccagcagcggcagaatgccaagcagcaggcggccgagcggcagcggttgctgaccggcggcggccagtttggtgaaggtgtcggtaaagcgcagtttgatgttgccggcatcgccccagttaccggccggggtagcgacccctaccgcatcggcccccggcgcgccttcgcccagcagacc

SEQ ID NO: 99426 - DNA, 165 bp, Glycine max
  Peptide Sequence Number=SeqID_216204
atgattgatcgcgtattgattgccaaccgtggcgcgattgccgtgcgtatcattcgtaccctgcaggccatgaatatccgggcgattgccgtctatgccgaggccgatcgccatgcgcgccacgtgcggctggccgatgaagcctggtcgctgggcgagggccag

SEQ ID NO: 99427 - DNA, 594 bp, Glycine max
  Peptide Sequence Number=SeqID_216205
atgcgtgattcactggaagagcaggcgcgccgttatgccacgcaggcacatgccgatgcgggccagcgtcgcaaatacaccgacgaaccctatattgtgcatccggctgccgtcgcggagctggtgcgcagcgtaagcgatgacgaagcgatgatcgctgccgcctggctgcacgacacggtggaggacaccgccagtaccttacaggatattgaagaacactttggtgcgcgcgttgcacacctggtggacatgcttaccgacagcgcccagccgcaggcgaaaaatcgtaccgcccggaagctggcacactttcgccacactgccgaagcctcgcccgaggcgcaaaccatcaagctggccgatatcatcgataacacccgtgccatcgtgcagttcgaccccaactttgcccgggtttacctggttgagaaacagattcagattcagctgttacagcagggcgatcggcgtttgtggcagcaggcgaatcacatcattgaacagggcatcgcgcagctggcaaaaccgccgtacagcgtgccggagagctggtttgtcaaacaggcggcgaaatacggtggtttaagctga

SEQ ID NO: 99428 - DNA, 465 bp, Glycine max
  Peptide Sequence Number=SeqID_216206
atgaacagtaatcaagatgacaaaaaagtgaagcctgcgccactccagcttgatcagcatctgtgtttcgcgctctattcggcgaacctggcgatgcataaagtctatcgccagctactggcggcgctggagatcacctatccgcaatatctggtgatgctggtgctgtggcatcaggatgatctgacggtatcggagattggtgaaaagctgtttctcgattcggccaccctgacgccactgctgaaacgactggagagcgctggtctgctgcgccgccagcgttcgcgtcaggatgagcgccaggtcgtggtcacgctgaccgaccagggacgtgcgctgcaggaaaaagccgccagcattccggaagcggtacagtgtgcgaccgcctgcgataccgacaccatggcggcgctgaaacagcagctggacgatctgcgcggcaacctgaatcgcgccacctga

SEQ ID NO: 99429 - DNA, 972 bp, Glycine max
  Peptide Sequence Number=SeqID_216207
atggaagggccgggcggctatcagttcgtcggacgtacgctgcagatgtggaatcgcgatcgccgcaccagcgcctttactcagccgtggctgctgcgtttcttcgaccaaatccgtttttatccggtcagtgccgacgaactgctgcaaatccgcgaacgtttcccgtggggcgattatccgctgcgcgtggaagccggggaatttcgcctcgccgactatcaggcgctgctgactgcccaggcgacggagatcgacgcgttccagcagcagcgtcagcaggcgtttgaagccgagctggcacgctggcgcgccgatggccagttcaccttcgacagccagctgcaggcgcagagcagcgaggaagtggtggtgccggcgggctgccacagcgtcgagagccaggtggcgggcagcgtgtggcaatggctggtggcggaaggcagcgatgtgaccgcaggtgccacggttggcattctcgaatccatgaagatggaaatcccgatcgtggcgccggtcagtggcaaaatccacagcctgcaacgccaggccgggcagcaagtgcaggcggggaaaactgtttcgggatacagcctgataaggccggtttcagcgcctggtggcgcttacctctctactttcacgtgcttcatagtgagttttaaggagttctctatggaaataaaagatccaatggtcgaattactcagcagtcttgagcaaattgttttgacacgtgatgcaaagactcccgtatcagaaattgcactcaataccgtttccgttcccgaaccgcagcgtttacgcgagatgaccggcatgcaggtggatgaattcgcccgcgtgatgggggtgagcgtctcgtcagtaaaaagctgggaagcgcaacgtacgcgcccatccgccacggctcgcaaactgatgaaactgctgcaggccaatccgtatctgggccgacagctgctggaataa

SEQ ID NO: 99430 - DNA, 660 bp, Glycine max
  Peptide Sequence Number=SeqID_216208
atggaggaaatattgtcgtttctccaccctcaacatagtcttaggctgtctagttttgagaggtcggaatggggcaatggttcaaatccaaagccttctattgaggaacctcctaaattagaattgaagcttcttgcttctagccttaaaatcaacactgaagaggggtttccacccaatcaagtggacaattgcggcaaggagatggaaagcttatgtgaagcttttgatgaagattatactcctcattatattgccataaatgagaagttaaatgctttgatctcacaagaagaatcttacccgaagtataggcaacaaactggcttgaacaagtctttttcccttcccaaattaaccagacctccattgtcctcattccaaaatcacccaacccaaaaaaccatgaaagactttaagcctatttccctatgcaatgtcctttttaaaatcattttcaaaagcttggccaacaggcttaagcctttactccaaaaatgcatctcccctgaacaatcatcctttgttgagggtagatcaatccttaacaatgaactcattccatttgaattttttcatcacatgaaatgcaaaacaaaagggaaaactggtgaaaaggctttgaaaatagacatcagtaaagcctttgacatggtttag

SEQ ID NO: 99431 - DNA, 414 bp, Glycine max
  Peptide Sequence Number=SeqID_216209
atggaagaaggcgaatacatacaaagtatgtttgaatgctttcaagccattcttaacgaattaagatatctaggaagaacttatgataactatgattatattgacaaaatattgagaagtttgtctagaaaatggagagtgctggtaacagtgctaagggctctaaagaaccttgattctatgtcctttgaaaaacttgtcggtgcacttaaagttcatgaacaagaacttcagcatgacgaaggaccaaagagagagaagtctttggctctcaatagccaaaaacacaaaaaggtctcattgtctaaagagaaagcatctagaagctcgtccaaagctctcaaagatgatgactcctttgatgaagaatttgaggaagaatatgatgaagatgaactcaccttcatctcatga

SEQ ID NO: 99432 - DNA, 120 bp, Glycine max
  Peptide Sequence Number=SeqID_216210
atggagatgggtgagagtgcattgctggcaattgcttatgggaagaacaaagcaactaagtctcaagctaatcagaaggggaatgggtatgcaaaacctaaggaaactagtgggaagtga

SEQ ID NO: 99433 - DNA, 162 bp, Glycine max
  Peptide Sequence Number=SeqID_216211
atgatggcacatcaactgggttcaacaaaaatagaagaaaatcactcaaagtgtatcaatctcacgcggggcaaggtttatggtgagttgggaatttggctcaaggcttgtagaacggatggacatgatatatgtcagggtgttggtctggttcagggataa

SEQ ID NO: 99434 - DNA, 306 bp, Glycine max
  Peptide Sequence Number=SeqID_216212
atgcctctccttgtggaaagaccatcccttgatggcctcgaagcgctactggtgctcgacacaccgaaaacgctgcatcttctaagatattgtctccacggtggtggtattgttcttcgtcgtcgtgatggggttctctgcggtggtagcgttgttctttgcctctgtgatggggttttccgtggtggtggtgctgttcttcgttgccatgatggggctctcctcagtggtttttgcgttagtgtagcagaagtgcagaacagcaaaagccaagatcgaatagaggtaaacgaaaatgacaaatga

SEQ ID NO: 99435 - DNA, 240 bp, Glycine max
  Peptide Sequence Number=SeqID_216213
atggtccatgacatcttcatcaaggtgaaactggaagtaacagggacatcgacagccctaaatgtgtttggcagtagacgaagcagcgatgtaacacgagcttttcgtaagatggttacttccatacttcaacttgactcgatgaaccttttccgtaaaagcacgagcttggttcaaccccataaaccagggaatggcaattttgattgtcaatacttcatcaacatttcattgggatga

SEQ ID NO: 99436 - DNA, 258 bp, Glycine max
  Peptide Sequence Number=SeqID_216214
atgactagggctatgctcggtgaaaactcgcttcataagcacttatgggtagaagcaataaacatggcatcctacaaaaatttatattcaaggactttagtcatggaagaatctattcatgttagattcaatgatgaactaacatctgataggaggctatcaaatcttgaggatgatcttgtagatatgcaaagaggtctttcataccctaatttcgtccggggaccatctgtttgttgggatgcgaccctcgtttga

SEQ ID NO: 99437 - DNA, 231 bp, Glycine max
  Peptide Sequence Number=SeqID_216215
atgttcttctacagacatagcttcaacaagtgcaatgttctagcttctatctgtaggacatatttcctctcaagctacttatccatcttagcttttcttctagactctgttagagataatctagttgccttggcaagagtagtggccttcttcttgcttgtaatgggagagtggactgtgattgaacttgctccgactgctcctccccaggttgcggttcctccttcttga

SEQ ID NO: 99438 - DNA, 402 bp, Glycine max
  Peptide Sequence Number=SeqID_216216
atggacatgccatcaaatgattctacatattacagacatactgctctggattggaacctgaagaaaggccacctgttgatgcttatcatcataaagttaagagttgttatcgaactctcaatcactcttgcttcacttcaaaaactcccttcaataggatatgcccatggcaaagggatttacccaatcattgaagaagtttacccagacactaatgttgtgtctggttccatggttgttcaaacttctttttacaagaaagcatctggatggaagcctcatcattctcctacgcctctcggtagcccttttaccatctcttctgattctgaagactctagtgatgagttcctaaggaagcttgatgaagaagctgccaaacaacgggggagaaaaatgtaa

SEQ ID NO: 99439 - DNA, 372 bp, Glycine max
  Peptide Sequence Number=SeqID_216217
atggttgaagaggctaccatatttgttgttgatggtgagcctgtactagaagaagtcattgttgaatctattcaagcacattctgtattggaagctaaacaagttgagttggaagagcttgagagacttcaatctgcagttgagaatggcgttgaagtaatctctacagatgtagctacacgtcaagtagaacttgaagtgactttagtccttgaaggcctaaaacctctagtgaaagaagcacttgaagaggcattggttcaatctattattgaagccttccttcatgagtctgaggattgggttactgagatagactatggagttaggcccattagatttaagccaatgtctaatactgatgaaagatag

SEQ ID NO: 99440 - DNA, 405 bp, Glycine max
  Peptide Sequence Number=SeqID_216218
atggttgagggtaacaagtatacaaatagaaaatatctcatttctctcaaaggctctatctttctttctttttctattgatgttcctccttctttttctccttcctcatcaactcctccttctcataaagtcctctcaagcttaaggcttgagctcttcatgggttgtgataattcttatccttcttcccttgagcttgcacagttgattgaaggaaaaccttggatggagctcaatatcatttcattcccttatcttcttcaaaacctagctcggatgaaaacttgtaagaaaacttgtgctttgggtgggattcaaattgggattgaattttggggtccttatgcagactttgtgtcgcttaagtgtgagggcttaaatgagggtgaacccatgcttaagtga

SEQ ID NO: 99441 - DNA, 264 bp, Glycine max
  Peptide Sequence Number=SeqID_216219
atgctgggtgccccaagcagttccctgccaccgcccaccactaatgatgaaggagaaactcgtggcaacaatgacaatgaaggaaggaaagttgtagcagtcatcaatgggagtcaatctggagcagttggagaagggaagggggaggtggtagttgttgtcatttgtagaggagtcttgaaatgttgcccaataatcactatcgacaacagtgaacggtggtcgaagaaatttgtagggaggaggttgaaagattcaatgtaa

SEQ ID NO: 99442 - DNA, 570 bp, Glycine max
  Peptide Sequence Number=SeqID_216220
atggataacaacacaaagaaagataaagagagagaatgtgtaaaaagtttaaaggcatttgaacaaatgtggaaccacactaaacacgaaaaaaacagaggtgaaggacctaaggcacatcaacccttcaaaggcaacgagaaaaaccagagaagaaatagggagcaagggcctacctgcatggggaaggaaacaaaggtgacgcgtgcagtaatggaggcgcttgcgggaacaacaaggagaaaactcgcgttgcgcgtgtctacttggagggtcgcgtccaaccgcgcttgtcctactgttcaaccgtgtccggtgacggtggaagcaacgaacaccgcgtcgcaccggagtcgtacccgcatgcatgtctggtgcgagtccaacgcgggacacgtcggtgaagtgccgcgtccgtacttcttaggattcaacctagacaatttgtgtatgtgcaatcctaatataagtgttcaaaagttacgctttgacatggttagggaacaaggactagttgtgtttgggagtaaggagggagtgaagaaatggtgtctgaacaaggtgaggtga

SEQ ID NO: 99443 - DNA, 285 bp, Glycine max
  Peptide Sequence Number=SeqID_216221
atgagacatgcagctactgctggcgcattccttgctctttcagctccgtgtcgttgccgtcctcgcttcgatcctttcatggactggccccgtgaacgccgtgctgcgagctccacggtttcatttgcttctcctgctggcggtggaaatggcgatgctggaaccgacgacggttgcggttctggcagtgagtctggagatgctaatctcaaactggtaggagacgtggctcaagagctttttcgactttcgcctgatgttatcattctcgatgtttcgatgtga

SEQ ID NO: 99444 - DNA, 1032 bp, Glycine max
  Peptide Sequence Number=SeqID_216222
atggcgcagatcggcggcacgcccgccggaggcgtgacccgtctggcgctgagcgaggaagatcgtattgcgcgtaacctgctgcgcgactgggcgctggacgcaggtttcacctgcgacgtcgacagcatgggcaatatgtttatccgtcgcgcggggaaaaacccgcagcttgccccggtcatgacgggttcacatgtggatacccagccgctgggcggtaactacgacggtgtttacggcgtgctggccgggctggagctgctgcgcacccttaacgatcataacgttgagaccgagcgtgacgttgtgctggtgaactggactaacgaagagggcgcgcgctttgcgccggccatgctctcttcaggggtctggacgggacagtttagcgaagcgtacgcccatgcccgcgcggataacgatggcatcaccgtgggcgaagcgctggatagcattggctaccggggtgaaacccctgcccgcgcgtttccggttcacgcctgctacgaactgcacatcgaacagggcccgatcctggaagatgaagccattgatatcgggttagtccgcgcggcaatgggccagcgctggtttaccctgacgctggacggattcgccgcccacgcgggcacgacgccgatgcacagccgccgcgacgcgctgaccgccttcgcagagctggcgctgaaggtggaagagattggctaccggcatgcgccggacggacgcgcaacgatcggtatggcgaaggttacgccaaactcgcgcaacgtcgtgccgtctcgcgtggaatgcagcgttgagtttcgccatcctatgcagcaggcgctggaaaccatggaagcggcgctgcataaggtggctgaaagcctcagcctgcgcggcgtcgcggctgccgttgagcgcattttcgactacgcgcccatcgcgtttgacgccgaatgtctggcgcgttcggagaaggccgtggcggaactgggctattcgtcgaaaccgatggtctccggtgcgggacatgacgcctgctat

SEQ ID NO: 99445 - DNA, 562 bp, Glycine max
  Peptide Sequence Number=SeqID_216223
tgtttttcgcaagtatggaaacattaaggaggtgtttattctggcaaagaaggacaagagaaaggaaaggtttgattttgctcgctttgaggatgttggagatgagaggttacaagaaggacacaaacaagagtctgatggatcatgggaggacatgaagatttggaatgagtgctccctagaaactgaagatccaaaggatgttggagagtatattaacgaggggacggattgggtattcagatggtttgaggagatcacgtcgtggaagacctcccacatggataatgagatattggtgtgcctaaaagcaacagtacaggcatggacatatagcttttttaaactattggcatccttgtacaagcagttcatgtatgtcaaagttgtaaccgagaagaaagaaaggctagatgtatctcgttttgttataaggactaattctctagatttgatcaattacagtgtgagggattcaattatcggtggatccatgcttgatggagaagcaaaggcagtgtgcccaggaggggttggtcgaggaggtggcgaagaatggtga

SEQ ID NO: 99446 - DNA, 498 bp, Glycine max
  Peptide Sequence Number=SeqID_216224
atggctaagcgacaactatggcatccaggaaaaggaaaagcaccgctaccaagcctcaagctcagtatgataccaggaaggatccttccagaaaggaatgttaagatctatcataccgaatttggcgagtttaaggcagagatggagaggcgtaacttacacaaatgtctcgccaatctccaagatggaagcatagatgtagctatggtgaaggagttctatgctaacttatacaacctagaagaccagagccctaatcaagggagggtaagagggcatttaatcaagattgatgctaacagcctgaataccttcttagagaccctagtagttttcgaggagggtgagacactgcctacctattccagattcacaaggatgaggattgatcctcaagagtttgcttctcgtctctgcatccctggtaggggttttgttctgaatgcagagggccatccttggaagcttccaaggaaagatctcaccactcttgcatag

SEQ ID NO: 99447 - DNA, 399 bp, Glycine max
  Peptide Sequence Number=SeqID_216225
atggcttctccacctgcctcccctcatcttcctcctccttctcctcctcctcctccttctgacgcatcagctttgctatttgctgtgaagcggacacgcaaagcctcacgtctacgatccttgtctaccagaccacctggtgctgagagaccagtggtccacgttgatcctgctaccgacaagcccgacggtccccacaggaagaaattaagaacatatttggggattgtcgcgcatgataaggtggacgtcacgtacgagaactggaaggaggaggaatttgaaatcccagaggcttctgacagtaggacaaaaaagaagttacttcagactgtcggggagagatggaggcagtttaaatcagacctcacgaggaaatgggcccttgtagctgattag

SEQ ID NO: 99448 - DNA, 516 bp, Glycine max
  Peptide Sequence Number=SeqID_216226
atgaggtcctgggtgaggggtcagtggatctcgtttgatgcagatgcgatcggccagctcctaggatatcctttagtgctggaagagggccaggagtgcgagtatggccaaaggaggaaccggtccgatgggttcgatgaggaggccatcgcccagttgctaaagacatccatgcaaacccctgaaagtctgtcttcttttaatgaatgccctaggccttcttcacttgcacaaccctccctaacagcctatgaatgtgtagtggaatcccgcaatgcgtcactgaatttgatggcaggcacaattctggctagttctccgcactacttttctgcggttgaagactatcatgcctgtttaatgaaaaactggctggctctggctaccttgcggagcaaacaaaatctcccccaatcacactgcctgtatgaacaaacaaactttgtacaaccagcttacgtggaaaagattcgatattctttctatgccaatagactcgtgacatccatgtactga

SEQ ID NO: 99449 - DNA, 147 bp, Glycine max
  Peptide Sequence Number=SeqID_216227
gagaagctactgaacctgaggatcctgactgaaggaacagaagcctatactgttactgaagaatgtctaggcatcgcaagaagctacattggccaaccaactataggtcacaagtcgaggcgtaggtggcatatagacagtcattga

SEQ ID NO: 99450 - DNA, 201 bp, Glycine max
  Peptide Sequence Number=SeqID_216228
atgtatagaagacctttaccaactcagggtagaaggttcccttcatctgcaccaatgtcaatagaccctatgcttcaagcaagctgggaaaactttgctttcttctgtgccctgactggattgctggccatattttcagaaagaaggctcgaaggtagaaaagaggttaaaggagtaaatgctagagtaatggaggtttga

SEQ ID NO: 99451 - DNA, 252 bp, Glycine max
  Peptide Sequence Number=SeqID_216229
atgccgcggaacttcacggatagcctaacgatgggtgttaagtaccttgaagcggtcaagcgaaggttgcatgccagcaaacaatggtcctcggacgaaattagggacttcaatgtcctccattttatgttttataagacttcaacgtcctctgtttggagttctaggacttcaatgtccttttgtttttttggtttcacctcttttgttgtctctagcgtccagttttggatagcaagatcgctcatatga

SEQ ID NO: 99452 - DNA, 330 bp, Glycine max
  Peptide Sequence Number=SeqID_216230
atggcctctgcaaataccctaatcactgaagctatcactaccatacacaccgagaatgagccttccattaatgtagaacactttttcgatattcaagaactcgaaaaaaagaccatagcctccaaggttttgggagtgaaggtcatactgtcatgcgacaccattgttaaggcaacaaggtgtctgtgcgagggcagtacctaccaagaaggttgggagaagagctacaattcccacgtcaccagagctctctattgtgataatacagacaaggctggtgatccgaagaccatcgtctacaacttgatgtgtgagaaggcaaaaatctag

SEQ ID NO: 99453 - DNA, 489 bp, Glycine max
  Peptide Sequence Number=SeqID_216231
atggaaatacagaaatacaaaaataacataattcattgtatcggaaatacgaaaattgcagaattaattcaagaaaacataggattggatttcatcgttcatgcccttagtatcttaataagattaacaaagcacaagactaacaagagaaatgatgaaggaagtgatccacggtcacaaatctacagtgcctcggctccacttctccttttctccttcctcttaaaaagtcatccaatgcagggggaactcgcccaggcaagcttcttgctttggcttaaaggaatcaacttgcctagatttaagggtagtttgcaagaaaactattacggtgaaaggataagtgctaacaatttaatcccagaaacaacggaaatttggcacgtatcaactccccccaatctagaatcttgcttgtcctcaagcaataaaatcagaggaaacactggatgcattcaagcagaggaaaacctcatcaaaggtgtataa

SEQ ID NO: 99454 - DNA, 261 bp, Glycine max
  Peptide Sequence Number=SeqID_216232
atgattcatcattcatctagtgttaatggcgagggtactagtcataaggaccctctatctataatcttagataagttgagttccctcaagttatggaaagaaaaactagaaagaaaagaaaaaggaaaagagagggaaggaataggtcacatcttagacctcactcccataggagagaaaaggaaagaaagtttcaagaggctaacattaaactcccatacttccatacccaaggacaatgtagaggcttacttagattga

SEQ ID NO: 99455 - DNA, 576 bp, Glycine max
  Peptide Sequence Number=SeqID_216233
atgaagactcataataatatgagctctacctcatcaaaacatctcctttatgtttctccctctcccaatgtcattaatggaagctccaacaacagctctagcgactcctctggcacgggtaatccccaaccgccaccacaccctcctccttcctcctcctcctccgtccaaaaacaaagagaaatttcatatttcacttcgaaaaggatgggctgcctctttggcagtggtggtttccgatggcgtgtggtgaaggaggaggttaccatgcaagggagtttagggctagttgtggcggcggaaggaggatatgatggtggtgtggtgatgaggaggatggaaatgatgcatgtggtaatcgtttctgagaatcacaatgcttcagatttggaagggatcagaaggtgtcacaataccaacaggaagaggaataatcagattggggtctttggcaaagcgggaggatggtggttgtcagtgtcgaggtcgcgttcaacactaaaatcaaagggtcggttatgttgtcagcgacgaaagtgtagaaaggaaaaggagaaagagaaggtcatgacataa

SEQ ID NO: 99456 - DNA, 525 bp, Glycine max
  Peptide Sequence Number=SeqID_216234
atgaccagtccgcatttgggagaggcaaacattgggaagattggccagtctctgtcaccaaaagtgtcaaacaagagagcccacgatccaaacacatcaaagtcagaatataagagagaaagaagaccccttttgctcatggagaggaaggagcctattgatttttcttctcatttttactttgaagcctctggtgactctgaagaagctgattttgatcccacctttgcttgtgaaatggccaaagcagatggtggcgatgttgatgatgctctatcttgcaactacgatggatctggtgcttgtaatgttgctgaattcgatgggtgtgatgagtcttgtgatgaacatgatggtggggttgagaagaaggaggatgatggtgtttttggaatgtcatattgtgaagatgatgagatgcaagaagaacagatgaaatcctatgtgtcctttgaatcaggccaggagtctttggatgaaatggaaaagaacaggctcttctgggaagcttgcttggcatcttga

SEQ ID NO: 99457 - DNA, 978 bp, Glycine max
  Peptide Sequence Number=SeqID_216235
atgttgcatccaatgattgaagagatgcatgaaattatagttgcgcaagctagggcaccaccggccggaggcagcctaaggaaaaagttctacaaggattcctgctctcaagctgaggacattattaagagcaaaacccagcagcatgtgtctgctaatcccgatttgcctgccaagttgcttagaatgcattttcatgattgttttgtcaggggttgtgatgcctcggttttgttgaactctactgccaataacactgctgagagggatgcaattccaaatttatctttggctggctttgatgtcatagatgacataaaaagtgaattggaggcaaaatgtcccaaaactgtatcttgtgctgacatactggcattggcagctagggacgctgtttccgtccaatttaataaatctatgtgggaagtgctgaccggtagaagagatggcacggtatcgaacagtaacgaagccttggccaatatccctgcacctttcttcaacttcacccaactcaaacaaaactttgctagcaaaggtctcactttgcacgatctggttgtattatcaggggcacacacaattggaatagggcattgcaacttgttcagtaacaggctttacaatttcaccgggaaaggtgatcaagacccttctttgaactccacttatgcagaattcttgaagacaaagtgccagagcctgagcgatacaaccacaacggtagaaatggatcctggaagctctaccaatttcgatagtgactattatccaaaccttctccagaataagggtctgttccaatcagatgcagcccttctaacagaagagcaatctgaagatatagctaaagaattggttgatcaagacaagttcttcacagaatttgcacagtcaatgaagagaatgggagccattgatgtcctcactgactcggcaggagaaatacggaacaagtgttcagttgtcaactcataa

SEQ ID NO: 99458 - DNA, 474 bp, Glycine max
  Peptide Sequence Number=SeqID_216236
atggtcatgccctgtcataggcaagtgcaacagactaggcacatcatccaaagtgatgtcatctctttgacaggaagatccaagcatggccaacacaatggcccctataaggccaaaaaagggacaaatcaattggagctcctcgaaatggagttggttgtggctgccatcgctcgtcaacaaggtgggcacgtgttgacgcaatcactctacgatgcctttctgcaacatcttccccttcttacgaggtgccttcatggggaagatgggttgcatcctaaaatgaagaagggttgggaagggaaggaaggtggaaggatggggaggagaggacttgggaatgggttagaagggaaggagaaaggtgggagtttgtgtgcaaagaaggggaagagaaggcgggaggtgctaggaaaggtggggggaaaaggtagagggaaggaagaagaaggatgggtgaggaatttgaactag

SEQ ID NO: 99459 - DNA, 384 bp, Glycine max
  Peptide Sequence Number=SeqID_216237
atgaagatgcttattgaagcaatacacatgtttgagcctatggagactatccaacgtgacactaaagtgtgtatttataaagcttcccacgactgggtagtggagttggcgccgccgcggagggagagggagaattgtcgacggagggcagcaaattcgatgccggtgagtatatcagagaggacgggccggcgacagtgggggtccaccgaggaggaggcggaagaggaggagatgacgccgtcgcacgagatcgtgaagaggagggtggctgcaaaaatgacattttcggtgtgcatggggaatgggaggacattgaagggacgtgatttgagtcaggtcaggaattcaatcctcaggttaactgggtttctggaagcatga

SEQ ID NO: 99460 - DNA, 1923 bp, Glycine max
  Peptide Sequence Number=SeqID_216238
atggaatttattgctaagagatcatctaaggtttttgtcggtgcacgattacatgttacaggtggtgttctcaggggtggacggtccgtggaaggtgaagcatccattgcagtattggacactgctgctggggtttggttagatagaaacggcattgtgtcctcctcacgctcaaacaaaggtcatgattatgacccttctttggagcttatgcgtcgttgtcgtcatgcagctgcagctgttggtgttcatatatttatctatggtggtttaagaggaggcagctgtggaggtggggtgttggaaagttcgatattgcctgcctcaattgttagagtgtggcaaacagttgtggaggtggagtgttggaaagtcccacatcgcctgcctcaattattagggtgtgatatactactagatgatttcctagtggctgaaaattcgccattgcagcctgacattaattctcctgagagagcttcacctgttacaagctccaaacaaaatcaatctaacttaaattataatgtaacaacaccaaatttggatggtggaccagatattccttcatctggtggctcaggcatggacaaaaattccttggagaaactgagggaagcatcagctgctgaagctgaggcagcgagtgctgtctggcaagctgtgcaggctatatcaagtaatcctgctgaagaaacatctgtgtcagatgacaactcacaagctgtggaaacagtttcagatggaagtgatacagagggagatgtccgccttcatcctagagctgttgtagttgcgaaggaggctttaggtaacctaggtggaatgataatttcaactttgcttaggcctcgcaactggaaagctcctgcaaacaggcggttcttcttggattcttatgaagtgggtgaactttgctatgctgctgagcaaatatttatgcatgaaccgaccgtacttcagctgaaagctcctgtcaaagtatttggtgatcttcatggtcagtttggtgatttgatgcggctatttgatgaatatggatttccttctactgcaggagacatcacctatattgactacctgtttttgggagattatgtcgatcgaggacagcacagcttggaaaccattaccttgctacttgctcttaaggcaggcctgtttaattttacattatttaactatctgatcgaatatcccgagaatgttcacttgatacgtggaaaccacgaagctgctgacataaatgcactatttggttttcgtattgagtgcattgaaagaatgggtgaaaatgatgggatatgggcatggacacgattcaatcaactttttaactatcttccattagctgctcttattgaaaagaaaattatctgtatgcatggtggcattggaagatcgatcaattcagtagaacagatagagaagcttgaaaggcccataacaatggatacaggatctattactttaatggaccttttatggtctgatcccacagagaatgatagtgtagagggtttgagaccaaatgctagaggcccagggcttgttacttttgggcctgatcgtgtcacagaattttgtaagaaaaataaattgcagctcattataagggcccatgagtgtgtcatggatggctttgaacgatttgcccagggacaattaatcacccttttctctgcaactaactattgtggaactgcaaacaatgcgggagctatactggtagttggtaggggtttggttgtagttccaaaattaattcatcccataccacctccccttcagtctcctgagacatctcctgagcgtgttatggatgaaacatggatgcaggagcttaatattcagaggccaccaactcctactcggggtcgacctcagccggaccttgatcgtggctcactagcatatatatga

SEQ ID NO: 99461 - DNA, 339 bp, Glycine max
  Peptide Sequence Number=SeqID_216239
atgaataaggaatataaaacaaaacatagactcctctttgacatgaacagaacagaccccaaaggatgtgaacagggtagagaccacagaacggtgtgccaaagttctacagagagtgggttgacaggatattgtgccatgggttggctggaaactccaccaacatgccatgagttggccggaaatgcagctgagagctctgggtcacagatagtttgtgttgaagagagaagagaccagcattatttagccctcaaaaggacaagttgtaacgcaacagggttccatgagcaccccatagccatgacgctccataacacttctgtagcagcgctatag

SEQ ID NO: 99462 - DNA, 1368 bp, Glycine max
  Peptide Sequence Number=SeqID_216240
atggacaggttagtgaaagcagacacaaaggaagtggagatgatttttctgaagggccaaaagtgcagctcctccttcaagctcaccaacctcatgcacaccatgtcagtggcagtgtctttaaccaccacaaactcttctcttttctccatcaacaaacccttctccacaattcccccactatctacggcatcatacaaactacaactctctcagccctccgatcaaccccctctctccgaccctcccgacgccatcaccgtccgagcaaccatgctccccaccgggaaggccaccgccgccgacctccgccgcttcttctccaaacccggcccccacgtcttccgcgacgccgtcttaacagtctccctcgtcggcccccacgtagcggagttcctcatctcccaaaccccccaatcacgcaacctcttcgccaaatccatatccgcatgcacgaaaccgcagctcatgaggctgctcaaacccgccgtcgaatgcggaagcaccgacgctgtcgcggatttactcaacgctggcgcagacgcgaccgcaaccacggaatctctcatgccgctcgcaattagggttgggaacctccacgcggtgaagcttctggaagcctcaggttgcaaaatcgacggatcgtctctgcacgaggccgcggcgatggaccgaatcgacgcgatggagtttctgttggcgcgctacgacggcgagctggacgtggatgcggtggactccgaggggaggacggcgatccacgtggcggcgagggaggggcacgcgagggttatccagttctgcgtcgcgatgggaggaaaccctaatcgagtggattcgaaggggtggaccccactccactacgcggcgtggaaagggcacgtgaaggccgcagagtgtttgttggaatgctccaacgtgaagtgcgcgagggacagggaggggagaacggcgttttctgttgcagcggagagtgagcacgaacaatctcacgcgcgcacgcgcctggtcgatttgctgggttggggcgatgcgctgctgcgtgcggtgagagttgacgatgttcacggagtgaagaaatgtttgggggaaggggttagtgtgaacgggagggaccagaacgggtggaccccattgcattgggcagcgttcaagggtcgaataaagagcctgaaggtgttgcttgaacacggcgccgaggttgaaaccgttgatgatgctggctacactccgttgcattgtgctgcccaggctggccatttgcaagttgccctctacttgatcgctcatggtgcctctcaacccaatctcaagtcctttccacatcttgctcacccttttcaaaatcatagtttcacactaatttga

SEQ ID NO: 99463 - DNA, 814 bp, Glycine max
  Peptide Sequence Number=SeqID_216241
atggaggaagcaagagttcagaagaacttcccggtgaagccgaagctgaaatcgatggccagaaccccaaagcaaacccctgaatcgaagtactggtcctccttcaagacccaacaaatccccaacctcatctccgtcccctccctcaccttctcccccacaccccctcactccttcgccgccgcacactccgcctccctcactctttacagctcccagaccctctcccccgctgccaccatctcctccttctccgacgccgtctcctgcgcctccttccgctccgactcccgcctcctggccgcctccgacctctccggccttgtccaggtcttcgacgtcaaatcccgcaccgccctccgccgcctcaagtctcatttccgccccgtccgcttcgtccacttcccccgcctcgacaagctccacctcatctctgccggcgacgacgccctcgtcaagctctgggacgtcgccgaggagaccccggtctccgagttcctcggccacaaggactatgtcaggtgcggagactcctcccctgtgaattctgaaatcttcgttacaggctcctatgaccatgtcgtcaggctctgggatgctagggttagggattcgaaatcgtcggtgcaggtgaaccacggcgcgcccgtggaggatgttgtgttcttgccgtccggagggatggttgcgacggcgggtgggaattcggttaaaatttgggacttgattggtggagggaagcttgtgtactccatggagagtcacaacaagactgtcacgtcgatttgtgtcgggagaattgggaaggattatg

SEQ ID NO: 99464 - DNA, 153 bp, Glycine max
  Peptide Sequence Number=SeqID_216242
atggaatatgcgagaatttcctccaacgtgatgaaatcagcttctttacttgtcactcgttatggtcttatggatggtggagttccttactttagcactattttctgttgcctaatgattgtatttggatcatcacatgcctttataccatag

SEQ ID NO: 99465 - DNA, 960 bp, Glycine max
  Peptide Sequence Number=SeqID_216243
atgcagatgtttttctcaaggaaagatcttaactttctacgatttagaacacggagattttatgaacattttgcaggagataagatgcaccagcattacaaaattttgcgtgcttctgtgaatagttatggaagtcacataagaatatacaacgtggacagaggttggaaagttcagaagaacattctagctaaaaatttgagatggacaatcactgatacatctctttcacctgatcaacgctatctagtttatgccagtatgtcacccattgtgcacattgtaaatgccggatctgctgaaacagagtccctagcaaatgttacagtaatcacaaccaatgctactcccccagcccctactaattccataaatattgcaattgctttaaatgctaccaaatattacagagcaatagatattaaaaaattggattttcatgatatgtgccaatcatttctgtctgatgtgaacactgtacgttttgctgatgaaactagccatcttatttactctgggagtgatgatagtttctgcaagtttggatacttcactcataagtatgggcgaagtatccaaagagtatcactattggtacaggagctgatgagtattgctatgctgctgatatataacaagatacagattcagttatgcccacatttccataaggggggcagaataaaaacaagttgtgtcagttactactgctctagcattgtatccatgctgtataattgggaaaacattattcaggtgagtggagctcaagttgcaacactgaagcaccataaatcacctttgagagattgtagttggcaccccttccatactacgcttgttagctcttcttgggatggagatgttgtgaaatgggaatttgctgggagtggtgatacaccagcctcttcaactaagaagagggtatggacaagacatttttatgaacattacctatga

SEQ ID NO: 99466 - DNA, 144 bp, Glycine max
  Peptide Sequence Number=SeqID_216244
atgtgtgcgccaccttcagagctttttgtgaggctaagaaccaggaaggatgtatggaaagtgtgggcaaaaattaaggtaggatttgttgagattcttcaagacataattttgaaatttaatcgtgattgtctaaatttgtaa

SEQ ID NO: 99467 - DNA, 162 bp, Glycine max
  Peptide Sequence Number=SeqID_216245
atggaacagaggaaggcaggggaaaagacagtggagaggagagaacagagacgcaaccataagaggatgttttacttggcctccccgcttcaacaaacaaccatcattgccattttcaatgttgtcccgctacttgtcacaatatattctggctatagataa

SEQ ID NO: 99468 - DNA, 192 bp, Glycine max
  Peptide Sequence Number=SeqID_216246
atggtgttgaagacaaggatggataaagagacagttggtgttgaggatggaagcaagacagtcttgtctgtcgcgggacccacactcactctgccacagtatttcataatttactgtctgttctcgcatggtcatcgcatatgtttcttagagtttgaggtagtctacccaaagcataagactgtgttctaa

SEQ ID NO: 99469 - DNA, 504 bp, Glycine max
  Peptide Sequence Number=SeqID_216247
atggttaaaaataaaaaaggaaaaggtcgcgagcagaaccttttttctcttggaggaggaattgttgttgttagaggagaactgaagggagaacaagcacttggcggtgccggggtcggaggggccgaagcggttggcgaaagcggcggcgtagataaaagcgtagtcggtgcagtgggtgaggtttccgacggagtctcccagtggcgggagaggggaaaacgaagaggtgcagagggcgcagggggagttgttctcgagcgattggttgcagttgttacggatgttctggagggatggttgagggaccagggactcgaagtcttgtttggtggtgacgttgttgcagccttgggagatccacgaggtttggaaaccgcaggaggaggtgatattgtaggttgggtcgaagttgttaacgtaggactggaagtgggtccagcatgtgtcggaggcgttgaggggagggaggaagaagccgctgcggcggaggtagtcggatag

SEQ ID NO: 99470 - DNA, 435 bp, Glycine max
  Peptide Sequence Number=SeqID_216248
atgatgaggaagttgagacaaggagggtgcttttgggagatttttggaggatgtctagaagacatgaatctcttttacaacaaaaaatcgagatttaaatggtcgaaaaagggaaatggaaataccaagttttatcattctatggtaaaatggagaaggaagcaatgtgaggtgaagggcttggagattgaaggtgtgtgggaggaggatccatccaaagtcaaaaaagatataaatgaattctttcaaaacaaatttaagaaaagtgttatgtccaggcctactttagatggagtggattttgaatctataggggagtcggagaaccaaagtctatgtgcaagatttagtgaggaggaattttatgataatgatggaaggattgtccaggctgatgagacgagtggggaagactccaagctaccaagggtataa

SEQ ID NO: 99471 - DNA, 1104 bp, Glycine max
  Peptide Sequence Number=SeqID_216249
atggagcagagcacaaccttgatcaggttcacttttgatgatattaagaaagcaaccaagaatttctcgagggataacatagttgggagaggtggctacgggaatgtgtacaaaggcttgcttcctgatgggagcgaggttgcgtttaagaggttcaagaattgttctgcttccggtgatgcaagcttcactcacgaagttgaggttattgcaagtgtcagacatgtcaaccttgttgctttgagaggctattgttctgttactactcgtttggaaggttaccagaggatcattgtttgtgatatggtgaaaaacgggagcctccacgaccatttgtttggttctaatggtatgaaattgagttggccaattcgtcagaagattgctctaggcactgctagagggttggcttatttgcattatggggctcaacctgcaatcattcatagagatattaaagcaagtaatatacttcttgatgataagtttgaagctaaagttgcagattttggactagccaagttcaaccctgaggggatgacacatatgagcactagggttgctggaacaatggggtatgttgctcctgaatatgctttgtatgggcaattgacagagagaagcgatgtgttcagttttggggttgtgcttcttgagcttttgagtgggaggaaggctcttcagatgaacaatgatggtcaaccttctgctttgactgattgggcttggtcattggttagaacgggtaaagctttgagtgttattgaagatggcatgccacaaccgggttcagaacaagttcttgagaagtatgtgttaattgctgtgctttgttctcatccacagttgtatgctaggcctacaatggatcaggttgttaaaatgatggagactgatgaatcagtgccttcaatacctgaaaggccaattcctcttgttgctgggaggcttgatattgagagatctgtgagtagtagtggctctggtcagctctctagtccaacgggttatcaatcatatactatagaaagtgatcgtcaatcttctaattctagggatgaaagaagctcaagctctagctctaggattttgagtacagattga

SEQ ID NO: 99472 - DNA, 303 bp, Glycine max
  Peptide Sequence Number=SeqID_216250
atggctccgaaaaagctttccgcaaagagatctaggagggacgccgcggctgaagggaccagtgccgcccccgagtttgatagccaccgtttcaggagcatcgagcaccagcagtgcttcgaggccatcaaaggatgggacgatgagtacacagattttcaagaggagatagctcgccgaaattggacgtcgttggtgactcccatggctaagtttgaccctgatatagtcctggagttttatgctaatgcttggcccgtagaagagggagtgcgagacatgcggtcatgggtgaggggttag

SEQ ID NO: 99473 - DNA, 3033 bp, Glycine max
  Peptide Sequence Number=SeqID_216251
atgtcgctgaatatgaaaaccctaacccaagcattggcgaagaccgcggcggtgatcgagaagacagtgcagacgacggtgcaggaggtgacgggcccgaaggcacttcaggactacgagctgctcgaccagatcggctccgcggggcccgggctcgcctggaggctctattcgggccgggcccgtgatccctcgcggcagcaccagtatccggtggtgtgtgtgtgggtcttggacaagcgcactctttccgaggcccgaatgcgcgcgggcctcaccaaggccgctgaggattcctttctagatttgattcggatggatgcctccaagctcgtccgcctcaggcatcccggtgtcgttcacgtcgtccaggccctcgacgagagcaagaatgctatggctatggtcaccgaacccttgtttgcttccgctgccaatactcttggcattgtcgacaatattcttaatcttcctaaagatctcaggggaatggaaatgggaattttggaggtaaagcatggtttacttcagatagcagaatccctcgactttctccacaaccatgctcatcttattcatcgatctatatcacccgagaacattctgatcaccttgagtggagcttggaaactggctggatttggttttgcagtttctgctactcagacttctggtgactcatctaatctgcaacccttccattatgctgaatatgatgttgaggactctattttgccacttcagccatcacttaattacactgctcctgagctggtgaggagcactgtgtcttcggctgggtgctcatctgatattttcagtattggatgccttgcctaccatttaattgcccgcaagcctttgtttgactgccacaacaatgtgaagatgtacatgaataccttgacttacttatccagtgacgcattctcatctatcccatcagaactggttcctgacttgcaaaggatgctttctccaaatgagtcttcaaggccaacagcaatggattttacaggatctgttaggcctaaggagttgcggcaccctgctgctcctcaaagggccattatgcctggcttaagcggagtgggcaagtcacgctgcactgctatcctaacttctgttccactcatggctgcacttgcatctagctgttcagagaaaagagatgatcagaatcacagccctaaccggcctaaccctaaacgacaatcgttttatgaaccggccggtctgaccaaacccagtggtcacactggttcggttcactacaaggattggaaatgtattagaatcactgtgacatgggttgaaatggagtgggaaagagataacatgcagaagtcagagttcttaaaagcattgtcagatatgtggaaagattttgattcgcgcgtattgcgatataaggtccttccaccactttgtgcagagcttaggaatgtggtgatacagccaatgattttaccaatggttctaaccattgcagagtctcaggacaagaatgattttgagcaatcaacacttccagcccttgtccctgtccttagttctgctgctggtgagacactattactgcttgtgaagcatgctgagcttataataaacaagactagtcaagaacatttagtttcacatgttcttccaatgattgttcgggcctatgatgatactgatgctcgtttgcaagaagaggtcctgaaaaaatctgtatcccttgtcaaacaactagatgcccagctcgtgaaacaagtggttttgccccgtgttcatggattagcacttaaaacaacagttgcgacggttagagtcaatgcgctgttgtgcctaggagacatggttaatcaacttgataaacatgctgtcttggacatcttgcaaactattcaacgctgtactgctgttgaccgctcccctccaacccttatgtgtaccctaggggttgcaaattctattttcaagcagtatggagtagaatttgtagctgagcatgttcttccattgcttatacccctgctgactgctcaacaattgaatgttcaacagtttgccaaatatatgctctttgtcaaggatatgctccacaaaatagaagagaagcgaggagtggctgtgactgattctggaacgccagagataaaactatctcccgtggttaatggccttcaatctgaagccacgcggacaagcagcagctctgtacctgcttcaacaaaaaacagctcttgggatgaagattggggtcccaaaccaaagggcactgcctcttcgatccagaattctattgatgcaaccagtcaatctatggcaggcaaccctgtggatcaagtaacatctttacaaaagcatttgtccttagcggctttatctgctaagcaaacagccaagtcatgtccgtcagtggatgtagaatggccacctcgtgcatcttctggtgttaccccacaatttggtgatactgaaaggcagacaatagcagcaggaacttcatccacatctaatcttgaatctgatgatccttttgctgattggcctccgcatcctaatggctcagtatcaggtggatctggaatatccaacaatggtactttaggaatgccactaaacaaagttgggtttaattcaatgacaagcacttcaagcaatatggctccccaaactagcaacagttggcctgttaattcccaaagttctgccgagtccattagtttgaactcaaggagtgctagttcaacaacgggtagcctgaatactggtggccttggacaacagaaatctcttgggttcctaaaacaaagccaagcttttccagcatcgaatgtttcatataataatgttcagtcaacagcaacagatcttggatcaatattttcttccaacaagaatgaacaaattgcacctaaacttgcaccacccccttcaaccactgtgggtagaggacgaggaagagggaggggagctgcttcaaccactcggtcctctcataccaagtcacatgctgagcagccaccccttttggatttgttgtga

SEQ ID NO: 99474 - DNA, 267 bp, Glycine max
  Peptide Sequence Number=SeqID_216252
atgccatttgacatttatatgcatgtaaaggcattccttagaggcaagcctccaccctttacagctggtaagcttgaagggatagcagctgttgtaaatgagaatgttagaacagtgaggaaactctgcagcagcagtcttcggtactggatattagaatatttacgaagacaaccaaaagagagaacatatcgtgcattggtccttagatttttgaaagatcgaattgcagctctattgttgcttgagatcagtggtgaaatgtaa

SEQ ID NO: 99475 - DNA, 828 bp, Glycine max
  Peptide Sequence Number=SeqID_216253
atggcggaacatggcagaaggccgaaaatccgccatataagcatgccattgcaccttatgatatcagtgaaagaagataagcacaaagaggaagtaatgctattttcagtaaaccgaaaacatgctgattattcatcctttaagcctgaaaaaaggcgagtggagaaaagtgagcaacacagtgttcagtctgccaatgaaattcgttcatccaaaactcttgaagtggctgaaatctacaagccaagtgtacatgtcaattccatattttcacctgtaggagctgacacggggaaactttttagtgcttctgaagctactgatattgtcttcaaatatgttgaaaaagaaaatcttgtgaaaccaacaaataaatccgttgtggttcttgatgtaatattatgtgatgcactgttcaagggggctattaaaaaaggaacaacatatcctacagaaattcacaagaaggatttaggatcaacatttgtgagccgtatgcagcctcaccatgttgtgacaagagggaatgaatctgtagtttgtaaaggtgcacttaaaacaattcagttattgacagaacgccggcaaggcaacaagaaggtaaccaaactctctggtatggaatcttttcttatagatgctgaagcattggcatcagaactgcagaagaagtttgcttgcagtaccactgttgcagaactaccaggtaagaaagggcatgaggttttggttcaaggaggagttatcgatgacttagctaggcatttgattgaacaatatggagttccaaagagatacattgaagttcttgataaaaccaagaaatga

SEQ ID NO: 99476 - DNA, 666 bp, Glycine max
  Peptide Sequence Number=SeqID_216254
atgggtttggcaaaaacagcatcttcagctgtaaaacttctgatagatattggatattttcctgtacatatcaatcttgatctgttgaagttgggaattcccactgatcattcagatgaaatcatatcggctgctcaaagtcttttattggactcatctgatccagacgagattgataggaagaatcttaccgatttaaaggtctatgccattgatgttgatgaggctgatgagcttgatgatgctttgagtgcaacaaagttgcaagatggtcggattaaagtgtggatacatgttgcagatccaactagatatgttcaacctggaagtattgtggacagggaggctatgagaagaggaacttctgttttcttgcccactgctacatattctatgtttccagaaaatcttgccatggggggcatgagtttgagacaaggagagctttgtaatgcagttactgtatcagttgtgctgcataatgatggcagcattgcagaatattcagtgtttaactcagtgattaaaccaacatacatgcttacatatgagagtgcatctgagctactccatttgaaccttcaggaggagggtgaactcagaattttgtctgaggctgcaaaccttcgttcaaattggcgccgtcagcagatttcaaaactgtaa

SEQ ID NO: 99477 - DNA, 870 bp, Glycine max
  Peptide Sequence Number=SeqID_216255
atggaggagtacttgcagcacatgaaggctctgcgctttcaaatgaacgatgtggaggatgaagcggcgaagatttcggtcgaagaggaaatgcaattgaccaacattcgcactttggaaaacgacttccaatttgcaaaatctggaattacgaaactcaatgaagacaccgaaaagatgaaggcggcaaagggtgagatttgctcaaagatattggataaacagaaaaggattgccactttggagtctgacacaaccaaactctcccagactttggagcttattcagcaagagagagttgggttagctgccaaactttcagagaagagagcctactataacaaggttgcggaggacatgaatgccaaattacagaagcaacaggaatggaacaattctaaaaagattagcagggaacggaaaaagcgtgatttggttacagaaaaggctgctgggcaacgaagtaaagttgaaggcatggctctaaactttaggaaggatggtgcagatggtaaccttgtcatggataacatggggagtgatgtaaggaaggatttaataattgaattggataatgctaaagcaacccttgatgggattcttgctctgaaagccaaagttcttacagagaacaacaagataaaacgggctattgaggatgtgaagtgcagagaaaatgagtttaagcctgagctaaaagcagcagatataactgctcttgaagaggaatgtacagcccttatttcagacaaagcaggagaagctgaatacttgcaatctctagagaaacaagttgagaaactcgagcaaattcgccatgtggtaaaatgtgcttgtggagaggaatacacagttgcagtaaatatgtaa

SEQ ID NO: 99478 - DNA, 2499 bp, Glycine max
  Peptide Sequence Number=SeqID_216256
atggaatcctgcaattgtattgacccacaagtgccagctgatgacttattgatgaaataccaatatatctctgatttcttcattgcccttgcttatttctcaatccctttggagcttatctactttgttaagaaatcagcagtatttccatatagatgggtccttgttcagtttggtgcttttatagttttatgtggagcaacacatctaattaatttatggacctttagaattcattcaagaactgtggctgttgtaatgaccactgctaaggttttaactgctgtggtatcatgtgcaactgccctcatgctgaacaaggctgcagagcttgatagagaaatgggcctgattcgcacacaagaagaaactggtcgacatgttaggatgttgactcatgagattagaagcactcttgatagacacacaatattgaaaacgactcttgttgaattaggtagaactttggcactagaggaatgtgcgttatggatgccaacacgaactggtttggagcttcaactctcttacacattgcgacagcagaacccagttggatacacagtacccattcatcttcctgttatcaatcaagtatttagtagcaacagggcagtaaaaatttcacctaattgtccagttgctagattacgaccttatgctggaaaatacatgcctggggcagtagtagctgttcgagttcctctcctacatctttctaatttccaaatatatgattggcctgaggtttcaacaagaagttatgctttgatggttttgatgcttccatcagatagtgctagacaatggcatgtgcacgagttagaactggttgaggtagttgctgaccaggtagctgttgctctttcacatgctgcaatcttagaagagtcaatgagggcaagggatcagctcatcgagcagaatgttgcattagatctagcaagaagagaagcagaaactgcaattcgtgctcgtaatgactttttggcagttatgaaccatgagatgagaactcccatgcatgcagttattgcactctcttcattactacaggaaacagatttgacagctgagcaacgactgatggtggagacaatattgaaaagcagcaatttgttggctaccctcatcaatgacgttttggatctttcacggcttgaagatggcagtcttcaacttgaagcagcaacatttaacctccattctttgttcagagaggtccttaacttgattaagcctgttgcatctgttaaaaagttatcactcacttcacatgtagcctcagatttgccaatgtatgccattggtgatgaaaaacgtctcatgcaaactattctgaatgttgttggtaatgctgtgaagttctcaaaagagggttgcatttccatcactgctttcgttgcaaagcctgaatcctttagagatgctagaattcctgactttcttccagtgccaagtgataaccacttttatttgcgagtacaggtaaaagattcaggatcaggaattaatccacaagatatcccgaagttattcactaagtttgcacaaaaccaatcattaacaagaaatcctgctggaagtggacttggcctggcaatttgtaggaggttcgtaaatcttatggaagggcatatttgggttgaaagcgaaggtattggtaaaggatgtacagtcacttttattgtaaaacttggaatcccagaccgatcaaatgaatttaagctaccttttgtacctaaagtaccaggaaatcatggatctacaaactttgctgggctcaaagttcttgtcatggatgacaatgggacagtaacaaaaggacttcttatgcatttaggatgtgatgtaacaactgcaagctcaagtgaagaatgtctgcgtgttgtttctctggaacatgaagtggtcttcatggatgtttgtacagggttagatggttatgaacttgcagtccgtatacatgagaagtttacgaagcatcaagatagaccactgatagttgctcttactggaaacaccaaaaaggtaacaaaagagaactgtatgagggttggtatggatggccttatattgaaacctgtttctgttgacaaaatgaggggtgatgtaaatgtgtgtgctgatgaacttggagtgttgcagccacataaatctcaaatacaaaattctgatgttgcgtttgcggaattacttttcaaaatgatagactcaacagaagccatatcaaaggagagagctgctatggagcctatgttggaggagaattcggttactgacaccacggtggttcatcatgacggagacatgtttatccaagactggtccaaagcgaaaaatttagatcgtgacataaaccaaccgcagcaaaggatacttcaagatcgctggtctcccccacaagaagataattttaaatttaacatcgatgcttccttttattctgaggagagaactgcactgctatgggtgcttgctttcgaacagtttgggtag

SEQ ID NO: 99479 - DNA, 2097 bp, Glycine max
  Peptide Sequence Number=SeqID_216257
atggatgccactcactccatgttctgtaacaatgatctggttaaccccctaagctcaatgggcatgcaagtgtcctgcattcttgttgtgtcacacgtcttcaacgttgtgtttaggacagtgggccaacctggaccaattgcacaaattctggctgggttagtgctaggtccaatgtcacatatagagtatataaaggctacattctttcctgccagttcaataaattactatgaagttgtgagctacttctgtcgcatacatttcatgtttttatttgggttggagatgaatattcactacaccatgcgcaatctacgtatagtcagcttagtagcctgtggtggtgcaataatgggtggtgtgtttggtctatctgtctcattttacttgcatcaacagctaaacaccattgacaatgcccccttgtattatttttgtatgatcattatgctagtggtgtcatacacaagctcgcctatggtgattcgtttggcagcagagttaaggtacttagccgtttggttaaacacaagaaatacaaaccagaagtacctcaaggctcctgagttgatgctcattctgctcctgctcctaacttgctcaatgataatagaaatttggggttacaacagtattattagttgtttcatcattggtttgttgtttcctaaggaaggcttacagtgtgatctgataaatgtcttcaagagcctggagagggcaatcaatatggccatattgatattgttgagcattggaagcaagcttggtggtactcttatagtttgccgctaccttaaaattcctactagtgaaggaatttttcttggcttcatattgaacactagaggttatgctgatcttctattcataggtgcagcagcaaagcaaacttttgattcagaggcgtacaatgttttgttggtatcaatagtacttaacacaataatatcaggagtaattgtggcttttctagtaagaggggaagaaaaaatgtttgcaaacaaccatacagcaattgagccacagcaaatggaggacgagcttcgaattctggcttgtgtgtatgaccctcgtcaggtatctgccatacttgccacagtactagcgatacatggctctagagtatcaccatctaccacttacttaatgcacctaatagagcttgtgaagaagatcaagtccaacctgttataccatgagaaagaaaatgctgaccttagcgacgacgaggactatggaggcaatgatgtggtggaaattaacaatgctttggataacttcactgcagaaacaaagattctagtccaacaaagaagggcagtatctcctttcccatctttgtatgaagatgtgtgcaatgaagcagaagatctccaagtgtccataattctactccccttccacaagcaccaacgcattgatgggaaattagaaagtgggaaagagggtataaggatcactaaccagaaggtgctaagacatgccccttgttcagttggtatcatagtagaaagaggacttgcaagggtaccaggcttctcacaactagtagcatctgaagccatacaaaatgttgcaacacttttctttggtggccctgacgaccgcgaggctattgcgtggagcctacgcatttcagggagtccgcgtgtcaacttgacaatcattagatttctgttgagttcctcatcacagaatgaaattattgagagtggagaatctgaggacaaagagatcttgatgtcattgtctggggaggagacggtgaatgagattgacaacaccttcatggttgatttctacaacaggtacgtgacttctggccaaatagggtatgtggagaagtttgtgaaggatggtgcacagacagtggaatctctgaaagagataggggacatgtactctttgtttatagtaggaaaaggtggtagaggacagagttcattgacaattgggatgagtgactgggaagagtgtccagaacttggaacagttggtgatgtcttggcctcttcagactttgatattcatggctcagttttgatcgttcaacaacacagagatgccaagaaagccctattgcatgcttag

SEQ ID NO: 99480 - DNA, 819 bp, Glycine max
  Peptide Sequence Number=SeqID_216258
atgggattgttgaatgaagagcttgctgaagatagacttgtgaaccattcattgcaaaaagggttgcttttggaattcaagaaggattctgatagagtattgctagcagttgctcagagacctgatggcaagaagaactggatggtttctgatcagaatggtttcacttcttccatcaaaccgcagcaagtgacatatattgttcctggtattgacaattttgaccaagcagatattgcagattttgctcagaaggctcaggataatatggacccatcactacttgaatttgcttgggtagagctccttgaaaagaataagtctgttacagttgaagagttggctgagataatttttggcagtactgaggcccttgagagctattctgcgcatctcttgctatcaaaagacgaagtatactttactgtactggagactaaaggatttcgttccgtttatggccctcgaccaagtgggcagggtaagaagagagttccttatccaccaaaatttatgataatttatttcttccatgattgttttagaaagagagggaaattgctttgggttgaggagcttattcatcagaagcttgcaaaggaggctgttgagaaagaatttcaggagtttattgaattactggcctctgtgaagtcaatgtcttcacaagacaaacctccaaaacattcatggacgaaggatgagagaatttggagcagaattgagtcacttgaagcatatgctattgatgcatgtaaaaatgacgaacaaaggaaaacggctgggatggtaactttttccctcaaagcattgttttga

SEQ ID NO: 99481 - DNA, 906 bp, Glycine max
  Peptide Sequence Number=SeqID_216259
atggaaagagagttactagagataaagaagggaccatggagtagtgatgaagatgaggtgctgttgagacacgtcagcaaatatggtcctcgggaatggagctccattcgatccaaaggcttgttgtccagaacaggaaaatcttgtcgccttagatgggttaacaaacttagacccaacttgaagacaggatgcaagtttacagcagaggaggaaaggttggtggtagaattgcaggcacagtttgggaacaaatgggccaaaattgcaacgtatttgcaagggagaaccgacaatgatgtgaaaaacttctggagcagtaggaggaaaaggttggagaggatgttgcagaagccacctacgtcaaagccgcacaaaaacaacggaaaaactcatattaatcaagtggaagaaatggttcctccttgcagttccaatcaggtggaggaaattctatcttactctacttcctatatgggaaacactcaagtgttcgagatgatcaacctaccagatttgataaaaccaaactatcaacaattggaaaatgattacctgagtgcagttgaggttgaggccaccccacttcacacagtaccatcgtttgagtcttcattagggtacaacttccctctactccctgaacctgatccactgatggactgtccactgttcccagagtgccaggaccttgttcctgagccctttgatccaatttttgttgacgggttcaaggagaaaaaatgttcagaatgtgtatgcagcagccagaagcttgggaccaggttgccaacttttggattggaaggaaattctcaaagtgcaagttcaaatggctttttcaaggacttcccgagcgagatttttgaatactttgagcacattccaacctcgtcagatcaatga

SEQ ID NO: 99482 - DNA, 330 bp, Glycine max
  Peptide Sequence Number=SeqID_216260
atgccgatggaagatgaaatggttgctgcacctcattgctttgcaaaggtacgtgggaggattattatacgccacctttcctttgcatacattaaaaagttgtttctgaattcgaatagagttttgcatgttttgggggtagattcaagcaataagggcaaaaatgtggaggttgttacgaaactagatgaagaggacaccataaagcacaatggcattggaggggttgagggggtggagggagagaagtggtggatgagatctcatcggttgatttttcctttcatccaatctctttgcaatgtaagggttttggatgagtggcagtga

SEQ ID NO: 99483 - DNA, 309 bp, Glycine max
  Peptide Sequence Number=SeqID_216261
atgtggaaatcggagagccgtgtgaggaacaaagctgttggggttaatttcattgatgtctactttcgcactggggtttataaagtcccctccttaccttacactccaggaccatactcattagcttacttcattgattatgacctcactgatatcggcgagcctcgaggttacatggtgtttgccaaggttgcttctggagtcttaaaggtgtgggctaatcggacttacccattgtctgaggcagcaaaagcacatgaagacttggagaatcagaagaccatgggatctgttgtgttgctaccctaa

SEQ ID NO: 99484 - DNA, 222 bp, Glycine max
  Peptide Sequence Number=SeqID_216262
atgactgcaggtgatccaccccagcagaagacaagtcaaggaaatgagaaaaagaaagaagatgagaatattactcaaggcgatccacctcaagaggagagaagtccaagaatcgagatagaggaagaactcaagaatattacagaaggtgatccacctaaacagaagagaagtcaaggaaatgagaaaaagatagaagacgacaatataactcaaggttag

SEQ ID NO: 99485 - DNA, 153 bp, Glycine max
  Peptide Sequence Number=SeqID_216263
atggtgagcaaacagaagacggaggtggcggcaagcagagaacaaaaggaagtaattcgagagtgcagaaagcaagatgctgtaggcgtacacgtgggggaagcgttaattacgctaggaatgtcttcttacgctgcaacacaaataatctaa

SEQ ID NO: 99486 - DNA, 309 bp, Glycine max
  Peptide Sequence Number=SeqID_216264
atggttacccatgggacagctacaactttaaatttacaggcattggcagaggagatcaaggcaagatatgataaagcagctgtcaaagttgttgacctgattcttacacttctacaatttggaggatatacactagtgcaaaattcagttgatctgtatcgaagctttgggtttgatacacagccagtcctcattgggctcatcatatttcagaatgtttctgagttgtgcattgatgactgggttggtcatgggtttgaatatggaaacaacctctttgtatatgcaaggataagggtgcataaatga

SEQ ID NO: 99487 - DNA, 333 bp, Glycine max
  Peptide Sequence Number=SeqID_216265
atggaaaaaataatagttagtgttcaaatgcacgagaggtgtgatgggactcaagaaatctcggggtaccgcacctatttgtacttgttccaacatgggcttcattggctaggggtgatgatggtgcaagccggcgcatctcatatagtgggttgggtcggttggtcaacatccaacccgataggcaaggtgttggctttgaaggtggtgcgctactgctctgctgttgtgcttatttgtggtggtgcttgtgtatctgacatgtcaaaagggggtgtgtcccttggcattgccatgcatgcctgtttgtcgaaaagcactggtgcgttctag

SEQ ID NO: 99488 - DNA, 319 bp, Glycine max
  Peptide Sequence Number=SeqID_216266
atgacgggaaatattacaaaaggacatttattgcatgttaataaggagattgtaggtgtgaatcttaagaatattgtgcaagatgttaaaagctcatgttacgcaaatctcacacaatttcatgaggacattttaattgatggaggattccgcattgaaaactctattgctcaacaacaaagggatattgtaggtgtgaatcttgagaatattgtgcaagatgttaaatgctcacgttacgcaaatcttgcacaatttcatgaggacactttaactgatgaaggagtctacgttgataactgtgttgctcaacaaaagg

SEQ ID NO: 99489 - DNA, 2562 bp, Glycine max
  Peptide Sequence Number=SeqID_216267
atggaaacaatgcgtgcgtcaggtcttctttctgagtttcagatactggaaattcctcattttgctctcagtcttgcggttcttggccgagatagagaattgataggcaaaggttttgtgggtttcagtgtaattgttcctgaaatggacaaaacagatgatggcgaggacagacaggataaagggtgtaagaacaagagaaaattaactcatccttctatactgcctgctagttttccatcatctctgattgagttccctcggtatcaattaccggttccacaaagtggcttaaacggatttagtccatctgagttgtgggcagagttgtttagagaagacgaacctgaactttatatgcatgagcttgtggattggaatgatcctattgcaagccagcttgaggaactactgttgtctaatttgcaagcgattttcagtggtgcactcaagcgggttgttgaattaggctttgatgcaagattggttgaaatgtccctttcaaggaaggccctttacattgaggaaggagaccctgtctcaaatattgtacatcagacggtgaatgttttaaagggggaagatgatactattacagattttatatttgacaattttcagcacttgctgcattacaccatggtggagatgatcagtgttgttcgtgaagtcagaccctccttgacagttggtgaagcaatgtggcttttgctgatatgtgacttgaacctttcactagcttgtgcagtggaagatcgtctgagtgttgtttgtaatggggaaaactccaccagttcttccagtccccaatcaaattgcagttcaccaactttccagaaggatttgtccaccaatcaccagaatcaaaagtctgaagaaccaaagtttggaagtttccagaattctgccaacaaccaaggtcctcatgcttcaggaggggtaaaaattaaggcagagaatgcttcattgccaattactgcagagacatcctctggaacttcagggattcctgcccacgaatgtaaatcaggaccttgttctaagcggcataacaggaaagaaatagcagcacttagacagagattccttcatatggagaaaacttacaggtcttgtggaaaaggaagttttaaatcaggtaaggttacaaatgttagcagtttggttgttgaaaaaagactcaagccaccatctgaaattcctaatcaacaaatgaaatgtggctcctcaaatatgataagcacaaaaggagttcgttcagcaaatgtagcatgccatgtttcaaacaatgatgcatctgttttgcctgcaggaggtaagtctggaacattacctgcaaaggatacaatatctacttctcggatggtgaatgcaaacacttcaacacctggcaatatgtccaaaccaaaatctgagctaagcttttctgtcaagattcttgattactgtgctgatattccttttgatgaggctttgggtaagtatgtcccacgggatgagaaggataggctaattttgaagttaataactcgagtgcaagaattgcagaatgagctacatggctggaacaactggacaaatcagaaggttatgcaggttaccaataggcttggcaaactacaggctgagtttaaaactctgaggaaggagaagcaagatgctgaactgttgaaaaaagataagaaaattgtggaggagaatgctgtgaagaggatatctgaaatggagaatgccatggaaaatactaaaaagcaaattgagagtgctgcttctgctactcttgtgttagaggcagaaaattccttgttaaagaaggagttggatgctgctaagttgtgggttgtaaagtcaatgacaagccatcaacaagcactggagagagagcagatggctcttaaacaggcccagatattggaaagccagaacagtttgcttcgagatgagcttgagagagagaagcacaaattatttaatctgcaacaggagctacacaaagagacaaatcttcaagccaaggttgagggtagattggctaaagagagagctgcaaaagaaaagctccttgcacaggctgcatccattaaaaaggagagagagcaacttgaacagcacatgaaatctgaggaggatatggctagaaagaaggcagctactgatctgcagaaatatgtggaagatattggaaagctagagaaggagttggttgacttgaaactaaaatctgattctgaaaaaatagcagcacttcgtaggtgtgttgatgtaaggaatgatagtttctcaagaaccaagagtgctccaaacatgaagggaaacaagaaatctgatacgtcacaaacattggtgagctaccaagacaaattggctgctggaagtttgaggcgtgagcaggagtgtgtcatgtgcctatcagaggagatgtcagtagtttttctgccatgtgcacatcaggttgtgtgtcctgaatgcaatgagctccatgagaaacaagggatgaaggaatgcccttcatgtagggccccaatccaacgtaggattcatgctagatttgctcggcattag

SEQ ID NO: 99490 - DNA, 213 bp, Glycine max
  Peptide Sequence Number=SeqID_216268
atgagccgtcaacctttattccaagacctgcaatggaagcctaagacaacatcgtccctgccctcaagactgccaaagcccccaaacccgaaattcatgaaagcctccatcgagcgcttcctcctcgatggctctgacacccacgatgccttccgacaatatgtgatttttgttgggtatggtgatttgaggttagggttcatggatgcatag

SEQ ID NO: 99491 - DNA, 1110 bp, Glycine max
  Peptide Sequence Number=SeqID_216269
atgaccaaatgctgcaatgggatatgccttttctttgtattaatctgtgttatatgggctccaatgttgggcttggattttttccaatacaccccctcacacctagacacttcttgggcttggtgcgtggataacaatggattttattatcctatgtttcttgtagtacctctgatgtatagcagcggtaacccgacaaacattgcaaaccccataaaagatgctagctttcaggttgatatcaagacagtaagtggaaggttgaatttgtatcaaactactctatgtgaaagactccggtgggatttactaaattcaaatgccaatcccgatccttatggctatttggatgcatataataagaatgatatccagttgatatgctgtcaagctgatgctagtacattgtggcttgttccacttgttgttcggaccagattgattcattcccttgaatggaatactgacatggaaatttttttcacctggatattctcaagggacaggccaaaagggaaagaagttgtgaaatatgaaaaagctgttgatcctcaatatcttccaacacagtctgatgttcagaaggttcttaatggctctatgaacagctttaggatttataatgtttatccaagatatttccgtgtcactggttcaggtgatgttagacctttggaagaggataatgctcttagtgctgatctcattttgaatcgcgagcaatttgagtggtgggccttccgagattttaatccatcaaatttgagtggactttgtggaggtttgacgggacctatggcaatcataatatctgaggagacaccaccgcagggcattcttggcgacacactcagcaagttcagcatatgggggctttacataacctttgttctagctgttggacgttttatcagactccaatgcgctgacttaaggatgagaattccgtatgagaacctaccttcctgtgacagattgatagcgatctgcgaggatatatatgctgctagagctgagggtgagcttggaatcgaagaggtcctttactggactctagtgaagatataccggtccccgcacatgctgcttgagtacacaaaacctgattag

SEQ ID NO: 99492 - DNA, 2021 bp, Glycine max
  Peptide Sequence Number=SeqID_216270
gacttattgttgatgatcccaggatgttgattagctactttgtggtattcatgctggcttgcttcaaacttcgtgcagatcgcctgcctagcttttcaggatcatcaacatatcgtcagattatgtctcaacgtaggaacacatttgtttggcgagatctatcttttgaaactaaaagcatgtggacctttgttgactatttgaggctttactgttattgccatctgctagatcttgtcctgatattaatattgattactggaactcttgagtatgacattttgcatcttggttatctagcctttgctctgatattctttcgcatgagacttgaaatactgaagaagaagaacaaaatattcaagttcttacgcatatacaactttgctgttattattatttctcttgcttatcagtctccttttattgggggaccaagtgctgggaagtgtgagacagcaaataacatttatgaaatgattggtttttataaatatgattatggttttcggattacagcaagatctgcaattgtagagatcatcatttttgtgcttgtatcacttcagtcatatatgttttcctcgcaagagtttgattatgtatgccgctacctagaagccgagcaaattggtgctattgtgcgtgagcaagagaaaaaagctgcatggaaaactgcacaattgcaacaaattcgtgaaagtgaggagaaaaaacaacagcgtaatatgcaggttgagaagatgaaatcagaaatgcttaacctgcaaacacaactccatagcatgaacacatccactaattgtattgatggattttctcacaacaatgagggtctgagaaggagaaggagtgtttctcttgcatcaaataatgacattggaatccctgataaagaagatcaggttttgggtagactagatcatacaataagagaggattctgtttatcctattaatctgcatgaaccatctgtttgtacaaatgtggaaactccatcaacagaggagtatatgaagcattcagtggattctgatttttgtgaaattactgaagtagacattgatactacttctagtgattcaggaaaaagggaaaaatttaaagggcaagcaaaagaaaaccctctcaagtctgctgtacaattaatcggtgatggtgtttcccaggtacagttcattggaaatcaggcagtcaataacctagtgagcttcctgaatatttcaccagaagattctgattcaaatgaacactcaaacattgaggacagcatatatgacgagatggagagtcagaaaactcagcatatatatatggatcgttcttcatctgtgcagtcagataagagttctgatgccgcaaggctgcagttgggaaggatctttcgttatatatggcaccagatgtgttccaataatgatgtttttaagaggactgatctccatgcaaaagatgatcgtactagttataactggcaagatagagcatgggatctgctaaatcaggtgtctatggatgtcaacttctggccagaggatgggattcaaccagagagaattgaatctggaattaatcaggtgctcagaattgttcataatgataagtgcaaggcaaagaacccaaatctttgctcttttgctagcagggttgtgtatgcttcacctgtaattgactgttcttccacagaatggaataagtctttaactccagcatctgatgtggccaaggaaatcctcaaagctcagcgtgctggttttgtggaagaaatgggattcccttaccgcattctttctgtaattggtggaggcaagagagaaattgatctgtatgcttacatattttgtgcagatctgattgtattctttcttgttgccatattctaccagtctgtcataaaaaataaaagtgagtttctcgaagtgtatcagcttgaagaccagtttccaaaagaatatgtctttatgttgatgcttaagcttttggagttgttggttcctgatgtggtattagaggttctttga

SEQ ID NO: 99493 - DNA, 673 bp, Glycine max
  Peptide Sequence Number=SeqID_216271
atgtggttgtccaaattaatagatctctacttttatctgggatatgactcaaaagcatcttctttcgacaatgtttgggaatctctggcagtcttaattgttatgcaactttatagctatgagaggaggaagaacaagcagaacaggcaggatcacttggatcagttagaaccaggggcacttgggtttatcaggcgatttattatctggcacagccagaagatcttgttcattgctctgttttatgcatctttaaactcaattagtgcatttggtttcttgtatctggttggcctcatcttctgctccattttaccaaaaacttctagtatcccatccaaatcattcttagcatacacaggttttttggtgacagctgagtatgtttttcagatgtggggtaagcaggctaaaatgtttcctgggcagaagtattctgatatatctctctttttgggtttccacgtattccagcctggcttttggggtctagaatctggattgaggggaaaagtgctagtgattgtggcttgtactcttcaatacaatgtcttccgttggctggagaggatgccaaatacagttctaagcaaaggacagtgggaagaaccttgtcctttgtttgttcccacagaagatgtattcattgatgatgctatgtgcaatgaggaaa

SEQ ID NO: 99494 - DNA, 312 bp, Glycine max
  Peptide Sequence Number=SeqID_216272
atgggggggggggggagtattttcttagctggattgcttctggaggagctgggcggcaacctcctccccttttttcctataaataggctgaggggggctgttctaagggtcccggatccccctggtgatgtatttcagttgttttgggtgaaaaaaaattgtttccgtgaagaaaatccaagccgaggtgcttccgtaatgtttccgagatgtttctgtaagcaaatccgtgaaggttttcctccgttattcaccgttcttcatccgttcttcgttcttcaacgggtaagtttccaaatccgagacttttaa

SEQ ID NO: 99495 - DNA, 528 bp, Glycine max
  Peptide Sequence Number=SeqID_216273
atggggaaatttctcgccggtttcgtgctgccttcgctgcttctgtcagctgctttaatcaattggagtttgatctctctcattgatttgatagcatttcttctcatcctgtacaatgtatcacaattaggatttcatatccacaggaggtttttgttactgtggcctattgttatcttttctgtagttgcaatactttctcaagtaacttatctggtaatatgggctgttaagccaatgccatggagtacaccagatgcttcgtgggcaaagttgattgggtttatgatagttcagacttggaagtctccttatgtaatttatttcctggtcatacaactgctagctcttcttgttgctttggttgatatatacgggaagagagattttctgaaaacatggcaagatccatcttggggtcatttcatatcaattatggaacatttagtcttttcattgctatgtgtgtttatttcctatgcaccaggtgtagacatgcaatatgaaatgtccactgttggcatatga

SEQ ID NO: 99496 - DNA, 546 bp, Glycine max
  Peptide Sequence Number=SeqID_216274
atgtcggtgctttcttcttttcatgcggtgcatgcagtggattcaaggccgtgttccggctggttaccgctggtgagaaatatcagtgagattcctcaggataactacggtagggctggtctctctcacatgactgttgcaggttcattgttgcatggaatgaaagaggttgaagtatggcttcaaacattttcaccaggaacacacaccccaattcatagacattcctgtgaagaagttttcattgttctcaaagggagtggcactctttatcttgcatcagattcacatggaagataccctggaaagccacaggagcacttcatctttccaaatagcacatttcatattcctgttaatgatgctcatcagctttggaacaccaatgagcacgaggacttacaggtgcttgtcataatatctcgtcctccagttaaagtgtttgtatacgaggactggtccgtgcctcacactgcagcgaaagtgaaattcccctactactgggatgagcaatgttatcaagaacctccaaaagatgaattatga

SEQ ID NO: 99497 - DNA, 255 bp, Glycine max
  Peptide Sequence Number=SeqID_216275
atgcatacatgcgcatgcacaggcatatcttgtgatagcaaggagcagaatcgtctcagaccacggtcagaagtcaagacaagtcaatggcagaaatcaaccaaggtacttagggagggaggcgaatggaggataggatcacgaccgaccaatcgtcaccccttcccggtgttgggtcagcggagaacgtcgctgcaaggcagcccagtatcctttgaattcgcagtattttactactattgtttgtttttttag

SEQ ID NO: 99498 - DNA, 144 bp, Glycine max
  Peptide Sequence Number=SeqID_216276
atgggtattgaggaagttcgagatgctgatgcttgcatccctatacccactaaagaggataaacaggtaccaaagggaccaatgaagcttgttgataggcctgataacgatcccatataccaaatgacattgatgatcccataa

SEQ ID NO: 99499 - DNA, 615 bp, Glycine max
  Peptide Sequence Number=SeqID_216277
atgactacaccaccgagtttccctcctcctgagtcagcaccttcactgtctatgttgaagaggactagaaaagtcacacaacttagatcattgtctgtcagacccgcgggggtggagagaccattggttcatatggatcctaccactgggaaagctgatggtccccataaaaagaaaataaggacttatttgggagtcattgcttgggacaagtctgatttgacctccaaatgggctctagcagaaggcaagaagggcgatgatgacaaagtttgtgaaaagtacggatttagcaaagaaaagtggaaccaattttgtcaaagccataaagacccttcatgggaggatgttagaaagaatgcgcaatccatccagaaacaaagcacaatccctcacatgttgtctcatgaggagcaccctgaccatgtccgtgctactggagccggtgtgacaatcaggcaatactttggaccatcttcagcaggctcccacacattgcttgtgtcagcagaaagggaagctgtgttgacctctcagggttggacccatacatggctacatcaaataggcatgggtcgtatgttgatgacaatcctcccccctggttgcccttag

SEQ ID NO: 99500 - DNA, 333 bp, Glycine max
  Peptide Sequence Number=SeqID_216278
atggatgcagaattcatggagagatgtatacctaggagccttgttgaatgggacaatgttgtcacctggttatgttccttgcgcaataatctcaacaactacttgaaaggaatgattaatagtgctttgaagggattcaacgataatgacggaagtaaatccaaggcaactgctaaatggattccaattaaaaatcaccaaaaaagggcagggggtgtacttagtaaaaatgggggtgcaaatagcaaccacgcccacttggaccctccagaagatttctccagaaggctgttgcttctggaggaagcaaccctgctcgcctgggcgagttga

SEQ ID NO: 99501 - DNA, 2496 bp, Glycine max
  Peptide Sequence Number=SeqID_216279
atggcctcttcaacttttcttcattcctattctctgcttcttctaattattctcccctttctcccatctgtgtttagtgctacttcttcaaactgcagtgctaatagtatacacttaaattccactctggtcaccaatcacacatggaattcaccctctggcctctttgcctttggttttcaaaatgttttatccaacaaggaattcatgtccgtgcttgcagtttggtttcccaaagacccccaccgaaccatagtatggtatgcaaaatacaaacaaacttcagatcttggtacgatgcacgctgtttccagtatgcaaaaaagtcttgcttttccttcagattccacagtgaagctaacaaacaaaggaattgtattgtatgaccaaaatggccaagagatgtggcaccgtccaaaaaacaacagcattgccttagtaagatgtgcttctatgttagacagtggaaattttgtgcttctggatgaaactggcaaacacgtttgggagagctttgaagagcccacagatacctttttgcctggtcagattctggctaagcctaaaagcttcagagcccgtcattctaacacaagtttttatgatgggagtttcgaactcgcttggcagagcgattacaatttcgttctttactattcaccacaatcaagcgttacacgtgaagcttactgggccactcaaactaacagctatgatgaatctctgctcgtcttcaatgagtctggacacatgtacataaaaagaagtaacacgggtaaagtgatccgtgaagtcttatatggtggatcagaagagttcttgtacatggctagaattgatcctgatgggcttttcagactatatcgacaccgcaaagatgatgacacaattgctgatagctgcagttcgggatggtggagtgtggtggatcgatatccgaaagatatttgcctttccatcacgatgcaaactgggaatgctatctgcggttataacagctactgcattaccatcaacgggaatcctagttgtgagtgcccggatattttttcttctttcgatcatgacaataatctcaaaacttgtagaccagattttccactgcccagctgcaacaaagacgggtgggagcagaataaggatcttgtagatttcaaagagtatcaaaatttggactggcctctctctgattatgacaagctggttggaactgcaatggacaaagatatgtgtagacaaaagtgcctagaagattgcttttgtgctgtggccatatatggtgagggacaatgttggaagaagaagtatcctttgagcaatggaaggaagcaccctaatgttactagaatagctcttgtcaagatacctaaaacaggtttaaacaaggatgggactgggagtcttgggaatgggagagaacagtctacaattgttcttgtcatatcaatactccttggaagctcagtgttcctcaatgtcattctattagttgctttgtttgctgccttttacattttctaccacaagaagcttttgaatagtccaaacttgtcagctgccacaataaggtactatacgtacaaggagcttgaagaagcaactacagggttcaaacaaatgttgggtcgcggtgcttttggaacagtctataaaggggtgttgaaatcagacacaagcaggtatgttgctgtgaagaggctagataaggtggtgcaagaaggtgagaaggagttcaaaacagaagttagtgtgattggacaaacccaccacagaaacttggttcgtttacttggttactgtgatgaagaggagcatcgtcttctggtgtatgagtacatgaacaatggctccttggcttgctttctctttgggatctcaaggcctcattggaaccaaagagtgcaaattgctttggggattgcaagaggtctcacatatttgcatgaagaatgcagcactcagatcattcattgtgacataaaacctcaaaatatactcttagacgagttgttcacgcctaggattgctgattttgggttggctaagttgttgctggctgaacaatctaaagctactaagacgggtttgagagggactgttggttactttgcacctgagtggtttaggaaagcttcaatcacaaccaaagtagatgtttacagctttggagtggtgctgttagagatcatatgttgcaagtcaagtgtttcctttgcaatggctagtgaagaagagacacttatagattgggcgtatcgttgttatagccaagggaaggtagctaagttggtagaaaatgatgaggaggcaaagaaagacataaagagggtggaaaagcatgtgatggtagcaatttggtgcattcaagaggatccttcgctgagaccctccatgaagaaagttacgcaaatgcttgagggtgtgacaacagtttctttgccacctcgccctgccatattcagttcatcatcgtttgaaacatcatttactttgtaa

SEQ ID NO: 99502 - DNA, 393 bp, Glycine max
  Peptide Sequence Number=SeqID_216280
atgtggaagttaggagagaaagcacaaaggcaaggagggtggcgaatgaagccctttatgcctaaaacgcgttgtgacaatagaacctggaaatgcaacaaaaggccaaccaagcccaagcaactctccaggctcaagcggaaaatctcaggcatttggagggggaagtcgcagtggagtagtcaagggatttcaacccttcatgacggccatgttgaacacggaagtgaaccttttgatcccaaggataccactattcaacgtggattttcggacaactacatcgcacgctttgaccatttttcttatgcttttgttgcacaatttgcggccaacaaggagaaaacactactgacggtcaaccttttcgatgtacctaagcagtcggggtaa

SEQ ID NO: 99503 - DNA, 1551 bp, Glycine max
  Peptide Sequence Number=SeqID_216281
atggtgatatttgcttcacagattcaaggtttggacttggttgtaatgattgcaggaactgatgatgaccttccaccaacccatcaaaatagaatttccaggggaggaggaggacgtctggctgggaatgggagatctgctgttgcttcaattccttacccaaggatgtacggtgaaattgatatggagacccaaattcatcagcttgagcaagaagcatacagttcagttctaagagcttttaaagctcaagccgatgccattacttgggagaaagaaagtttgattacagagctgagaaaagaacttagattgtcaaatgaggagcacagagaacttctaggtcgggttaatgcagatgatgtgatacggaggataagggaatggagacaggcaggtggccatcagcctggtgtacttagtactggtcaaggtcttcatgattcaattcccagtcccacagtctctgcttctcgcaaaaagcagaagattacaccatctgtaccaccatcacgatcttttggtgggccttctcctccttttcacccccaaacagtgactgcgccccaccaaccatcttcttctgcagcgaaacgaggatctgctcctgggtcaaagggaaagaagcacaaacctggtcaaatattacctggtgtctcttcaatgaagcagtatccttcatcaggaccaggtggaaggaatcaagtatctaatagagctgtcatgggtgagcatgctgagggagcatcatttgattcgttggttggtaggagagtgcggacaaggtggcctgacgacaataacttctatgaagctgttatcacgaactacaatccagccgatggacgacataatttggtctatgacatggggagtgcaaatgaaacatgggaatgggttaatctatcagagtttgtgataaagtgtagtgaagtttctatttcattgtttgggaagtggatgggaatgatatctcctgaagatattcagtgggtaggtgaggatcctggaatcaatcatcgtgggggttttgggggccctggtcatgggatgaataggtctgttggacgagatggtgttccaggagctggaagaggtagaggagctgcaaaggggcaatccagaaaagattttttgtcatcacaaaatggcctaggaaagaaggtgcatgatgatatacaaatacttcacacagacacactaatcaaggaggtggagagggtattcagtgcaaatcaccctgatccccttgaagttgagaaagcaaagaaagtattgaaggatcatgagcaggctcttattgatgcaattgcaaaacttaatgatctttctgacggtgaaagtggtacatctcagtttcagtatctcattgcactgtgtggagttgtcgactccaaaattgctacagtgatcttgtttgtaggaatttggggttgtaacaaccttgcctatgtggcaaggagggtaggaaagacaggaaactgtagaagcaaaaacaaaaatggaggaaaaaccggaaacgtagggggagaacatccatccgatgattag

SEQ ID NO: 99504 - DNA, 1110 bp, Glycine max
  Peptide Sequence Number=SeqID_216282
gaccgtattaggcgccttgaagcgataacttccagaaccaggcagtattcgagttggccgctgtttcacactccaatccaaataaccaactctactggacaaaccagcgcgctagctgatgctcgtgaagaagaaatgccgagccgggaagttgaggaaagagtcgttgaaagtgggagagggttcaaaaggaaaggtgcccatttagtagctaaggcattggggaggattgaaacagatgccaataaggaagggggaagcactggaaatttctatgattgcaatatatgtttagacagggcaagagatcctgtgttgacctgctgtggtcatttgttttgttggccatgcttctatcaggtgcaaattgtctattcaaatgcaagggaatgccctgtttgtaaaggagaggtcactgaaactggcatttttccgatttatggcaattcaagtgccgatggcagttgtgagtcaggattgaaaggagctggtttgagaattcctcctcgacccgctgcacccagaattgagagttttaggcagcagctaataagtcagggagcatcttcttctgtaatcctaaatatccggcggtttcatcaccttattggtgggttaggagctcgagttcagtcacaaaaccccaatgctgcaactgataggaataatggtttgctcgctcaatctcgcccgccatcaagcaatgatcgaggtactggttcctctcagactccaatttcaaccttgttagtgcaaggagctgcttcattttcatccctttcatcagcattaaattctgcgatggattctgctgaaagattagttgaggaccttgagtcatattttcataatcaccagacaaatggtgtcaatacaagttcaactcataatgggaatgttgctgcaactgattccacacctgcagcttctacatctccttttagtaggaatgttgacaccactgctaatattggctcagaaattcagacaacagataataacatacagactgagactagtacattggacccttcttcatctcgcagaggaagcactcgtgtttcaacttcaagacaagttacaaatgatcgcagaaggaggtcaagatga

SEQ ID NO: 99505 - DNA, 4185 bp, Glycine max
  Peptide Sequence Number=SeqID_216283
atggctattagtgggtatgcaccaatgttctcagatttcagctacgatgtttttctaagttttagtggtggaaccagcaacccttttgttgatcctctctgtcgagctttgcgtgacaaaggaatcagcatcttcagatcagaagatggagaaactagacctgccattgaggaaattgaaaaatccaaaatggtaatcgttgtgttttgtcaaaactatgcattttccactgagtctcttgatgaacttgtcaagatccgagagtatgttgacaatagaagaaaacaggtttggacaattttttacatagtggaaccatcagatgtacggaaacaaagaaattcttacaaagatgccatgaatggtcatgaaatgacatatggaaaagactcggagaaggtaaaagcatggagggaagctttgactagagtatgcgacctaagcggaatacattgcaaggaccatatgtttgaagctgaacttcagaagattgttgaagctgcatcctgtaaattatttcgtgtgcctggacaaatgaaccatgcagttggacttgatgatcactttgaacaggtgaaagcattcatagatgttgagtccaatgataaggttggcgtattgggaatttatggaggtggtggaataggcaagaccacatttgccgtctatctatatgaaaagattagacattattattttgaagctgcaagttttctgattaaagtcagagaacaatcaaaggaaagcaagaatcacttggaagatctccaaaacagacttctatctcaactgggtgtagacacaggaaccatgatagggagtacgaataaaggagaacttgaaatcaaacacaggcttggccatagaagagttcttctagttttggatgatgttgattcaaaagaacaattggagttactggctggaaaacatgattggtttggttctggcagtaggatcattataacaacaagagatgaagcggtgctagattatggtgttaaagttaagaaatataaaatgacggagctaaatgatcgtcactctcttgaactcttctgtcagaatgcctttgataagcctgaacctgcaaaaaactttgaaagtatttctcatcgtgcaataggctatgcaaagggtgtccctttggctttacaagtaataggatccaatttgaaaggaagaagcatagaggaatgggaaatcgaattgggaaaatatcggaaggttccaaatgctaagattcaaggtgtactaaaactaagcttcgatagcctgcctgagacagagatgggaatattcttggacattgcttgttttttcaaaggggagaaatggaattatgttaaaaggatattgaaggcttctgatataagttttaaagtacttgctagcaaatgtctaataatggttgatagaaatgactgcttggagatgcatgatctaatacaggacatgggtagagagattgttaggaatcaatcgccatcaaaccctggtgaccgtagtagattatggtctcacgaagatgttcttgaagtactgaaaaaagattcagtaacaatcctcctttctcccatcattgtttcaattacttttactacgactaagggaagtataacaattgaaggaattatgcttcatcctcctaagcttgaagtagtagataaatggactgatactgcctttgagaagatgaagaatctcagaattcttattgttcggaataccaaatttttaacaggacctagttctctaccgaataaattacaacttcttgattggataggattcccatcagagtcttttccacctaaatttgatcccaagaatattgttgacttcaagttatctcatagttctctggtatccataaagccacctcaaaaggtatttcagaatttgacttttgtcaatctctcccagtgtcatttcataactaaaatacctgacatgtttgaagctaaaaacttgagagtactgacaattgacaaatgccccaaattggaagggtttcatccatctgctggacatatgcctaaccttgtatatttaagtgcatcagagtgcaccatgctcacgagttttgtgccaaaaatgaatctgccatatctggaaatgctttcatttaacttttgcagtaaacttcaagaattcccagaagtaggggggaagatggataagccattaaagattcacatgataaatactgctattgagaagtttccaaagtccatttgtaaagttacagggcttgagtatgttgacatgacaacttgcagggaactcaaagatttatcaagttttgtgtcattgccaaaacttgtcacattaaagatgaatggatgttcgcaacttgcagaatcatttaaaatgttcagaaagagccattctgaagcaaatagctgtccaagtttaaaggcattatatttaagcaaggctaatctgtcacatgaggatctttccataattcttgaaatatttccaaaattggaatacttaaatgtgtcccacaatgaatttgaatcactcccagattgcatcaaaggatcattgcagttgaaaaaacttaatttaagtttttgcaggaatcttaaggaaattccagaacttccatcaagtattcaaagggtagatgcaagatactgtcaatccttaagtacaaagtcatcaagcgtgctgttgtctaagatttataaagaaagggaaaaaatacaagttgtgatgccagaaactgaaattccaaaggagtttgacagtaaagatgtcctgcttttctgggctcgccggaagttccctgttgttgcttttgtttttgttttcgaggaagtaaaaaagaatgatgatatacagatggatacctcagaattgtttcctggagttgtatcagctgaggagtcctacactgttggcctgaacttgtttatagacggcaaagaaatatgtcgcaaagatcatcattattggagtattggggatcaacatttgttagtatgtgatctacaggttttgtttaaaaatgaagagtggcaggatcttggagatgactggaaggcctttcagattcaatgtgaatcaacgttgactctgagtcatcaggaagtttatgtggacaagcagaaaacaaacactgatgatattcaatatatctctcccaatttaacaggtttggttccaaaaacaagtccacataagaaaacaagacatggacaaaattgtgatgtaatagaaaaatttggccagaacttgttaatacaaactacctctgttgccaacgtgttattgagctggtggaggaatgccaaggctgatattagaggggaagtttcagcctctacctatgaggcaagttcactgcaagaacatgaagatgttgtctgggatgtggcacagattttggagatgctgctggagaatttgccccagcatattactgattcagaagttcaaagaacaggcctattggcggttgaatcattgattgcacgggcacaacataagaaggaatacggtcatgagaagttgcacatcaatctaaccatgcctattgttctagtggaatgtagatgtcaccctcataaagaattagaaggagctcaaaaccttcgctattggggatctgtggagctagaagaaggagacccacgtgtgtggaaaatttggaagagcaatgaagccttcaaggagaggctaaattacacagttctgttgaaatgtgagcatcactctagagaggaagcttcaaaatctgaccatggggaatccttggaggaagaacacaagggttctgaattacaagcattgatgaggaggatagaagaagacactataaggttgaataagtcttatggaaagttgaaggcatctattgttccaatggatgttctagtttctgacaaatatcttctggaaacggcaatcattagaggactagaaagattgggaaggttggggtctaatttcaacaagacagaatatggaaaattgagggtggagcatcatgctcatagcattactcatatggagcatgagttgaggatggagcaggatgctcagagctctactcagaatcaggagcggcatgagttgggggtggagcatgatgctcagagctctactcaggaaaagaataagttgggttggatcagatcattactaggtggatttgggaggcaaagcaggtga

SEQ ID NO: 99506 - DNA, 1668 bp, Glycine max
  Peptide Sequence Number=SeqID_216284
atggccaagtccaagaacaatgccaagaagttgtcctacatctcagttccatctcagatcatcaactccatctcatcttcatctcttcaatctctgcttgaatctcccaagaagtgtgcaaggcactccaaattcttcacctttgtcaagtgcatgaggccaagactcttcttccttttcaccctctttttccttgctttctttgccatgctcaagtttggcctcaatcttgacaccccttttcctccattcccatgtgcaccctcaataggccccacaaaatccaatcttggagctttggatggtggtgatgttagtgtttcagaggctatgattagcagtgtgcagttacatggtgcacaggttccaagtggggtggttgaagataagagtgagttttgggagcagccagatgggttggggtacaagccttgcttggatttcagtagggagtataggagggagagtgaaggggttgtgatgaacaggaggaggtacctcatggtggtggtttctggagggatgaatcagcagaggaatcagattgttgatgctgttgtcattgctaggattcttggggcttctttggttgtccccatattgcaagtcaatgtcatttggggagatgaaagtgaatttgctgatatattcgatttggagcacttcaagagtgttcttgtcaatgatgtgcgggtggtttctgcattaccatcaacacacctaatgacaaggccagtggaggggagccctctccctcatgccactcccagttggattcggtcacactatctcagaagattcaacagagaaggtgtcttgcttttacgtggattggattcgaggctaacaaaggatcttcctcccgatcttcagaagcttcgatgcaaggttgcttttcaggcattaaggtttgcaaagcctgttcaggaactcggtaacgatattgctgagcaaatgaaaagcaagggaccctaccttgctcttcatctacggatggaaaaggatgtctgggtgagaactggttgtctacccggtttgagtcctgagtatgatgagattgttaacaacgagaggataaaacggcctgaactcttgacagcaaaatcaaacatgacttaccatggaaggaaactggctggcctctgccccttgaatgctttggaggttacaaggctgcttaaaggtctaggtgctccaaaaaatgcaagaatttattgggctggaggacaaccactgggtggaaaagaggccttacaaccattaatcaatgagtttccacatctttacagtaaggaagatcttgctttgcctggagagctagaaccatttgcaaataaagcttctctaatggctgccatagattacatagtctctgagaagagtgatgttttcatgccatctcatggaggcaatatgggccatgcacttcagggtcaccgggcctatgcgggacacaagaaatatataacaccaaacaaaagacagatgctcccctattttctaaattcttccctccctgaaaaagagttcaataggattatcaaggaattgcatcaggattcattaggtcagccagaactcaggactagcaagtctgggagggatgtcaccaagtatcctgttcctgagtgcatgtgcaatgatgactctcatcatcattcttcctaa

SEQ ID NO: 99507 - DNA, 3078 bp, Glycine max
  Peptide Sequence Number=SeqID_216285
atgataaagcagccaacaccatccttgtgttccttcacatgtggatggacttatgatgtgttcctcagttttagtggcatagatactcgccatagtttcacggacaatctctacaattctcttaaacaaaggggaatccatgctttcattgacgatgaagggcttagaagaggggaggaaattacaccaactcttctcaaagccatccgagaatctaggatcggcatcattgttttctccaagagctatgcatcctcaacatattgtttggatgaacttgttgagatccttgagtgcttaaaggttgaaggtcgattggtttggccggttttttatgatgtggatccgtcacaagttcggtatcagactgggacttatgcagaagctttggcaaagcataaagaaaggtttcaagatgacaagggcaaggtgcaaaaatggaggaaggctttgcacgaagcagctaatctatcaggatggcatttccaacacgggtctgaatcagaatataagtttattaaaaagattgttgatgaggcctctaagaagatcaatcgcactcctttacatgttgctgataacccagttgggctagagtcttcagtgctagaagtgatgtctctcctaggatctgggtccgaggtcagcatggttggtatttatggtattggaggaataggtaagaccacagttgctcgtgctgcatataacatgattgctgatcaatttgaaggtttgtgttttcttgctgacattagagaaaaagccattagcaagcatcgtcttgtacaactccaagaaacactactttctgatatacttggggagaaggatatcaaagttggagatgtcagtagaggaattccgatcatagaaaggaggcttcgaaaaaagaaggtccttttgattttggatgatgttgacaaattggtgcagttacaggtacttgctggaggatactgttggtttggctctggcagcaagattataatcacaacaagagacaaaaagttgctagctactcatggggttgtaaaattgcatgaggttaaacagttaaatgatgaaaaagcttttgaattgtttagttggcatgcctttaaaagaaacaaatttgacccaagttatgtggatattttaaaccgtgcagttttttatgcatgtggccttccattggctttggaagtgataggttctcacttatttgggaaaagtttagatgaatgtaattctgcattagataaatatgaaagaattcctcatagagggatccatgatatacttaaagtgagttatgatggtttggaagaagatgaaaagggaattttccttgacattgcttgctttttcaatacttgtaatatgcggtttgtcaaacaaatgctacatgctcgtggttttcatgcagaagatggtattagagtgttgtctgacaaatctctcataaagattgatgagtctggttgtgtgaaaatgcatgacttaattcagcacatgggcagggaaattgtaaggcaagaatcaaaattaaagcctagaaaacgcagtagattgtggcttgatgaggatattgttcgtgttttggaagaaaataagggaactgataaaattgaagccattatgctcaatgtccgtgacaagaaagaagtgcagtggagtggaaaagccttcaagaaaatgaaaaacctcaaaattctggttattattgggcaagcaatcttttcttcaatcccccaacatctgccaaatagtttgagagtgctggaatggagttcttatccatcaccatctttaccacctgatttcaatcctaaagaacttgagatactcaacatgcctcagagttgcctagaattcttccaaccactcaaggcatgtatcagtttcaaagattttagtttcaataggtttgaatccttgatttcagttaattttgaagattgcaagttcctaactgaattacatagcctctgtgaagtaccattcctaagacatctttctcttgataactgcaccaatttaattaaagttcatgattctgttgggtttcttgacaatctcctcttcttgagtgctataggatgcactcagcttgaaattctagtaccctgcatcaagctggaatctctcgagtttctagatctcacggagtgctttcgtcttaaaagcttcccagaagtagtgggaaagatggataaaataaaagatgtttatttagacaagactgggataaccaaattgccacattcaattggaaatcttgttgggcttgaacgattgtacctgaggcaatgcacacagctttatcaactaccaattagtatccatatattgcctaatgttgaagtgataacagattatggtaagaggggatttcaattatttgaaggataccatgaagacaaagaaaaggtgagttcagaaaaatctccaagtgccatggttgactataatgaaggttcgtttatttaccttgatttgtgttttccatacataagcttccataatgtgatcgaagtatgtagtcccaatccacttgagtgtcataattttggtttcttgtttaaactgcttcaagctgggagcttgaattggtacaagccaggaagcaggacatcatcaatgcaattctggttccggaagaaattccccaagatagctctatgttttagtgtagaagcctacattaatagagccagttgggtgttggattttgagtttactttactcatcaatggcactaagcaattcagttcttcatgtaactacataacttgtaagtggaatccaattctttggtgtgatctacaatgcaaagaggagggggtattttctaagcatgaatggaatgaagttgagattttatgtgacgtcaaatacccgataccatgtggcgagagggttatggtcacagcaaggaacaaaattggaagtctaaactggtccctaatttatgtctatgaggagggaaacaatatggaggatgttgaattcaaaagttccatgctcagttttccattctttggtgtaaaacctatgtcctccttacctggttgcttgtattatcaagttgtataa

SEQ ID NO: 99508 - DNA, 471 bp, Glycine max
  Peptide Sequence Number=SeqID_216286
atggtcatgttcttcaactccttccatcttgctggacttccgccaccacaagaagttttggcactggctgcaaagcataaagggtatgaagtgaaggtatttgagaaggatgtaagtactttcagaggggaaggtaggcaccgtggcccaattcagcccttgagtggtgctcttgctgtgttggaagccattgaccagagtgttgcaaggcagataatggaggatggtagtgtcactgccaataggactaatggccttgctaatggtgtatctggggaccggtacaaggttttcttgggcttgaaccagtactttgttgcttcagatgttagccaagggaagaagaggcttttggatctctctttgagggatatatgtgacagaggcatgatcaacacttggggaattgggagagtgactttgttaggtgatgcggcacatccaatgcaacctaatcaaagcatcttctag

SEQ ID NO: 99509 - DNA, 4146 bp, Glycine max
  Peptide Sequence Number=SeqID_216287
atggcaaatctgaaccacggtgcaacattcagagatgatttcttctacgatgtttttctgagttttagaggtgggacccgttatgggttcacgaatcgtctctacaatgctttgcggcaaaagggaatatacactttcagagatactgaggagcttaggattggagcagacatcagacccgcgcttctgaaggcaatagaaaattcaagaatgtcaatggttgtgctctgtgaagactacgcgtcttctacttggtgtcttgatgaacttgccaagatcattcaatgctatcatgcaaataagcccaaacaagttctgctcatattttacaaagttcaaccttctgatgtgtgggaccagaaaaattcgtatgcaaaagccatggctgaccatgaaaacagattcgcaaaacaacccgagaaggtgaaaaattggagaaaagctttgtctcaactgcgccacctcaccagagaatattgcaaggatgacgggtacgaagctgaacttatcaagaagattgtgaaagacacctctgctaaattacctccaatccctttaccaattaaacatgtagttggactcgattctcggtttctagatgtgaaatcaatgatacatatcgagtctcatgataccgtcctcatcttagaaatttatggagctggtggaattggcaaaactacatttgccttggatatatataacaatattcgacatgaatttgaagctgcaagttttctcgctaatgtcagagaaaaatcaaacaaaagcactgaaggcctggaagatctccaaaagacacttctatctgagatgggtgaggaaacagaaattataggggccagtgaaatcaaacgcagacttggtcataaaaaggttcttttggttttggatgatgttgattcgacaaaacaattggagtccctagttggaggaggtgattggtttggttccagaagtaggatcattataacaacaagggatacaacattgctagatgagcatgtcattgatgatgttgtcattgaaacatatgaaatgaaggcgcttaattatggtgactctcttgagctcttttgttggcatgcttttaatatgagcaaacctgcagaaaactttgaaggtgtttctaatgatgcagtgcgttatgcaaaaggccatccgttagctttaaaagtaataggctccaatctaaagggtgggagcctaaaggattgggaaatggaattggaaaaatataaaatgattccaaatgccaagattcaagaagtacttgaaataagctaccacagcttagatgtcttggaccagaaaattttcttggacattgcttgtttcttcaagggagagagaaggggatatgttgaaaggatactaaaggcttgtgatttctgcccaagtattggagtatttactgcgaaatgtctcataactattgatgaagatggctgcttggatatgcatgatctaatacaagacatgggtagagagattgtcagaaaggagtcatcgataaatgctggtgaccgtagcagactttggtctcatgaggaagttcttcgagtacttatagaaaattcgggaagcaatagaattgaaggaataatgcttgatccccctagtcatgaaaaagtagatgataggatagatactgcctttgagaagatggagaacctaagaattctgatcattcggaatacaacattttcaacggcacctagttatctaccaaacactttgcgattacttgagtggaaagggtacccatccaagtcttttccaccagatttttatcccaccaaaattgttgatttcaagttaaatcatagttctctaatgttggaaaagtcatttaagaaatatgagggattgacattcatcaacctgtcccagtgtcaatccataactcgaattcctgatgtgtctggagctataaatttaaaagttttgacactcgataaatgccgtaaactgaaaggatttgataaatccattggctttatgcgtaaccttgtgtatgtaagtgctctaaggtgcaacatgctcaaaagtttcgtgccaagcatgagtttaccatctcttgaggtgctttcatttagcttttgcagcagacttgaacacttcccagacgtaatggaagagatggataggccgttaaagattcaattggtaaatactgcaattaaggaatttccaatgtctatcggcaaacttacagggcttgagtacttagacatttcaggttgcaaaaaacttaatatatcaagaaagttgttcttgttgccaaaacttgagaccttattagttgatggatgttcacatattggacaatcatttaaaaggttcaaagaaaggcattcaatggcaaatggttgcccaaatttgaggacactgcatctaagcgagacaaatttatcaaatgaagaattgtatgcaattctgaaaggttttccaagactggaagccttgaaggtttcgtataatgatttccactctctcccagaatgcatcaaagattctaagcaattaaaaagtcttgatgtgagttattgcaagaatctcagcagcattccagaactccctccaagtatccaaaaagtaaatgccagatattgtgggcgcttaacttcagaggcatcaaattcgctatggtctaaggtaaatgaagagaaggaaaggatacaatttgtgatggcagaaacagacattccagattggtttgagtttgattgtgttggtggatcagatagtcctactccgcttatgttggcacgcaataagttccctattattgctgtagcatttgcattgggcaaggccaaatctggctactctgaaacggagttatcccgcacccttggtctccacgtgttcgtaggcgacggctaccctaaaagggagttatcttacactgctgctgtccacttgtacataggcggcaaagaaatatgccgcaaagagtaccattattgttgtgttggggaggagcacgtgctattgtgtgatctaatggttttgttcagtgaccaagagtgggagggtcttgatgcacatttcactggagatgatgaatggagggtaattcaggttcaatgtgaatcagacttgccattgagtcaatggggagtatttgtgtacaagcagaaaacaaacactgatgatatcctatttacgaatacccgtcacaactgcttattgactaatttggttcagaaagaaactccatggaagtctgagcagagaagaagacacttcttcaataattttaacctgagagaaatttatggcgaccgtttgactctttatggtgagtcattagaccaatgccagctgttttcttcaaacatggtttttaggcacattctggccgacattatcaaagggaaactagtttcagcctgcgattatggggcaagtttaatgcaagctcacgatgaatctagcggcgatgtgaagcacactatgaagatttacaaggagcgtcttgatgacacacaagctacatatggacttatggaacttggactcgaggcacgcgaagaattgtcatgggcagaaggggaggatcggttagtcgtggaattcgctattatcctagaggaggaagatggaaatcgtcgctattggggaacattgaagttgaaagctggagaagcagggttcgatgaaatggagaggaaggaattgcaattcctttgtttgcgccgagcattcatgtcatacacaagtgcccaaaaggagtcaatgcttgttgttctgttgaaaagagaggaagcttcaacctctggccagggggaggaggagggagaatggcaagagtatgaccctatattggaagaattgatgtctgaaatagcggaagatgctacgaggttgagtaaatcttatgggaaattgaaggcgtctattgttccggttacgtcagataacttggtttctgacaaatattccttggaaggaatattcttgaatgcaatagtaaaactggaagatggaaaatggggaccaacaaaaatacaattgggatacgcggtgattagaatgttaatttgcggacagtgcccaccgggattgtttggaactaaggaactcgatttctctggagatgtaatgacagatctagccgctcaaacatcaccttcttga

SEQ ID NO: 99510 - DNA, 1440 bp, Glycine max
  Peptide Sequence Number=SeqID_216288
atgtgggttaaggttgtttttattctccttgcagcactttctctatttcactcagcagcagcttctcttaatcgtagcagtttcccagcagatttcttctttggaacagcttcttcagcttaccaggttggatcttatttgcatttctgggttctgtgtacttgggatatgaagtatgaaggtgcagcacgtgaaggtggcaagggacctagtatatgggacaccttcactcatagccacccagacagaatatcagaccacagtaatggggatgttgccattgattcataccaccgctacaagggaggagttaaccgagaaggcatcacatattacaacaatctcataaatgaactgatagcaaatggacaacagccctttataactctatttcactctgatttccctcaagctcttgaagatgaatatggtggttttctaagtcccaaaattgagcaagattttgcaaattatgcagaagtatgctttagggaatttggtgacagggttaagcactggattacattaaatgagccagtgctatatagcactggaggttatgcaagtggtggatccccacccaatagatgctccaagtggtttgctaactgcaccgctggtgattctactactgagccctatgtggttacacaccacctcatacttgctcatgctgcagcggtaaaagtctacagggagaagttccaggcttctcagaagggtcaaattggggtaacacttaattctgcctgggttgtgccactttctcaatcaaaagaggacagagaagccgcatatcgcggtcttgcttttatgtatgactggttcatggaaccactttactcgggaacatatcctgctgtaatggttaacagagttggaggtcgtttgccaaagtttaccagaagggaatacttgatggttaaagggtcttatgattttataggattaaattattacacttcaacttatgcaactagttctccttgcccacgccaaaggccaactgcctttacagacgcttgtgttagatttactactgtgagaaatgggcttctcattggtccaaaggcagcctcagactggctctacgtctatccaccaggaattcaaggtctactagagtacactaaggagaaatttaacaacccaattatttacatcacagaaaatggaattgacgaggttaatgacgggaaaatgttacttaatgacagaacaaggattgattatatcagtcaccatcttttgtatcttcaaagggccataaggaatggagtgagggtgaaaggatactttgcatggtcattgttggacaattttgaatggaatgctgggtacagtcttcgctttgggctcgtgtatgtggattacaagaatggattgaaaagacaccgcaaaagatcagctttgtggttcaaaatatttcttcaccaatga

SEQ ID NO: 99511 - DNA, 1170 bp, Glycine max
  Peptide Sequence Number=SeqID_216289
atgacgacccgaatcgcgcccggtgtgggagccaatttgttgggtcaacatgccgccgagaggaatcaagatgccactgcttatgtcggaaatctcgaccctcagatatgtgaggagttactatgggagttgtttgttcaggctggtcctgtcgttaatgtctatgttcccaaggatagagtcaccaaccaacaccagggttatggtttcgttgaattccgcagtgaagaagatgctgactatgccatcaaggtgcttaacatgattaagctttatggcaaacccatccgtgtcaataagggaggctcgctatggcgtgcttatgtgacagaattctggcattctgcctttgataaccttggtgctaggtataatgcatcccaagataaaaagagcctggatgttggtgcaaatcttttcattggcaatcttgatcctgatgtagacgagaagctcttgtatgatactttcagtgcatttggagttattgttactaatccaaagatcatgagagatcctgagacaggaaattcccgtggttttggcttcattagctatgattcatttgaggcatctgattcagccattgaggcaatgaatggacaatatctttgcaatcgtcaaattacagtgtcatatgcttataagaaagacactaagggtgaacggcatggtaccccagcagaaagagttttggctgcaagtaatccaactacacagaagagcaggcctcatactttatttgccagtggacctccaacacttcccagtgctcctcaggctaatggggttgctccagtgcctccccgaccctttgttaatggggttgctcctgctgcaattcctaccctccgtccaccaccccctcaggctgctgcattccagcctatgccggtgcctggacaaccagcgtggcatcagcaacagccaggtcaaacaatgttatcacccgcgatgccaccacctcaaatccagcagttcaggccacctcaccctggtatgcagcagatgccaccacctccacaagctccacccaggcctcttcctccaccatcagtaatggcaagtcagccaccacctgtttggcgaccaccaccccctcagcagcagggtggacggcctttgccataccctcagtctgcaatgctgcctccaccacctccccagtaa

SEQ ID NO: 99512 - DNA, 325 bp, Glycine max
  Peptide Sequence Number=SeqID_216290
atggccaagctatggtccagaaccaacaaaatgcctcatgtcccatttctttcatcttctaaatttattgtagcttctgcagatttaaaagaagcatttgtcattttcaacattcagaactatcaacatgcaaagagatctaattctgcaaaagccaggatcaacaggaaacgtatcatgcaacagaagcgacatcctcatgctcagtcatcttcacaaccaacaatgaactgcacttccgaatatgatagttcgggctctaattttttaagtgcctatgaggattgccaatctccaactaatcatcttgtaatcaacaccgaag

SEQ ID NO: 99513 - DNA, 2949 bp, Glycine max
  Peptide Sequence Number=SeqID_216291
caagcacagaagaagcagaagtatattctgttgcagaagctcagtctatcagtgttgatatcgatcaagagccaaagaaagaaagcagagaagctgtcatagagacagtccaacaactaaacaagcaccaagttctccagccacaaattatttcaataaagagaagaccacaaggtactccatccaccatgcactcagttgatcctcaagttcaatctagccatcataaaaactataatcacaatgacaccaatcaacagccaaggatttcaataaagaggcgaccacaagcacaaggtactccattcacaatgcactcagttgatccacaagtccaacctagccatggtgaaagctacaatcataatgacaccaacatgcagccaaggatttcaattaagagacgaccacgaggaccaggtactccatctccaatgcactcctttaatccacaagtccatgctagccacaatgaaagctacaacaacctcatgggaaccaacccacaacagccaagaattttagtagagaaacaaccacagaatactccactcaccacacaccaagttagtccccaagtccctactagcaatgatgaaaactacaatctcagtgacaccaatgtgcagcagcttgacaagcggtggccaagtgatagagcttatggtagaagagggtgggtgagtggtagtgacagattcactagcacgtatgaccttgttgagcagatgttttatctgtatgttcgtgttgtgaaggcgaaagttcttcccccaagcaccatcacctcaagctgtgatccttatgtggaagtgaagctggggaactacaaaggaagaacaaagcactttgagaagaaattgaacccagagtggaaccaagtgtttgctttctccaaagatcgcattcagtcttctgttttagaagtcttcgtgaaagataaagcaatggtggggagggatgactatcttggaagggtagtttttgacctcaatgaggttccaacaagagttccaccagatagtccactagctcctcagtggtaccgacttgaggactggtgcgaagaaggcaaggtgaggggtgacattatgcttgcagtttggatgggaacacaagctgatgaggctttctctgaagcttggcattctgatgctgccactgtctatggggagggcgttttcaacatcagatcaaaggtttacatgtcaccaaaactgtggtatctcagagtcaatgtaatagaagctcaagatgtgataccgggtgacagaaaccgcctaccggaggtttttgtgaaagctcaagtgagctgccaagtgctgacaaccaagatatgccccagcagaacaaccaccccattctggaacgaagatttgatctttgtagcctgtgagccatttgaggagcaattaacaatcactgtggaggatcgtgtgcacccttcaaaagatgaggtactggggaagataagcctaccaatgaccctctttgagaagcgattagaccataggccggttcattcacgctggttcaatcttgagaaatttggttttggaatgctagaaggtgatagaagaaatgagctcaagttttcaagcaggattcacatgagaatttgccttgaaggtggataccatgtcttagatgagtccacattgtacactagtgatcaaaggccaacatcaagacagctatggaagcaacctattggaatacttgaagtgggcatcttaggtgcacaggggcttctcccaatgaagatgagggatggcagaggcagcacagatgcatactgtgttgccaagtatggtcagaaatgggtcagaaccagaacacttttggacactttcagtcctaaatggaacgaacaatacacatgggaggtctatgatccttgcacagtgataacattgggagtttttgacaactgccatttaggtggaggggaaaaagcccctggtggcagtgctgctagagattctcggattggaaaggtaagaataaggctatcaacacttgaagctaataggatttacaccaattctcaccctcttcttgttctacacccccatggagttaagaagatgggtgagcttcagttagcagtgaggttcacagcactctcactagccaacatggttcatatctatggccaacccttgctccccaagatgcattacttacatccattcacagttaaccaaatagacaacctcaggtaccaagccatgaacattgtagctgtgaggctaggccaagctgaaccgcctttgaggaaggaggtggtggagtacatgttggatgttgattctcatatgtggagtatgagaagaagcaaggctaacttcttccgcatcatgtcccttttctctggtatgatcacaatgggaaagtggtgcagtgatgtttgcctttggaagaaccacgttacatcagtcctggttcatattcttttcctgatactgatatggtacccggaattgatcctgccaaccatgtttctctatatgttcttgattggtctgtggaactacaggttccggcctagacacccgcctcacatggatactaaactctcatgggcagaagccattcaccccgacgaactcgatgaagagtttgacacatttcccacttcaagatcacatgacgttgtgagaatgaggtatgacaggcttagaactgtggcaggtaggattcagacagttgttggggacatagctacacaaggggagaggtttcagtctctactgagttggagagaccccagagcaaccagcctctttgtagtgtttagcttctgtgctgctgtggttctctatgcaactccattcagagtggtggctctggtgacaggtttatactttttgcggcatccaaagtttaggagcaagacgccttctataccaagtaatttcttcaagaggctcccagctagaacagata

SEQ ID NO: 99514 - DNA, 261 bp, Glycine max
  Peptide Sequence Number=SeqID_216292
atggactccacgccgtcttcggtgagcgctttgactcattggacaactgcattgatgccattgatgcacgtggattgtcatcatcaaaaagggggagattgtggaagcaatgctttccaagattattttgataatgccaaagactcaagtcaagaatcaagagtcaagcaagtttcaagaatcaaagagtcattcaatcaaagaaagtttcaagagtcaaagagtcgttcgtcgttcaatcaagattcaagactaaagtga

SEQ ID NO: 99515 - DNA, 165 bp, Glycine max
  Peptide Sequence Number=SeqID_216293
atgagaataaagatacacgaaacacaatgtggaccaccatgggtacgtagaacgaatcgaaaagcttggtttaagcaaaataggggagatgcttgccgcgcagctcgcccaggcgagccaggttgcttcctccagaagcaacagccttctggaggaatcttctag

SEQ ID NO: 99516 - DNA, 750 bp, Glycine max
  Peptide Sequence Number=SeqID_216294
atggcacatttgtgctttgcattggaagataataagagtattctcttatccctgcttggtcatgatgcttatgtaaaccaacaaagcactggttctggaggcgagggtggcttcaatcctttcgaacagatattccgtgatcatgattttgtcaagagcttcttccatcagaatattggtggagaggatgtcaagacttttattgaactatcttttatggaagcagtacaagggtgcaccaaaactttgacatttcaaacggatgtgctttgtaatgcttgtggtggcagtggtgttccacctggtactaggcctgaaacttgtaagcgatgtaaagggtcaggagtgttatttgtacaagctggcatattcagaatggagagtacttgtggtacctgcaagggaactggaaaaattgtatcgaattactgcaagtcttgcaggggtgcaaagattgtcaaaggaacgaagtcggtcaagttggatattatgcctgggatagacagcaacgagaccataaaggtttttagaagtggtggagcagatcctgatggagatcaccctggtgatctttatgttactatcaaggttagagaagaccctgtttttcgcagagaaggatctgatattcatgtagatgctgttttaagtatcactcaggcaattttggggggaactattcaagtccctactcttactggagatgttgtacttaaggttcgcccaggcacccaacctggtcagaaagtg

SEQ ID NO: 99517 - DNA, 681 bp, Glycine max
  Peptide Sequence Number=SeqID_216295
atggatccctcaaatccctacacgggggcaatgaaaggccccatgcataaccctcaaacgaacctaggggcagatcaaaataccctcaccttcagagggctacacgccctcacctttagaggacttcacgtcctcaccttcagagggttgcacgccttcaccttcagaggactacacgtccttgccttcagagggttgcacgccttcaccttcagaggactacacctcctcgccatcagaggactacacatccttgccttcagaggacttcacttcctccccttcagagggctacttgccctcgccttggtagggctacacgctctcaccttcagaggacttcacgtcctcaccttcagagggctacacgccttcgccttcagaggattgcacgttctcacctttagaggaccaaacatcctcatcttcaaaggactacacgtcctcatcttcagaggactacacaccctcaccttcaaaggactacacgtcctcgccttcagagggctacacgtccttgccttcagaggactacacgtcctcgccttcagaaggctgcacatcctcgccttcagaggactacatgtcctccacttcagaggactacacgtcctcgccttcagaggactacacattctcgccttcagagggctgcacatcctcgccttcagaggactacac

SEQ ID NO: 99518 - DNA, 309 bp, Glycine max
  Peptide Sequence Number=SeqID_216296
atgagtgagcataatctgcatgtttttgtttgttggatgtggagagtaactttgtggcgtaggatgctattagagatgttatcggatacgcgcgtgttttctaatgttaagtttgttaattgtgtagatccttttcatgagattaaggacccaatagattccaggtctcgtgggagtgggacagacaacacatctagtcgtggtggcacaggtcgttatggtggacgtggtggtgccaaccaattcagcaacaatggtatgcagatgatgggtgttgagctgatatgttgctctggaatgtatatttaa

SEQ ID NO: 99519 - DNA, 159 bp, Glycine max
  Peptide Sequence Number=SeqID_216297
atggctccacctaaagaaattgtgactgtcattgattactatggtcacatagtagacgacccagttctgggatcgggtcaaacatgttatatttcagcacaactactcgacaatgacgatctcagaggcgcgatggaaacaattctccagaatccataa

SEQ ID NO: 99520 - DNA, 246 bp, Glycine max
  Peptide Sequence Number=SeqID_216298
atgagcgatatcccagttgattcaataagttttacttggatagtggacaatgcgataatcttcatagttatgcattgttcacattttgaatctgacagtaattatcagcgaccgatgaaggcagcaaagagttatgagtataggcttggagttgtactgctagaactcttcacgggaaaggaagctatattcaagtatgggaggcaccacattaagtgtggtggactttgcggtgcagtgccctaa

SEQ ID NO: 99521 - DNA, 896 bp, Glycine max
  Peptide Sequence Number=SeqID_216299
atggtccctcccccaatgctcgtctccgactccttcgccaaggacgccatcctcgcctggttccgcggcgagttcgctgccgccaacgccatcatcgacgccctctgcgcccacctctccgcctcctccgcccacgattacgacgccgtcttcaccgccatccaccgccgcaggctcaactggatccccgtcctccagatgcagaagtaccactccatcgccgacgtcacgctcgagctcgccagactcgccgacagaaaccacaactctgccgccgccgaacacgaaaccgacgacaaaacgacgccgtcggagagtgtcggaaatggtggtggcggtgacgaacacgaggagtatgagtcccccgagagcgagattactgattcaggatctcaagaaatgcaggctagtcccatgaacgttaatatatgttccaatcatgaagagtgtgaaggacgttcttcacagtttaagttgacaaaaggcttcgcagcaaaagagtcagtgaagggacatatggcaagattgaagttatatgaggacattttcactgattcagaactgtgcaagctaacagattttgtgaatgagatccatgctgctggccagaatggggaactgtcaggcaatatagagccaattccagtacttctccaaggtgtcattgatcaccttattcagtggcaattacttcccgagtacaaaagaccaaatggttgtatcatcaacttctttgaaaagggggagttttctcagccattcctgaaaccaccgcatctggatcaacctgtgtccacacttcttctctctgaatcagctatggcttttgggcgtatacttatgagtgaaaatgatgggaactacaaggggccactcacgctctcactgaagcaggg

SEQ ID NO: 99522 - DNA, 135 bp, Glycine max
  Peptide Sequence Number=SeqID_216300
atggcgacatatggtgactttctagcctcgcctgtgtcttttgtttgtggctacccaaccgcatgcactcatgctgttttcttgagccagccattaaatggagccacttctatatcagcttggctaggcttatag

SEQ ID NO: 99523 - DNA, 216 bp, Glycine max
  Peptide Sequence Number=SeqID_216301
atggagattttcaaccatggagatgcagcggaagataaaggaaaagagaggaatattccaaggatatgtcaaaggcagcttagaatattccaagaatatgccaaaggcatcttagaatattccaagaatatgccaaaggaatattctaaggatatgccaaaggaatattctaagaatatgccaaaggggggaaaactacatacacccctccaatag

SEQ ID NO: 99524 - DNA, 357 bp, Glycine max
  Peptide Sequence Number=SeqID_216302
atggtctcagaaatataccctgaggttcatgagaaccctagggtcttctttagcaactctagctcaatcctcttggagcctcttgctcatggctctggtgactggtcccttcctaggggggatttcatcaagaagggcaatgtgtctaccaagaggttagggataagagaagccacaaaaaagaaggaaaaggataaggtcatttcctctcctactactgaaggttttgtttcagagatggagaatgagaaagttggagatcataatcaagacattcatccttctgagggtgcgaaggctgttaaagctcagaacaatgcgagttttgagccagttcaagaggatctcaatgtatag

SEQ ID NO: 99525 - DNA, 495 bp, Glycine max
  Peptide Sequence Number=SeqID_216303
atggcattgcttccacagaaagaagaagaagaggaggaggaagagccttttgagaaggtagaaaaggttgaagttgttgtagaaactgctcataatgtactagaggttacgggtggtgggagaacccttgttgggtatgtaaaggattccttgttcaacaccaaaaatatgcagaatctctttaactctcccatctttgacacttcagtcaaaattgcatgtggcattgatcccttacatggtgaaccctcaaccttgtccatttcattccctcatgagttagctactacaaaaccttctatggttcaggaggaggttcattttattcatatttcctctcctcaacctgttgttgaaccttctacaagagaactgatgcaatcctacctcccaagggcattggatagaagactccaagaagattgggccaaagatgcaggagaaggccctagggttatcatgagccttagggtagattttggacccatgggctaa

SEQ ID NO: 99526 - DNA, 615 bp, Glycine max
  Peptide Sequence Number=SeqID_216304
atgaaagatcacacctcgtatctaagacctttcacgggcaaggaaagcccttcgagcgttgaaaggattggtgaaactcaagcactcttacgtgtacaggcccaaatccatgctggtcgggcccaaattttgcactccccctcttccattgcccacctccatggtccagcaacaccggacaaatttgaaatccccatcagatccgagagcatgaaaaatgatcagtactcgtcaccactactcaagagaaacagctctaaatcccgtgtacagattaatggcagcaatcgagagagatgtagtatggatgaagagagaagtgtgaggatcatggactctggtgtgaggaaaccagcaggtagtggtatgaagatcattgactctggttgctcccatggagattccttccattataaagcaaccatagaattcggaatactcagttcgagaacgcacattgacgatgagtatgcttatgctgtggaaaaggatcctaaaattttgctgacttgggatcctagtgctcctcttcaacagtttgttaaggagttgagttttgtgtttcccaatgtgcaaaggatgaatcgcggtggtcaggttggtgcctttacttaa

SEQ ID NO: 99527 - DNA, 462 bp, Glycine max
  Peptide Sequence Number=SeqID_216305
atgggtgaccaagaggaggtacaggaacagatgagagccgacatgtcggctttgaaagagcaaatggcttccatgatggatgccatgctaggaatgaggcaactaatggagaaaaacgcggccatcactgccattgttagttcggctgccgaagcagacccaactctcccagctatcgcgcaccacccagacgtggtaggacaagaaagaagcatactggggaacatcagcaacccccatctgggatacaaccgagtggcttacccttatggattgccacttaattacacaccaacagtcatacgtgatgacgcgggtcgtgtccctccccctatccttgaaggggaacctcctcgacagtcggacaaggtccacgaggattgttgggagcttgcccaaggagacatcgattcccactccatgttccccgccaaggggccggcgcccaatgcactaccttag

SEQ ID NO: 99528 - DNA, 558 bp, Glycine max
  Peptide Sequence Number=SeqID_216306
atggtgagtttccttctatattctgcttctgcacagccacatcacactaaaaaaattcactttttttgcgtttggtcacatgatcagtcaggtagaaaagaaacggttctggacttggcaaagtttgttgacaaaggggttcaagttaagctcacaggtggcagacaaggaactctgaaaggatatgaccagttacttaatcttgtcctggatgaagctgttgaatttctaagaggttggctcagccattgggaaaaatggaagcttatgctggaaccagaattcctcaccacagtcaggatgcttgataaagggtgtagtgatgccaacatgtgtgcctctttacttcttggaataaagactatactcaatatggacagggatgttcaatggtgtcatgtggttagagaaagtaactcttttgctcatggtcatgccaaatgtgggctcagagttaatgatgatctagttgtatttcatagtctacctccttcgatttctgttgctttcaatgcagacgtaatgaaaactcttatggatggagttgttaggatgtag

SEQ ID NO: 99529 - DNA, 621 bp, Glycine max
  Peptide Sequence Number=SeqID_216307
atggcattgaaacagctttccctccttgtcatgcttttctctttaggagtggatgcaacagttcttactttacaaaataaatgtagggacatagtgtggcctggaatcctaacaggagcaggaagacctgaactcattgatgatggggctgagctaacacctggtaaggcaataaacatcactgcaccaaaagggtggtccggccgcatctgggggcggcgtggatgcaccttccatagctatggcagtggcacatgcatcacaggagactgtggaggcaagctgaagtgtgatggagttggtggtgcaccaccagcttcactggcagagtttacactagacagccaggaggggggtttttatgatgttagccttgttaatggttacaatttgccagtgtcaatcttccctaccggaggatccgggcagtgtaaggcggtaacatgccagtcagatttgaacagaaactgccccaacggattggaggtgacttcagtaacccgaggaagtgtcagccaacaagctattccaaggtgttcaaggcttcgtgtcctcaggcttatagctatgcctatgatgatgcaaccagcactttcacttgccaaggagcaaactacttaa

SEQ ID NO: 99530 - DNA, 255 bp, Glycine max
  Peptide Sequence Number=SeqID_216308
atgtgtttaaagttgatcagggaagattcctcagcaataattgggaagaactacctttttgtctactttattaatatgtcctttaacgacctcttaggtcctacacagcaaaataagcagttttctgcatttcaagatagttcgtttgagggtaaccaagaactatatgggaatcttctatccaagaaatgtgaggatgatgcagggtcaccatttgctccacctttagcctgtgaggataatcaagactcataa

SEQ ID NO: 99531 - DNA, 183 bp, Glycine max
  Peptide Sequence Number=SeqID_216309
atggtttgtgtcgattcaagaatatctctcatttttagactatgtccaagtgcagcaaacttgggagagatactttgctcactaaatttcgccacccgtgacagtggaatcaagaatcagaatggtccagagcttgctatagcaagtagatcacagagttgtttaagtacaagcaaatcgtaa

SEQ ID NO: 99532 - DNA, 669 bp, Glycine max
  Peptide Sequence Number=SeqID_216310
atgacggaagggtgtggtgaagggctttgccttgcaaaccttcccggtgatgcttttagtctatgggggaacttctttgaggcaaagaaacaaatgatggctgatgccaagtttgcggggctgcttggtttagccgttgggagggtcggcggtgctgggttatggccccgtgctaagtttcggattggttggcccccccctcccccccgtgatcagttttgttgcttttggggggggggagtatggcttgcgccccgttggctaagtctgtgcctcggtggtggatcatcatgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 99533 - DNA, 351 bp, Glycine max
  Peptide Sequence Number=SeqID_216311
atggaggacttggctgagatgctagagaagcaattggcttcagagttatccaagatgacgctggaagaagctttgccccttgctcgtgcctttagccatcatcttactttgatgggtatagctgaaacccaccatagggttcgtaaaggaggaaatatggttcttgctgcaaaatcttgtgatgatatctttaacaacctgttgcaagatggggtttctccagttgagctttataagacagtgttcaagcaggaggttgaaattgttctcactgctcatcccactcaaattaaccatcgtaccttgcaatataaacaccttaaaattgctgtgagttgttctcttttctga

SEQ ID NO: 99534 - DNA, 459 bp, Glycine max
  Peptide Sequence Number=SeqID_216312
atggatgccctacaatatattaaggaagtacaatgtgcatttcacgacagcagagaaaagtttgacaagtttatggatgtcatgaaagattacaaatttcatagaattgatgttgggattgtcgtagaaaaaatggaggagattcttaaagaccatcgggatttgattttgggattcaacaagtttttgccaaagggatatgaaatcttacttctagatgagggtgaggatgggtttggaaatgcttcgaaatatttgaagaagattcaggatcgatttgaaaacaaagatcatgtttacaagtcatttctaaatatacttcttaagtacaaaaataatggagtcactctttatgatacataccatgaggttgctacactttttgagggtcaccgtgatcttgttcgtgacttcactaagtttctaccatctgtacatctaaggggaaaatatacttaa

SEQ ID NO: 99535 - DNA, 606 bp, Glycine max
  Peptide Sequence Number=SeqID_216313
atgtcctcgccatcagagggttgcatgctctcacctttagaggactccacgtcctcacctttagagggctacacaccctcaccttcagaggactacacgtccttgccttcggagggctgcacgccctcgccttcagaggactacacgtcctccccttcaaaggaccacacgtcttcacctttagagggctgcacgccttcaccttcaaaggattacaagtcctcgccttcaaaggactacaggtcctcaccttcagaggactgcacgtcctcgcctttagagggctgcacgctctcgccttcagaggactacacagggctacacgccctcaccctaagaggactacacgccctcaccttcagagggctccatgtcctcaccttcagaggactacacgtcctcgcctttagagggctgcacgcccacgccttcagaggactacacgtcctcaccttcagaggactacacgtcttctctttcaaagggcctcacgccctcaacctgagaggactacacgtcttcacctttagagggctacactctctcgcctatagagggctacatgccgtcgccttcatagggctacgcgcccttgccttcagatga

SEQ ID NO: 99536 - DNA, 309 bp, Glycine max
  Peptide Sequence Number=SeqID_216314
atgcgtctaccagggaaggaagagtctgctgatgaaacccccataaccataaatgagattttggatgttagcatttcgtttctaaatgaccatttagaggaaacactgggttcgacaaaaatagaagaaatccactcaaagtgtatcaatctcgcacaggacttcccttgggaatgggttcttttggtgggtttttcggcttttgcgtgtttttggccttttccttttctgttttggttttgcgtgaggcgaacaagtcaccgacgcgcaggattttggttggtaatcaaagggagaagaccaccttag

SEQ ID NO: 99537 - DNA, 860 bp, Glycine max
  Peptide Sequence Number=SeqID_216315
cgatggtttgatcgatcagatctttaaagctgccgccccaggtgctgacaatcagcttgtcggcggccatggcattccctgcgctcagaattcccgtggtgtcacagcgattctgccgctggccgctgctgcggtaaaacagccttttcctcgccgttgcatcggaatttctgacgctaaaaaagtcgctgctttgcgacggattttcttaagccttagtgaggcagaagcgaatgggcgtgaagggtcaggcaggggattatgctgctattcgctgtccggcatgataaatgcatggaaacaggggagaatctgcatgctcagtcgcatcacccagcgccagctggaatatttcgtcgcgtccggcgaagccggcagcattattggcgcatccgaacgtattcacgtgtcgtcaccgtcgatctcggccgccattactcacatcgaatccgagctgggggtgcagctgtttgtgcgccaccacgcgcagggcgtgtcgctcaccgccattggccatcaggtattaaaagaggcgaagctgattctggaacagatgtcgaatctgtataccatcgcctcagagtcgctgaacaacgtgcgcggcccgctgcgcgtcggctgtctcgacacgctggccccgatgctgacgccggagctggtgtttggctttggccgcgccttccccggcgtgcgcatcacgctggtggagggcaatcatgaacagctgctgaaacagctgcgcgccgccgatatcgatatcgcgctgacctacgatctggtgccggccagcgacatcgcgtttcagtcgctggcgcagctgccgccgtatgtgatggtcggcgaacatcacccgtttgcca

SEQ ID NO: 99538 - DNA, 171 bp, Glycine max
  Peptide Sequence Number=SeqID_216316
atgagattgcacatgctgagggagagatctataaggaatgttgaacaaggaccacaacagcatcaagacatgcagggaccacgccaacaccagcagggaaagaaaaaattgccagcaagtgcatgcacggcaagctggtcttatggacaaatagagacaagaagcaagtag

SEQ ID NO: 99539 - DNA, 178 bp, Glycine max
  Peptide Sequence Number=SeqID_216317
gctaacggcggtgctgaaggttacacattttgcccatgcaatagttgcaacaataggacttgagggaagtgaaaaaggagaagggtggcttcagaatcttcactatggtgtgtttggccttggaaacaggcagtatgagcatttttacaaggtggcgaaggtaggtgtcgccgattga

SEQ ID NO: 99540 - DNA, 741 bp, Glycine max
  Peptide Sequence Number=SeqID_216318
gtcgcgcgcctgggctacgacggcaagggccaggcccgcatcgattcgcgcgaggccgcgctggccgcgttcgccgagttcggcggggtggcctgcgtgctggaagcgctgatgccgctggactatgagatctcggtcgtgatcgcgcgcggtttcgacggcgccagcgtggtgttcccggtggcgcgcaacgtgcaccgcgacggcatcctggccgtgtcgacggcggcgccggtcaagcttgacgccgcccacgccgaacgccaggcgcaggccaccgcggccgcgcaggccatcgcgcagggcctgggctatcacggcgtgctgtgcgtggaattattcgtgctccaggacggcagcctgatcgtcaacgagatcgcgccgcgtccgcacaacagcggccactacaccatggacgcctgcgtcaccagccagttcgagcagcaggcgcgcgccatggccggcctgccgctgggcagcaccgacctgctggcgccggccgtgatgctgaacctgctgggcgacatctggtatccgtcggctaccggcgacacgcagcgcgagcccgattgggccgccgcgctggcggtgcccacggccaagctgcacctgtacggcaagcgcgaagcgcgccgcggccgcaagatgggccacgtcaccatcgtcgcgccgacgctgcaacaggcccgggccgacgcggcgcgtgtcgccgccgcgctgggcatgcaggcgcccgagtaa

SEQ ID NO: 99541 - DNA, 255 bp, Glycine max
  Peptide Sequence Number=SeqID_216319
atgagtatagagaagggaggtggcgaagatagaacaaatgaggtagcagttaacaagaaggaaaagggtgcctcatccaagtggaagataaaaacatcttggaagaaacaaatcaaagaggggttgttggtgggacatgacatcaagggaaaggtagagaagtttaggcatatgggggatgatacgattcttgattatggggttaagcaggagatgaaggagctattttgcaaggttggagacctagattcttga

SEQ ID NO: 99542 - DNA, 392 bp, Glycine max
  Peptide Sequence Number=SeqID_216320
atggcagctcgtagtggccaccggtggttgtgggtggtggatgaggagtttctaggcacaagtcctatcgggttggaatttgcgttgagcgcgacattttgcgttgagcgtaattcctgtcgggttgaaattgcacttaacgcgacacaatataactactatcacaaaaaatacgtgtttttctcccgtcttctcccccaaaccctcatccaacaccttaaacctcttcctccaccacccacgatcattagtggccgccatgagccgccgttgcttgccgctggaccactgcaaggagaggaacactttgattggagcagaatcttcataatccaccttaagaagtcagtagagaatggagctctcaacccttccttcatggtttcttcgag

SEQ ID NO: 99543 - DNA, 554 bp, Glycine max
  Peptide Sequence Number=SeqID_216321
ctgtgccagaaacaggcggcgcactgttgggaacgggcggacgaggcgcggctgaagctgacactgcgctggttggcgctggcggtgctgctgctggggctgggcatggcggtgtggctcaatgtgctgcaacgcctgccgctcagcctggcttacccgatgctcagcctgaactttgtgatgcgtgcattcatgaggggctatgcctggggcgccgccagcgtgttgctggtgacgttggcgcagttgctgatgaagtggggcatggtgcaaatcccgctgatgtcgttcgccgacgtctcgttggcgctgatcggcggctactggctgccgctgttggcggtgggcggcggcatctgcggttatgcgctgtcgatgctgtgttggttctttgcgctgcgccacctgccgttaaaccgcgcttatcctctgttgagcgtcagttatgcgctggtctatctggcggcggtgatcctgccgtggttcaacgagtccgctacgctgctgaaaacgctgggcacgctgtttattctgttcggcgtctggctgattaa

SEQ ID NO: 99544 - DNA, 477 bp, Glycine max
  Peptide Sequence Number=SeqID_216322
atgcccgccatgatacaccaaatcaatgggttaaggctaaatgcgtcgcgcctgccagtacacccgcttccagtagacgttatcgagcgaggagcggatcaccccgcggctggtcgacgcgtggataaattggtcgttggtatcgtaaatgccgacgtgcaggccgttctcaccgccgccggttttgaaaaacaccagatcgcccggcatcagctcatcgcgagagaccttggtgcccagcgaggtctgttcttcggtcgaacgcggcagttgcatgtcaaaacgatcgcggaacgtgcggtaaacaaagccggaacaatctaccccgccccgatccaggccgccgtaacggtatggcgtgccgtaccactggcgcagctgctcattgagctgggccaccaccacgatagagtccgccaggcggccgctgggcggcggcgcatggctgctgcacccggcgaggatcaaactggctaa

SEQ ID NO: 99545 - DNA, 180 bp, Glycine max
  Peptide Sequence Number=SeqID_216323
atgaaggatgacatggaggccatgaaagagcaaatgaccataatgatggaagccatgatgagtatgagaaaaatgatggtggtcaacatagctacaattgttgccgtaagtaccaccactgaggtgaacttgactcacccatctaggcccaatcaagtaaataatccagtctcagatatg

SEQ ID NO: 99546 - DNA, 165 bp, Glycine max
  Peptide Sequence Number=SeqID_216324
atggaggcttgccaagcaatagctgaaaggttggaacgattgttcaacctaaggatagttactgaaggcacagaagcatacaatgtcatggaagactgcctaaggatcgccaaaggtgtgactgcggattgcaatgtatctctttttacattaactccatgttga

SEQ ID NO: 99547 - DNA, 462 bp, Glycine max
  Peptide Sequence Number=SeqID_216325
atggagtggaatctaaggatcacatttttgtatgtggcgtttttgtttgaagtgatgggggtacatgcactcttacaaggtctcactttctacaatattttggtgcttgatggtatgcaatcggaaaaatataaatgtctggggtgttcggtttggtatgctgttatttgggttctgtgggagaatagaaaccaaattatcttctcaaacaaaaagcaagatgcagctgagatgttccaacctattcagcttttttcgtggaaatgggcttcagataagttgcagtttttgtaccctttctcatgttggtgtggtgacacaagttcatgttggaacacacactgttcctcactcaattgcaagagatgcaatttactccctcttacattcactcgtgtatcactcactgttttcaagcaaagaattacacacctacacactagaaatagcattagagactga

SEQ ID NO: 99548 - DNA, 210 bp, Glycine max
  Peptide Sequence Number=SeqID_216326
atggcaagcataagaaaatcttaccttgtgattgcgagtacaaagaagagcaaagagtgcccagaaaacaaagctaataacccctatgcaaaatatgctttggtgtcaatggaatggctgcaaggaaagcaacgaacgtcattcagagacaatggcagtaatgagatgaattttttcgaagcaacacaacttaccaagacatggtggtga

SEQ ID NO: 99549 - DNA, 210 bp, Glycine max
  Peptide Sequence Number=SeqID_216327
atggcggaaccatcaaagaagcgcaaaggttcttcgagtagaagccaatggcattctgaggttcaggatactccaatcccttcctccatttcctcctcctcattgttctcatcggaagaacaacgtatacgagatttactctctggtaatcgattaccagaggatgtaatcgattaccagtggccaaaaatgatttacaacagctactaa

SEQ ID NO: 99550 - DNA, 324 bp, Glycine max
  Peptide Sequence Number=SeqID_216328
atgacaataggtactagtaccaaagggctcaaccttatgagaaagcaagaggttgactctttgagatggcctctcatcctaaacttaaaagataggacattagatttgggaaattggtctaggtacttgggatcaagaatttgcctagaggaaaagagagatgagtaccatagacgttgttcatcagataagaatagtgtggatgatgaaaatgatggtggaattgatgtcgggggtgctccggtggctccgagacatcaaattattgttgcagaagcagaggtgtatgaacccttgcgcttcttggatgattctaccatttga

SEQ ID NO: 99551 - DNA, 1560 bp, Glycine max
  Peptide Sequence Number=SeqID_216329
atgggtaggtttggtcttttttctgatggcaaagaaaaatttgccatcttgtgttccaatgggcacttaagagaagcgtttgaaagctttttatctgagatatgggcaaaaccccgtttgttctcaaacctcctccaagcatgcattccgttaaagtatgtttctttggggaaacagcttcattccttgatattaacttctgggtgttcctcagacaagttcatttccaaccgcctcctcaacctctactcaaaatttggggaacttcgagccgctgttgcactatttgatcgaatgccaaggaggaacattatgatcaaggcctgtcttgaaatgggaaatcttcagagtgccaagcacctgtttgaggaaatgcccgagagaaatgttgccacatggaatgcaatggtcacggagttgaccaagtttgaaatgaatgaagagtctttgctcttgttttcgagaatgagcgagctgggtttcatgccggatgagtactcaataggttgcgtgctcaggggatatgcacatttgggagctttgttgacagggcaacagttagccttccttggtcaagggaagcaaattcatgctgaagcagtcaaagcaggagctatttctgaagtttctgtaattggttcattggttagtatgtactctagatgtggatgtttgcaagactctatcaaagcatttctggaatgcaaagagcgagatgttgtgttgtggagctcaatgattgctgcttgtgggtttcacggtcaaggagaggaagcaatcaagctttttaatcagatggaacgagaaaatctgcctggaaatgaggtcacattcttgagcttgctatatgcttgtagtaattgtggattgaaggacaaaggactcgatttctttgatatgatggtgaaaaagtctggttgtttggaggaggcagaggcaatgatacgatccatgcctgtaaaagcagatgtaattatatggaaaacattattatctgcatgtaaaatccacaagaatgccgacattgcaagaagggttgctgaagaagttcttaggattgatcctcaagactcggttacgtatgttctacttgccaacatttattcttcagctaacagatggcaaaatgtttctgaggtgaggagagccatgaaagacaagatggtgaagaaagaaccaggcataagttgggtagaagtaaggaatcaggttcaccagttccatataggtgatgaatgccacccaaaacacgtcgagattaatcagtatctggaagaattaacttcagaaatgaagaagcggggctatgtacctgatactagctacgttttgcatgacatggacaatgaggaaaaagaacacaacttgaggcaccatagtgagaaattggcaattgcttttgctttaatgaacaccccagagggagtgccaataagggtgatgaaaaacttgcgggtttgcagtgactgtcatgttgccatcaagtacatatcagagataaaaaatttagaaattattgtgcgagattctagcaggtttcaccatttcgaaggaagataa

SEQ ID NO: 99552 - DNA, 264 bp, Glycine max
  Peptide Sequence Number=SeqID_216330
atggagggtacatcccttgtggatctttggcttgtaaaggattttacaaggttgaaagaaatctcaagaatcgtaggttgcttggggactggatgtaggcacggctttttaaaatttaaactcaaatttctaaaagtttttacaaacaattttaacttctggaagccaagcgatgaatgtggcttgacttgggtccttgaccttctcctagagcttggtcatgaaaatggagtaaaagagagatgcaaggatcctagtgaatag

SEQ ID NO: 99553 - DNA, 369 bp, Glycine max
  Peptide Sequence Number=SeqID_216331
atgtggcctctaaggtctcaaaagaacagcaccaccacagtgaagatgcaacatgaatctgccaccaccaataccgtggcaacaaaatctctgatctcaacatgccactgttgttgtttggtgacaaaactgatgacaaagctcaagagacgtggccgaacactgcgaccaaaaagtgcaagtcgacagggttcattccaatgccgctatgatccattgagctattccttgaactttgacaccactggatgtggcagcttaatggatgaagattactataagttctatgctttttcttcgaggtttctggcaaatccaagaactccatgccccattgttcaagtacaaggaactcccattaaccaatag

SEQ ID NO: 99554 - DNA, 1164 bp, Glycine max
  Peptide Sequence Number=SeqID_216332
atgatgtcaagtgaccggatcacccttaaaattggtccgcctttactattttcttttcccggcgaagtccgcggtttctatttggtatctgcatttctccaccagaagcagctacctccccccattgaggcctcttccgatgaagagcaacgaccttcctccaagcaacacacagaagaaggagtttcctcttcagaagaagcttcttcccaagaagaagacgacgacgaccaacctcccacccttcctctcgcttccgcaaacccccacccgaaaccgtcgtcctccgactccgacaccgacttcgagcccaccaaagtaaaacccaagcccacggaccaggcccagaagccccagccctcacccgcgccgcccaaatggggatccaagcgccctgcccagaacaacgcccctgccactgacccgaaacgcgcgaagaagaaattgaccaattcttcttccgccgctgccgcccacgagacggaggagaagtccggtggcggccaagcgaagttgtctcagagactcttcagcaaggaagacgaactcgccattcttaagggcatggctgagttcatttcgaagacgggccaagacccttacaagtacgccgatgccttccaaaatttcgttaagaattcgctccgcgtggaggcttcgagcaaccagatcaaggagaagatccgacggctgaagaagaagtttgaaactaaagcacagagagcgaagaaatgggaggaccctgagttctccaaatttcacgaccggactgtgtttgaattatcaaagaaggtttggggagaaggagccaatgggctggtggagaagccaaaacctaataatggaaaaagaaaaactgccaagactccaaagaaggatgctactagcaggaatgtagtagcaaaatctgaaactacaacactactggagtcgatggagttggaggagtgtgggaatgtaaatttgctttaccgcgaagtatctggtttcaaagaactgaatgaggatgagatgaagaggggattggcgttaattggagaatctaagaggaaagagttggagggcaagtggaggaaattgcgacttgctgagatggaactggttgcgaatcgctcactacttattggggagcagattaagttgatatttgaagcacttcagtaa

SEQ ID NO: 99555 - DNA, 975 bp, Glycine max
  Peptide Sequence Number=SeqID_216333
ggtggacccttgggtactagtaccctcacattccgaggactacacgtccttaccttcagagagctccacaccctcaacttcagaggtctacacgccctcaccttcagaagactacacgtcctcgccttcagaggactacacgtcctcgccatcagaggacaacacgttctcgcctttagaagactacatgtcctcgccatcagaggactacacgtcctcgccattagagggctacaagccctcgcgtacagaggactacacgtcctcctcgctttcagaggactacacgtcttctccttcagaggactacacgtcctcgccttcagagggctacacgccctcgccttcagaggactacacgtccttgccttcagagggctacacgccctcaccttcaggggactacacgtcctcaccttcagagggctgcacgccctccccatcagaggactacacatcctcgccatcagagggctgcacaccctcaccttcagaggactgcacatcctcaccttcagaggactacacatccttacctttagaggattacacgtcctcaccttcagaggactgcacgtcctcaccttcagaggactacacgtcctcgccgtcagaggactgcacgtcctcgccttcagcggactacacgtcctcaccttcagagggctgcacgccctcgcctctagagggttgcacaccctcaccttcagaggactacacgtcctcgccatcagagagctgcatgccatcaccttcagaggactacacctcctcaccttcaaagggctacacaccctcaccttcagaggactacacgtgctcgccatcagagggttgcacaccctcaccttcagaggactacacattctcaccttcagtggactagatgtcctcgcctttagagggctacgcgtcctcactttcagtgggctccatagccacaccttaagagaatttaaggtcctctgcccttaa

SEQ ID NO: 99556 - DNA, 567 bp, Glycine max
  Peptide Sequence Number=SeqID_216334
atgggtcaacttcaacagcaagccttccgcaaagcctatggtaagatttgggacttagctacgatagaagtctctgtggaagtgattgcatcccttacccagtattatgaccaacccctgaggtgcttcacatttgaggatttccaactagtgccgactatggaagagtttgaagaaatcctgggatgtccactgggaggaaggaagccatatcttttctctgggttctatccctccatcgctagagctaccaaggtagtgaaaatctcggcacaagagttggaccgagtaaagcaaaacaggaatggggtagtcaaagtaccaaggaggtgtttggaggaaaaggcaaaggccttggaaaatcaaggggaatggacttcttttattgacatcttggcgcttttgatcttcgggtttatcctctttccaaatgtggaagggttagtggacctagcactattgacgctttcctcgcctttcaccatagcaaggaaagcccggtcatcgccattttggccgacatggatgacacgtttgaccggaggtgtgaaaagagcggcgcaataa

SEQ ID NO: 99557 - DNA, 970 bp, Glycine max
  Peptide Sequence Number=SeqID_216335
accacagaaagcaagtcgaaaatggggtggttggaataccgagaaaatgtttggaggcaaaagcaagaatcttggcaggtagaggcgaatgggccccgttcatagacatccttgtgcttttgatcttcggaggagtcctctttccaaatgtggatgggttggtggacctggcagcgatcgacgattttctcgcctatcatgaccgcaaggaaagcccggttgtcgctatactagccgatctacatgacaccttcgaccgaagatgtgagaagagcagtacaaggattgtttgctgtacttcggccctctatgtatggggttgcatcagttacaatcccgttcttgctataagacaacttggctaccctatgagaggggcaccattagaggaagagctcacacctattattgcaggaggcttcaataagaccaacgtggaggcacttcagaaggtccgcaaggcgtgggagatggtgcaaaagaaggacaaagaactcagaggcagtaacaacgggcccatcggcggctactgtaagtggttgaaagcccacatgcaaggtttggattggctctcgagtttgagaaccactaaaggggaggaagttgacgcactggaggaagacgaagaggtgcaggcccttagggcagaactcgagcaagcccaaatagtcaaagaaaggttcaaatcagcagctcttaagatccgaaaggagaatgccgaactgagagatgtaaatgtagctaccaccaaggccttggaacaagagaccaaaatggctcatagggaagaacacgaccggaacaaattccgaggggctttgtggggcagtaacagcgagctcaagcttcggagagaggagagggaccaatcacgagagaccaacatatttgccatcgtcagcaagtaccaagaagaactaaatctagccacagcccatgagcacaaagtggtggacgagtatgcccgagt

SEQ ID NO: 99558 - DNA, 222 bp, Glycine max
  Peptide Sequence Number=SeqID_216336
atgatgcacaagctgttcattaaagaaattgccacttggcggagagagggtgacatctttggatcagacacactggggatgacacttggggaaatagaaggtaagattgaaagtgacccgacgtcgcatcacaaacactcggcaatcttcaatggggatgatgccactagggtatatcaaaatagtgacggggtaaagcccgcagcaactgatggggaataa

SEQ ID NO: 99559 - DNA, 933 bp, Glycine max
  Peptide Sequence Number=SeqID_216337
atggcgcctatcgaattggttgcataccgcagccgctgcgtcgtcctgtcgcgcccaaccgtgcccgcggccagaattcgtgccgatcaagacacaggttgcctggttaggctcatcacgcgcgcttcacgcgaagaggtcgaaaaggccacatccgtgaacgagcgcctgaacgactccctgtgtcgactctttcccagaaaggacaggaccatgaaccgtcatcgcacccgcactgctcatcctcatcaacgcccgctggcgcgtggcatcgtcctcgcactctgcatgctgccgctggccggcgcctgggccggtgatctggacggtaccgttgggttggtcaacaacggcgacccgattgaagagtggacactgcgcaacaacgcggtgttgacagtggtcggtgggcagaccaacagcatccgtgcggttgattcactcgtgtacatgtcagatgccaccatcaaccgcagcggctcctaccagcgtgctgtcgagctggatggcacggcgagcctgcagtcggaacgcagcacgttgcgtggcggcggcatcttggtccagggctcctcgtcggcgcacctgatcggcagccgcattcttgtcaccgctgccgacggcctgctgccaggcaatccactcagcatcggcctgacgctgggcagcacccccggcggcattcccttgcccggcgcctggtctattctggattccacctacgtacgtgtggaagacactgcaggcggcagcgatattgccagtggcttgggcgtgcgcatggaaaatgggcgcgtggacatcgtcaatggctcggaaatcgacgccgacaacgtgggggtgttgatgtacggctcgatccatacgcccgacacgctacgcctgggtattgacggttccactattcgctccgggcgcggcgcggcgatccgc

SEQ ID NO: 99560 - DNA, 519 bp, Glycine max
  Peptide Sequence Number=SeqID_216338
atggcacgtgctgcctcagatagactaggagaaatgtctagcaaatcacacctgaaatatagaagtgcatctaagcaagacatggaaatggaaatggaggatagacatacaggcggagcttgccatgccgttcttgttgaacactggatccagaaggcagtgatgaagaggggcctcaagggaggtgaggaagcagaggaagaaggttgcagccgtgaggttggagagtgtctcgaagtcgtagaaaaggaccaccggtggcatcgacggtggcgagcatatggatccattgcaccagtgggtcactttacacatttcatgttcattgcggctcacacgcagagcttctttaacacctccaacgttgtcaccaacggcgcgaagataatcgcgatgccgcggtggtggttcatcaccgatgccgagaacgagcaagagcatgatgacgcagtcgacggcgaccaggcgcggggaaggcttctaaccaatgcaagacccactcaaatgagtagggtcaac

SEQ ID NO: 99561 - DNA, 360 bp, Glycine max
  Peptide Sequence Number=SeqID_216339
atggccatgacaactaggggtgtcaatttgtaccataaacgggaatgcccctggggattgttctattcagggtcttgcagatggggaattttcccctataggaacgagaatgggataaatatttccccatgggcacgacaagggaatggggacgaagattattcccctatcccaccgtgctgcaccgttcacttctccccagattgcactgtcaccatccagtctcgtcaccacttgctgctggtcacctcagagtggtcccacgaaggacaaaaatggggaaaaaagttttccacgacgaggatcagggatggggatggggagcagggaagtactttctgccctgccttatcccgttga

SEQ ID NO: 99562 - DNA, 105 bp, Glycine max
  Peptide Sequence Number=SeqID_216340
atggaaacaagaaacagactcctcaatccggccttgcctatagcaataagaataaatgaaatgccaacaactgcatgcaaggggaaaaagattcaaacaaggtga

SEQ ID NO: 99563 - DNA, 381 bp, Glycine max
  Peptide Sequence Number=SeqID_216341
atgtctgcgcactctggatatggtatcggtgcgaagagaataaagcttccagcaagtcaacgtgccgaggatctcgagtcgtggtacgggtcgaggcgcgagatggaggagcgggtgaacatggggacaacggccgtgcctgcagttgatcatgcaagacttcgaattgcttctcaattcgctgaaatggatgatctggttctagaaactgcgaggggctcggctccatccttagaatgtacggactggcttttctccgcttggaaaaaccgttttagggcaaccattttgcgtcaatgtgcgcgaacaaattacttaaggtctgctcaattccaaattgcaacaatgctctccggtaatcgagtcaggcgcactcggtag

SEQ ID NO: 99564 - DNA, 624 bp, Glycine max
  Peptide Sequence Number=SeqID_216342
atgggttgctggtttaatcctaaacttggttgggttataccagattacaccagcaacctcctaaggagaagaagacacagggaagaagagaatttgtctcatagtgcctggtgtcttcctttgctgaacgatctcaccattcttcctttcttttgggctttgcttcctcttgtacccctggatgcggcgactggggtactccttgcagatttggaaaagagttgcccaacggcggtcggagggcgcgtggggcttgttgttaacaaggagggggatgacaacaatgtcggcatgaacggaggcggtggcgtgggcgacggagtcgacatgagcggtggagtcggcatgggtatgtgtgcaaggagtgcctttgcagaggaagaagatggagtggtagtggaagaggaagtaaagggagaggcagccatgggaggcggtgatggcaaaagaagaagggaagtggctgggtggtgcgggttgcggcagatgatgaatgagcgcatcgattttctgcatgagttgttgaatagtgtgagtgagataaagttagtgagtggtgagcttggtaagagcatcctccagtcgatccgaagtagctgtggatctcgtggattccgccattga

SEQ ID NO: 99565 - DNA, 150 bp, Glycine max
  Peptide Sequence Number=SeqID_216343
atgaattcccaaaagataagcattcagaataatcttgcccctgtaacaaggccaccccccaagggtcctaactccaaacctcaaactgggactaagttacccactacccaacaggttgacgtatataagttggaccagtactggagttag

SEQ ID NO: 99566 - DNA, 791 bp, Glycine max
  Peptide Sequence Number=SeqID_216344
gacattgtctaggtgttggtactaggtatgaagcattagtggtactttcaagaagggagagacaagcaggaataaagccagaccctgagattgatgcaattcatgaaggctatagcattgtcaggtcacaaaaccaattcggtaacagattatgttctcaagcggtaaagttgtgccttggtgacttgttggtcatgggttcgaatccggaaacagcctctttgcatatgcaaggggcgagccctggtgcagcggtaaaattgtgccttggtgacttgttggtcatgggttcgaatccggaaacagtctctttgcatatgcaagggattggacagttccaccacttttcagatatgcaagttcatgaggcaaatgaaggtcaaattgcataccaaggttcacgtgagaatgtgttagagttctttgaacacatgggcttcgagtgtcctgagagaaaaggagttgctgatttcttacaagaaagaccagcaacaatattggacttcaaattgtattatgatgctaagtttggtaggaagaaagtcgcggagaatggagatactgctactgataaagcggtcagcaatggaaattcagtgacagtgaccattgtgtccaatggcaacaaaagggcatcggaaatggctgtttatgagcagtttcgaggcgaggggctgaatcagattcacacaaatggctttgtgccgaccattgtggatgaaaggccgtatgactctttgatccatcactttgtatttttggactttgttattaccacatactcactttaa

SEQ ID NO: 99567 - DNA, 950 bp, Glycine max
  Peptide Sequence Number=SeqID_216345
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgacgatcccggccacttcatgggcttgctcgacgggcagtccatgcgcgccgcccgcgtcgtactcgacatcggcctgcactgccagttcgaggcccccgaggaaatgggcggcggcgaatggaattgggataaagcctgggccttcttcaataaccacgtctcgatggacgagggctcggcccgctatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 99568 - DNA, 177 bp, Glycine max
  Peptide Sequence Number=SeqID_216346
atgattggagatgttggttggcatcttggcaattgtcattcaataaagattaagttacaagaccatggaaatcattttgttcactttggattggaacgaaggtcttccaatcaaaagcacaaagagatgctaatgctactactgcggtatggtgtctacacctttggggtcctttaa

SEQ ID NO: 99569 - DNA, 252 bp, Glycine max
  Peptide Sequence Number=SeqID_216347
atgaagcttgcttctacatgtctcctcatcaaggtcatcaggccccctattaacagggccttcatcaagaagtactgcgcccctaggcaggtgcagggtgaggcaccacaacagcttggggacgacgttaaaaaagctctactaggaggcaacctagaattggctacgaagaagcttcctgcgaagaggttcaggaatggcaccattgaagtgggttccagtgtggccccacaagccgacacaagcttttga

SEQ ID NO: 99570 - DNA, 813 bp, Glycine max
  Peptide Sequence Number=SeqID_216348
ataacccttgggtgtctccgcatgctacctaacttctcacaggtcggggtagcagaaatgtgtttgtacagaaaaccacttgggtatttctgcctgccgcctaactcatgggtcaggatcagcagatgttgtctttgtatggataaccgttgggtatatccacctgccgcttgtcttaagggattagtagatgttgtctttgtacggataaccacatggggtacttctgcctgccacctggcgcatgggtcaggattagcagatgttgtgtttgtatggattaccgctgggtatatccgcctgccgcctgactcaaggatgttgtgtttgtatggattaccgctgggtatatccacctgccgcctgagtcaagggtcaagatcaacagatgttgtctttgtacagattaccgctgggtatatccgtttgcttcctgactcaaggatgctgtgtttgtatggattaccactgggtatatctgcttaccgcctgactcaagggtcaggatcaacagatgttgtgtttgtatggattactgctgggtatatccgtctgtcacctgactcaaggatgttgtgcttgtatggattaccgctgggtatatctgcctgccgcctgactcaaggatcaggatcagcagatgttgtgctgggtgcggataacccttggaaagtcgccagcgcacaggattttggttggcgatcaaagggaaaggaccacttcagggcgaggatggaaattctcaccctgggtcaaggtttatgggataaaggaatgtcctacattatttccatgacatgcgtgcaacaatga

SEQ ID NO: 99571 - DNA, 483 bp, Glycine max
  Peptide Sequence Number=SeqID_216349
atgcccggcggaaaaacaggagcatcccgtgcatcgccttcccctcgttgtccgcctgctcctgctgctgatcgcggcctccgccttcccggcaactgcggcgccactacaggcacagtgggaattccgcatgctgcccggcgacgcgcagggcgccgcccacccgggtctgcagcaatggcgtgcggccacggtgccgggcagcgtgcacaccgacctgctggcgcatgcgttgatccgcgacccgtacgtgggtgcgcccgaagccgagctgcaatggatcggcttggcggcctgggagtaccgcgcgcgcttcgacgtggatgcggcgacgctggccaagcccaatgccgaactgcgcttcgacgggctggacacttatgccgaagtcagcctcaacggcaagccgctgctgcgtgcggacaacgcgcaccgcacgtggcgtgcgcgcgtggatgggcgcctgcgcgcgaacggcaatga

SEQ ID NO: 99572 - DNA, 588 bp, Glycine max
  Peptide Sequence Number=SeqID_216350
atgaatgtggggtacctcatctcccaccagatctcccttattgctcaggatgacacatccagacttggattctctgccttgattatagctttatgtaaggctaggggagttcagtctgacttaagatccttggagagcctaagtcctaccattaatttggcatacattaagaagaactgttggaatcttgttgatccaatagtaactttcagaggacccaggaaggccagaggtaagagatctgaggccccttccacttcagcatcatcaaaggcaccagtaccttcttcttctacacttcctccctcttcctccacagagatcctagtgattcctccagcacctttagagattccacttccagctccaatatctacaggtccagtagattttattttcactcctcaaatgctacactccatgcttcaaagcatccatagggggcagtccatcatcatgcagagccttcagggcttgggcttgcccttcattatgaacatggaggagtttgatgctcagtgtcctgggccaggagaccagccttcttcctctggagggggtggggcctccacagcccagagcctgtga

SEQ ID NO: 99573 - DNA, 321 bp, Glycine max
  Peptide Sequence Number=SeqID_216351
atggaaaaagctgagtattggtgggagaacactggccaatgcttggaggctaaaggtcaagttgtgacctgggaagtcttcaaaagggtatttctggagaaatactttgctgaggatgttaggaacaagaagaagatggagttcttgcagctcaagcaggggaacatgaatgtggctgaatatgcaaccaagtttaagaagctggtgaggtactatccccattatcaaggaatagatggcaaaagttcaaaatgtgtgaagtttctgaacgacttgctacctgaggtgaagcaagctatgaattaccaaggtattcattag

SEQ ID NO: 99574 - DNA, 258 bp, Glycine max
  Peptide Sequence Number=SeqID_216352
atgaggatcaaaaggtcttttgaggttgtaatggggccaaggacaaggcttgtagtgagcttaaaaacaaggaaagggaaacaaggctcaaaagggctatcaaaggaattaattcaaggtaagtccatttggctagaagcttataagaacaaaattgcctcaatcatttccaaatatgcatgtgaattaggaagcatcaacaagaatcaagccaaggctattgtgcaagcaatcaatggggcaaaacacaccaattga

SEQ ID NO: 99575 - DNA, 165 bp, Glycine max
  Peptide Sequence Number=SeqID_216353
atggctttgtgttcagtttttctcaatcttcatcttctgctttttgtttgtttgaccatagaagcgttaggtgtggccaagccttcagtagctagttaccttagccaggagatactagcagagcaagaagttgatagagcgcatggattacctgcacagcctccg

SEQ ID NO: 99576 - DNA, 921 bp, Glycine max
  Peptide Sequence Number=SeqID_216354
atggaattcttttctgatgaaacctttgattgcattcaagcctttcagaacttaggtcttataccttttatgtcattacaattgcctatttatcctgaattggttaaagctttttattgtaatcttgaaattcaggacagcactctgatttctgaggtttttgggataaaaatggtcattgaccagtcccttttccatgacttaaccagtgacagtgtaccatttgaaggtacactgaatgacgactggaaatttgatttctctgcacatgatgcccgccagttggtttgcaccaacaatgcggatatgaccggacgtcttcttgccgggtcattggcttttgaaagccgcatccttcactatttaattgtgcgtattctgcttccacggtcttccaaccttgcccaggtttctgaggaagatctaattataatgtgggcctttcatacagggcgtcaacttgactgggcacacttagtcaaatatcgcatgcataaggcattgcgatttaatgctccactaccatatccacagcttgttactctctttcttcgtcattttggaattcctcttgattctgaatcttatattccaatcaagagatcctttttaattggtgctgctgtgattgcttcttttggttaccgcaaagagcgtgatggctcttgggtcaaaaaggacgttccacccgttgatgatgaaggccacctaccagttgaagataattccactcttcttcaaaggcttatggacaagtttgatggacttcagacttttgttggtgacaagtttgatgccatggaattgcaagttgacatgcggttcgatgctatggaatcaaggatcaccagagttgaagaagatgtctccttcatccgaacttgctttgatccaccaccaccgcctccttcatcctcttag

SEQ ID NO: 99577 - DNA, 501 bp, Glycine max
  Peptide Sequence Number=SeqID_216355
atgtttcgttgccttcaaaagctggttctcaagttgcagcaaaattggaaggttaaacggcaacgtcaggcagctattgttccagggaatgaaggcttcacctttgatctctttgataactcatacgaccaagcagctattattcgctcattgtctatgtccactgttcgagtcaatcacgatgcagttggaatgctggcaataaatgtgtctcctgatttatgccattctctccaactgggttttgttggtgtacaatcagatgatacacggaggaaatccaatgaaaacaaatcccaattttcaggtgagcataatttgggagaaacaagtgaagagtccttaagtgatgaagagtgtgttaagaaaacacattcactccttcgtgaagtgcatgaagctattttcaatgaacagtttgtccaatatcctcacttgaacatttcttggtggtggtttgttgctttcgattcttatgcttccaggtgtttgatctggtga

SEQ ID NO: 99578 - DNA, 279 bp, Glycine max
  Peptide Sequence Number=SeqID_216356
atgactggggagatgaaagagaaggaggaattggtgctggtgggtcaccgaaggttctatggcggtggtggcttgcagtggtggtggtggaggaggatcccttttgttttgttcgaagattcttccattgaagttttagggaggttgggcactgttaaggagaaggggaggaatgagggtctgcgcaaagagagagaaaacgagtcttgtgtaatcgattacatcctactgttctatggtaatcgattacagggagtggtaatcgattaccagacctaa

SEQ ID NO: 99579 - DNA, 813 bp, Glycine max
  Peptide Sequence Number=SeqID_216357
ctggccgctattgcgcaggtcgatgttattgatggcgaggcggaatttgtggatgcccacacgctgaaaatcacttcctcgcagcaggttagccagattcatgctgagcgtatttttatcaatagcggtgccgaagcggtgtttcccgcactggaaggcttagttgccggaccgcgcgtggttgacagcagcggtatcctgaatttaacgcaactgccgcagcggctggggatcctcggcggcggttatattggcgttgagtttgcttccatgtttgccggttttggcagcgaagtgacgttgtttgaaagtgcaccgcaatttctggcgcgggaagatgatgatatcagtgcggcgatagccgggatcctgcaggagcagggcgttaagatcgagctcaacactgcattacagcgtgtgaccagcggtcacgacagcgtgacgctgcataccgcacagggcgatcgtgaagtcgatgtgctgctggtcgccacgggccgtcgtccggcgacgaaggcactgaaactggaaaacgcgggagtggtgaccaatgcgcgcggcgcggtgcgcgtcgataaacagcttaaaacttccgtggaccatatctgggcgctgggcgatgttaccggcgggccacagtttacctatatttcgcttgatgatttccgcatcgtttacgatcagttgctgggtaagggtacgcgcaccaccgaagatcgcgttaacatcccgtattccgtgtttatgacgcctgtgttatcacggattggtttgactgaagcgcaggcgcgcgcccaggggcgggatattcag

SEQ ID NO: 99580 - DNA, 564 bp, Glycine max
  Peptide Sequence Number=SeqID_216358
atgccacccaccaagcaccctctagacccggataagtctagcagggccctgggatttccagcattgatcacgggcctctgccagtcgttcggggttcccgtcacccccactaaggtgatccgaccgccgatcaccaaggccttcatcgagaagtattgcacgcctaggcaggcgcagggtgatgcacctcaggccgcagacgcaccgccaccacctcatcaggccgatcccgctggatcactaggcatggagcgttatctatacacttggttcgccagcaggcggccaaccaccgggggcaggtgcagatacatgagtgtctctaccggttcagcctcagtcaacaggggcagggtttcgctccttttgcatgccctactccatagcagtttggggctgaggtcgcatggcccagagattaacccgaggcccaggcaggggaggagcccgcaggatcccctggtgaggcagagagaaatttttggcgttatggctctcaattatttcgtcaccgtttttgctacttgccatttcatacgttcttttcatttaccttgtggttag

SEQ ID NO: 99581 - DNA, 213 bp, Glycine max
  Peptide Sequence Number=SeqID_216359
atgaatatatacttggtgttggccgtatcatttcttggtggtaccatattagctgaaagtggagattgcggtgggaaggacatttcagccacaattactgttggtagacagggcaattttacatttggatcaattcaagctgcaattgattcaatcaaaaccaacaatgatcgatggataaagattcacatagaagctggcttatatatgtaa

SEQ ID NO: 99582 - DNA, 492 bp, Glycine max
  Peptide Sequence Number=SeqID_216360
atggattttttgaagaaaaaaataattggcaaatacgatgaggatcttgatgttgacacaaaagacgtcatggttgtggtcatagatcttgcagttgtttgcactggttgcatcctagacatacagggtctgatcgtcaaaggtagagcaaatttaatgagaattggagataccttcagagtggctgacgtggtggatgaaggtaggggtggcataatagattttgttgtgggagaacttgacacacgacataatgcttttgtggtttggctgctgctattgcttgtggttgttctcattggaaccaccacattcaatgtaagaatagatctaaggattaaggttttgggtgagacaaatggaagaagggagtgggggcagagcggggacgaatcgatgataatagtgtggtttgtggtgttggtggtggccctagtgattgctgaggaaaagacaaaccttcattctcaaatgacaatgcttttgttttaa

SEQ ID NO: 99583 - DNA, 777 bp, Glycine max
  Peptide Sequence Number=SeqID_216361
atggaggagaaggagaagggggagaagacaaaggaagaaaaagaggaatctgaagctggagagggatttggtagaggaaggcagcgagttccggcaaccatgttcaatgctccggcgagtccatgcggcagtggcagaggcaaccacgagagcagtgagcatagtcctcgctcctacttccgtgagcaggactgcttcctccccatcgccaacatcagctgcatcatgaagaaaatgcttccttccaacaggaaaatcgccaaggacgccaaggaaactttgcaagaatgcgtctctgagttcatcagcttcgttacctgcgaagtgagcgataagtgtcagggagagaagaggaagaccatcaacgacgattgtaataggactgtaacagtgttaaagaaagaagagggccttaatatcgaaaagattgaaaagtgcatgggagatccagatgccgatactgataatcctattttgaaagaagagcaagatgcccaagtattggatcgtgaggtgatgataccatattgcctactcttgttgtcaataatcgacaatatcgagaaaggtgatgttctaaaggctatatgttatgggtttgaggaaactactgaaccatctacaaatgagtgcttgacaaacaatggtggttgctggcaggataaagtagctaacatcattgcttgcaaggatatattccgtgggagagtatgtgaatgccctctagttgatggtgtgcaattcaaaggagatggctatacgacttgtgaaggttaa

SEQ ID NO: 99584 - DNA, 420 bp, Glycine max
  Peptide Sequence Number=SeqID_216362
atgagctcgccctggcgagttggtttcttcaccatgaagttattcggtggcacaggcaagctagaggctagcctgagcgagctagggtcaaggaaaccaaggaaaagaccatttttccctttgttggtgaaaaagaggctaagttttgaattgcaaaaagtagcagttgggctaagcacttatccaccgctaagcgcagcttcagagcacttagcgcaaaggagaatctggatgagcatcgacatcataggcgcgcgctatgtgcgaaatcagtgtgctaagcgcaacaggtgccttcagccaggctacgcacgacactggcgctcagcccaattccatttactcgcactaagcgcaaaggtggctctaagcacaacattgcgaattagggtacaatgcccagggcacagaatcccatag

SEQ ID NO: 99585 - DNA, 2527 bp, Glycine max
  Peptide Sequence Number=SeqID_216363
atgacgttacacaaaggcatctgtggagcaaacacgaagcttagttgcaatggaaaagatcgatctgcattgctactcttcaaacacggtgtcaaagacggtttgcacaagctctcttcttggtccaatggagaagattgctgtgcatggaaaggagtccagtgtgataacatgacaggcagagtcacaagacttgatctaaaccaacaatacttggaaggtgaaatcaacctatctttgcttcaaattgaatttttgacctacttggacttgagcttgaatggctttacaggtttaactcttccacctatcctcaaccaatcactagtcacaccttctaataacttgtctaaccttgtgtacttggacttatcctttaatgaagatcttcatttggataatcttcaatggctttctcaactttcttcgttgaaatgtctcaatctgagtgagattaatcttgaaaatgaaacaaactggcttcaaaccatggccatgatgcatccttctctattagagttgagattggcaagttgtcatttagtcgatatgagccctttagtcaagtttgtgaattttacttcacttgtgactcttgacctgtctgggaattactttgactctgagttgccttattggctgtttaatattagcagtgacatctcccatattgaccttagcttcaacaatttgcagggtcaagtaccgaagagcttgttaaatcttcgaaatcttaaatctttaagattggttaacaacgaacttattggacccattccagcttggttaggggaacatgaacatctgcaaactcttgctctttctgagaacttgttcaatggttcctttccttcgagtctaggaaacctttcatccctaattgaattagctgttagctccaatttcttgagtggtaatgttacaagcaccattggccaactcttcaacttgagggctttattcattggaggttcattgtctggtgttctatctgtgaagcacttttccaaactcttcaatttagaatcacttgtcttgaattctgctttttcttttgacatagatccccaatggattcctccttttcaacttcatgaaattagcttgagaaacacaaatctaggtcctacttttccacaatggatatacactcaaaggacactagaagttctagatacttcttactcaggactttcatccatagatgcagacaagttttggagctttgtagccaaaattagagtaattaacttgtcgttcaacgcaattagagctgacttatcaaacgtcactctaaattctgaaaatgtaattttggcttgcaacaatttcacaggaagtctcccacgtatatcaacaaatgtcttcttcttgaatctagcaaacaattccttgtctggacccatttccccttttttgtgccataaattgagtagggaaaatacattgggttacttggatgtgtcctataattttttcactggagtaattcctaattgttgggaaaattggagaggtttaactttcctttacattgacaacaataagctaggtggtgaaattcctccatcaattggtttgttagatgaaatcgtagagatggattttcacaagaacaacttgtctgggaagttttcacttgacttgtcaaacttgaaatcgttggtgttcatcaaccttggagaaaataatttttctggagttgtaccaaagaagatgccagagagtatgcaagtgatgatattgagatccaataaatttagtggcaatattccaacacaactatgcagcctcccttctctaatacatcttgatctttcacaaaataaaatttctgggtctattcctccatgcgtctttactctcatggatggtgcaagaaaagtgagacattttcggttcagtttcgatttgttttggaaaggccgagagttagagtatcaagacactgggttattgagaaatctcgatctttcaacaaacaacctgtctggagaaatcccagtagaaatttttggcctcactcaattgcagttcttgaacttgtccagaaatcatttcatgggaaaaatatcaagaaagattggtggcatgaaaaatttggagtcccttgatctctccaacaatcacctttcaggggaaattcctgaaaccttttctaatttattctttctaagttttctcaatttgtcatacaatgatttcactggacaaatcccactgggtactcaacttcagagttttgatgcatggagctatgttgggaatcccaaactttgtggacttcctttaccaaagaattgctctaagcaaaatattcatgacaagccaaagcaaggtggagcaaatgagtcgctctttcttgggatgggagttggatttgttgttggcttatggggagtgtggggttctttgttcctcaataaagcatggagacacaaatattatcggatcgtgggtcatgttgaagattggctttatgtgtttatagctctcaagttcaagaagtttgctgaattaagagcaa

SEQ ID NO: 99586 - DNA, 294 bp, Glycine max
  Peptide Sequence Number=SeqID_216364
atggggaaacaactagtctctaggagggctgaaattcttgagtatgacagtgagattgaaagagcttgtggcaagaacaatgctgacacaaggaggagaaggatggctaaagaaaatgctagaaatagtggtaatggaggcaatgtaggtaatgaggttgacccacaggagtgcactttgcaagactatttcacccctatggtggaagtcacatccagtattttgcttcctaacttaggggagcaaaattgcaagctgagacatgggctaatcaacatgattgaaaaaatgtaa

SEQ ID NO: 99587 - DNA, 609 bp, Glycine max
  Peptide Sequence Number=SeqID_216365
atgacgatggagcatatgactaatagtggtgaaaggattagaaccttggaatcaataatatcaaaccttgtcactcttatgtctcagagcccaaaggagaatgtgaaggcagtcagcaccaggagtgggaatccccatgtggaggttaagaagaaagagaagacaactccaccaccaccagagaaggaggctcttactagggaaaagttagaaggggaaaaggaaactcttactgaaaagagtttagaggtagaaaaggaaaatgaggtattgacacctcctaagaaaataggcataagagaaacacaacccataaacatcaccttgcagcttgtagacaggtctatttctatccccaatgacatagttgatgatgtgttagttaaggtggacaagttcatctttcaagctgattttgtggtgttagatatggaagaggatgaaaacgtcccgatcacactggggtggccatttttgaatacttgtgacatagcatcatttccaagtgtgggaatggaggagcccctggaaagagttcttactaatgaggaattgcattgggaattgagtattgatgaagaggaaataatgatgttcctccaagcttaa

SEQ ID NO: 99588 - DNA, 846 bp, Glycine max
  Peptide Sequence Number=SeqID_216366
atggaagaaggccaggagcctaagtggttgccttggaggaggctcaaccccaacatgatggaggttgtgaaaggagaagtgcttaagttgttggatgcaaacatcatgtaccttatgtccgactataaatgggtaagtctgatccaatatgtccctaaaaagaagggcaccatagtcatggaaaatgagcaaaaaaagctcatagcgataagaaagattattgggtggcaaatgtgtattgatgtagttttgaaaaaggtgcaaggagacaagattggtgttaaattggaaaaagtgttagttcatggtgcattagtgcgttgtgctatgacacaaggtgtcctctattggcattttggtgggtctcaccatgatgaagaccacttgtctcgccttgacccctttgttaggcaacctactaatgatggagcaatacatgagacattccctaatgagcacttgttgggtgtagctattctaccaagagcaccttggtatgctggcattgtaaattatttatcatgcaaggcatttcctcctaagttcaagttccaagagaagaagaggttcatggtagaggccaaacagtattttggtgatgaccgctacctctacaaggtttgtggggatgatgtggtaaggcgttgtgtgccttatgaggaactggtgttaatcttaaggttgctactccctgtcatccttaaccaagtggtcaagttgagtgatggaatcctccctaggaagggaccggtcactagaaccatgagcaagaggctccaagaagattgggccagagctgctgaagaaggcaatagggttctcatgaacctcagggtagatttctga

SEQ ID NO: 99589 - DNA, 255 bp, Glycine max
  Peptide Sequence Number=SeqID_216367
atggctatagagttaatcattatgagaaggcattgcttcaagtgcactacattgtgcatttccaagagtgaattttcccctttaactcgccaggatcaagatgttaaacaagcgttccccaagaggcaacttgtgggttcttctaacccaccttttatcagcgaaacacaagtcattctagcaagagctccagaggcccaaaatcagcacaaagttttggaaggagaaattgtgaaaattgaagataaaagctag

SEQ ID NO: 99590 - DNA, 153 bp, Glycine max
  Peptide Sequence Number=SeqID_216368
atggcggacaaaggagttggagaaggcaatgcagtcgaggagcttgctgaggtgttggacaagggccaacaatttaaacagaatccttacaagcaatcacaagtaatctatagtttccaccctggaaaaagagacttaggcacccaacactag

SEQ ID NO: 99591 - DNA, 1623 bp, Glycine max
  Peptide Sequence Number=SeqID_216369
atggcttccaacaaaacttcttttcattcggctcttgccgtatcaaacatcaggaatcatgtttccattgttcttgaaatggaaaacgttcaatattcgacatgggcggaactcttcaagattcacgcacgctcaaccaaggtgcttgatcatatcatacctccggccaacggcacggggatggttccttctaccgaggaagagagggagctatggtcaactttggatgccacggttctttcgtggatttatgctaccatttctagtgacttattgcacaccattattgagcccgactcaacggctatggaggcttgggatagattgcgtgatatattccaagataataaacattctcatgacgttgccttggagcaagaattctccgccacttctatggagaatttcccaaatgtttcctcttattgtcaacgtctcaaatctctagcaaatcaactgaagaacgttggggctctggtgtctaatagtcgactagtattgcaattggttgagggtcttacacaaccgtaccgtggagtgggtatgttgattcgtcaaagcaacccccttcctcccttttacaaggctcgttccatgctcactcttgaagaggccgggatggcaaaggaacattcgaagggaaaaaatggtgcgcaacattctggtggcggacgacgcaacaacgggggaggtcggaagaatgctggttctggtggtggccggaactcgaccggcggtaaaggcggtggtcgggggcagtcctctggtggccacggatgggcccgacccaatactcctcaacagcgccaggtaggtttgctcagcccaaaaccacctcagcaggcctatgtacatcaagcaacatcgcctaatcctcatgggcagtctggttcgtacgctcctaccgatatcgaggcagcaatgcacactatgtcccttaaccaacccgacccatcatggtacatggacactggtgctacatctcacatgacttcctctaccgataatctctcgtcttattttaatttgagcaatcatcctaatactaatattattgttggtaatggtcacacgattccaattcttggctatggtcacacaaatttgtcttctccatgtcaatccctctcccttaacaatgttctttatgctcctaaactgattaaaaatctcgtttctgttagaaagtttacaaaagataattcagtgtctgttgagtttaatccctttgggttttctgtgaaggattattggacggggatgtcaataatgagatgtgatagccgcggagacctgtatctgatttcctattccctcaacaatcaagcttcctcttctacatttgccgccatctctcctaagctttggcatgatcgtttgggtcacccagggtctcctatcttcaatgtgcttaggaagaataaaagcattgattgtaataaactttctagttctagtatttgtggttcatgtgttcttggtaaacatattaagttgccatttgtttcttcctctttgaatactactatgccatttgatattttacatagtgatctttggacctctcccgttttgagttctttgggacatagatattacgttttatttcttgatgatttttag

SEQ ID NO: 99592 - DNA, 2127 bp, Glycine max
  Peptide Sequence Number=SeqID_216370
atgtctcgtactcttcctgctcatgcatctcttcctccatcattttggcatcatgctctccaaatggcaacctatcttcttaatgtgcttccaagtaaattgttgggaaataagtctccgcttgaggttctttacacaagggtcccttcttatgatcatatccaggtttttgggtgtttgtgttaccctttcattccgtctacaactattaataagttgcaaccaaggtctactccttgtgtcttcctcgggtatccaacccaccatcgtggctacaagtgttatgatttgtcgtctcataaaattattatttgtcgccatgtcttgtttgatgagcatacttttctgcttgctagtttgcattccccaaaatcccatacatatgatttccttgacgaaggattatccccttatgtcattcaccatcttcaccaacctactccaactccttcttctcagcccaacgtgccaagtgagcccaactcatcccttcctgacctaatttcctcacaaatcactcctgcccaaacacaaatcgatccctctcctactaattctcctatccaacagcctagggtcgtgacccgtagcaagcatgggatatataaacccaataaaaaatattccatgcatactacggttgaaaggtctccattgcctcgaaatccaatcgcggctcttcgtgatcctaattggaaaatggtcatggatgatgaatatgatgctctatgtgatgggaaaacacaacatgttggcatcgattgtggtgagacttttagtccggtggcgaagcccgctacgatctgcactgttcttagtctttctctttcgaaggcatggccaaatcatcaattggatgtcaaaaatgatttccttcatggtaagttacaggaaatagtttttatgcatcaaccattgggttatagggaccgtgatcatccagattatgtttgtctcttacgcaagtcattgtatggtcttaagcaggcaccccgggcttggtataagcattttgctgattatgttttgtctattgggttccttaatagcaaatgtgataattctttattcatttttagcaaagggtccagtgtggcttatattttattatatgttgatgacattattctcattgcttcttcttatgctctgcggtgttttataatggatcttcttagctctaaatttgctatgaaggatcttggccctctgaattattttcttggtattgcggtgactcgacataagggtcgtatgtttctttcccagcgcaagtatgccgaagaaataatagcgcgggcagggatgacttcgtgtaagccatctaaaaccccagttgacacaaaatcaaaggttagtgctacatctggtgctccatttgatgatcctactctatatcggagtcttgcaggggctttacaatatctcacttttacacggccagatatctcttatgtcgtgcaacaagtgtgtctccatatgcatgatccgagggttgatcatatgtcagctctcaaaaggattattcgatatgttcaaggtacattggatttcggtctttatttatattcatcatctacttctactctggtctcatacactgatgcagattggggtggtgctgaggccaagtatcgtggtgtggcaaatgtgtgtctagtacccaaagctaccctggtgtattgtgacaatgtgagtgctatttatttgacacggaatcctgttcaacatcaacgtaccaaacatattgaaatggatatccattttgtccgtgagaaggttgcacgtggacactctcagcgtccaaaagcctcccgctacgactgcggggtgggaggaggtacctacaaaaaggactccgacgagcaagttagtggtgctttgaggttgcaccatgctcagagttacgttggccaaccaccgctctatgtgtcgtgtcaggaaatggttgagacccatcacgtgtcgagtctatgggtcgtacagtacataagcccaccaagctctgaattcttgactaatgataaagtttcatgtggtgatctccggctagctgtgttttatgagcttgtgccaagtttatggtgcgtacggtacacaagcccccaggcccacacgagcagctag

SEQ ID NO: 99593 - DNA, 369 bp, Glycine max
  Peptide Sequence Number=SeqID_216371
atggccacacaactgaagtcgatgaagtttgagcttggcaagaccaaggaactcaacttagagttggccaaaattgatgacttggagaagcaagtgaaagatatcagtgtcagggtggaggagctgacttttgagaagatggtggaggagaatttgacaactgcggaagacaaagttgttgatttggagaagaaaattgaagatctgaagtgcgagttgctaaagaaggaggaggctaaatttgtgttgtcgactgagttggacaaggccaaaagatggatcatcctaaatcaccgagaggattcaagaaggctcaacatcaaatcaaagtgtttctaccctctttcgattccttgcaactcgacgtga

SEQ ID NO: 99594 - DNA, 234 bp, Glycine max
  Peptide Sequence Number=SeqID_216372
atggaagagagcgtggtggtggtggtggtggtgtgtcgttttgcttttcttgaagccttcgagtgtattttacggaggagaagaaggtgtgacagagtgaaggagggtttagccagtgaaacaaagacacgtggaagaatgcacacgtggcaaagattgagatggtgtgtggtgttgttcttgagtcctcctccaacccttgtgctgaaggttctcgctgagtcaagagtctag

SEQ ID NO: 99595 - DNA, 549 bp, Glycine max
  Peptide Sequence Number=SeqID_216373
atggagaggtacgccactatctccattagaattagagacctcgaccctggtgtcacactaccatctaagatcatgacacttaagctagggtcgttcactaatagcctttgtcgaaagcaacccaaatatctaaatgagcttcgagcaaaggcagcgggatacatccagatggaggagttattcgccttccgcaaccaaattagaaggaagaaagtagatgttgatttactacaccagctgagtactctaagaaatgacgaagcctccaatagcaagggcagcaacgtgggtgttatccttgaaggacttgataacatcttcatcaagcaatcagtaaaatttgattggaaggcttcaaacaaccaagcagagtatgaagctctcatcatgttcctaaagctagcaatcaaggttggcataaagaaatttaggtgcagaagtgactccaagctagtcaccaaacaagttaatgaggtattccaagctagggaaacacaaatgcagaaatactaccacttaatcaaacaaatcttggagcattccaagtaa

SEQ ID NO: 99596 - DNA, 2676 bp, Glycine max
  Peptide Sequence Number=SeqID_216374
atggcgtcgaaggtggcgctgatggcgctgttctccgtcgcgctcctgttctctccgtcgcaatccgcggtcttcagcgtagatctaggctccgaatcggtgaaggtggcggtggtgaacctcaagcccggccaatccccgatctccgtcgcgatcaacgagatgtccaaacgcaaatcgccggcgctggtctccttccatgacggcgaccgcctcctcggagaggaggccgccggcctcgccgcgcgctacccgcagaaggtctattcccaaatgcgcgacctcatcgccaaaccctacgcctccgcgcagaggattctcgactcaatgtacttgccattcgatgcaaaggaagattcacgaggcggcgtgagtttccaaagcgaaaacgacgacgctgtttattcccccgaggagctggttgccatggtgttaggttacacggtgaatttggcagagtttcacgcaaagattcagataaaggacgcggtgatcgcggtgccgccgtacatggggcaggcggagcggagagggctgcttgccgcggcgcagttagcggggattaacgttttgtctctgataaacgagcattccggcgcggcgctgcagtacgggatcgacaaggacttctccaacgagtctcggcacgtgatcttctacgacatgggcgcgagcagcacccacgcggcgctcgtttacttctcggcgtacaaggggaaggagtacgggaagagcgtgtcggtgaatcagtttcaggtgaaggacgtgcgctgggatccggagctcggtggccagcacatggagctgcggttggtggagtattttgcggatcagttcaatgcgcaggttggaggtggaatcgatgtcaggaagttccccaaggctatggctaagttgaagaaacaggttaaaaggactaaagagatacttagtgctaacacagcagctcctatttcagttgaatcgcttcatgatgacgtcgacttcaggagcacaataacccgtgagaaatttgaagagctttgtgaagacatttgggaaaaatcgctcttacctgtgaaagaggtgcttgagaattctggcctgtcattggaacaaatatatgcagtggagttgattggaggtgccaccagagtgccaaaattacaggctaagcttcaagaattcctcaggagaaaagaacttgataggcatcttgatgctgatgaagcaatagttcttggcgcagctctgcatgctgcaaatttaagtgatggaatcaaattgaaccgcaaactaggaatgattgatggttccttatatggatttgtggttgagttgaatggtcctgatcttttaaaagatgaaagctctaggcagctacttgtgccacgaatgaagaaggtcccgagtaagatgtttagatccattaatcataacaaggattttgaagtttcacttgcttatgaaagtgagaatcatttgcctcctggtgttacctctcctgaaattgctcgataccagatatctggtttgacagatgcaagtgagaaatactcatctcggaatctgtcatcccccatcaagacaaacatacatttttctcttagtagaagtggaattctttcactggatcgggctgatgctgttattgaaataacagagtgggtggaagttcctagaaagaatttgaccatagagaattcaaccgtttcatcaaatgtttcagctgaatctgctgcgggtaatagttctgaagaaaacaacgaaagcgtgcaaactgatagtgggattaataagacatccaacattagttcagaggagcaagctgctgctgagcctgctacagagaaaaagctgaaaaagcggacctttagggtaccattaaagattgtagagaagataactggatttggaatgtctctatcacaagattttcttgctgaagccaaaagaaaactacaagtactagataaaaaagatgcagacagaaaaagaacagctgagttaaaaaataatttagaaggatatatatatacaactaaggaaaagattgaaactcttgaggagtttgaaaaagtttctacaagtgaggaacgccagtccttcattgagaagcttgatcaggtgcaagattggttgtatacagatggtgaagatgccaatgccacagagtttcaagagcgtctagatcagttaaaagctgttggagatccaattttcttcaggttaaaagagcttacagctcggccagcagcagttgagcatgctaataaatacattgatgagttgaaacagattgttgaggagtggaaagcaaagaagtcttggcttccacaagaacgagtagacgaggtcataaaaagttctgaaaaattgaagaattggttggatgagaaagaagctgagcaaacaaagacttctggattcagtaagccagcatttacatctgaagaagtatatctgaaggtgcttgatctgcaaaccaaggttgccagtattaatagaattcccaagcccaaacctaaggttcagaagcccgtaaaaaatgaaaccgaaagcagtgagcagaatacagagaattctgattctaactcagctgatagttcctcttcaagtgattcatccgttaacagttcagaaggcacaagcgaagagacggtaactgagcaaactgaaggtcatgatgagctatga

SEQ ID NO: 99597 - DNA, 708 bp, Glycine max
  Peptide Sequence Number=SeqID_216375
atgccaactgtgatcaccattgggtcatcttgcttgggattgactcctacaaagtcggtgtcggtgaacgttatcagttggattgatttccttgagctcgcaatggaaatatggttcatgcttttgatggggcgcaaatgcctcttttctctactatgccaaacgctattagtgaacgaccctagcttaagtgtcatgatcttagatggtagtgtgacaccagggtcgaggtctctaattctaatggagatagtggcgtacctctccataaaagactacaatgactcatcattagcttggcagaggttgaccagagtggtgaatgtgggaggtaggaaagaccttgcatatcacggtgtcatcattgaaatacaagttgacttgcatgctgaatgcatcaagtgttcaacgggatctgaggtaccgtcatatcattcaatgttcaggggtttccaggtgatgggtagaggggttgcttgtggtgattgcatgagtaaagttgagtgtgactttcctaggtatgtgtctcggcataggtgggtggtagggacagggaccgaggtagagatagtggtggtgggggtggcggaggaaaaattatccccggtcccaaggcgggcgccaaatgttcctactgagttccaacgaggtccgaccaatctgcttggtcctcttcttttgagtggaatcttcgatctccggcgatga

SEQ ID NO: 99598 - DNA, 2745 bp, Glycine max
  Peptide Sequence Number=SeqID_216376
atgggcagtgttcgaaaactgatcgtggaggtagtggacgctcacaacctcgtccctaaggacggccacggaacctccagcccctacgtggtggtcgacttccacggccagcggaggaagacgcggaccgcggtccgtgacttgaacccggtctggaaagaaacgctgtcgtttaatgtagacaatgttaactcccagtcgtctcaaatcttcggcgacacgctcgagctcgacgtttaccacgacaagtcctacggctccacccgcagacacaactccctcggccgaatccgcctcagctccgcccagttcgtcaacaaaggcgaggaggctttggtgtactacgtcctggagaagaagtaccttctcagcatgatccaaggtgaaatcggtttgaaaatctactacgtcgacgaggagaaggttcttaaaatagaggaagcaccgccgcccccaccaccaccgcagaaggaagcagagattactgaaccggagaaagtggaagaaacacctccaccacaaccaccagaaggtgagaaacctaaagaagaagaaatgaaggaaaaagagaaagaaaacgctgaacctcctcctcctccagctccagctgctgcaactgaaaaaccaccacctgaagctgaacaggattatcaaccgttggatccgttgttagatgtgaaggcagcgtctgtgtcgaggtcgaattcggaaataagattcaacggaaccaataacggtcctgcacctcctcaaccaatgagaaggtctgcatcaacggcgagttttgcagcatcagaggcgtcgagtgaaactagcagcatgatgacgatgatggaacggtcgtcgtttgatcttgtggagaagatgcactacctcttcgtccacgtcgtcaaagcccgctacttacccaccaacggaaaccccgtcgtcaaaatcgccgtttcggggcagcaccacgtcacgtccatgcccgcgcgcaagtccaccgtgttattcgaatggaatcagaccttcgcattcgcacgcgacgcacctgattcctcctccgtgctggaggtctctgcgtgggacccccaagcttccgaggctctgctcggtggtgtgtgctttgacgtcaacgagattcccgtgcgggacccaccggacagccctctggccccacagtggtacagattggaaggcggaggggccctccacggcgacctcatgatcgccacgtggatgggaacgcaagccgacgaatcatttcccgacgcgtggaagagtgacacgtttgctcatgtgaactccagagccaaagtttaccagtcaccgaaactgtggtacctgagagccactcttctcgaagctcaagacgtttttcttctgccattaacctcatccaaggaatcgtgttttcgagtaaaggccaaactcggattccaggtgctgaaatccaaaacggtggttactcgtaacggcaccgtttcatggaacaacgaagacttcatttttgtggtggcagagcccgtgagcgaccacctcatgttcactttagaaaaccgacaacctgacgcgccggtgacaattggagtcctcagaatacctttactcgctattgagagaagggtcgatgaccggagcgtggcgtcgcggtggttcaccttcgataacgagagcgacgacaaagcaagcagcaggcccagggtgcacctgcggttatgcttcgacggcgggtatcacgtgatggacgaggcggctcacgtttgcagcgactaccgccccacggcaaggcagctctggaagccaccggttggcacggtcgagctcggcatcattggctgcaagaacctgctaccgatgaagacggtgaacggtaagagctccatggacgcgtactgcgtggccaagtacggtagcaagtgggttcgcacgagaaccgtttcggataacatggaacccaagtggaatgaacagtacacgtggaaggtttacgatccttccaccgttctcaccatcggagtattcgacagctccctcctcgacatggataatgacaaaaataccctcataggaaaagtacgcgtgcgtatctccacgctgcatacagggagagtgtataaaaacacttacccgttgttggtgctgagtccggtttcggggctgaagaaaatgggggagattgagatagcgataagatttcctccacgtgtactcgcagccgatgctgccgttgatgcaccatgtcaagccgctgggggtggtgcagcaggaggcgctgcggaacaccacggtgaggatggtggcgggacacctgtccagggcagaaccgccgctgaggaaggaggtggtgttctacatgctggacgcggactcacacaacttcagcatgaggaaacacacgcggggatggaggaatccaaccgcaaccatattggtgcacgcgctgttagtgatgttggtgcgtggaactacaggtttagggcgcgtgacccacttccgcatttcgaccccaagatatctttggcagaggttgtggatagggaggagcttgatgaggagtttgacactgtgcccaacggtgctgggggatttggcgacgcaaggggagcgcgtccaggcgctggtgacgtggcgggacccacgcgccacgggaatatttgtgttcttgtgcttgactgtggcgttcatgctgtatcttgtgccttcaaagatggtggcgatggctttcgggttttactatctcaggcaccctatcttccgtga

SEQ ID NO: 99599 - DNA, 819 bp, Glycine max
  Peptide Sequence Number=SeqID_216377
atggaagaggcagaggaggatcagcgtcgtcgtttgaagcttgaagaggcccttgaaatccaatccctcaggcgcatcattagtgcttacctcaattatcctgatgccgcagaagaggatgttagaagaaatgagaggtcttataggaagcttccaccttcccataagttatttctggcttgtgtcttcctaagcttgagcaagatggatactctttggccaattcagaccgtatggattgagattcttgaggctttgttatcccagtatcctcaaaagtttcaaagattacgctggtgtatctcaatgaatactcatttcatattcagcatgcttcaagcatttgaacctccacttgacatgagccaggatgcagattttagtgaagatcctcatcccgaatctgcccaaaaagatcatttagtttctgaagggattagtgcttgttcatgtgagtcagcccctgaggtgggcattgagagtcgccatcagtcaaatactgggaaccattctccaaggttgatacatactaaagaaactagggaatattgtggaagtcctattgctgattccaagggcaatgtaccagacacctcatcacagcaacaatggttggctccatctttaaaattgaatgttcctttagttgatgcagataaggattatggaaaggtgcgatgtataataaggaacatagttagggactgggcagccgagggtaaaaaagaacgtgatcagtgctacaatcctatacttgaagagcttaatatgctattccctaatcgcagtaaagagaggatttatcagtcagggaaatga

SEQ ID NO: 99600 - DNA, 303 bp, Glycine max
  Peptide Sequence Number=SeqID_216378
atggcttcctatggtggtgagattcttcttgattcatcttttcctagaagtggcgtctcccataatttttcttccatctccattccgctgccattgatcttcaataagcaaaggattccattaatgaagaagatccaaggcctacaagctccacatggagctacgtcaccttattatgatgtaacttctaaggagtatgtcacttgtggtttatatggacttggtggtggacctaaggacgagatccaacccttggccttttatttatgtaatggaatatggggtcattacacatctcaataa

SEQ ID NO: 99601 - DNA, 714 bp, Glycine max
  Peptide Sequence Number=SeqID_216379
atggccaccgccctcagggacaagattatgtggaccacctcaccagtcaccacgaaggcagaatcaggggctgaggctgaccatttcaagtggattaagattggggctcaactttatagtgttatcaaatcaaatccacttttcatccttcccttaagcagattttttgtgttcatgacacttgcgggtctatctgggagcaagcccttgatctctacaacaatcatactcaacgtggttatgtattcccaaaatctcatgacttggacaaacttttgcttcttgctgacaccctttccaaggagcttcaactatacaaacctttttcatgttgttggttttgtatgggctgcctggcatagtattccatggtatgttggcaagctagttggccgatactatgatagccaagggaatcctacaaaatatttaaaaggagttgaagcgaaggctgccagaggtgcacagcttctagaaaagcagaagattgaagaggcgaaactaccttcgtgcaattcgagatggagtcaagatgaaggtggtgaggtatggtgtgatgttggttaccctagattggttcagaggccactagagattgctttgacagggaagatgagtaagcgttgtgcatgctttgaagattctcagttggaccaacctggcttagaggtatatgaagggtgtgattaccatgctaccaggtgcaaagtttaa

SEQ ID NO: 99602 - DNA, 387 bp, Glycine max
  Peptide Sequence Number=SeqID_216380
atgtcgttgaaaacgttaacaacctctcctctttcgggaatcactgttttggtccttctcctcgctctccttctcagattttacatcaaattcgacaccgctgagaggttgttcagtgctgaagagctatcattgctcaatggaactgatgaagggttgccaatccttctaggaattcttggggaaaatctcattatggttcaggagggggatacaatcattttgctggcagggatgcttctcgcgcatttgtctctggaaatttctcagaattggggacactctaccacaaacgttgagaactgcattttccccatcgactatggagagatgagagaatttgtaatgttctatatgcagtgtcgcgaaaatcttgatttcacttaa

SEQ ID NO: 99603 - DNA, 1965 bp, Glycine max
  Peptide Sequence Number=SeqID_216381
atggtatcctcaggtatgattaaattgagccatggtgcattttcctcaccggtgttattggttaagaagaaggacagaagttggcatttttgcgtcgattatcgggcactcaattcaatcacggtaaaagaccgttttcctatgcccaccatcgatgaactcttggatgaatcaggcaatgcttcatggttttccaaacttgacttaaggcaaggctttcaccaaattctattggatgagaatgacaccccgaaaatggccttttgcacacaccaaggccactacgaataccgggaataccttggtcacattgtttcacaaaagggggttgcacctaagccttccaagattcaggctatggattttacagaaaattcattcaagctcaaacgagccatgacccgggctcctgttcttgccttaccagattttttcattcctttcactcttgagacagatgcttcgggtttagccatgggggcagtgcttatgcaacgtggacatcctattgcttatcacaagagcctgaaggaactaatgagccaaattattcaaaccccgaaacagcaggtgtatttgtccaagctgttgggatacaattacttcatccagtataagattgggaaatccaaccttgttgctgatgcattgtctcgaatttcggatactcagcaaggccattactttgttgtgtccttgcctaattttactattttagatgctttgcgcaacacgctgtatgatagtgatgcttttaaaacgttattacagcaagttcaaactgatccatcttcccaccctgacttcaagctgcataacagcaagttcaacccctttcggtcagttttgatggaagaatatcataaaacacccttgggagaccacatgggttttgcaaaaactctgcatagactacacgagaatttttactggcctactatgcgcaaggaagaagacttatcattggattttattacaggccttccaccttcccatgggtacactgccatcttggttgctgttgatagattttcaaagggagcccattttgaccctacatttgttagtcaattttggcgtgaatcgttcaaactatgtgggaccaaactccgaatgagtacctcctatcatccagagacagatggacaaactgaggtccttaaccgcatattggaacaatacctttggtcatttgtgcatgatcaaccctctaagtggtacaaatttctttctttggctgaatggtcttataacacgtccatccattccactacaggccttacaccttttgaggcaacatatggcaaacctcccacttcaataccacagtatctaatgggttcgtcacaagtggaagctgtagataacttcctttcttcaaggcaggacatgttgacaaccttaaagactcgtcttttgaaagctcagaatgcaatgaagtctcaggctgatgacaaaaggcatgatgtttcttatcacattggtgattgggtttatgtcaaattaagaccctatcgtcagacctcagtttctcttgccaattacaacaagctctctaagagattttatgggccttttcaaatttcagaaaaaataggtgtcgtgtcttaccacttggatcttccccccacatccaagatacataatgttttccactactccttacttaagccacatcagggtcctttggtgcatgtgatagaccctctacctcctaattcttatgacaaacatcctctgatcaaacctttggctatcctggacagcaaatgggacaacgctacttcacctcctactttgctggtcttagttcaatggtgtggcttagcccctgaagacaccacttgggagaagtgggatgacttgcaacttatgttccaccttgaggacaaggtgtctctcccagcggtgggtgatgatagtaataccatgattccttttcctagaattgcggcttgccaatga

SEQ ID NO: 99604 - DNA, 234 bp, Glycine max
  Peptide Sequence Number=SeqID_216382
atggaggcgaagaagacaccaggggcatttagggaattaaaaacaattgctgggtgcacaagcaataatgctggtgcacctagcatcacccttgatgcatttggacctgacatggtagatatggagatggaaagccaactgacaatgctgcaagatttcacaaatggtttactgaggttaaagacgacaggggtacctggcttcaacagctcacatatggtgtttttggcttag

SEQ ID NO: 99605 - DNA, 318 bp, Glycine max
  Peptide Sequence Number=SeqID_216383
atggggatcgcacccacaaagacacctagtggacctgaagaagtccaacagggccctggggtttccagctctggttacgggcctctatcagtcctacagggtgcccgtacccccctagcaagggatcgcgcccgcaagacatccagtggacccgaagaagtccaacagggtcctagggtttccagctctaattacgggcctctgtcatttctacggagtgcccgtcgaccccagcaagttcatcaggcccctattaatcaggctttcatcaagaagtactgcgccctcaggcagacgcagggcgagacaccacagtag

SEQ ID NO: 99606 - DNA, 1185 bp, Glycine max
  Peptide Sequence Number=SeqID_216384
atgtgtgagcgttcacacccactaggccactacccaataactagtttcagtttgggccaatgtgacgtgactcaaacagatgtagagagaggatggaacactttcgttttcccatcacaccatcgacaacttgctcatgattggtcttccattgctgtaatatgccctctttttgttaatgagggagagattttggatggacagaataaaagggtagccacaatttttgacatttcaaccccagaggaactagagggacttagaccagaggatcagaaggcagagaatattgtagttaatttactagattggcaggtaatacctgctgaaaatataatagctgcatttcaaagaagccaaaagattgtgtttgccatctctaataatacatctgaagctcaggtgtttcttgagatggttatgaaagttgaagatgttgagcctgttctcgagctaaaggaatattttgaaagaagaatggaagaaagcaatctactgagcttgaccaaagccactgtaacacatattcaagtggctggaatgggtgatcgggtttgtgtagatctctgcagtctcatgagacctggtgaaggacttctcgttggatcctttgccagaggattatttcttgttcactcggaatgcttggagtcaaattacattacaagcaggccgtttcgagtaaatgcaaattacctctcttatcttcacaattcacaacaatggggtgacagtgtgagacaagcagtcgaaacctgcttgggaaaagttggttgtgatgtgtttaattctcaccatatgacgtggatcaatggaccagtacatgcctatgttgctgttcccggaggcagaacacgctacctgtcagaattaaaatctggaaaagaagtgattgtagttgatcatcagggtcagcaacgaattgcaattgttgggcgtgtaaagatagaaagtagaccactaatccttgtggaggcagagatagaattagataatcaaattatcagcatccttttacagaatgcagaaacagttgccttggtttgtcccccacaaggaaatacactgttaaaaacagccatccctgtgacctcactaaaagttggagatgaaattctgttgagagtacaaggaggtgctcggcatacaggaatagagattcaagaatttatagttgagaaatga

SEQ ID NO: 99607 - DNA, 311 bp, Glycine max
  Peptide Sequence Number=SeqID_216385
gaactaagcaccttacatggcctatcagaattaagattgcaattggtgctgctaatgcccttgcatttttgcatgaggaagcttcaaggccggtaatatttcgagatttcaagacatctaatgtcctattggataaggactacaatgcaaaactttctgactttgggcttgcgcaagatgctccagtgggagataaaagtcacgtttccactgaagtaatgggaacacaaggttatgcagcccctgagtatgtgatgacagcatatacaatcacaagctttatgaaaatacctagtccgggccatgtataa

SEQ ID NO: 99608 - DNA, 474 bp, Glycine max
  Peptide Sequence Number=SeqID_216386
atggtgcagaaattgatcgaaagcctcatagtggcaatcgcagtgatgaacgccggcaagaaaatcacgaacaacaaagatcatcatagtgaaactctggaaacgcaaaggcattacatgcagaacaacaataacagagggaattcttggcaacaaatcattcacgatgctggaagcaaattcgatacggaaaacttagcattaagtttctttctctctggtttaacccctgagcttgagagatcagtaagggttcataggccaaagacaattcaagaagctatacgaattgcaagattacaagaggagggagaccagtcagggttacagtgttttgcgataatgctccaaccatttgggatcaacatagacttaaaggagcactcaaaccgtgtgacccccaaggcctacactccgaagagtccgtcagggcctctccctcctgattcaggtccaacccagaaaatattttag

SEQ ID NO: 99609 - DNA, 265 bp, Glycine max
  Peptide Sequence Number=SeqID_216387
ggtctacatgttctttgtgctacttgtggctgttatggccatgttgctcgagcttgcccaaccataccattatctcaactgattgctgacagtcaggaaacccaaagcaagcaaggggtaggggtgactcctaatcctaaccataatatggagaaggtgtcacaactagctattgagtttgatgacgttgcaacgcatgaggagtggatggtggtgaagcacaaacctaggaagaacgagactaatcagaagacaccaatcatgg

SEQ ID NO: 99610 - DNA, 231 bp, Glycine max
  Peptide Sequence Number=SeqID_216388
atggaattaaaatttgcattgtgtgagtggatcaaaggcctcaggaatatcatttgcaagtcggactctaagttagccttgcaatttgtgactgagggtgtcattcaatctcacccttatgctccaattgttgccaaaattcgagagttcctctcctatgacgggaatctttcgtttttgcataccttaagggaagggaacttagtttctgactatcttgctaagaagtga

SEQ ID NO: 99611 - DNA, 204 bp, Glycine max
  Peptide Sequence Number=SeqID_216389
atggagaagaagctttcgaaggaagctagaatgtcgaacgtaaaggtgactcttggagcaacaacaggatctgatcaagtttgtagctcggattcacaacaaaaccacacgttttcggcccaactgaacgcttcgcttcctagagaaaacttaacaactgaccaatcagcctgcaaagtttgcgatgggccaagaattatttaa

SEQ ID NO: 99612 - DNA, 237 bp, Glycine max
  Peptide Sequence Number=SeqID_216390
atgtgcttggtcctccatattctgatgctgaaggcagacactgcacatactaccacaatttccccttgtccaacttttcagctaatggggtgcatatgttttggaatttcagcggatggattatccataccagaagaggaaaaaaatgcttatgaatggctacaagagagggaggaacttgaagacttagaagttaatggaaaaatgtacaacggtcccaagattgttgagagctaa

SEQ ID NO: 99613 - DNA, 587 bp, Glycine max
  Peptide Sequence Number=SeqID_216391
gaaaaggaagagacttttgtgaattgccaagagaaaccattgccagcagcaactcaaggaggaaccggcggcggcagaggaagaagccgccggttcagaagcttttcgagacttgcaaggttgtctttgcctctgcagggacaggctttgtccctccccatgaggacattgacgagttgcagtctgttctagatggaataaagccagaagatgttggtttaagaccagatatgccgtatttcaggacaagtgccactcagagagtgccaagaatcacgtacctgcacatatatgagtgtgaaaagttctcgatggggatattttgtttgccaccttctggggtcattcctcttcacaatcaccctggaatgacggttttcagtaagctactttttggcactatgcacatcaagtcatatgattgggtcgttgacttgcctcctgaatctcctacaactatcaaaccatcagaaagtgagtacttcccaatttttgtaccctatccatgtactattcactactacttagagcgtggttggataacccttgcacatcttccaaaaatactttcagaatggaagatataa

SEQ ID NO: 99614 - DNA, 168 bp, Glycine max
  Peptide Sequence Number=SeqID_216392
atgcaatgccaaaacaacctctcagactcaaattcagcaaatgggcaccccgaaaagcctctcaaaaatgcaaaacaagggcacccaatagccagaggaactagaacagaggaaacaggggaagcgggtatagtgataagaggtagaagaggcgctggcaggggttag

SEQ ID NO: 99615 - DNA, 195 bp, Glycine max
  Peptide Sequence Number=SeqID_216393
atggactacatttttggaaatgagaccgaagcaagaacattttctaaagctcaaggttggaaggagatgcttttgtgggaggatttctttaacaattggttaagcaagcccattgaagaatgcctcagaatgattgaagagttgggtgttaagcagccaatgttatcatccaaaggtcaggctgcacatacctag

SEQ ID NO: 99616 - DNA, 384 bp, Glycine max
  Peptide Sequence Number=SeqID_216394
atggagggggatctgaagcagaagctgttgagaagaagaaaggaagaggaagaagaagaagaagaagagttatcattggccaagagggtgtggaatgagagcaaggttatgtggatagtggcggcaccagccatattcacaaggttttccacctttggaatcagtgttataagccaagcttttgttggccatattggttctaaggaattggccgcttatgctctcgttttcaccgttctcattaggttcgccaatggtgttctgggttctcttgaaaaagaaaaatacatgaaagaaatagaggttggattgttgcgattggttgacttgggttatatgaacacatggattgtaacatctgaagtttgtgaacatatgctataa

SEQ ID NO: 99617 - DNA, 690 bp, Glycine max
  Peptide Sequence Number=SeqID_216395
atgactgcaaagctgtcattgctcccttggaggggaccaaagactcctaatgctcaagcgtcgcccctgctgctcagacaaccatcaaaccccacagaaacaccaaaccaaaaaagaaaacagcaagttacagcactaccgctgctgctaccaacaaaacctaataaaagcgcaatttgtggctctaattgtacaacaacctccagcagcgttgcagatcaacaatcacgctttaggaagtgcagcattactgatcaacacggtacaggaaatggagcatgccaccctgtcgatgacactttctctcaaccatatggtggaggaaatggggcactcccctctgtttgtgtcactttctctcggccatatagtggaggaagtggagcattccaccctattggtgtctcattttctcagccatatggtgcaggaaatggaggcgccaccgtttttatgtcactttctcagccatatgtggttgatggaagccagtatgaagttatagactggagtggcttcctattgaaacttggatctaaagcttctctatatctgaagtcgtttccagtggcttcagatctgaagttatatgttgaagcgacttcagatccaagtttcaataggaagcctgaagccgctccagcctatagctatcaaagtccatggactggcttccaattcccagcctaa

SEQ ID NO: 99618 - DNA, 342 bp, Glycine max
  Peptide Sequence Number=SeqID_216396
atgggaagcagaaaggaggaagagaggaacgaaaaaatcatcagaggtctcatgaagcttcctcccaatcgaagatgcatcaactgtaatagtctgaaaaatccacacaacactaacaccaaacaaacaaaacccacagcaagttacaactctgccaccgccatggccaccacaaatgtggtttcaattggatcacaaccaccagcagcgttgctgatcaataataatactgcaggaagtgcaatgttactgatcaacaacgataaaagaactggagcatgtcatcctgtgggtgtcactttctctccaccatatggtgcaggaaatggggcatgcacctag

SEQ ID NO: 99619 - DNA, 1836 bp, Glycine max
  Peptide Sequence Number=SeqID_216397
atgaggaggtcacccaatcgtgagtttacccatcgtgtgaagtctgtatctatggcaatgttcacgtcacaagaagttgatgctcttcaaaatgggggtaaccagcgtgcaagggaaatacatttgaaaaattgggacttccaaaggcagcggttgccagatagcagtaatgttgataaagtaagagagtttataaggaatgtatatgtggatcaaagatatgcagcagcaaagtcttctgataagcctccaagagatagtcctattgaagatgatacaaggcgtgccagttcctatcactcatattctcaaagtcctccatatgattaccaatatgaagatcgacgatatggaaaacaagcagctgcattgaccaggaagcctggttctgataaagtttgctatgaaagaaagataagtagtattatctttagtcctggtcggttcagcgatcatgcgtatgatgacagatttgcaaatgagagatctggtccaagaatctccgacttttctatgtctaatggtggtgagcaatttaaaactgattttcagcattctggtacctgttcaagtaaagatgtattgcctcatgtaacaaatacatctctggaaacaaactccaaaagagatgcagatggaattcatcgtccacagcaaatgtcaattggcagtttgttagcaggggagattgaacccgcgatcttccctcctttcccttcattcttaaccacccaaccaaccttatatcattgtgtgccttgcttaagcatgacattttcccttgtacaactctctggtaaacgagccagagatgaattacagcagtactggagaactacctcattgggatcaacagacagcaacctgtcatccttaagatcttacagttctggtggtttagttgattttttctcagaaccattccaagcttctggaccccatcaaaataaagtgtcttgtactccacaaccatctgatctgggaagtactgttagttcagatctttctgaggcaccagtggcacccaaaccattttcttcatctgcttcatctattgaccttttccagttaccagctgcaccctctcaggcttcatcagtggatctgtttcagtcatctgctttatctgcaattgcatctttcaatgagcgtcaacctttgaaaacatcacaatcctcatctgttgactttatggacctttctcagcagccatctgctgcaacctcaagtgagaagtcactggagttgtctgtcccagaaaatgaaggatgggcaacatttgatatgcctcagcacacatctactgcacaagtagaaattcaaccagcagtacaggaaaaatttgatccatttttgaacttaaatgcaaatacgctatggccatgttttgaaacttctagtgctagcgctctttcttcagttacatctaatttatggcgtgatgtcacatggaccagagaagaacaagtttctgttatggcatcaaactctcaatcatggagtgcatttaaggatcctgctaactctgttcctgtggatgctcttattactcaaggatcacaaatgcatgatcttccgtcaactgatgatcagtttttggatttaagagcttctgagggatccaataaagatggtatgcaccgcattgaccctgttgctgggtttgatcatgatctttcatcgcattttgttagtggctcaccatgtcctccatctgcatttcctccaatgggagaggttcagcctaatgaaatcaaccataaatcaactaatccatttgattatccttttgattcagatgtagaacataataatacggtaggtcatgactcatga

SEQ ID NO: 99620 - DNA, 183 bp, Glycine max
  Peptide Sequence Number=SeqID_216398
tgtcaattgcaattccttgacgtcagctctctacaagcagctctgccagattcccagctaacacccaccttccaaagtggtattgctgaaccatggctccctcagaatacactgaacccttatttctcctctgcaggacaaggtggtccttcaagactcatactggaagttcaaacattttaa

SEQ ID NO: 99621 - DNA, 297 bp, Glycine max
  Peptide Sequence Number=SeqID_216399
atgactaagctgtgtgaaacggaattgacagtgcaaagacctgacatgagaggcagggtgtgccagaaaatgcttggactgctgggagaaagcttgataagccaattcatgcacacaccagaaccaaaacactttgaagctgcttatagaattttcaactatctaaaagggtcaccaggaagaggattgttgtataagaagtacagcaactctacacctacgaaaatctacagagacaggtcagcaaccgccatagcttacaatcatgttctctatgatggaatcaattggaagtag

SEQ ID NO: 99622 - DNA, 447 bp, Glycine max
  Peptide Sequence Number=SeqID_216400
atggttggaagaagaaaaagagagttgggattggagggaattgaggttatcttgagaacgggagcagccaattatagtgtgaccacgatgggcgagttcaagagccagggctcttccgagtccttttccgactccagttatcagcacgattcgtcgtcttcctcctccgttcatcattgccaaaaggggaaaagaaaccctaattcagataaaattggaattagctttctgaaagtagtggaatgctgcaaccaacttggtaacttttgcttttgcacttcaaaggtattcctcaagttcacattggagtcttgtttaaacaaattttggtggaagaggaatgagatggttttccagcaaaaatgcgtaaccatagagaagcaaggaagtccaaatttgcttctcaatgatgagaacatgactcatcgtgataagtctgcaaagtga

SEQ ID NO: 99623 - DNA, 336 bp, Glycine max
  Peptide Sequence Number=SeqID_216401
atgacaacggacaagcggcgtggcaaccgtggcaacagtggtgagggggtggcaacaaccgtgaggattgactacaacgagttcgatggagaagatgatctggaacatcgaagcagaattaggacgacaccatttacgacctcgaagcttacaagcctttgtagctttgaatgtcggatacatgcacttgagatggaactcaagctttgtaagcaacagattgcagggttggagaagtcctatgaatacgttgcattggatgatggccaaagttccagggagatgaattttgctagtctttcttcctttgaaactgggaagttgtttctgccatga

SEQ ID NO: 99624 - DNA, 219 bp, Glycine max
  Peptide Sequence Number=SeqID_216402
atgacggcagcgaactcggcagcgaaggagttcgatgtgatatcgatgcaaagcgacaacattacttatcaccagaagggagtggtggtgagtcgcgttgagatggaaggtagagacgacaaattggtgacacaggtgagcggattcgacgcaaaggagggcgtgatggaagctatggccatttgcccatttcattacttatggtgtgatgccggttga

SEQ ID NO: 99625 - DNA, 402 bp, Glycine max
  Peptide Sequence Number=SeqID_216403
ttctgcctgaacatagccggcgacaccccttcgtcgaaccggcttttcgatgccattgccagccactgcgtccccgttatcatcagcgacgaaatcgagcttccctacgaggatgtcattgactactctcagttctgcgtgttcgtgcgcacaagagatgctctcaagaagaggtatcttataaacttcatcaggagcattgggaaggaagagtggacaagaatgtggaacaggttgaaagaggttgagagtttctttgagtttcagttcccatctaaggagggtgatgctgtccaaatgatttggaaggctgttgcacgtaaagttcctttcatgaagctcaagactaataggtctaggagatttctgaggtctctttatgggaatcacaatttttggtga

SEQ ID NO: 99626 - DNA, 1095 bp, Glycine max
  Peptide Sequence Number=SeqID_216404
atggttgagagaaccgtgtctgctgggtccaccatcaaggttgtttccaagaagtccttgtgtggattcttcacaatgacaacgttgttgttcatgttgtcatggctgttcgttcttcgttccactcgctccgaggcttcgcctaactcaaatcttttctcttccttcagcaactcagattttgatcagtcagtgcagcagcaaaaacacatggaagaagaagttgaaccatctaattttggcaatagagcaatacttgtaaacaatatagaggcaacaacaacacatgatgagaaacaacaacaacaacaacaacaactaggtgtgaaatgcaaagcacatgacaaggctgttctaagagttttcatgtatgatttgcctcctgagtttcattttggactattggattggaagcctgaagagaatgttaacagtgtttggcctgatatcaaaaccaaagcaccccattaccctggagggttgaattcgcagcatagtatagagtattggctcactttggatcttcttgcttcagaactacctgaagctgaagcacaatctaatgctaggagtgtaatcagagttagaaactctagtgaatctgatgtggtatttgtgccattcttttcctctctttgttataaccggttctcctccaaaactaatccacatgagaagaggagcatgaacaaggtgctgcaagaaaaattggtgaagtatgtgacggaacaagaggaatggaagaggtctggggggaaggatcatgtgatcgtggctcaccatccaaatagtatgttggatgcaagaatgaagttgtggcctggcactttcatactctcagattttgggaggtatcctacaaacatagccaatgttgagaaagatgtgattgcaccttacaaacatgtggttggatcctatgataatgatcagtccagcttcgatagccgtccaacattgctgtacttccaaggagctatatacagaaaagatttgcagttaggaatttctgttctaaactgctcctcaggttgcatcacatacacaagggctaaattggtgtcagctcatgttaaatgtacaccgtgcttgtag

SEQ ID NO: 99627 - DNA, 707 bp, Glycine max
  Peptide Sequence Number=SeqID_216405
gtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgattcgtcggtcagcccggccacgtccttctggagctgcgggaacgagaggagggtgtggttgttgcccaggccgtccgtcacgacgacggtgccttcctcctgagtcagcagcgcgatcatctgattctcgcgccggttccagcggtctaccagcgtcgagaggcgcgaggccagctcggcgttggagacgtagccgggggtagtgctcatgcggtgcttgggttctctctgagggttatcggatgccgaaggcgaagccgccaatcgacgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 99628 - DNA, 582 bp, Glycine max
  Peptide Sequence Number=SeqID_216406
atgcaattttgtgggactttgcctcctgttggtcacttattcaggctgaatttttatgtcaaaagttgcttggacccagagaactttaaggcattcaaacttgttaagcgtgcacagctgagccataatgttgcaaagttcacatttgcactcccaacacctacatctgttttgggtcttccaattgggcaacacataagttgcaggggtaaagatgctcaaggtgaagaggttatcaaaccatatactcctactactttggattccgatgttggacattttgaactagttattaagatgtacccacaaggaaggatgtcacaccatttccgtgagatgcgtgttggtgactacctttccgtgaaaggacctaagggacgtttcaagtaccaacctggcgaggttagggcttttgggatgcttgctggagggtctggaatcaccccaatgttccaagttgccagagctatattagaaaaccctaatgacaggaccaaagtacatcttatctatgccaatgttacgtatgaggacattcttttgaagctgtcccaaaatgcccacccaggtcagtttgcttga

SEQ ID NO: 99629 - DNA, 498 bp, Glycine max
  Peptide Sequence Number=SeqID_216407
atgaattcattgcctagcactgttcatgtgtcctccaccatcgagtctggagccctgcgaattcattgcctagcgctgttcgccaattctccattctccacttttattcggagacccatgaattcattgcctagcgctgttcatgtgtcctccaccatcgagtctggagtcccgcgaattcattgcctagcgctgttcgccaattctccattctccacttttattcgaagacccatgaattcattgcctagcgctgtccatgtgtcctccaccatcgagtccggagtcccgcgaattcattgcctagcgctgttcgccaattctccattctccacttttatccggagacccatgaattcattgcctagcgctgttcatgtgtcctccaccatcgacgctgttgatgtgtcctccactcacgagtctggagccccgcgaatttattgcctagcgctgttcgccaattctccattctccacttttttcggagacccatga

SEQ ID NO: 99630 - DNA, 117 bp, Glycine max
  Peptide Sequence Number=SeqID_216408
atgttgtgtggtatggggtccaagaagtacggtggtagtgacacttgccgaaggagctcattgcttcgtattgatgaatccgataagcttcatgacaactatattaatctcatataa

SEQ ID NO: 99631 - DNA, 270 bp, Glycine max
  Peptide Sequence Number=SeqID_216409
atggtgaaagtaaatgagagatacaaaagaaagctttcttgtcatcagctatatatgctagagctgaatgaaggaagcaagaacgaagggagaagcaaggtagctagcacaaaaaggagtgaagaatttgtgtgcaaaatgttggtagtggtctacttatttagaatggcacatggactcacatggttcttgctttccgcagaacagaacggagtctctcatcccatcccatgtgcactagaaaacacagacactaaaaccccactataa

SEQ ID NO: 99632 - DNA, 624 bp, Glycine max
  Peptide Sequence Number=SeqID_216410
atgggagggcaagtagttaaacgcagacgtgtatactccgtggaatcaaaccaaatagtgcaacctatatttactaggaattatttgaaccatttggttccagcgttggtgaagataaaggaaaagggttctataaaagaagatagcagcagccattgtaatgataatattaacaatgctgtcaagtatgaagtggacatggcaatggtattgtcagcacaaggttttgcatggagtaacggccttaaagtcaagcttcaaagcgatgacgttcatgtcaatgcagctaaaagcactaggtttcttgaaaatgaggctagtgaaggttcatcgaagaataatgtttatgacaaaaatgaagttgtcccaatggaatatttctcttcaaaccctagctcaaggtctaagtgcaaggacatgtcagaaatgaaaagggatttagccagagaagatgataaggaagctgaggacatcaacaaccagtggaagaggctgagaaggatgatacctggaggagaagagatgtgtgatgatgaacaaatggtttcagagcttgagagttacataaactgtttgcaaatgcaggtgaacgctcttcagtttctgctgccacacacgcgctga

SEQ ID NO: 99633 - DNA, 312 bp, Glycine max
  Peptide Sequence Number=SeqID_216411
gtaccgttctcctcactgccaggcgcgcagagcaaagtggataccagactggccaacggcgccaactatggcttcccggtgaacaccatgcatatcgtggccaacaaagcctgggcggagaagaatccggcggcggcaaaactgtttgctgaaatgaagctgccgattggcgacatcaatgccgagaacgccgcgatgcatgccggtcacgcctcagaagcggacatcaacggccacgttgacggctggatcaaagctcatcaggcggaatttgataaatgggtcagcgacgccatggcggcggcgaaataa

SEQ ID NO: 99634 - DNA, 240 bp, Glycine max
  Peptide Sequence Number=SeqID_216412
atgtctcctttccgccgcccgcatcgggtctgtcgcgccaggatgagtctgcgttatcgatggcattcaccctgccacgtgccggttatacggcagacgacgaacggaattcatcacgccgctgatgctggcgcgttacccggactaaccggtgccttgtcgattaacccattgatttactccagcaaagctggccgggaaaagtgtttagaaaacgtaaagatcaatgcaaagtggtga

SEQ ID NO: 99635 - DNA, 773 bp, Glycine max
  Peptide Sequence Number=SeqID_216413
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataggctccaaacaacaccttctcctttgatccacactcagccttctctctccaatgctctcattgctgcattgaagagagctcaggctcaccagagaaggggctgcattgagcaccagcagcaacagcctctgctcaccatcaaggttgagctggaacacctcatcatatcaatccttgatgaccctagtgttagcagggttatgagagaggctggcttctccagcactgctgttaagaaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 99636 - DNA, 920 bp, Glycine max
  Peptide Sequence Number=SeqID_216414
atggcgctgggctcgcaggcacaggcagcagaaacccaacctcacgccgaccatagcgcgctgcccagcggccaggcgaaggaggctaacgtgaccggtgaagccaatcagcacgacaagcaaaagactcaaaatccgttcttctatcaaagccgtctgccgttccaggcgccgccgttcaacctgatcaaggagagcgactacgcgccggcgatcgaagcgggcatcaagcaaaagcgggaagaggtggagaagatcgccaataacccggccaagcccaacttcaaaaataccttggtggcgctggagcaggctggttcgctgctgacgcgggtgatgaacgtgttcggcgccatgacctcggccaacaccagcgacgcgctgcaaaagctggatgaagaaacctcgccgaagctggcggcgctgaacgacgacatcatgctcaacggcaagctgttcgcgcgcatcaaggccatctatcaggatcgcgacgcgctgaagctggatccggaatcgcgccggctggtggaagtgacctacaagaacttcgaactagcgggcgccaacctgtcggacgccgacaaggccaagctaaaggcgctgaaccaggaagcggcgacgctgagcacccagttcaccaacaaactgttggcggcgagcaaaaacggcgcgctggcgataaccgaccaggcgaagctggacggcctgtcggaaggcgagctggctgcggcggcccaggcggccgccgaacgcaagctggagaaacagtggctgctggtgctgcaaaacaccacgcaacagccgttgctgcagagcctgaaagatcgcgacacccgccaggcgctgttcgacgcctcctggacgcgtgcggagaagggcgacggcaacgatacccgccagaccatttcccgtctggccaa

SEQ ID NO: 99637 - DNA, 852 bp, Glycine max
  Peptide Sequence Number=SeqID_216415
atgcactcagtaaaactctcggcagaggcgttgccatcacaagcatggatacaacgtttcttgcctaaaagattatgggctcaggccttgctgatccagtgtgtgagtatgctgttgatcaccggcctggctcctggcgtgatcaacagcgtatttgcgtttgagttacgtagtctaggcatccgtctggatactatctggttctggctgctaccacacgtttgcttgacgagtgtgatggcaaaaatagccaagatgccagcctggtggcgctggatacatgttattttcccggtggctgtcgttttcatgcagcaggttgcgttacctcctggtgtgtactttgccggctttatcatgacactggccctttactggtcagtccacaatacccgcgttcctttttatccgtcttttccatcgacctggcgcgctatgcaccatatcctggaacaacatgctggtgaccgttctttgcaagtactggatattggcagtggcatcggggatattgccatgttcctcgccaagcagcgcatccatgatgaagtgtctggcatagagattgcacctttaccgtgggcgatcagtgcagtgcgtgccattttttcgggcaccagcgtcaggttcatcctgggcgactaccgtcagctggattttgcagcattagacgtcgtatttgcttacctttccccggctgtcatgaccgatgtctggcaaaaagtgcaacatgaaatgcggccaggcagtttatttgtcagctcggaatttccggttgcagagctgacagccgaccgcattatttacccttcagcgcaggcccctgcgttgtacatctaccatatccgttga

SEQ ID NO: 99638 - DNA, 270 bp, Glycine max
  Peptide Sequence Number=SeqID_216416
atgaagcgtgcacagattaacagaacgcatccttccataagttcaacaaaagcagaaaacgtaaatgaaactagaagcagaaacgtaaatgaagctaaaggcagaaacgaaaatgaagctaaaggcagaaacgaaaatgaagctaaaggtagaaaaaggaacagaaatgaaatagcaattagaagcagaaaaatggaaaaatgcattcacgtgaacagtaatacaaagctcccaaaacgtaaaaccctaaactcctcaataatagcataa

SEQ ID NO: 99639 - DNA, 246 bp, Glycine max
  Peptide Sequence Number=SeqID_216417
atggataaatttgacatctttgtccctcatcctctcgtaattacatctttgcttccactagaatatgggtgcaagccattgctttgtttgctcaagcgacctgcgctcctgagtttggacttccaagaccgttcaatcagaaattacttgatgcaatcctaccccgcaagggcattggatagaaaactccaagtagattgggccagagatgcaagagaaggccctagggttcttatgagccttagg

SEQ ID NO: 99640 - DNA, 672 bp, Glycine max
  Peptide Sequence Number=SeqID_216418
atgcatcccacaaatccaaagactccatgtaggattacattttcacttcccaaagatcataattctctccatcaaagattggaagagttatgtgggaaaaacttacttcaccttccatggtacaagtcccctgttgtgtattctcttgcctttgagtttccatggcttgtttccgcatcaagtgatggcaagctggctctaattgatgtgagaaagctgttgaagattagcaagcgagctctggggaagagagtctcaaaggtaaagcatttgggtggagacatagtagagcctccacagaggatgttgcacggatttaagagcaatcttttctctgtggatataggagctgaacgaattgtctgtggaggtgaagaaggtgttgtcaggatctggaatttcacagaagctttggaaattgaacggagagcccgtgcattaagaggaatacgattagacaacagaatgaggcgacggaaactccagacagagctgagcaataaaagtggtcggagtgatcagtgttcagttgcagcgaagaagaatgctgtcacttgtatttggcccaaacgtggagtgggctcaatgattcttgcttctgagttctatgaaactaatagacacacgggaagctatggtagtaatacgggaagctggggtagtgatagatag

SEQ ID NO: 99641 - DNA, 165 bp, Glycine max
  Peptide Sequence Number=SeqID_216419
gaatccattgatgaagaagatcctaggcctacaagctccaatggagcttgcatcatcgtgtgtcagggtgtcggtcccgggttgaatttccatattatttccacgaggtatgcgtacaatgatgatttgggaacaacgtgcaaaattagtcatggctacagctag

SEQ ID NO: 99642 - DNA, 438 bp, Glycine max
  Peptide Sequence Number=SeqID_216420
atggccactgttcagcacctagtgattgtcaacaagaagaggatgcctattatttgtagaatcaaaccagacctcaacagaacttccaagactacagaggtggctcaggttcaaatcgaccttatggttggagaccacaaaataataatgcatattgtaggtccttttaacaactcttatgcaggttcttcaaataggggaccacaaaaaccaagaacattgatgcttccattaaaaatctggaagttcaggttagacaactggcaaaacaactgcctgagcatggaaatggattttttttcaacaaacacacagatggctccaaagaaacttgccactaaaagagacaggaaggccgctataagagaaggatctaggacagctccaccggtagattttgaatttgatggagaccgattttgtagtgaggagcactaa

SEQ ID NO: 99643 - DNA, 288 bp, Glycine max
  Peptide Sequence Number=SeqID_216421
atgtcttcaacttcctctgctcttcctccatctccttggacctacctcctcttgaaaaatagacctgtctctaggctatgcaatagtagaactaaattgcttgggagtaggccaaggccaaatgacgcgtgtaagtgtgcatctggagcttcatcctctacaggtgtgttgagatggactccaaggatggcaactgctgtggtggtggtggaacatctgctgctggttgaggctgctaaaattgcttcggttgttgtacttgccttggcatgcaatatttgtcaatga

SEQ ID NO: 99644 - DNA, 445 bp, Glycine max
  Peptide Sequence Number=SeqID_216422
tagtagccaagaggaggctacctcttctccttcctcaagtggaagtgagggtgaagccaagggtgatgagcatattgaagaggtttacccctatgaagaaggtgatcttctaatggtgagaagcataaggttggtatctaagttgagtctcactatcatttcccacccaaagccttacaagcttcaatggctcaatgagcaaggggaaatgatagtcaatcaacaaaaagcaatccacaatggtctcaccaatgaaaaaaccctcacccatggaagcaaaaagttcaaacttgttcccttgacaccttcacaagtggttggggatcaagtacaaataaaactcaaatgggatgaggaaaagaatagaaaaagaaaagaggaacaacctttaatagttaaggaggagtgtaaggaggtaagtgtctcctccaagaggttagcttaa

SEQ ID NO: 99645 - DNA, 510 bp, Glycine max
  Peptide Sequence Number=SeqID_216423
atgatatatgctataaaaaatgttagggtgccagggtatttagacttggaatggttctttcaacaagggttcaactttcccaatctgctggaagtacaagcactatcaaagctagtgcagatgaaagaaacattttatccagagctagtctacacttgtgctcgtgttgaccatgaaggtaacttcttctccactattaatggagtagatatggacattgatgttgttgtatggaaggaagtagctggtttggacataggtggagttcgtaagtttgatgaaacacctgatggatgtgatctacaaatagtttacgatctgaaattaggtatcaggatcaactgggtattgttgaatattgtggattttaccaaagcctctagtgagattaccaaaagacatctcaaaaatcttggaatgatgtttgctaatcatgaatggataatagctggagagcctgtagctagaaatgttggtgagattgaagaagatgttgaagttgaagcttaa

SEQ ID NO: 99646 - DNA, 285 bp, Glycine max
  Peptide Sequence Number=SeqID_216424
atggagatgggtgtccatgatatcatgaaacctatggttttgaatgaaatcaagaaggctcgagaggaggaatattgtcacagccaatcaaaggaaacaactaattttgtacctagacttcaatcttgtcaacctttggtcacatggacaatgataggcattgaattatttagacctcctccaatgaaattcagtatggtgcaaatggctaggcatccacccaatttctcagttattagaagggtatgtgggcaaatgtcaagcatgggaggtctatgtcattaa

SEQ ID NO: 99647 - DNA, 426 bp, Glycine max
  Peptide Sequence Number=SeqID_216425
atgggttcagagaggggtgtaacaggggttttagaaaaggtgttggtgtgctttgtggatagtgtagaagcaaagcttcatgatgaatcaagattgattcaaagatgttttgatgataacaaaggtgatgacaaaaagctcaaaggtcaatcaaagaatgagttcaagatgttcaagatagaatcaagaacacttcaagattcaagaggaaatttgatttcaagaatcaagaatcaagcttccaagaatcaagatcaagattcaagactcaagattcaagaatcaagaaaatacttaatcaagataagtatgaaaaggttttttcaaaaattgagtagcacatggatttttctcaaaacatgtttaccaaagagtttttactctctggtaatcgactaccagattgttgtaatcgattaccagtag

SEQ ID NO: 99648 - DNA, 222 bp, Glycine max
  Peptide Sequence Number=SeqID_216426
atgacatcaaggtggctcacaaatcactcaagtcccaaaactcacaaaataactcttcaatcccggacttggtacagaactcgtgcagcctccatcaactccagtattttcgggcaggatgtcctggacattgtatccgacatcgtggatcctgcaacttcaattcttcatttgacattttatcttgccttgtgcattgtgcagcccgatcttattccttga

SEQ ID NO: 99649 - DNA, 312 bp, Glycine max
  Peptide Sequence Number=SeqID_216427
atgaatagcttccccaaggttttttttgagttttacactgaccttgatatcaacagatgggattgtcacacctgcgacgatgagatgatgagtcatttcatgactaaaaaccaaaatgaaagagaggtgatggagaaaaccaaagtcacaagcaaaccacacaccaaaacaaaagggaagttgcagagaacactggcctttcatgacttcatcgccaccacggagagctatgagtgggagcaagaaccagaatgcgagactgagagatgttgggtcaccatgccgccgcaaaaagtgcaagagtgggagtga

SEQ ID NO: 99650 - DNA, 432 bp, Glycine max
  Peptide Sequence Number=SeqID_216428
atgaaggtcgacatggaggccatgaaagagcaaataaccacaatgatggaggccatgatgagcatgaagaagataatggaagccaatgcgattgcaattgccgctaccaacgttgttgctaaggtgagcccgatgcccccatctggcctcaaccaaatgaatcatccaacctcagtatgtcccaactatacaccacccaatgtggcgtacactcccagtgagaatgttaataactccactcccatactcattgagagccgacaaccccaaactgatcatgcacatgtctctcaaatcgtgggggagacacatgaaattccccaccacaatctagccgacttcaagccttgcctcggatatgccattaaagggcaagcagttggtggtatacccctacaaaacactttggagggccgtcagtatcacccataa

SEQ ID NO: 99651 - DNA, 261 bp, Glycine max
  Peptide Sequence Number=SeqID_216429
atggaaaactctagcctccgaaacattgccttcgttctctttttgtttttgattttgcaccaccaagttctctttgtccaaggtaggaacttgaagtgtccgttgtgcaaagagtgctccaaatctcaaaaaaacaccatgagtgtagcttcttatgaggtgcaccaagaagggttaagacgcgtagaatatgaagtggacgattttaggccaacaacgccaggccatagccctggtgttggtcactccatcaacaattaa

SEQ ID NO: 99652 - DNA, 174 bp, Glycine max
  Peptide Sequence Number=SeqID_216430
atggagaagaatgaggagtgttggaagagggaattgaaggttggtatttatatgcgagggttgcgaaacagaaaatggaatctaaataaagttttaaggtttgggcgaccacagcttgtgatgtatttcactcctcatcgctgggaaaatattctttgtggagacatcctgtaa

SEQ ID NO: 99653 - DNA, 771 bp, Glycine max
  Peptide Sequence Number=SeqID_216431
gcaagcgagcccgttgacacacagagactaacatcatcatctgcacctttcaagagatgtcagcatcttccgaccgagactgcgaaaaagtctcgtttgctatccgttagactcaaggacggcaagtccgatgacatgcggagataccctatggttatccacaccttttgtcagctagaggcaagggatcctgttgacacgcagagactaacgtcgtcatctgcaccttcgtcatccagagacggcaagtccgatgacatgcggagataccttatggttatccgcaccttttgtcagctagaggcaagcgagcccattgacacgcaaagactaacgccaccatctgcacctttgtcatccagaggcgaaaagtccaatgacatgtggagataccttatggttatctgcaccttttgtcagctagaggcaagtgagcccattgacacgcagagactaacgtcgtcatctgcacctttgtcatccacagacgacaagcaagcgagcccgttgacacgcagagaccagtgtggtcatctgcacccttcccggaaatgtcagcgtcttccagccgagactgcaaaaaagtttcatttctgccatcagactcaagggtttgctagcatgcggagataccttaagggtcttccggccgagactgcgaaaaagtctcatttctgctatcagactcaaggttccggtagcatgcggaaataccttatggttatccacacctttcataagctagaggcaagcgaccctgttgatacctag

SEQ ID NO: 99654 - DNA, 392 bp, Glycine max
  Peptide Sequence Number=SeqID_216432
tctctgcgtgctatcaggcttttcgtcttacagacagcaaaaaagaatgtttatacggataaccactcgggtatttccgcccgtcagcgtgactcaaatgtcagtatcagagatcttgtgagcgcggaagatgacaaagaaaaaaagaatgtttattcggataaccaatcgggtatttccgcccgtcaacgtgactcaaatgtcaatatgacagatcttttgagcgcggaagatgacgcttttcgtcttacagacagcaaaaaaagaatggtttatacggataaccactttggatatttcccgcccggcagcgggaactcaaatatcaggatcggagatcttgtgagcacggaagatgaacgtaaatcttcgcgggtcatcgggcttgtcgg

SEQ ID NO: 99655 - DNA, 195 bp, Glycine max
  Peptide Sequence Number=SeqID_216433
atgacgttagtctctgcgtgctatcaggcgttgagtcttacagatagcaaaagaatgtttatacggataaccaccggggtgcggataaccataaggtacctcggcatgtcatcggacttgccgtctctggatgacaaaggtgcagatgacgacgttagtctctgcgagtcaacgggctcgcttacctctggttga

SEQ ID NO: 99656 - DNA, 252 bp, Glycine max
  Peptide Sequence Number=SeqID_216434
atggagcagtcagaagggttcagtaaagctggatcggatcggttgatttttaagttgaagaggtctctgtatggattgaagcagtctccaagattcacacttcagagtatgcaatcacaactgacaagttcaagcattgcttggacttgtcgaatgttgctgagtgttagatgtgataggaccctcaacccaagaaatcaaggtggagattgttgtgcatggctcatattttatgggttggacaaatgttag

SEQ ID NO: 99657 - DNA, 249 bp, Glycine max
  Peptide Sequence Number=SeqID_216435
atgtcaaatgaagaattgaagctgcaggatccacgatgtcggatacaatgtccaggacatcctgcccgaaaatactggacacataaatctgttatatctttaacagattgtgcaggatccacgatgtcggatacaatatttttcaggagaatgatagatctcatccagcgcaagttgttgcagcccagatacgctcattgctatattaacatgaaggctgcacgagttctgtaccaagtccgggattga

SEQ ID NO: 99658 - DNA, 240 bp, Glycine max
  Peptide Sequence Number=SeqID_216436
atggcagagaagaagcgatgggtggaactgagcggtgttcggttttgcaattggggaagagggagcgaagggtttgggggaaagggttttggagaaaggaatgaaaagagaaatggtggagacgacgtcgttgtggtggcttgggcattgagtggctcagttcacagttcacgctttataacgctggtgtgcaaggtgggaaatcttgaaccattcgtagcgaatgttaggcttcattag

SEQ ID NO: 99659 - DNA, 571 bp, Glycine max
  Peptide Sequence Number=SeqID_216437
atgacggaagggtgtggtgaagggttttgccttgcaaaccttcccggtgatgcttttagtctatgggggaacttctttgaggcaaagaaacaaatgatggctgatgccagtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 99660 - DNA, 168 bp, Glycine max
  Peptide Sequence Number=SeqID_216438
atggctcaatttggaaccctatcagagcaatcggaggaaaaacttgaagaatctcaggaaaccgttagaaatgctgctattgttgtcacaatgcacacgttcgcccgcttagaggtaacagatgagttcacaattggggttagaatgaacatgtgtagagatccttaa

SEQ ID NO: 99661 - DNA, 441 bp, Glycine max
  Peptide Sequence Number=SeqID_216439
atggcctccaggaaacggaggattattttgccagagaggaaggttgagatataccacacggagttggatgacttcaagacagagttggagaggcgtaatcttaacaaacgcctcaccaacttggctgatgggactattgatcttgctttggtgaaggaattttatgctaacctctacagctttgaagacccttcaccaaagcaagccagagttagaggccacttggtgaagatagacgctgacaacctcaacacatttctagagactcttgtagttctagaggagggggagacattacccatctactctaggtattgcaggttacccacagatcatagagagattgagactgctctgtgcataccagggaaatggttcattttgaatgctgagggccatccagggaggattctcaggaaggatctgactaccttggcccag

SEQ ID NO: 99662 - DNA, 257 bp, Glycine max
  Peptide Sequence Number=SeqID_216440
atgacagaaaacctgctgttgaaagattacatttccatcttccaggccaacagtgttgtcgatgaagaccatgacgatattgatgatgtgttgtctaagccaagcatctctgattcaaagtttatttcatggatgaacaccaaccaaaactctgttgaaggaagaagtcttacttacgcagaatttgtttttaagtttgtatatagtaaaaagaaaagatgttggcagcttaggaagaaaggctacaccattggcag

SEQ ID NO: 99663 - DNA, 396 bp, Glycine max
  Peptide Sequence Number=SeqID_216441
atgcatgctttgttagggacattcgacagtggaaattggtctgactctaaagtccttgatagtgcagggctgagttgtcgtgctttcacgaggaatcgggcgataatcttggtagagataagtcttacaagaggaatctgcagacgatgcttgatcaggattaggctaagctatcatgaggaatcggggtttagtatttcaggagacaccataagaacacatgagcattatagtttatacacttgttcatattcacacttacttttacacaatagacgcctatttgcagaaatagcttaccaaataacacaagttccccgagtgttcgatactcggttcttaccgttttatactacttgtgcgatccgatgcccttgccggaagccgaacacttag

SEQ ID NO: 99664 - DNA, 198 bp, Glycine max
  Peptide Sequence Number=SeqID_216442
atggatatgagcgtgaagcaagagaagccctcattcgaggcacacaattttgtgctctttctctccttctccctcccctcatcttctcctacttcaagctcttatccatggctttctatggtggtgagcttgtgcttgactcatcttctacatgaagttgtaatgacccacctcgtcgctaggatatcaccactctaa

SEQ ID NO: 99665 - DNA, 213 bp, Glycine max
  Peptide Sequence Number=SeqID_216443
atgacttctctcatttcaaaagaattgaaagtttgtttaatggtccgacgccttaaagacctttcattcaataaaaacatgtcttgcaaaaaggataaagacaacttaaccaaacactctgttcacaacaaactacataggtctgatttccttatcgcaattaaggaatacgtaggagcaagggaaacaccctcgtcgaccgcaaaaagataa

SEQ ID NO: 99666 - DNA, 204 bp, Glycine max
  Peptide Sequence Number=SeqID_216444
atgtggggagtggagcttttacggaaaagaaggttctatggggtgtttatacagtggatatataggaatggggcagtgatattaattatcaaaggacttgcgggtgaaattttcgaatttagtcttgatcctatcttgatgactcggttacggtttagcgatgtgttacaacttgtggcatatcctaaactttattatacataa

SEQ ID NO: 99667 - DNA, 726 bp, Glycine max
  Peptide Sequence Number=SeqID_216445
atggctcagggttccacccctcctgaccattgcaatctcatatctcagtttttggttcatggattccttttctcttctacacaattccaagaatctattcttggtttgaacaagtttttggcttttggtggtaatgtggtggctatggataaggactcgtgtggagtggggttcatggcggaactgtccggcatggagcaagaagagactaaaaaagctttctttattttgactgtagagaagagaaacaagatgcagggtatcacacgcatggatgttgccctggacgcaatgcgtccacttggatttaggacacaactaattctacgaacggttaatgagcttctcgatgtggtgtgggagcttcttcaggtgtatggtggaaatcaaggatggtgctttattgaagagacctattacaagctcctaatggaggccctacttagcaaacaacaaggttctgcagaatataagtttggtaatcttggaactgggcgtggcacatccgtgcttgaaatggttgctgcctttgaaaaagcttccggcaagaaatttccattaaaaatgtgtcccagaagacccggggatgctactgctgtatatgcatctacggacaaggctgagaaagaacttggttggaaggcaaaatacggtatagaggaaatgtgcagggatttgtggaattggacaagcaaaaatccatggggataccaggggaagcattaa

SEQ ID NO: 99668 - DNA, 354 bp, Glycine max
  Peptide Sequence Number=SeqID_216446
atgtatcgtgttccttatgtgagtattgtaggtagtctcatgtatgcaatggtatgcacaagaccaaacctagcacaagtagtcagcatgttctcttgtaaggctacacttcagcccacatttgccttgtccactacagaagcagagtgcatggctctagcagaagcaacaaaggaagccaaggatcaagtccatcatgagaggactaaacatattgacactaaataccacttcatccgtactgagaagaggattgtagtccaaaaagttgatatgaaggagaatccagttgatatgttcacaaaacctattccacaaagcaagttcttgcactatctagattacttaatgtag

SEQ ID NO: 99669 - DNA, 249 bp, Glycine max
  Peptide Sequence Number=SeqID_216447
atgatgtggatggacaagttcgcctttactttaaatgggagtcaagatcttccaagactgctagctaaagccaaggcgatggcggatgtgtactcggcccccgaggaagttcacgggctcctcgattattgtcagcacatgatcgatctgatggctcctctcgctaagccaacctatcggcttagcgagccattcgctgagcgcaacactccttggttgagcgcgaggaagaatctggaagaaggatga

SEQ ID NO: 99670 - DNA, 279 bp, Glycine max
  Peptide Sequence Number=SeqID_216448
atggctacaccacctaactcccatcctcctccacctcctactgattcacattcaccttctaccatgaagaggctaagaaaagagactcggttgagatcattggctactagaccagttggggcaaagagacccttggtccatgtggatcctgcaactgagaaagccgacgatccccacagaaagaagttaagaacatatttggggatcttcgctcgtgataaggatgaatttgatatccctgaagcatctgatttgaggacgaaaaagacaatactatag

SEQ ID NO: 99671 - DNA, 417 bp, Glycine max
  Peptide Sequence Number=SeqID_216449
atgcaacagggacagggttttttaaaaggaagagtaaaacaccctattacaatacctaaaacacaagagacactaagagaaactcaagctaacaaagagaaaggcttagaagtcaagattacttcagagaagctacgaaaggaaggattgagagaattttctccaccaaacccttcttcttggtgtgggagttcaacgacaagcaacggcagctcgtggtggccactcgtggtcgtgggtggtagagaagaaggtgttagggtttggcgagagaagcgtgctaagcgagagatcagaagttgttattttcaaaatcccaatggtcaaactgtggagaattgtcttaggaacctccagccgaaatttgaagaggatccaacggttaatgaatccaggatcacgattttactgaaatag

SEQ ID NO: 99672 - DNA, 249 bp, Glycine max
  Peptide Sequence Number=SeqID_216450
atggagaagcccccggggcattccgttgagcattgtagggctctgaagcgtaaggtgcaagtgcaagccattggtctgtttgctcaagcgacctatgctcctgagtttggacttccaagaccgttcaatcagagattactcgtcttgcacgttggtgggggtgccgtaaaacaacgaagaagtgagttatcaagaataggatgttggacaaatggcctcagttatcttgagaaaggggggttgaattaa

SEQ ID NO: 99673 - DNA, 279 bp, Glycine max
  Peptide Sequence Number=SeqID_216451
atggccaccattttggccgtgaaaagcaccgttccagccacaacggccaggtgggatatgatgacgcttggaggagggttaagggttgaaggtttagggtatagggtatatggtatagggtttagggtatatggtataggatttagggttaggtttagggttagggttatgattggggtttgggatatggggcatgggggtcggggcttgggttcggggtttgggagttggggtttggggtttgggttgagggtttggggtttagggtttgggttttag

SEQ ID NO: 99674 - DNA, 450 bp, Glycine max
  Peptide Sequence Number=SeqID_216452
atgcagggataccttatggttatctgcaccttttgtcaaccagaggcaagcaagcccgttgacacgcagagactaacgtcatcatctgcacctttgtcatccaaagacagcgagtccgatgacatgcagggataccttatggttatctgcaccttttgtcaaccagaggcaagcgagcccgttgacacgcagagactaatgttgtcatctgcacctttgtcatccagagacggcgagtccgatgacatgcggggataccttatggttatctgcaccttttgtcaaccagaggcaagcgatcccgttgacatgcagagactaacatcgtcatctgcacctttgtcatctagagacggcgagtccgatgacatgcggggataccttatggttatccacaccttttgtcaaccagaggcaagcgagcccgttgacatgcagagacgaacgtga

SEQ ID NO: 99675 - DNA, 197 bp, Glycine max
  Peptide Sequence Number=SeqID_216453
agaagataccgcggctgattgtccaactagcggaagcaggtcgggaactagagctggagcgaaagaagaaggagctcgcagacgagacagtgcgaagagatgagatgattaagtctgcttcacgcttggctacccgcatcaagaacgcagtggaatggaagaaagaaagaacaagagctattcttgaggattgttga

SEQ ID NO: 99676 - DNA, 336 bp, Glycine max
  Peptide Sequence Number=SeqID_216454
atggattttctaggtttgagaagtgaaattgagactaagcacataaacatcacaagcatcatcataaaaaccctaaaactgaatggaaacttagcaaaactacccatcatatctcccaaaaccccatacccacgaaaatcaagagagaaagaagtccacccaaacctgaaatttcgaagtcccacacgtagagatgcgcttcacgactccgaaaatgccctcctttcgcgatttggagcagaaatgatggccaaaggttggagctttgttggagcttcaatggtggaggaagaagaaggagaaaagcaacgtgagggagagaaaagagctttctga

SEQ ID NO: 99677 - DNA, 612 bp, Glycine max
  Peptide Sequence Number=SeqID_216455
atgggatggatccgaggcagacatttgttatcaattgaaggtgttccaaatcgtccttcgcagcagatttgctatgacaactcgggatttaagctgtggtatacgggaaaaatcagatcaagaaatggggtagggattattgtggacaaggagtggaagaaggatgtcgtggatgtaagaagagtaggagatcgtatcatagtcttaaaattggtagtgggacaggacacctttaatgttattagtgggtacgcacctcaggttgggttagcagaacactttaaggtaaaattttgggaggatctagaaggggtacttcaggatataccccaaggagagaaagttttcctaggaggggatctcaatggacatgtaggtagcgtggctagaggttttgagggggtgcatgggggttttggcctaggggagatgaatggggagggtaaatccatcttggagttttcggaggctttggatctttctatagccaatacatggtttaagaaaagagaggaacatcttatcacttacaaaagtggagggacatgttctcagatagatttcttccttatcaggaagtctgatagatttcttccttatcaggaagtctga

SEQ ID NO: 99678 - DNA, 713 bp, Glycine max
  Peptide Sequence Number=SeqID_216456
tattgatatgctgattttgttcattgcaacaacctttggtgctggaggaacattaacagccatagacaacctgggacagattggacactcattaggatacccgaacaaaagcactacaacatttgtttccttagtgagcatatggaactacttgggacgagtagcttcaggttatgcctctgagatcttcttgaccaaatacaaagtccctcgcccctacatgctcactctagttttgcttctctcttgtgttggccatgttctgatagcccttggtgttccaaactctctctacttagcttctgtggtcatagggttttgttttggagctcaatggccactaatgtttgcaatcatatcagaagtatttggcctcaaatactactccacgttgtacaactttggagctgctgcaagccctcttgggtcttacattctgaacgtgaaagtggctggtgttttgtatgataaagaggctttgaaactattgaaggccaaaggactcacgagacaagaaggaaaggacttaacatgtgtgggagtgcaatgctacaaaatggcttttatcataatcacggcttcaacgttggttggttgttttgcttcgatcattttggcgctgaggactagaaagttttacaaaggggatatctatagaaagtttagaacggaagatgaaacaatagagaatgagatagagattaccaaggctg

SEQ ID NO: 99679 - DNA, 237 bp, Glycine max
  Peptide Sequence Number=SeqID_216457
atgtggtttgccagtagacggccaaccaccgtggacagccaacagaggcagggttctgccccttttgtatgccctaccccggagaagtttagggatgaggtcgcatggcccggagactggcccgatgcccagacagagatggagcctgcagaatcccccggtgatgaggatgaatcccatatggatgaggatatgactaacctgctcagttttttgggagggagcggagccacatga

SEQ ID NO: 99680 - DNA, 637 bp, Glycine max
  Peptide Sequence Number=SeqID_216458
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcctgtctcatcatggaaggcgctgaatttacggaaaacattattaatggcgtcgagcgtccggttaaagccgctgaattgttcgcgtttaccttgcgtgtacgcgcaggaaacactgacgttcttactgacgcagaagaaaacccgttgcgaggtactaaaggcaagcgtaaaggcgctcgtctttggtatcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 99681 - DNA, 506 bp, Glycine max
  Peptide Sequence Number=SeqID_216459
ctaataagcccgtggatattgaggttccacaagcggtacttcctgatactgtatttgaagcagttgttcgaattccttatgatatgcaagtgaaacaagttcttgctaatggtaaaaagggagctttgaatgtgggggctgttcttattttaccggaaggttttgaattggcaccccccgatcgtatttcgcctgagattaaagagaagataggcaatctgtcttttcaaaactatcgtcctacaaaaaaaaatattcttgtggtaggccctgttcctggtgggaacaggggaaggggtcagatttatcttgacgggagcaagagtaataataatgtgtataatgctacagcagcggtgattgatattatacctccaggaccagaacttcttgtttcagaaggtgaatctatcaaacttgatcagccattaacaagtaatccaaatgtgggtggatttggtcagggggatgcggaaatagtacttcaagatccgttacgtgtccag

SEQ ID NO: 99682 - DNA, 480 bp, Glycine max
  Peptide Sequence Number=SeqID_216460
atgttatccttcaaccagaagcagtctcagtttcaatcgcagatgcaatcacagggactcacactacctcctgagcctgaggttggtccttcagctgctcgtgccagtacaaaggagagttgtgttgatccctcagggaacgatccaaacacaggtgactcagacaaatgcaggttgtacgttgaagaaaaccctccaggcctagtttccctaggaagactttatgaggggtccacaaccattcactatattcctttgccccatgatcaagtcaaggttatgcgggatgctaccatgtttggggtgtttaatgagaacttccccttgtacataaagcatgaagatctgtcaaaaatagtacacggtggtcaatgtctccgcatctttgttatacagttgtggatttcgcatatgactgagacaagtatgcgagcggggaatgtcgatatgtatggattcctcgagccacagtccatctag

SEQ ID NO: 99683 - DNA, 301 bp, Glycine max
  Peptide Sequence Number=SeqID_216461
atgggggataagcttcatcgtcgagagggaaacagcccggatcaccagctaaggcccctaaatgaccgctcagtgataaaggagatgaacggggctaagcgatctgctgaagctgtgggatgtaaaaaagaatcggtaggggagcgttccgccttagagggaaggacccgcgcgagcagtgctggacgaagcggaagcgagaatgtcggcttgagtaacgcaaacgttgggtctgaaagaacaaaactgtctttcaggtttgtgtgtgcgccgcttcccgttcaatttgcaatggctgaag

SEQ ID NO: 99684 - DNA, 883 bp, Glycine max
  Peptide Sequence Number=SeqID_216462
atgagggttgagctaacggcttcgttagctactgagagatacaggagtaagggtacccctagcttgggtcgactcaaaactggcggtgtggctatggtctttttgaaagctaggaaagcttgttcacaagtcttatcccataggaagggcatacttctggacttcttgaatgttggcagggctgcgtatctcgagtatagtggtgcatttgtcagtttggcttcaatccctcagtgtgtgatcatgaagacgagggaacttgcctccgtctaccccgaaaatgcattttttaggaagcttagcacttggaactcgaacactccattgactagcctgtcgatgctgtgcagagggtgctatttgccatttgccattgacctttttgaccatgacgacattgtcaagctaggtgaaaagcctgacctctctgatgaagtttgccttaaggagtttgtcgacttcttcctttacgactttatgtcgttcttcacccatcttccttttcttttgcgatattggtttggcctacgggcatatggcatcaatgcgccagtgctcatgactagtaaggtccttaaggaactgcatacactacccaggtttaggtttgagttgcagcttgacaagctcttcgataggtttcaagcctctgtccggggtgtcatctcgcggatctacatcgaattcattgccttggcttgcttggtagacgacgctatgggggtgaggcatggaaggctccttgatgggaggatatggtgctacctgatgcaatcctaccccgcaagggcattggatataagactccaagtagattgggctagagatgcaagagaaggccctaggattctcatgaggcttagggtagatttcgggtccatgg

SEQ ID NO: 99685 - DNA, 582 bp, Glycine max
  Peptide Sequence Number=SeqID_216463
atgcaagagcccatcacttacattgcacacaagactcgacaaacccaagctccacactcggtaagcctcacaggttcacaaaatccaaggcttgtccttggtaagcctcaacatagctccacaggctcgacaaaacacagggcaaacacgtccccagtccaaggcttgatagacccaaggttcacccttggtgagtcgtttcttttactaagttccatctccaaagaaactcaaggcctaccaaaaaaacccaaggtccacctttggtgtacattcttccaaaacctaaggtctgtccttggtatacattcctttaaaacccaaggtctgcccttggtacacacttctacaaaacccaaggcattcccttggtctgctcacatgcagcaactacgacaaccaccgtcaaaggtccaagttcaactaaacaaactaccaccacattatttggcaagacctttaatcaggtacaacccatacttactcttcacaaccatcaggagtactttggcaggtcaagatgaccctattaaagacagcgggagcaatatgagtaacatggtgaacaacataaaggcctaa

SEQ ID NO: 99686 - DNA, 477 bp, Glycine max
  Peptide Sequence Number=SeqID_216464
gtctccaaatggaaggatgttgctcgtactttttggcgagtggagcgccctaaggtgggcaatgccactattgttgttgctgaggccgtaaggtcaaaccgccaattgacttccaaagttggtagagaagaagaacttgggcggcaaggtggagagcttggcggttggaaggatgagcttgccaaggccgtcaagcaagccagtttcattgcaaaagaccttgacttaggtctctttgatcccttcaaggatatgaaggatggtgtcctgcttgatgaggaagacattgtagctgaggatgaggctattgatgaaggactccaagtagattgggctagagatccaagggaaggccctaaggttctcatgagccttagggaggtgagcttagctattagagagcttctcaaggaagttttctcaaagaagcttatcaaggaagttttctcaagaaagcttctcaaggaagctacctag

SEQ ID NO: 99687 - DNA, 232 bp, Glycine max
  Peptide Sequence Number=SeqID_216465
tggtgaactatcaaccccaaatgccccacttggtggtccgtggaatgtacctgaagatatacccgacatggacgacttattaggagttgatttacgtcatgatttctctgtcgaggctgaccaagtggatgaaagggcgaatcgtagaagaagaaatcctgatagggcagctagaaattgggatcggccatgtgggacttcgtcgcggcatcacagacatagtgatgattga

SEQ ID NO: 99688 - DNA, 1011 bp, Glycine max
  Peptide Sequence Number=SeqID_216466
atgaaaaaaatagttgccggcgccgtagtcatcgctggcctggctgccgcattgagctactggcagattaaacgctttgccgcgacgccattaaccattcaccaggaaaccctgtataccctgccggccggcagcggtcgcgtggtgctggaagcgcagctggagagccagcacatcattccgcaaagcatctggtttggcccgttgctgaagctggagcccgatctggctaacttcaaagccgggacgtatcgccttgagaccggcatgacggtgcgccagctactgcaattgctggccagcggcaaagaggcgcaatttccgctgcgctttgtcgagggttcccggctgaaagagtggctggctgagctgcgtaaagcgccataccttaaacacacgctgccggatgatgaatttgccagcgttgcggctgcgcttaagcttgatgtcagccagctggaaggcggtttctatccggatacctatctgtatactgccaacaccagcgatgtggcactgctggagcgggcgcacgcgcgcatgaacaagctggtggatgaggtctggcaggggcggatggccagtctgccgtataaaacaccgcagcagatggtcaccatggcgtcgattatcgaaaaagagaccggcgtcagtgaagagcgcgcgcgcgttgcctcggtattcatcaatcgcctgcgcaccggtatgaaactgcagaccgatcccacggtgatctacggaatgggcgacagttataccgggacgctgacgcgcaaggatcttgagacgccgaccgcgtacaatacctataccatcagcggcctgccgccgggaccgattgccatgccggggcgcgcctcgctggaagcggcggcccatccggagaagaccaattacctctatttcgtcgcggatggcaaaggcggtcacacctttaccaccaatctggccagtcataataaagccgtgcaggtttaccggctggcgatgaaggaaaaaaatgaaaagtaa

SEQ ID NO: 99689 - DNA, 766 bp, Glycine max
  Peptide Sequence Number=SeqID_216467
tgagataatgatactgctgggttatcatgccactggtggttacaaattgtttaatctagtaaccaaagaagtgcttgtgagtaaagatgcggtagttgatgaatccaaggactggaattgggataaagagatggtagaggagcctacaaaagttgtgattgaagcttctattgatgagccaagtgattcttctgctgcagtaattgatgacagtgaccaaggaggagtaaggaaatcacagagagctagacaaccctctagcaggttacaggattatgaattgatacatgattcagcaataggggaggaaggtgagctagtacacttagctctatttgctgaatctgaatcagtgagcttggaggaagcaatgaatgacacaaagtggactgatgctatgaaagaagagctgaaagctattgaaaagaataatacatggcaacttgtgcctctgcctgctaagaaaaaacctattgtagtaaaatgggtttataaggtaaaaaagaatctgaaaggagagatttccaagtataaggccaggctagtggcaaagggattcttgcaaaaggctggcattgattttaagaaggtttttgcacctgttgcaagaatggagacagtgagaattattactgctatagcaagtcaaaaaaggtggcatatgcaccatatgtatgtgaaatcagccttcttgaatggtcctctaaaggaggaggtttatgtgagtcaaccacctgggtttgaaataaaaggaagtgaagagaag

SEQ ID NO: 99690 - DNA, 321 bp, Glycine max
  Peptide Sequence Number=SeqID_216468
atggtggaggaggagtttctaaggtggtttggatggagtattgagagagaaaagcgtgacattgtgtttctcatgctaaaaaatctcgtctcgctaagcaggagtccacttttggtgctaagcgcaacttttcgcgttagcgcaattcctctcaggttgggatttgcgctgagcacgacaattcgcgctcagcataattccctatcaggttggaattgtgccattttgagaatcccaatgatcaaactgtggggaaatatgtttggaacctacagtcaaaatttgaagacgatccaacaattaatgaatccaagattgtga

SEQ ID NO: 99691 - DNA, 300 bp, Glycine max
  Peptide Sequence Number=SeqID_216469
atgaggcagatgcttgttaatgagctcgcttcaatcagtaaaattgtctataattctgaacatcttgacctaattcttgatggtcttcctaatgaatatgagttgtcgatttctatgattactagtcggaattttggatggaacaattgtggtggtcatggttctgaccatggtggtggtggtggtagaggaagattggaggaggattatgttcctacttttcctccaccagcttcattttcctttacttcatctagttcaatttccactactcaagctcaaagtggtcaaacttcttag

SEQ ID NO: 99692 - DNA, 459 bp, Glycine max
  Peptide Sequence Number=SeqID_216470
ctgatatatgaagcgtacaatttggggcttagatcgaaaagaaattatgaagcaagtcatgatcgtaatgcaaacgctgcacgcaatttccttgatgaggaaattaagaatatgattgtgatgaggataatgaagagtactgttggcgtctgtttcttgtttttccttttatcggaagccattcgctgtgaaggctgttggaaggaagagagagatgctcttttgggccttcattcccgctttgacctcccttactcttgggacggcccagattgttgtcaatggaaaggagtcatgtgcaactcctccactgggagagtggcccaactcggtttgtggtctgttaggcgaaacaaatatagtactctaaattactcggattttgttgtcttcaaagatttgaagaacctcaacttgtcagaaaatggaatatccggttgtgcaggaactgaaggttaa

SEQ ID NO: 99693 - DNA, 306 bp, Glycine max
  Peptide Sequence Number=SeqID_216471
atgactaaagcacgtcaaaagggggtacgaaaagaaaaggaaggagatacttgccacccagctcgcccaggcgagctaggttgcttcctccagaagcaactgccttctggaggaacatcctggaaggcccaagtgggcctgcatgtcacggaacttcacggattgtgctacaacgcttttcttttgacttccggcatgtctcgaaacttcacaaattgcctaacgatgggtgccaaataccttgaagtggtcaaacgagggtcgcatcccaacaacggatggtccccggatgaaattaggatatga

SEQ ID NO: 99694 - DNA, 291 bp, Glycine max
  Peptide Sequence Number=SeqID_216472
atgtacaattatcatgagaaaggaagagctcctgatcttgaaagtgtattggcagacttcatgacatatcaagctagctctaaagattatcaatgggagtcagaatggcaaccttattatcacaatgaagcagaaggggtgtctaatctggatgacctgttaatgcaattcaagggtacagtagattcaatgcaacaagcatttaaaagagctgagactcagattggtcagttggtggacaacatgattaaagttgtggtcagaatagaagaagagtatgcaaaagattga

SEQ ID NO: 99695 - DNA, 159 bp, Glycine max
  Peptide Sequence Number=SeqID_216473
atgacattttccagaggagaagtggcgcttaacgcatcatccacactaggcccactgattaagccaaccaatcaggggtctgtgcgcttagcgcgagcaagctcaggcttagtgcgtgaagacatggcactttgcgtaagggtcgtgcttagcggatag

SEQ ID NO: 99696 - DNA, 182 bp, Glycine max
  Peptide Sequence Number=SeqID_216474
ttgcaaggaatacttgttctcaacaatgttgctgttgtttgcacccagtcaatagaacaacaaaggtgagtgaacatgatggtatttttcttgttgaacacatgacaaagctatgccaagacaatgcgaaggtaagtggtggtgaagattgtgaggaagaagataggaatgggagacattaa

SEQ ID NO: 99697 - DNA, 849 bp, Glycine max
  Peptide Sequence Number=SeqID_216475
atggccaagtttgaccctgagatagtcctagagttctacgctaatgcctggcccacggaggagggagttaaggacatgcgctcgtgggtaagggggaggggggtgcgaattatgcgcaccagcatgactactctgactcagatatggatgaccctgctacttagcaacatcctgcccagtgaccataattctgacctccctctgcctaagtgccagctggtgtacaccatcctgacacagatgactgttcacgtggcccagataattgctaaagctatttatttgtttgcagggacagcgaccactaggcatcctttcgacccggagaagtccaacagggccctgggattttcggccttgatcacgggcctctgccaattctacggagtacctatcatccccagcaaggtaatcgggccatcgatcacccgagctttcatcgagaaatattgcacccctaggcaggcgcaaggggacacacaacaggctgcggacgcaccaccacctcagcagcccgatctagttagaccactgagcgtggagcagtatctacggcatatggtttgccagcaggtggcaaaccatcgcgggcaggtgcagttgcatgagtgcttctaccgtttcaaccttagtcagcaaggacagggctccactccttttgtatgccctaccctagagcagttcaggactgaggtcgcatggcctagagattggcccattgaggaagaaatcagacccgtaggatcctcgggcgaagcggaggaagcccacgtgaatgaggatatgaccgacctactcggttacttgggagagggcggagccacacgaccaaggttgccgcacttgtga

SEQ ID NO: 99698 - DNA, 189 bp, Glycine max
  Peptide Sequence Number=SeqID_216476
atgcctccatctggcaccatatttcatccaataaggtcatacttttttgctgtagctggctctaagttgataaaaaggattgggctgatgtgttacaagaaaattattcacatggaagtaggctggtttgacaaagctgggataagaagtgagatatacaagttgcgggtgatatatgtgcaaaattaa

SEQ ID NO: 99699 - DNA, 348 bp, Glycine max
  Peptide Sequence Number=SeqID_216477
atgttttgtggtcaatcgcaacccccatttacagcgacgctgacagggactcgctccatgtggcgtccgccgataaggccatctgaatcagaccgccaccgacacggcttagctattcaccgtggatatggatacttgtcagagagtgttgacttcaccaaactttgtgaggacaatggtctcacgtttatagggcctcctacgtctctgctattcaagatatgggtgacaagagattatcaatctttttttggtatggattgtggcagtgcatctaagagaataatgggagttgtaggtgtgcctcttgtgcctggatatcatgggaggattgatgtggttttgtaa

SEQ ID NO: 99700 - DNA, 456 bp, Glycine max
  Peptide Sequence Number=SeqID_216478
cctcacactactcgtctggaccataaaacactgaagcttctcaaaaactggacttggcaatttgttgtgatacgtccagtgtgctcaatcttgatgataactctacagtatcttgatgtttatcccacttgggtcagctggataaacacagtcattctgaacatttcagtgtcactggcattgtattctcttgttgttttctaccatgtgttttctaaagagctggagccacataagcctcttgccaagtttttatgcataaaagggattgtctttttctgcttttggcagggaattgtgcttgatctcctggcagcactaggaataatccgatcccgttattcctggctagctgtggaacgcattgaggaaggctaccaaaaccttttgcaatatgcatacagtgctgctccatacaaagttaacagtgcaccttcagataaaaagtcaaagtga

SEQ ID NO: 99701 - DNA, 516 bp, Glycine max
  Peptide Sequence Number=SeqID_216479
atgttgctaagcagaaacatcatccagatctatgtaatggtggccatgctgcaattgactgatagcctcctcattgaagccggaggcctgactcctcctctgggagatctcacagtattggccttcctccaaaaccagtggatgccccaaaaactgattgatggcatctccatcaaagggaatccactggcccctcacccagaagtgcatgtctctgactccttcttccgtaggcttagcattagcacaaaactccatgactatctcaggatcaaacttagccatgggcgatacaagctgagcccatcgcctccaggctatctcctcttagaactcaacatactcctcatccctcagctggactcgcctccctttgaggaacgaccagcctttgatggcctcaaaccgttgttggtgtttcgcactccgggacttgtgtctatcgaagtccatatctgcctacggggccgcacgggaaccctctccagtggcatccttcctagacctcttggctag

SEQ ID NO: 99702 - DNA, 270 bp, Glycine max
  Peptide Sequence Number=SeqID_216480
atggtgccagaaggattaataaacatacccttgccaacccctttaaaggccaagaaacaccctgatttaaaggttgcaaatgacctcccttttgagacaaaaatggaggaagtgaaggaagacatgaataacctaaagcagcagtacgaagcatcaatcaaacgtgttgaagaatcacagccgccaaacaaatctgatggcggctttaaggaaatcaatcttgtgcagggcaatggaaggaggaaaattggaggcatagttatgttttaa

SEQ ID NO: 99703 - DNA, 147 bp, Glycine max
  Peptide Sequence Number=SeqID_216481
atggccgccgccgtgaccgatatggcccgccgtcacacgattagccaaatactggtcgacctcgtcaagttcgccgtcggttccgccatcgacggctcacgcagaatcatccctgaaattgaaatgaatctacatgtgaaaaattag

SEQ ID NO: 99704 - DNA, 588 bp, Glycine max
  Peptide Sequence Number=SeqID_216482
gatgatggggaaattgaaggggatgtgaatcatcgcattcaagcaggatggatgaaatggagaaaagcatcgggggtgttatgtgatgcaaaggtaccgatcaagctaaagggaaagttttattggactgcgataagactggcgattttgtacggaacagaatgttgggcggtcaagagccaacatgagaataaagtaggtgtagcggagatgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttataaaaaaggatctcgaacttaatgatttggatagaagtatggtcatttccagagccattacagagtgtgtcaaaaacaacatagatgttccacgaccggattatgaaagaaagttcctcgatggcatgatccatgaatga

SEQ ID NO: 99705 - DNA, 417 bp, Glycine max
  Peptide Sequence Number=SeqID_216483
atggagactggagatattagtcagcctgaaccaccgaaacaggtgtggtgtgaggaaaaacaggcttctgttcatgaagaaattaagagaatgaaccaattgcctgcaaacagttcatatgttacacatcgtctgaaggttcttaataaaattttgcaactcatgtcagttcagaactgtatcccgagagcaggagttggagttgctttttgccgggctttctttgtgaaagtagtattgctggccatgcccctgacattagtggatctgcatcttgaaggccaaaagataaagaacaaggcttgtttacagtttagtcaaggctttactcataacttggctgagcttaagcagcaatgtctgtacccttctttggctacttttgatataatagtaatacatcatgttgcaagttga

SEQ ID NO: 99706 - DNA, 1083 bp, Glycine max
  Peptide Sequence Number=SeqID_216484
atgagtttgagtatgagcttgtgtggtagttacagtcttcaaattcgaaatcgcagaattgtaagctgcaatcttcaccaggatggcaggcatattgttcccatcaatacgcaccaaaaaacttccaaacctgaaaattgtcttcggtccaaatggaagattaatggcaataacattaggacatgcattggagtcatgacagtggcacacttggttgctccagtcactgcaaaagctgaagtggctgcttctatttatgctttggctgatggaagcctcaatgactggtttggaggctttctatattcagctggacaacaggccaatgaagctgttcagggccaattaacctctctcagtttcactagtttggctgtaatttatggggcagggcttgtgaccagcctttctccctgtacacttagtgtcttaccactgacccttggttacattggggcatttggctctggcaaaagcagagcagaggtttctactcacaacaatggtgccttacattttattaaatcaggcattgttgtaggagattccattgcattctccttaggtcttgcaaccacattagcactgttgggtgttggagcttcatttgcaggaaaggcttatggacagattggccaaggattacctttggctgcttctggtttggctataattatgggtctgaatcttcttgagatcattgagttacggctgccctcattctttgacagttttgatccacgtgcagccgctgccaatttcccatccagtgtgcaagcctacctggctgggcttacatttgctttagctgcctcaccttgtagtacacctgttctggccactcttttgggatatgttgctgcatccaaggatcctgtgattggaggcagcttacttttgacttacacaactggctatgtttctcctttactcttggctgcttcttttgctggagcattacagagcttgctctcatttcgcaagttctcagcatggatcaatcctataagcggagcaatgctgttaggtggtggtgtatatactttcttagataggctgttcccagtcacaatggtgatgtag

SEQ ID NO: 99707 - DNA, 1449 bp, Glycine max
  Peptide Sequence Number=SeqID_216485
atgcagatactggaaggacttcttaaactaccagagaataaggagtgcgctgactgcaaagctaaaggtccaagatgggctagtgtcaatcttggcatctttatatgcatgcagtgttccggaatacatagaagtcttggggtacacatatcaaaggttcgctctgcaactttggacacatggctcccagagcaggttgcattcattcaatcgatgggaaatgagaaggcaaatagttactgggaagcagaattacccccacattatgatagagttggaattgaaaatttcattcgtgcaaagtatgaagagaagagatgggttgcaaggaatgagaaaccaaaatcaccttctagtttccgagaagagaaaagtccttcacattggcaaaagcctgtggaaagaggtgggcatgattatgcagctgtgtctgagaatacttttgaggaaaggaagaaaatccaaccatcacatgcaattcctgctacaagaattagtgttcccgctccacccaaagggcctgagctggtaactactgtggcaaaacctcaacatgttgagaaagtggaacctgttgcaccatcaccacaagctgaaacttcaaaacagactactgacacaacacaaaattccccttcaaaagttgactatgctacggacctttttgacatgttgtctatggatgatccaaatgaaaagggctcaggggcagctgatgctactgctgatgataataactgggcagctgctgcagaggcatcgacagctgagaagactgatgctacaaaagcagttgagagtacaccccagtccacttctggaattgaggatttatttaaagactcaccttcagttacaccaagtttaactacagaaaaaccacaaaaagatgtaaaaaatgatatcatgagcctctttgagaagtccaatgtggtgtctccatttgcaatgcatcaacagcaactggccatgctggcacagcaacagtctcttctaatggctgccgctaaatctgctggtggggatcccaagtacctggccagcttacaacaacaacagtctcttctaatggctgctgccgccgctaaatctgatggtggggattccaagtacccaaccgccatacaacaacctgggtccaacattcctgtccaaagttggccagctgctagcttcccaatgcctggtgcaatgcccatgggtggtctggaagagttacagaaactcatgcagacaatgaacatgaatgcagcacattcagcagggagttcatttcagtatccaccatctagttactatgctatgggacaagttgctcccactaatggtacggcaccaacgggagcgagcaaaccacagtcagcatctccggtatcatctaccacttcaaagacagggaacgactatgatttttcctccttaacacaaggaatgtttgcaaaacactga

SEQ ID NO: 99708 - DNA, 210 bp, Glycine max
  Peptide Sequence Number=SeqID_216486
atgttcagcccttctggtattgagaattctctcgaaattagtggaaaaaattgtttccataaagaaaatcgaagccgaagtgcttccgtaacgctttcgagacgtttccatgggcaatttcgtggagattcttcaccattcttcggtcttcaaccgttctcaaaagaactacgtaggtctgatttcctcattgcaattgaggatacgtag

SEQ ID NO: 99709 - DNA, 442 bp, Glycine max
  Peptide Sequence Number=SeqID_216487
gtccttagggcagaactcgagcaagcccaaacagtcaaagagggctcgtagggaagagcacggccggaacaagtttcgaggggctctgtggggcagcaataacgagcttatgcttcgaagggaagagagagaccaatcacaagtacatagcatggccttaaaggaggagttagctgctagctcaagatccaagaagagtttgacccaacacttagaagccacgaagcaaaacatgctagctataatagggcagtacaaagaagagttaaaccactctttgacccatgagcaaaagctagtagaggacttcgcacaagcatacgccgagaaggaagcaaaagggagggtgattgatgcattgcatcaagaagcgaccatgtggatggaaagagaagttctgaaactcatcacgttgtctaaaaaggccttgaggtggatctaa

SEQ ID NO: 99710 - DNA, 222 bp, Glycine max
  Peptide Sequence Number=SeqID_216488
atggaaaagagcggaggcaaacagaataattttgggtcaatgaaagaaagggaatggaaaatcttcagatcagataaattctcggcaagattgccattctcgactggcgatatcccaccccacatgaacaaagagaaaaagaccgaaacacccggcttcctctccaaaaacacttccctcgagaaaatcctattggtccgtgatcgtacgtttgatctttga

SEQ ID NO: 99711 - DNA, 1476 bp, Glycine max
  Peptide Sequence Number=SeqID_216489
atggttgaagagttttacagggcatatcgggcattggctgagagatatgatcatgcaactggagtgatccgccacgcccataagaccatggctgaagcatttcctaatcaaggtgcatttcttgatccagatgaaccacaaaaggatgtttatgctcatttccatgctatcaaaagaaatggtggttatactggtgaacccgattctcctttgaacaaaaccggtttgaaacagctcaatgatctctacatccctggagaacaagaaaatcttccaaagtttgctagaagggggctcaatttttttgagacgcgggaggagagtaatgagcaaaacagtggaagcaacaacactttgtctgagtctaaacgtgtgacaaaagatgagacagtaattttggccttgaagaaagccattgccaaattagaagatgaaaaggaagctggcttgcttcaatatcagcagagtttggagaaaatgtctaatctcgagttagaagtgtctactgcacaagagaattctcgaaaactcgatgagcgagcaagtaaagctgaagctgaagttcaagccttgaaggaagcccaaatcaaattacaggctgaaagtgaagctagtcttcttcagtaccagcaatgcttggagaaaatatctaatctggagaaaaatatttcttctttgcaaaaggaagcaggagaacttaatgaacgagctactaaagctgaaactgagtctgagtccctaaagcaggaacttgctagagtagaagctgaaaaggaagctacccttgttcaatataaccagtgcttggagacaatatcaaaactggaggagagaataaaagaagttgaggagaatgcaagaaggattaaggagcatgccaatatagcagaaaaagaaatcgaagctttggaattacaagttactaaacttaatgaagaaaaggaagatgctgctctccactatcagcaatgcatggagataatttccagtttggagtataagctctcttgtgctgaagaggaggtgcataggctaaattccaagatagttgatggggagagactgcaattcattgaggctgaagctgctttccaaactcttcagcagttgcattctcagtctcaggaagagcttagatctcttgcttctgaacttaacagtaaagtggaaatactggggaatgtggaatcttgtaagcaggctttagaggatgaagtacacagggcatatgatgatgatgactatgaaggaagtttttgtgacaaccctttgttggagaagacttcaaatgaatcaaatttagcaagcatagatagccatagaaagtgctttccttttcggtttggtcgtgttggaaatcggcaaaagattgtgattttggttactttgctagttttcatcatcgtggttgcttttgttgtagtaatctggattgggataggaaagaatcccattgattctgaagtggcagctcag

SEQ ID NO: 99712 - DNA, 288 bp, Glycine max
  Peptide Sequence Number=SeqID_216490
atggcgggtcacagcagctacacttctgggagatgccacacaggtcacaggcacgggctctctcacgtactcacagcacgagctccactgcacacaatgggcattgccgagagagtgaggtttcgaggaactttcaggggtttgaggtgggtttcgagagagcgagagagagcgaagggcacaatagagagaggggttagagttagggcacagcagagagaggggagagagcgaggttcagctatgttgtggaaagagagagtgaggttcagcagagagaggggttag

SEQ ID NO: 99713 - DNA, 459 bp, Glycine max
  Peptide Sequence Number=SeqID_216491
gaaaatgagggaggagcttgccacccagctcgcccaggcgagctaggttgcttcctccagaaggcaccgccttctggagaacatcctggaaggcccaaattctttttccgtaacgttatgaaactttacgaattttgtaacgatacttgttttcttttcgtaatgttacgaaaccttatggatcacgcaatcatcccctttttgggcttctgggatgttatggaactttacggattgcgcactaacacttcctttcgacttccggcatgtcacggaacttcacgggttgtgcaaaaatgctttcttctgacttccggcatgtcacggaacttcacgaattgcctaacaatgggtgccaagtacctcaaagtagtcaaacgagggtcgcatcctaacaacggatggtccccggatgaatttagggtgacacacgtcaacagatgtgacttttcattttga

SEQ ID NO: 99714 - DNA, 210 bp, Glycine max
  Peptide Sequence Number=SeqID_216492
atgcgtctaccggggaaggagagtctgctgatgaaatctcccataaccataaatgagattttggatgttagcatttcgtttctaaatgatcatttagaggaaacactgggttcgacaaaaatagaagaaatccactcaaagtgtatcaatctcgcacagatattgtccggtccaaagacctctctgcatattccttctgtttttccttag

SEQ ID NO: 99715 - DNA, 348 bp, Glycine max
  Peptide Sequence Number=SeqID_216493
tttcttggttcagttgtggcatctgtggttggtttgagccatcttttccacactgtggcagactcaaatagtgcaagactaaaagaattatttcctcggaaagtctttgaactcactaggaattatttcaatggctcaattccaaaaagccttggacgcctctcatcagttgtcactcttacaattgctacatgcttcaggaaccttttaggaaatcgacttactggttcaattccctcagaaattggtgacatggctagtctgcaagaactgattttggaagataatcaacttgagggacctcttcccccgagccttggaaaaatgagcaacttgctgagattgtga

SEQ ID NO: 99716 - DNA, 426 bp, Glycine max
  Peptide Sequence Number=SeqID_216494
atgacatttcctaatctgaagaatttgaaacttttgctaagactggaattgaggaattgcttaataactgttcccattccaaactacattggagaaatagaaagtttgaaaagcatagatctgagctccaacatgttaacaggttcaatcccagattcatttcaggatttgggaaatctaaattacttgtttctaactaacaattctctaagtggaccaattcctgattggatactgagcataaaaaagcatattgatttatctttgaacaatttcacaaagacttctgcaaataattgccaaatgccggatgtatttttcaggagaatgatagatcttatccagcgcaagttgttgcagcccagatacgcacactgctatataaacatgaaggctgcacgagttttctaccaagtccgagattga

SEQ ID NO: 99717 - DNA, 249 bp, Glycine max
  Peptide Sequence Number=SeqID_216495
atggatgaattagagaggcgtaacttccataagcgcctcaccaatttagctggcactagcattgacctagcattggtgaaggagttctatgccaacctctacagtcctgagggactttcaccaaaacaagtcagaatacagggccacttgataagaattgaagcagacagactcaatgtctttttagaaacacttgtggtgcttgctgagggtgatctttacccgcttactcaagatactgcagggtga

SEQ ID NO: 99718 - DNA, 611 bp, Glycine max
  Peptide Sequence Number=SeqID_216496
atgtacactaggcatcaacattttctaaaacctcatcacccttgcaggcgattgaaaaaagcatttaatggaagtcaagagcatgaaactgcgccgataccattaactggtgaccaggtcttccagcggatgttagacattgtattgatgttatgcatgtggagaaaaatggctgggacactccttaacattcaaggcaagacgaaagatgattgggacgagacattttgcctaacaaacaaagtccttgatcttgtgaagttagatgagctggaaaatgaggctgctattatattgtatcagttggagatgtattttccttctgctttctttgacatcatggttcacttagttgttcatctgcggatgtactcggttgagtggtacatgaagatcttaaaagggtataccaagaatctacatcatccggaagcatctattattgaaaggtacattgcagaagaagccattgaattttgttcaaagtacattgaaaaagctaaacctgttgggcttcctgagtctcagcatgatgaaagagtgggaggtaagggttcaagaggactacatgttatcactccaattgtagaagatttgcaacgagctcattt

SEQ ID NO: 99719 - DNA, 198 bp, Glycine max
  Peptide Sequence Number=SeqID_216497
atgaggcatcttaagtcaattttcagactcacgatactcgctacgcctcctcttcctctcaaatgtttgggaaccctatcagagcagtcagagaaaaaacttgaggaatctcaggaaaccgctagatatgctgctatttctgtcacaatgagttattcacatttggggaatagtgagaacatgtgtagggatccttag

SEQ ID NO: 99720 - DNA, 1553 bp, Glycine max
  Peptide Sequence Number=SeqID_216498
atggaatcttgtgcgcaattcgggttgtgggtggtcttgatcttgtgcttggcgtttcaaattcaacccaattatgggttctaccttccgggcagttacccccacaactatgatgtcacggatgagttgtgggtgaaggtgaattccctcacttccattgacacagaaatgccctttagctattacagcctgcccttttgcaagcccgagggtggcatcaaggacagtgccgagaaccttggggagcttctcatgggagataggatagagaactctccttataggtttaggatgtacaccaatgagtctgagatttacttgtgccagatccaggcgctgtccggggaccagttcaagatcttgaaggagaggattgatgagatgtatcaggttaatttgattcttgataatttgcctgctattaggttcacacagaaagatgggtactttatgagatggactgggtaccctgttggtattaagattgaggatgcttattatgtgtttaaccatctcaagttcaatgttcttgtccacaagtacgaggagaccaatgtggctcgcgtaatggggactggagagggtgcagaagtgatcccggttggcaaggaggggtcttctgagaagcctggatacatggttgttgggtttgaggtgattccttgtagtattatgcataatgctgattctgcaaaaaacttgaagatgtatgacaagtacccgtcatctatccgatgtgatccggccactgtggcaatgcctatcaaggagggccagcctgttgttttcacttatgagatcacctttgaggagagtgacatcaagtggccgtctagatgggatgcttacttaaagatggagggagctaaagtgcattggttctctatccttaattcgctcatggtgatcacttttcttgctggtattgttcttgtgatcttcctgaggacagttagaagggatctgacccgttatgaggagctcgataaggaggctcaagcacagatgaatgaagagttatctggttggaagcttgtagtgggagatgttttccgcactccgacaaatcctgctttgttgtgtgtgatggttggggatggagttcagattcttgggatgtctgttgtgacgatattgtttgctgcacttggattcatgtcaccggcatctcggggaacactgatcacaggtatgctgtttttctatatgatacttggtattgctgctggttatgtctcagttcggatgtggaggacaatcagctttggcgaacagaagggctgggtgtcaattgcatggaaagctgcgtgtttcttcccaggcatttcctttttgatcctcacaaccttgaacttcctattgtggggaagccacagcactggagccattccattttcactctttgtaatactaatcttgctttggttctgcatatctgtaccccttaccattgttggtggctactttggagcaaaggcaccccacattgagtatccggtccgaaccaaccaaattcctcgcgaaattccccagcagaagtacccatcatggct

SEQ ID NO: 99721 - DNA, 510 bp, Glycine max
  Peptide Sequence Number=SeqID_216499
atgagatcaattctgcataggtttgctgaggaagatacatcatacatgtcacaaaggactgaagatgtgcgagctcatcctactcatttcttgcatatgtttggatttggaacgcgcaacgggctctgccagtgcccggtgacgaagaattcgaaagaaagcacgtttcgcctccgaaaagggacgacgatcgagagggccattatgtcttcaatcttggcgaaaatctcactcctagatataaaatcctcagcaagatgggtgaagcatattgctagtgctgtaggcacatttggtcgggttttggaatgttgggaccgccaaaccagagaatatgtggctatcaaggtagttagaagcatacggaaataccgggatgcagcgatgcttgagattgatgtgcttcaacaactagccaagaataatagaggaagctcccggtatggagcttatggagtaaaatggattttaaatttttttttataccttattgtaccaagggatgactaa

SEQ ID NO: 99722 - DNA, 468 bp, Glycine max
  Peptide Sequence Number=SeqID_216500
atggaaaaagggtatgtggcaattcgagtttttgaagatatgcagaaagcaagagtggctcctaattgggtaacatttgttggtgttttgtcagcttgtgctcatgaagggattcatcgcaatcttgagattgctgttgttgccatggaacaacttttagagcttgagcctgaagaatttggaaactatgttttgcttgctaacatatatgcggaacttggtaagtgggaaggtgtatcagatgttaggaaactaacaagaagcaagaggataaagaaaacccctgggtgtagcttgattgaggttaacaatttggttcaagaatttgtatcgggtgacgattcaaagcctttttcacaaaaagtgttttggatcctaaaaggactgagtttacatcaaactagaaccaatgacttaatagaatttgtcgaagaagatgcaggtcaactttatagtaaagttatttag

SEQ ID NO: 99723 - DNA, 173 bp, Glycine max
  Peptide Sequence Number=SeqID_216501
atggcacttgatgaggcaggggcaattccaattctcattgacctgatgaatgatgttgatgaggttgaggaaccaagggataatgttgtagaggctcttgtcatttattatgttgatccattatatcatgatagagtgtctgatacgattaatgttccgtcgttcagaaatat

SEQ ID NO: 99724 - DNA, 1413 bp, Glycine max
  Peptide Sequence Number=SeqID_216502
atgaaggcaaaagaaaggagaattcaaggacgacagggatttctggaaattggtcagggagaacagaaacgtggcgaggtcaagattgtcattctaattcaagtcgatatagctatccttcttggtatttacagctactggtctatatgcaacttgaaggtgaagacccacatttggtggaagcttcagaaacacactccttgtttttcttcgttacctttgtacttaaatttccctaccctccatgcacgtatccctcaagtcattgtttcgtttccaagtgaaccacataacttatataaaccatcaaaacttgattcaagaagagtttgtctctccatgcaaaaggaaaaggaagcaattatcaaggaggggactacggaaatagaaatggaaggaactcgtgcaaaagagggaaccctaccaccgggatttcgatttcaccctactgatgaagaacttgtcacttgctatctcgtaaataagatatcagattctaattttacaggcagagcaataactgatgttgatctcaacaaatgtgagccatgggagcttccagggaaagcaaagatgggagaaaaagaatggtacttcttcagtctgagagaccgtaaatacccaacgggtgtgagaacaaatcgagcaactaacaccgggtattggaagaccacagggaaagacaaggagatcttcaacagtgaaacatcggagttgattggcatgaagaagactttagttttctacaaaggcagagctcccagaggagaaaaaagcaactgggtcatgcatgaataccgcattcactcaaaatccagctatagaactaacaggcaggatgaatgggtggtttgccgggtattcaagaagagcggtggtgcaaagaagtaccattcctccaaccatgcaagaacagtgaatccatacagcttggaaattggaccaagtatcatgccaccaccaatgatgcaactgggagatcctagtgctcatttcctttatggaagaaactacatgaacagtgctgagttagctgaacttgctagggttttaagagggggtggatcaaccagtagtgtcaacctcccaattcagtctcagttgagctaccctacatcatcatcagctggaggaggaggattcatcatttcagggctcaatttgaaccttggaggaggagcaacagccacaacacaacccattttaaggccaatgcaaccttctcctcctgtccatacaatggcccaagtacttgatgtgaattccagcatgatgacaaccagttctcttggtgctgagaataatgttggttatggaacagaagtgagtaacaatatgaattctcatgggaataggtatatgggcatggaccaccattgcatggatcttgacaactattggccttcctactaa

SEQ ID NO: 99725 - DNA, 297 bp, Glycine max
  Peptide Sequence Number=SeqID_216503
atgaatgcatcggtggaggcgagaactaaccttgcttgtgatcggcacctttttcagaataatgcagaggaaaaaactgctgcaagagagagagacaagagtgagaagctttgcaagaatgaaggagtgagagaagaggcaagaactgaccttgcttgtgaccagcacaaactttccgatgcagtcaccggaaaccaccgtcggcagctgagtgcggaggttttcggtcccgaagccaagagagagaatagtgaaaggatgaaggatgtttcaagaagctgtggtattctggcataa

SEQ ID NO: 99726 - DNA, 531 bp, Glycine max
  Peptide Sequence Number=SeqID_216504
atggactcaaaagaggatgcactaggggttgtggattctgaaggggaaaaccaggaggaacaaaaggtacagaaggagaatgagagggagacagttgagaggattgaggggcctcagcaaggaaaaacaggcacagtcaaaggttttaaggaaatgaaaatcaggatccttgttgaaaagggtaacaaaaggaatggcaaaattgagggaagcaatgggaagtctattaatcagatagacagcagtaataaaggcataatcccaaaacttactcagcgatggatggtgaacatcacgagatttcgtatggagactaaagtactcatgaatcttctcccaaacttgataggagtgattcgagccaaaccaaacaaggagcgtttggtcttgaacttcccaagcttcatactcaggattcacacgatctgcaatgcgatcatcctccgtgagatagcgaggcagaacgatgggattgacgacgaaacgctgcaattatacaacttgataaccagttctacatgttgtcgctag

SEQ ID NO: 99727 - DNA, 537 bp, Glycine max
  Peptide Sequence Number=SeqID_216505
atggggatagcagaagcatgctccagattccttggggactttttacaagcattgaaatgctccccacaaagctcagtgtctcaccttgatcacaagccccagaatgtgctcaaacttaatgacaagatggttggtgcccttgtcagtgtttttggcatggaaaccaacggaagaatcaagaaggaaaatgctaggcaagtggtggagaagctaggtttgatgtatgataagtcctcatcatcatcagggtttgagctaactaagggtggcttgctggatgatgaagtgcctgtggaagaggtgcttggtgagttggaggacatgtcaaagcggagtgagcttttgcatgaagccttcaagatctttgatgaggatggggatggatacatagatgcaatggagttgaagagggtgcttgattgcttggggttggacaagggttgggatatgagtgctattgagaagatggtgaaggttgctgatttgaactttgatggcaaggttgattttggtgagtttgaattgatgatggggtag

SEQ ID NO: 99728 - DNA, 1314 bp, Glycine max
  Peptide Sequence Number=SeqID_216506
atggcgcctccgaagctcttcgtatttgcgctttcagtaaccctgatttttgccatcgttggggccgaagccgatgtttccgtcgaaggagccactccagagcctgatacctccgccatcaagatccaattagatcaactcaattccaagatccaaattctcgagtctcaaatcagtgaaaagttggaagaagtgaagaagaaggacaaaattatagcagaaaaagaaaattccattgaagataaatcaattaccatacaatccttgcagaatgagattgcttctctccagaaaaaagggtcactggatgctgaggagcaggttggaaaggctcatgcacgtgctggtgaactacagaagcaggtggacaaacttaaaagggaactagaaacacaaaacaaggagaaagtgaactgggaaactcgagtacctgagttagagaataagattcatgacttgaactcaaaattagaagatcttcaaaagataaatgaggaacagaagacaaaaattcaaaaaagtgaacgcgctcttaaagttgctgaggaagaaatgttaaaggcaaagtttgaggctactgccatagaaaaagagctgagggaggctcatggtgcttggcttcccccttggcttgctgttcactatattcatagtaagtcttttgttgatagtcattggaacaaacatgggaaacctgctttggaaatggttactcaaaaggccctagagaaaaaggcacaagctggaaagtgggctgaacctcatgtggaaaccattaaaacttggtctgtggtgaaaacaaatgctgaacctcatgtgcaattattgaccacgaaaactgttgaagtttatgaggcatcaaagaatgcaatttccccccacttaagcaaggcaaaagaagttgtagatccttattatcaggaagctagaaagttcagcaagccatacattgatcagattgctattgcagctaaacctcatgttgataaagtacaagaggttttgaagccctacacaaaggaggttgttcgtgtttatgggaagtttttggaatcagctactacatatcatcgccaggtccaagcttctgtccaagagacactgaaaaagcatgagcttactagacctcttgctactaaagagttggaatggtttgcggcctctgcccttctggctttacctattgttttaatggctagagtgttttcagctgttttctgtagcaaaaaagtgagtaaacctgctcgaaatggaaacactcaccatgcacgacgtaaacctaagcgagggcatctagacaagcacacaacatga

SEQ ID NO: 99729 - DNA, 263 bp, Glycine max
  Peptide Sequence Number=SeqID_216507
ctgctactctcattcccttttccctccctattctctctcctactgttaacgttttctgttttctttccgtcgacgttctggctgcgtcccaagaatctctgacgccgttgtcggttttctccggccacggctacttccaacggatggcgacgacgaccacggagttcgatctcgattacgagttccccgatctcgattacgaccttcgctatctcagtctcgccggaatcgatgccctcaccgctttccaaaacctattaccg

SEQ ID NO: 99730 - DNA, 1098 bp, Glycine max
  Peptide Sequence Number=SeqID_216508
atgcaggaaagcctgacgcgcacggtttcttcggtgcgccgcggcgttgacgaaatcaataccggttcgcacgagatcgcggccggcaacaccgacctgtccagccgcaccgagcagcaagcggcctcgctggaggaaaccgcggcctcgatggaagagctggcctcgacggtcaagcagaacgccgacaacgcgcgccaggcgaaccagctggcggccagcgcgtcggatgttgccgagcgcggcggttcggcggtggccgaggtggtcaacacgatgcagggcatctcggccagctcgcgcaagatctcggaaatcgtgtcggtgatcgacggcatcgcgttccagaccaacatcctggcgctgaacgcggcggtggaagcggcccgcgccggcgagcagggcaagggcttcgcggtggtggcgggcgaagtgcgctcgctggcgcagcgcagcgcgcaggcggccaaggagatcaagggcctgatcgaggactcggtgagcaaggtgggcgccggttcgcagcaggtcgaacgcgcgggcgcgacgatgcaggagatcgtggcgtcggtcaagcgtgtgacggacatcatgggcgagatctcggcggcgtccgaggagcaatcgagcggcatcgaccaggtgaaccgcgcggtgtcgcagatggacgaagtgacgcagcagaacgcggcgctggtggaagaggcggcggccgcggccggctcgctgcaggagcaggcgcagcgcctggccgaggcggtggcggtgttcaagatcaacgcgggcgacgtgatcgaagtgccggcgcgccagctggcgcagcaccgcagtgcgccgcgggttgccgcgccacaagcggaaacggttgcgccgaccccggcgccggccacgaccgctgccgcgcccgcggcgcgcctgacgcacagcgcgccgcgcgccaaaacggcgacggcggaggcggccagcgcggcgcgtccgccgcggcgcccggccccccgcgcggcggccaacgatgccaagccgacaccggcggccacccgccgccaggcgccggccgacgatgactgggaatcttttgacgccggtcgagaccggtaa

SEQ ID NO: 99731 - DNA, 804 bp, Glycine max
  Peptide Sequence Number=SeqID_216509
atgccagctataggttttactaatagctggggcgttatgctgctgcgacacatccgttattttctggccgttgccgaacagggcaacttcacccgcgccgccgaatcgctgcacgtctcgcaaccgacgctgtcgcaacagatcaagcagctggaagacacattgggagcgccgctgttcgatcgcagcggcagagccgtgcgcctgaccgacgccggtgaggcgtggatgcgctatgcgcgcttggcgctgcaggatctggatgccggcgcgcgggcgatccatgacgtggcgacgctggcgcgcggccatttgcggctggcgatgacccccacgttcaccgcctatctggtggggccggcggtcgatgccttctaccgccgctatccggggattacgctgagcattgaagagatggcgcaagagcgaatggaggcgctgctggcgcaggataggctggatctgggcattgccttcaagatggcgcagtcggcggaggtggaagcggcgccgttgttcaatgagtcgctggagctgatggtcggcaccgatcatcccttggcatctcatcgccggccgctgacgctggcggagtggcaacatctgccgctggccttgctgagcggcgactttgccacgcgtggcggtggaggccaatgcgctaggcgccatcgtcgagatcgtgcggcgcgggcagctcgccacgctgctgccggccgccattgcgcgcgagaaccggcagttgaaaaaagtggctttggccaacgccatgccggtgcggcaggcggtatggctgcagcgtaa

SEQ ID NO: 99732 - DNA, 666 bp, Glycine max
  Peptide Sequence Number=SeqID_216510
atggagaaacggatgaaagaggtgattgaaggcttcctgaagttccagcgcgaagcctttgttgaacgcacggcgctgtttcagcagttggcgacccgccaaaacccgcgcaccctgtttatctcatgttccgacagccgcctggtgccggagctggtcacccagcgcgagccgggcgatctgttcgtgatccgcaatgccggcaacatcgtgccttctttcggccccgaacccggcggggttaccgcctcggtcgagtacgccgtcgccgcgctgggcgtcgaagatatcgtgatctgcggccattccgactgcggcgcaatgaccgccatcgccacctgccagtgtctggatcacctgcccacggtcgccggctggctgcgttacgccgattccgcgaaggcggtcaatcaggcttatccgcacgcctcggacgaggcgcgggtcgcatcgatggtgcgcgaaaacgtcatcgcccagctcaacaacatcaaaacgcacccttccgtcgccctggcgctggatcagggacgcctgacgctgcacggttgggtctatgacatcgccagcggcgctatcgaggcgctggacggcgaaacccgccgcttcgtgccgctcgccacccatcccgaggtgaccgccaccccggcgctcgcccgtttttaa

SEQ ID NO: 99733 - DNA, 654 bp, Glycine max
  Peptide Sequence Number=SeqID_216511
atgataacatcggacgacgaaggggaggttggtgatgttcttgacgacactaataccaatttctccttctcgccggagctgcccaaccagaaattgtctccgtctcgtacccaacgggcagaaggagggaccgatgtgcgctgttgtgatcttagacccctgggtaatatccaggcagacgttacacccaaagaaaagtcaaaaggcactgtagaaggtatgctgggctctagctttggtaagctcaacctaggggacagcttcgcaggaacagaagaggaagctgctaacaccaaagaggtaacctgctataataccctacaggatgatcgaaggcacaggaatcacatagagggaaagtatttgaatggtggagcgaaagtagctgctgaccagacctttatcggggaagaagagggacatgtcacgcagtctctctctccttctttatcggggcagattcaacaaggaattgggccaggttgcattaagggcccaatttcgactcaaggagggtgtaataaagaagacatccacccagttgagcttttgggggtgcaagctgtgcagaatcaaaaagagggtgggctaagtaatgatttaggcccaattttgaaaactgacgggtgccataaggaggatccctacctgtaa

SEQ ID NO: 99734 - DNA, 276 bp, Glycine max
  Peptide Sequence Number=SeqID_216512
atgacgacaacgatgatgcttctcccccaatgcgggtggatctcctccgatactatccgcatctggaggatccgtaacgactatcagtggaagcttgtagattttattcgaattctttttcttgtgtttctggggagggagacgaaagatgagtcggaaataatcatcgtggagggcgtggttggcgatagggaaggggaggttgtgtgcatgcaacaatggtggaagttaccgtcgagaagagtgcggagggaggccagtgcatatctggaatga

SEQ ID NO: 99735 - DNA, 165 bp, Glycine max
  Peptide Sequence Number=SeqID_216513
atgacaaatggcgacgatgaaggggagtttgagccaaacataggtgacgacaatggtggggcagggggagaagccccacatccgtatcctagaagagagggtgcttggctggcacaaggaagagggagaagaggtgttagggatgagggtattttttaccattga

SEQ ID NO: 99736 - DNA, 1170 bp, Glycine max
  Peptide Sequence Number=SeqID_216514
atggatcagaaggtcgatttcagcgctccccattccatgggaaccactatcatcggcgttacttacaacggcggtgtcgttctcggagccgactctcgaaccagcaccggagtgtatgttgccaaccgagcatcggacaaaatcactcagctcactgataatgtatacgtgtgtcgctctggatcggctgctgattctcagattgtctctgattatgtgcgttacttcctccatcaacacacaatacaacttggacaacctgcaacagttaaagttgctgcaaaccttgtccgacttctctcatataacaataagaatttcttagagaccgggttaattgttggtggatgggataaatatgaaggtggacaaatttatggagttcctctgggtggaacaatagtacaacaaccttttgctatcggaggatctggctccagttacttgtatggtttctttgaccaagcctggaaagagggaatgaccaaggatgaagctgaggatttagtaaaaaaggctgtttcactggctattgctcgtgatggtgcaagtggtggggttgtccgaacagtcataggagtgaccaggaatttctaccctggcgaccaacttccattatggcacgaggaaatggagccccacaactccttgctagacattcttggtgccccagagccgatgagcatggagttaagtgacagtagaggggaagaaggaaagaaagatgagcgtgaagttgaattgcgtgggtggtggcgagactcacaacgtcttcgtttacggtttaagatcaaaggtcgcgtttatcccgctattctccccgtccaaaacaacaaagttaatggcagggtgcttcttggtatctccggagtagaactagatatcttagatgagttcgaggatgttgaatatactagaactgatgttgaggtttccttgaaggacaagtctgaaaagttacaagtttgcgcttatgtttggagcaacccaaatgatcctaacttaaatgcagagtgggattttgaggaatggaaacaagttcacttgaatgatttcgtcaagatgactggtggctttatgcaagagttggaattgccagaatcaaagccaagagtgcagacttatgaaaccttctacaagcaagaaaacgataagccacttgaaccttga

SEQ ID NO: 99737 - DNA, 513 bp, Glycine max
  Peptide Sequence Number=SeqID_216515
atggcaggcgtgttattttggaggaaaaacaaggtcagaaatggaaatgttgataaaagggataacaagacgaagaggaagcgtgtccactccagaaacaggacaggggaatggcaaccatgtcccttacatttgcatttgcacttccttcaatcccctctctcagccaatgccatggccgtgctctttacgtcaagcccctccactgcactcccattcaacaacgccacgtactctactctatcttctcacctgatctttacttcccaaaatcctttatctcataggtttattgttggtgcagaggcaggtattgtttgtgagccttgcaatggaacggggtggttagtttgtgacttttgtaatggccaaaagaccaacgtcaaagccgaaaacaataaacgtatctaccgtagatgtccctcctgcaaagccgttggatatgtcttgtgttcaaagtgcaaggtcttcaaatgcgtcacttttcctaatttcaacgactctgagaactga

SEQ ID NO: 99738 - DNA, 336 bp, Glycine max
  Peptide Sequence Number=SeqID_216516
atggaaggctcgactcaagtggttcgcacagataacgataccaatcccatattgtccaggttcaattatgaaaaagaggcacgtgatagacatgttgtgttgttggaggaagccgaatccgcgtgccaccccgcacacaccataaatacatatctttcgtgtgcggcatttctcaagccagagaaagagaaggaaccaacaacaaagagcagagagaaagagaggaccattccaaccctaatttctctgctaaaccctagttgtttggcatttcctctcttctccctcgtaaatcttctcccattccctccggtagctttccagatccaaatgtaa

SEQ ID NO: 99739 - DNA, 597 bp, Glycine max
  Peptide Sequence Number=SeqID_216517
atgtatgatgatgattcgagtgagactggaccaactagatttcataaggttggaacgaaccgggcacttatcaacagtggtcatttctttgatagtgatcgtgcaaactactatacttggactaatacaacaaagcttgcaatggacaattctaaactatacatgaatgcacgtgtttctccaaattctttgacctattatggattttgcctaggaaatggaaactacatagtaaatcttcattttgctgaaataatgtttacagatgataaaacatatagcagcctcagaaggagtgtatttgatatctacattcagactcgtatggctgagtatagtcgatcaaagtttaaaatggagcaaatcgaagatgctattgctaagctaacttcgaaccaactcaattatgccaccgtgcaaaaccacgtcaccgccgagctcgatgagcttcttcaatggatttttgccattgaaaacaaccaacactcacctaattcttcttcttccacgaatcctcactcaccggtttctcaattccaatcgactaggcgtattctgtcgattctttttagttatatatctagaaatacccgttga

SEQ ID NO: 99740 - DNA, 333 bp, Glycine max
  Peptide Sequence Number=SeqID_216518
atgcagcaacaaataactttgacaaagccttcaagattggagaaggagggtttggtcctgtttataaaaggatttgtattggtattgctgaagattgttcacacaaacatcaaggccactaatgtgttgcctgataaagatcttaaccccgagatatctgattttggtttggccaagcttgatgatggggacaaaacccacttaagcacaagaatagctagtacattgctcctgagtatgcaatgcatgagtccttttcttcttgaatatcaatggcaacagaatggagaaggaggaaaggtgattggagacgccacttcaaggagaagatga

SEQ ID NO: 99741 - DNA, 1971 bp, Glycine max
  Peptide Sequence Number=SeqID_216519
atgcctatcatttctcaattttcctcactctctatacttcctaacccaccaaccaaaacccgtttcagttttcatcttcaaagtattatgccacataaaagagaatatttctgtcttttcatgctcttcacttgttttttgccatcattggccgacaatgctcaagttctgatgaacttcaaaagtaacttgtccaatgctgatgctttaaagaactggggggatccatcgactggtctgtgcagctggactggtatattatgcttcgatcaaaaatttcatggcttgagattagagaatatgggactaagtggcactattgacgtagacacgctgcttgagttgtccaatttgaatagttttagtgtcataaacaacaactttgagggtccaatgcctgcattcaagaagcttgtgagtttaagggcattgtttctgtccaataacaagttctctggtgaaattccggatgatgcttttgaaggcatgaagcgtctcaggaaagtatttttggctgaaaatgggttcacgggtcatattcctgcatcccttgttaaattgcctaaactttatgatgtggacatacatggaaatagctttaatggcaatataccagaatttcaacagagggatttcagagtgtttaatttgtctcacaaccacttagagggtccaataccagaaagcttaagcaacagggatccaagctcatttgctggcaatcaaggtctatgtgggaaacctctaaccccttgcgtcggaagccctccctcaccttctgatcaaaacccaatttcaactctttcacatcaagaaaaaaaacagaaaaaaaaccgcatccttttaatcgttatcgtagtggtggcggtgattgtgttggctttaatactagcacttgtgttcatccgttaccgtcgaaagaaagccgtgttggtcacggatgcacaaccccagaacgttatgagtccagtttctagtgagtccaaatccattgtaatggcagccgagtccaagaaaagtgaagatggaagtttgagcttcgtgaggaacgaaagggaggagtttgacttgcaagacttgcttagagcctcagctgaggttctggggagtggcagttttggatccacgtacaaggccatgcttctgaacggaccagctgtggtggtgaagagattcaagcacatgaacaacgttggaaagaaagagttctttgagcacatgagaaggcttggaaggttgtcacaccccaacctagttcctcttgttgcattttactatggaagagaagagaagcttttggtttatgactttgctgaaaatggcagtttggctagtcatcttcatggcagaggtggttgtgtgttggactggggaagtcgtttgaggatcataaaaggagtggcaaggggattaggatacctctacagagagttcccggagcaagacttagcgcacggtcatctaaaatcgtcgaacgtagtgttggaccattcattcgaggctcgtttggcggagtacgggctggcggcagtggtggacaagaggcacgcgcagcagttcatggtggcgtacaagtctccggaggtgaggcagttggagaggcccagcgagaagagtgatgtttggtgtttggggattctgatattggagcttttgacggggaagtttccagctaattatctgaggcacgggaagggtgcgagcgaggatttggcgtcgtgggttgagtcgatagtgagggaagggtggagcggggaggtgcttgataaggagattcctgggagagggagtggagagggtgagatgctgaagctgttgaggattgggatggggtgctgtgaatggactttggagactaggtgggattggagggaggctgtggccaagattgaggacttgaaggagactgataatggaactcaaggggatcattcctactcatcggatcacttgtctatctctctcaattaa

SEQ ID NO: 99742 - DNA, 279 bp, Glycine max
  Peptide Sequence Number=SeqID_216520
atgcccttccaccacaatataccaaataccaagatgataacaattgctccagcaaccacaatttcaaccacaacccctatggatatactactaccaccactttctgatgggagtataaattctgcaagattattatgtgtcgcaacctaccgttcggcgggagggcaacgcgaggctcacggttgcgttttccaaagaaggaaaatgcacggagtcgccaccaacatttatttgaggaaaaaattagaaaaaaccaaaaagtgggtctacgaatcttaa

SEQ ID NO: 99743 - DNA, 834 bp, Glycine max
  Peptide Sequence Number=SeqID_216521
atggctgcaagttcccggacatatgtggatgcacgcagaagcacagtgcccattcctacacctggtgcatctgtttcgatcatgaagggagaaccgaagatgagaaagggcttgtgcttggctagattatgccatttcgtaacattgattctacttggttctcaatttcttgcttttggaaatgggggtaccgggtggcaaatttgcgggtccgggaggatatgtcagagtattgtagtggcagttttgttgaagagagctcaagtggctggtgttgcagtttcctttcagtttgatgatcctttaagcatgcacgaaattcatgtcgtcattgttggcaatgaggaggaagaacttggaagaatacttatgctcacaactaaacttctcatcgcaattaaaacacagtcccctctcctagcaactagcaatctcctcaagcgacaatcgtttaagaggtgtgggggtggttttggtggggaagggaaaggaactacgaagtctgctacggaagacacgacggtgatcattgagtttctcttcttgcaattgcacaagggtcattgtctggaccagagtgagaggctgaagggcatgaacctcggggtggatctccagagtgaaactggagacaaaatagctaagcaaaaatggtgccagaagttctggtgggatcctcatactgggacggagcaaacccgagtcatgactatatttgtccattacacatcatccattgaaaccaagctaatgtcatccaacctgagggatttgtgccatcaaaacatgggacctcgagcttcattagacgaggatttggagaaggtgatgccg

SEQ ID NO: 99744 - DNA, 456 bp, Glycine max
  Peptide Sequence Number=SeqID_216522
gtttgtcagctaaaacagacactacccaaattggacaaaaactatgctgttcaatcagagaaagacacattgattgatgcagtctctatattaggagagtatttgaaggaagagccttggttgcagcttttgtgtaaccatcttaagtatcagcctttcagaatgtcttattttaaagattttacttctacattccttgtgattataactcataagagaaaccctagtcgggttggaatgggattcctgttaaatatacttgaggttactggaaaagcacaagcaaatgctgaaggaaataataactcacgtttatgtaatgaattacaggaacagagtaatgataagaagggtacaactgcaaagaaaggtagacaagcaaagaaggtaaaattggagacagaatcacacaacatcaaagacatgttttcgagggcctcccgaaagaaaagttaa

SEQ ID NO: 99745 - DNA, 1239 bp, Glycine max
  Peptide Sequence Number=SeqID_216523
atggcagggttaaattttgaagccacacatactgacaaccgtgatattctgaagatatttgcagctgaaggtgttgagttccttttatcttgtgaagggaagatccaacttaagatcaaccctcttagagcatgtttgggaattagttgcaaaattatgtttgaggcaaaagtacccgtgtcagaatgcaatgggaaaattatctgcctatttttcactgcaaactggtgcagaccttgcagagctttcgttccccgtcttgttgaactttatgaaacactgagaaagaggcgaataaatctagagattatcttcatctcctttgaccgtgatgaggatggatttaaagaacacttcaagaatatgccatggctagctgttccatttgatttaaatttgcacagaagactgattgacagataccaagttgatcgaatcccatcattcgttccatcttgttcagatggcataaccattgaagaagacttgattggatgcattgaggattatggtgctgatgcatttcctttcacaaggaagaggcatgaggaattgaaaggcatagatataaggaagcgcgaggaagcagacttggaagaattattgggacacgaaggaggcaaatttctcatctctggagatgatagaaaggtgccactatctgaactagctggtaaaaccataggcctgtattttggtgcctattggtctcctccttgctgcgctttcactgtccaacttacagatgcatacaacaatctcaaggcggcaaaaggcgactgctttgagattgttttaatctcaacagatagggaccttgaggaattcaatgtcaacaaaagtactatgccatggcttgctgtcccatatgaggacaggacaaggcatgaccttcgaagaatcttcgatgtaaagggcattcctgcattggttctcattggaccagatggcaaagtaattagtgtgaatggaaagttaatggtctcctcatatggtgcagaagctttcccattcaccgaatcgcggataagagaccttgaagcagctctgagaaaggaaggagaggctttgcctccgcaggttgaggatgtgaagcatgaacatgtactgaaattggatatggccaaagcatatgtatgtgattcctgtaaaaagcaaggcaaattctggacattctcttgtgatgtctgtgactatgaccttcatccaagttgtctagaaaaggtcaacaaggactaa

SEQ ID NO: 99746 - DNA, 195 bp, Glycine max
  Peptide Sequence Number=SeqID_216524
atgaagaacggacgaagaacgacgaagaatgttcacagaatcgatcacagaaatcttaacccgttcccttcagcccccacgcctatttatagcaaaatgaggggaggagattgcaacacagctcgcccaggtgagctagttgcttcctccagaagcagcatgctcacccagacgagttggttgcttctcctttaa

SEQ ID NO: 99747 - DNA, 407 bp, Glycine max
  Peptide Sequence Number=SeqID_216525
gcgcctgtcggcgagtcgggttgtttgggaatgcagcccccaatcgggcgggaagcggatgggggccggcgatgtgtcccggtcggatgtggaacggtgagagccggtccgccgatcgactcgggacattgaccgacgcggattgcgatggtggccccaagccccgggctgttgatatgctcgtggagacgtcatcatcgcgattgtggatggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctgtgggttgcaccgccgaccgaccctga

SEQ ID NO: 99748 - DNA, 135 bp, Glycine max
  Peptide Sequence Number=SeqID_216526
aaaatacttcagactgtaagggagtggtggagacagtttaagtctaatttgatatcaaaatgggcacttgcagccgacaaggacaatgtagatgacactgtatgcaaaaagtacgacattaacaaggagaagtga

SEQ ID NO: 99749 - DNA, 276 bp, Glycine max
  Peptide Sequence Number=SeqID_216527
atggatgaaaagaaaaagaaacaactggaggaagcttctcaatccagaagcactgacactatgattgatcctccatctcccatcaaacgacacgtgaaatggaagatggcccgcaccaagaaaactaggcaaatgacgtctaaggcaacaaaggaaattgttggcaagattataagatttgttggaggagcaggcctcacaaggttcctttgtcgcccatgggcgttaggatgtactgactgctgccattgggcgactagaacaccctggtcgtgt

SEQ ID NO: 99750 - DNA, 1563 bp, Glycine max
  Peptide Sequence Number=SeqID_216528
atgtggctgtcaaagcatcactcagagaagaaggatggtgtgaatggattagtagcagtggcaattgataaagaaaaagggggccaaaatgcactaaaatgggcagttgacaatctcctcacaagaagttcaactgtaattctcatccatgtcaagcttctcgcgccaactctatctccgtcaccttctcttttcaccccaaggataagtgctctccttggcgatgatacttcactggtatctaaagaaccagaaggcaataacaaaaacgttttcctcccatatcgtgtcttctgtacacggaaagatatacaatgcaaggacgttctactagaagattcagatatatccaaagcactaattgaatatgcttcacaggcgggaattgagcatctggttcttggctcttcaacaaaaactagcttgctcaaaagattcaaggtatcagatattccaggagcagtttcaaaaggggcaccagatttctgtacagtctatgttattgctaaaggaaagattcaaacagtgcgatctgcttctcgacctgcgccggccattgtccctaacctgctcagtcaagcaagtgtcaggacagaccattcagacccaaatgtgccattgactcaaagcataaaagaacaagaaagacattcctttgatgctgcagcaccgcgtagatcactggatgaatcagaaccattcaggtcaccattcacttggaaaggttacaatggaagacaatatggggacactcccaagccagataaggacatatcctttgtaagtaccggaagaaaaagcatagaaaacttgttcccttcgttgaactcagattcaggattttccaaccatcgactatcattgggctcagacatagatggaagcttcagcttagagtcaatgcatgatggaaggaagtctacggaaactggcactcctcctgaattcccatccctctcatttgagagtgaccagcattcatcttctacatcacaagccgtggatgacatggaggctgaaatgaggagattgaagttggaactgaagcaaaccatggaactgtataacacagcctgtaaagaagcagtcacagcacaacagaaggcagtggaacttcagaagtggaaactagaagaagagaggagattggaagaggcaaggcttgctgaggaaacagcattggcgattgccgaaaaggagagagcaaagtctaaagcagccattgaggctgctgaagcacaaaagaggattgcagaactggaagcacagaagagactcaatgcagaaatgaaagcacttagagaatcagaagagaaaaaaaaattgcttgatgctttggtaaatgtagatgtgaggtatagaaggtacacaatcgaggagattgaagctgcaacagatttttttgcagaatccctgaaaattggagaagggggatatggtccagtttttaagtgccttttggatcacacacctgttgcagtcaaggttctacgccctgatgcacaacaaggaagatcacagtttcaacgagaggtaagcagagaaacaaaacactacatttaa

SEQ ID NO: 99751 - DNA, 522 bp, Glycine max
  Peptide Sequence Number=SeqID_216529
atgaactgtttacttcacaagcttcttgataaagtaacacaagctgaacttcattgtcagttccatgcactgggggctggggtgattgaggaggttcgagttcagagggataaaggttttggatttgtcagatacaacactcatgacgaagctgcactggccattcagatggctaatggaagacttgttcgtgggaagaatatgaagtgttcatggggtagtaaaccaactccacctggaacggcttcaaacccactacctcctcctgctcaaccatatcaaatacttcccactgcagggatgaaccaagggtattctcctgcggagttgttggcttatcagcgccaactggccttgagtcaggctgctgtatctggtctttcaggtcaaactcttctgcaaatgactggacaacatggcctagctccagcttcgatgggcgtaaactctggggcatctcaagccatgtatgatggatataccggtaattcatcgagacagcagcttatgtactatcgttga

SEQ ID NO: 99752 - DNA, 216 bp, Glycine max
  Peptide Sequence Number=SeqID_216530
atgatatgccttaatgcaattgatatgcaggatgcccaaagtgcaataaatgatatgacaggtaagtggctgggaaataggcaaatacgatgcaactgggcaactaagggtgctggtggcagttccaatgaagagaagattaatgacagtcaaaatgctgttgtgcttacaaatggatcttcagaggggatgggtacaacagaagagctaaggtag

SEQ ID NO: 99753 - DNA, 591 bp, Glycine max
  Peptide Sequence Number=SeqID_216531
atgcaacagaggctaaagttgcagcaacaacaggccctcatgcagcaagctttgcttcaacagcagcagatgtaccaccctggcatgctcgccgctgctatgtctcagatggagcctgttccaagtggaaatgtgcctcctggttttgatacgtctgcatgccgtagtgtttatgtaggaaatattcatgtaaatgtcaccgataaacttcttgcagaagtttttcagagtgctggtcctcttgctggctgcaagctcataagaaaagaaaagggaactctcctaggaatctttaatcaatctacaaaggtgataggttttcaaggagttctgaatcgatatgcatcatattctgagaaatcctcttatggttttgtggactaccacgatcgagcatctgcagcccttgcaataatgacattgcatggacgacaactgtatggtcaagcacttaaggtgaattgggcatatgccaatagcagtagggaggacacgtcagggcacttcaatatatttgtcggtgatttgagtccagaggttactgatgcaactttatttgcttgcttctcagtctatcctagttgttcgtga

SEQ ID NO: 99754 - DNA, 507 bp, Glycine max
  Peptide Sequence Number=SeqID_216532
atgtggctgaaaggggagaagacccctgtggttctatctggaaatcacgatgaacgcgctaagcacgcctgtgcgcttagcctgttcatcgcaactgttaaaattttggatttccatatgaacgccctaagcgtaccatgtcgcgctaagcgcgttcatccctcgttaagcttgacccttatggctaaacgacactttgcttatatgacatccaagataagaaaaactccttctacacctacccaggccagatttgatagatccaggaagatttcacctgaaaagagtgtcattcttcatcatactaagttcgatgaatttactgaagaactcgagcgtagaaactggcacaaggagttgacaaactttgttgatggtagtattgatgtagccatcgtaaaggaattttatgtgaacctctatgaccctaaggataaaccaccaaagcaggtgaaggtgagaggtcgattggtgaaattcgatgcagacaccttgactcattcctga

SEQ ID NO: 99755 - DNA, 540 bp, Glycine max
  Peptide Sequence Number=SeqID_216533
atgtgggacttcgttataagtgtctccaagttttgttcggatgcagagcatgagccagttcaatcacaagcaatgatagctatcttttttggattcagattgtcttcggtccattcattcaacgggtttatttacggccgcgttacaagacctgagatctacaaaaatgaacacaaggatcaggtcaaaggacagagatacacaaggattgtgtgctggacttggaactcgatccaacataatattaacagcaaagcgtctctatgccacagctattgccttagtctagctgcccatgcatttcaagttagtgcttcaggcaccaaccggtggcaatgccaaacccaagataggatggacagaacccataagaaactctggggtcctctgaagaagaccctttcccaaaaattggcgtatgctgctttgagtgacaaatacacggattggagtcagcccacaattgttgatggatttgagggtatcctctatagttacggatcatcaaatatgaggagaaggctatatgtctgggcgtaa

SEQ ID NO: 99756 - DNA, 2082 bp, Glycine max
  Peptide Sequence Number=SeqID_216534
atggctccaaggttgtacttttccaattggtggaccaaggatacactgaagggaacaccagtggtggtgaaaatggagaaccccactttctctgttgtggagatcaatggtgctgatgctgcattcaggccagtggagaaaagccgcggcaagaatgccaaacaagtcacgtgggtgttgcttctcagggctcaccgtgctgttggctgtgtcacttggcttgccactgttctttgggcgttgctcggagccattaagaagaggttgattcatggacaaggtgtgtctgtggagagtgagagtgacaagttggaaaagggcaagttgctgtttagagtcattagagtgttccttgtgacttccttggcggttttggcctttgaggttgttgcttaccttcaaggttggcattttggaaaccccactttgcacattcctcgtacctctgatttggagggcctgctccacttggcttatgttgcttggctaacgtttcgtgccgagtacattgctcctcctatacaggcactttccaagttttgtgttgttttgtttcttatccagtctgtggatcgcatgctcctttgcttggggtgcttttggatcaaatacaggaaggttaagccaaggattgaaggggatccgttcaagagtgatgatgttgaaggatctgcaagcaattatcccatggttctggttcaaattccaatgtgcaatgagagggaggtgtatgatcaatccatttctgcagtctgtggcattgattggccaagggatcgtttactgattcaagtacttgatgattctgatgatgagagcatacagtggttaattaaagcagaggtctctaaatggagccaaaagggtatcaatataatctataggcatcgcttagtcaggactggatataaagcaggaaatcttaactctgcaatgagctgtgactatgtgaaagactatgagtttgtggcaattttcgatgcagactttcaaccaaatcctgattttcttaagcaaactgtgccacatttcaaggacaatcccgaactaggtttggtccaagcaaggtggtcttttgtgaacaaggatgagaatttgttgactcgtctccaaaacattaacttatgcttccattttgaggtagagcagcaggtcaatggggtatttctcaatttttttggtttcaatggaactgctggtgtttggagaatcaaggccctggaagagtccgggggatggttagagaggacaactgtagaagatatggacattgctgtccgagctcatctgaatggttggaaatttatcttcctaaatgatgtaaaggtaccttgtgaagttcctgagtcgtatgaagcttataggaagcagcaacaccgctggcattcaggtcctatgcaactttttaggttgtctcttccagcaattgtgagatctaaggtgtctccatggaagaaagcaaacttaatactgctattttttctgttgaggaaactgatccttcccttttactccttcaccttattttgcataattcttcctctaaccatgtttgtaccagaggcagagcttcctttgtgggtgatctgctatgtgcctgtatttatgtcactccttaatattcttccttctccaaaatcctttcctttcattgttccctacctccttttcgaaaacaccatgtccgtcaccaaattcaatgcaatggtctctggtctcttccaattgggcagctcttatgaatgggttgtcaccaagaaagctggcaggtcatcagagtctgatttactggctgctgcagaaagggaagccaagtcaatagaacaaaagattcatagaggagcttctgatagtgagcttattgagtcaaaccaattgaaggaacacaaagaagcagctcctgcaaaagttaagaaatctaataagatatatacaaaagagctgactttggcattcctccttctcaccgcttctgtcaggagtctgttatctgcacaaggagttcacttctactttctacttttccaaggggtgaccttcctccttgtggggcttgatttgattggagagcagatgagctag

SEQ ID NO: 99757 - DNA, 564 bp, Glycine max
  Peptide Sequence Number=SeqID_216535
atgcagacctatttgcaatccattactgtgaggcttgaagagtggaggctcaagcgacgtgacactgaagagtggatgagccatcgccagctcccacaaaatctcagagagcgagtccgaagatttgttcagtacaagtggcttgcaactcgtggggttgatgaagaaacaatcctacgtggccttcctactgacctacgtagagatatccaatgccacctttgcctggacctcgttcgacgtgttccctttttctcacaaatggatgatcaactactggatgccatatgtgagagattggtatcatccttgagtactcaaggcacatacatagtgagagaaggagacccggttacagagatgcattttatcatcagagggaaacttgaaagctcaaccacaaatggaggcagaactggtttcttcaactccattaccttgaggcctggtgatttctgtggagaagagctacttgcttgggcattgcttccaatatccactctcaacttgccttcgtctacaagaactgttaagcccttgtggaagtggaagcctttgcactaa

SEQ ID NO: 99758 - DNA, 951 bp, Glycine max
  Peptide Sequence Number=SeqID_216536
atggccatcaagttcaggacggcctatgtgtcaccgaattcaagggtttttgctaggggtgagcttgctatggatcctaggctgattgcaaggcggtatttgagatcagagttcttcctagatcttgttgctacactgcctcttccccagattgtgatttggtttattatgccagcaattagaagctcccatgctgatcataccaacaatgcacttgtactaattgttctgcttcaatatgtccccagattatatatgattttcccattaagatctcagattattaaagccactggtgtggttacaaagacagcttggactggagctgcttacaattctactatacatgtcttgggtgcatcctggtacttgttatcaattgaaaggcatgctacttgccggaaatctgaatgcagaaatgaaagcctccctgtgaaatgtgctcttaagtacttagattgcagtactttaaaccatgatgatcgcacgaagtgggtaaacactacttctgtgtttggtaactgcaatccagaaaatagcatcaatttcaactatggaatatttggaaatgcagtggaaaataatgttgtgtcctctgtgtttaaagagaagtatctctattgtctgtggtggggcttgcagaacttaagttcctatggccagagtttgacaacaagcacgttcgtttgggaaactgcatttgcaatactcagctattctgggtcttgttctgtttgcccacttaattggggagatcatccaggacataggttattacacaagtggtctttgacagttgacatcacattcaagatatatggtgaatgggtctttttcaccgagcaattagtttattcttattcaatggttggatgcttcgctcacacttgtcattccaacaatagtattaaagcattgaaactttggcttgatggagtacatagcatatag

SEQ ID NO: 99759 - DNA, 426 bp, Glycine max
  Peptide Sequence Number=SeqID_216537
atgggatatcacaagaatgaggctgtgaagtcgctagaatcatttgaattctcacaagctatcactattgtgtattcttggtggcaatatcaattgcgtgatgtattcatcgaagtgattaaggcttgctttactggtaacgatcctaggtttgcttttgaaatatgctttgcacaagatactttgtggttttgtctggataatggccttcgattgcttcatcccttcatgccttttgtcacagaagaattatggcaatgccttccttcaactagggaatatgagagagcagaatctatcacaatatgtgattatccatcaactgtagagggctggaataatgaaagggtggggaatgatattaacattattgagtttattattaagtctctcaggtcactggcaaaagaaagtcgtgacaggtaa

SEQ ID NO: 99760 - DNA, 174 bp, Glycine max
  Peptide Sequence Number=SeqID_216538
atgtcattagagtatgagggacctgttacttataatatgaagagggagttgctgaaggtccttattgataaggactgctacgccaaatttccagagcgcacgttgccgatgtgccgcgtgacatttgttgtaaaacctggcagtcttggtaaagatgtggttgagaatatgtga

SEQ ID NO: 99761 - DNA, 948 bp, Glycine max
  Peptide Sequence Number=SeqID_216539
atgggtaaatacattaggagtaaaccatcaattaccacacgatattataagaaaaatttgttccacgtgacggaccaggatggaaacaagcttacggacgtagggctcgttcattacattcaacaggcactgtgcgagtctagaagcagcaacaaagaaatttcaagtgacatagagctaacaagctgcaacgaaccaccacgagtggtgaacttagcaatagagttgaccacaacggacaagcatggcatgttctcggagatatcagcggttctattgggcctgggcttcaacgtcacctctgccacggcctggacccacaatgacagggtggcctgcataatccacctcgaggacgcaaacaaactcgggcccattaatgcagaacgtctggcccaggtccaggcccagctccagaacgtagtgaaggcccgtgatgggaagaacggggaagacgatagagtgaggttgaggctgaggagcttcggcggcgggcgcaaccataccgagcggcggctccaccagatgatgtacgccgacggggactacgagaggttgcgtgcgtgccacggagagaaggggtgtgaggggacaaacgtgtccgtgggaagatacgaagtgaaggggtactgggtggtaaacgtgaggagcagggatcgccctaaacttttctttgatactgtgtgcgtgctcaccgacatgcagtacgaggtgtttcatgcggctgttagctccaatggctccatggctgaccagcttgaactagaaaatcaccctacacagatctgcacattaggtgcagtagctatggagataaagaaaagtagactattgctcgagaagaaaagaggaaaaacttatgaacaagaaagcaaagaaattaagcaagatgatcaaaacaagcttctgtcttattcattgagcaaaatgaacttatatacagattga

SEQ ID NO: 99762 - DNA, 396 bp, Glycine max
  Peptide Sequence Number=SeqID_216540
atggctgggatgtgtgtatctctttcactcattgtcacaatcgaagatcaaagccagatgaaactcaaaacagagcagagctctttgaagagctctgataccatgtcacaaatcaagcttgaactagaaaatcaccatgcacagatctgcacattaggtgcagtagctatcgagataaagaaaagcagaggctattgctcgagaagaaaagaggaaaaacttatgaacaagaaaacaaagaaattgagcaagagatcaaaacaagattttgtcttattcattgagcaaaatgaacttatatacagattgagaatgagaatagatccagaaactaacacaaaagcagttacaaagtttgttactgttagagttcaaaatgaatttggcgggaaatga

SEQ ID NO: 99763 - DNA, 324 bp, Glycine max
  Peptide Sequence Number=SeqID_216541
atgatcgactcttgcattgatgaagacttcaaaggcttagatgttaaccaagaatctcaatatgcacagcttcatcgacaggcgacagaagatgcagctttcttgagaaacctatgcatgaaacaagacaatgctgttaatgttccttctccatcttcattgatgcatcatcaagaatatgcattctacaggcaaaaatatctcataatgtataaccccttcagaggaaaaaaggaagacaagaagtttaccagggagaaaataaaaaagttgttcattgtgaacttaaagaagaagaacgcaaaaactactcaacctaattag

SEQ ID NO: 99764 - DNA, 276 bp, Glycine max
  Peptide Sequence Number=SeqID_216542
atgcaagagaaggccctagggcaggaggctgctactccagagagatcaccatatatttcacctaatccaccgtcgtcaatggtggttcaatattctcctcagcagctagtaaaccctcctacactagtgcatgagataccagcagacccatcaactccattactggagattccagaggaccctgccacaccagttctgggactgactaccactcctccagacactcctttgatatatttttcagatgaggagggcactcaagatcaggacacctag

SEQ ID NO: 99765 - DNA, 579 bp, Glycine max
  Peptide Sequence Number=SeqID_216543
atgggtgacatagaagaggtgcaagaaaagattaaggtcgatatggtggccttgaaagatcaaatgacctccatgatggaagccatgctaatcatgaagagactaatagaaagtagcgcggccacagctattgccaccagcgtcgctgttgaggtagacactactcatccatctgccacgaatcaagcacatcaacccaccccggacatggcgggacgaggaggagaggtgttagggagcaccgacaacccgcacatggggtataatagaaatgcttacccctatggcttaccctgcaattatacgccgcccaccatgcacgagaacgttgatcatgccgttcccattaccttcaacggtcaacaaccccagcctataggggttacccatgaagagtctagggagcgtccccaagatttgtgtttggtaccggatgttgtcatccctccaaaattgaaggtaccagattttgatagatacaaggggttcacttgccccaaaaatcacttgaagatgtattgtcggaaaatgggggcatattgttcgacggccggcaagtgcactagatcgcacaagtag

SEQ ID NO: 99766 - DNA, 767 bp, Glycine max
  Peptide Sequence Number=SeqID_216544
gctggacccttgggtacttgtacctatcacctttagaggactacacgtcctcgccttgagaggactacatgtcctcgccatcagaggacttcatgtcctcgccatcagagggctgcacgccctcacctccagaggactacctgtcctcgccttgagagggctacacgccctcaccttggggctgcacgtcctcaccttcagaggacttcatgtcctcgccttgagagggctacacgccctcaccttgggactacgtgtcctcaccatcagagggctgcacgccctcacctctagaggactatatgtcctcgccttgagagggctacacgccctcaccttgggactacacgtcctcaccatcagagggctgcacgccctcacctctagaggactacatgtcctcgccttgagagggctacacgccctcaccttgggactacacgtcctcaccatcagagggctgcacgccctcacctctagaggactacatgtcctcgccttgagagggctacacgtcctcaccttgggtactagttaccttcaccttcagaggactacacgtcctcgccgtcaaagggactacgcgtcctcgccatcagaggactacatgttccccattttcaaaggggggcatgccctcaccttcagaggattgcacgtccttgccatcataggactacaatccctcgccttcgaaaggcgacacgtcctgaacttcagagggctacacgccctcgcctttagaggactacgcgtcctcactttca

SEQ ID NO: 99767 - DNA, 987 bp, Glycine max
  Peptide Sequence Number=SeqID_216545
atggcacccttcctcccacgggtaattgcatattggtttaagctaaagaagttggaggagttagatctatccgaaaacgaatttgagggaccacttccctcatcttttgttaacatgacatctcttcggaagttggaaatttcttataatcactttataggaaattttgattctaaccttgcaagccttacatcacttgaatattttggtttcataggaaaccaatttgaaattcctgtgtctttcactccatttgccaatctttcaaagatcaagttcatctatggccatggaaacaaattcttattggactcgcatcatagtttgcaaacatggattccaaaatttcaattacaagagctttttgtgtcttcgacaactgagactaaatctcttcctctcccaaactttcttctttaccaaaacagtttaaccaatatagatttgagtgattggaagttggaaggagaatttcctctttggttgttggaaaacaacacaaaaatgaccgaagctttgtttaggaattgctctttcaccggtacttttcagctaccaatgagtcctcttcctaacatacaagcaattgatgtgtctgacaataccataaatggccaaattcctagcaacaatatcagttcagtttatccaaatttgcaatatctacacttgtctagaaacaacatccaaggatcaatccctagtgagttaggccaaatgagcttactgtattcattagatctttctgggaaccaattgtcaggaaaaatacctgagagcatatttggagatgggcacccactccaattcttgatactttcaaacaatatgtttgagggacctattttgacaatccctaatggtttgaagaccttgttgttgaacgataatggctttattggtagactcccaaacagcatttttcatgcatccatcatttcattggatgtaagcaataatcatttggtgggaagattccaggtctaa

SEQ ID NO: 99768 - DNA, 888 bp, Glycine max
  Peptide Sequence Number=SeqID_216546
atgccttttgaggttgaggactctcccagattgtggcgatatcttcatggttggccaatgggacgttacctggtccgtaataaatatagcagatttcaattattaccatatgttcaagagaaagccaatttcacttcaaagaaaagaacatacacttacatggggagcatccttgcttatatgtcaggaattgacttatcccacaacaaactgaaaggaaatatcccatctgagcttggaaacttgacaaaaattcatacattgaacttatcccacaatgatttaacagggaaaattccagctacgttctcccatttggtacaaacagagagtttggatctttcttttaacatgttgaacggtcaaattcctcctcaactgaccacgttaacctcacttgcagtatttagtgtggcacacaataacttatcaggtccaacacctgaatttaaaggacaattttccacatttgatgaaagcagctatgagggtaacccgttcctttgtggacttccactgccaaagagttgcaaccctccacctactgttatcccaaatgactctgacactgatggacactatgatactttggtggatatgtattttttttttgtgagctttgtcgtgtcatacacatcagcattgttggtaactgcagcagctttatacatcaatccttattggagacgggcatggttttactacatggaattggcaagcatgaattgctactactttatcatggataattgtagcaagcttgcccctcttttgaaggtccttgcctttagggacatagatccacaagctcctacccatattctaatcattcctaaagttagggatgcatggttaactggtctgtccaaggcatattatgctgtctaa

SEQ ID NO: 99769 - DNA, 1791 bp, Glycine max
  Peptide Sequence Number=SeqID_216547
ctagaggatccccgcattcaagcgcggcttcggcaacatcgcggacctcggatccggagaaaagtcatcttcgacgaagaggcgtgggaagccgcggagacccacgacttcatcatcggcctgcgggctctgaccgtcgacgtcaccaacgaccgctcctggacgagcctcgcctgggcaggcatcaaccgcgcgggcgacatgcaggccgagctcatcaagcacgagcgagggactcactggatcgcagctgaggcgggcgctatcttcgaccgcaacccgaagatggcgcgccgcgtctactgcgtccccggcgggcaggcggtcaccctcgagtccgcgctcgagcgggctggcatcgatctcgtcgtcctcggccgtgcggactatgccggcgcggccggtcagtactacgccggttcaggcgacccagaggaactcgcctctgacgaccccgcacctcggatctatcacaccgcgcagaagggccagagcccgctgcacgtcgccatcgccggcgcagtctggacgaaggacaaagctccggtctgggacacgctccgatcgagctcgagcgccagcccgtcggcgacatcctgcagaccatcgcctaggagattccgtgaagctcaaggacatcgtgacgactctgctcgagctcatcggcctggtgctcatcgtcgcaggcatcgccatcgcattcggcatcgcccccgcgctgatcaccgccggcatcctgctcgtcgtcctgtcgtacgtgctgaccactcgaggaggccgcccgtgagcatcatgttccgcgagcagcgggaagcgaagttctccgacctcccgagccgcgtcggttggcgccgcaacgtcacatcgaagcggggcgccctcgggcactccgccgcgtgggcgtgcatccgcctccgcggtgacctgatctcgaccctcccgatcgacacctatcgcaaggtgccgtggggccaggtcgaggtcccaaagcctcccgtgcttgttgagccgggcggcacgaaggtcgacatcaccgaatggatgtactccacccagaccgatctcgacaccctcggcaacaccttcggcagcatcaccgaggtcgacggcgccggactccccagacgcatcgacctcgtcgcacgtgacgaggtcagcgtcaccagcctcaagggcaaggtcacctaccgcttcaacggcaaggttcaggacgaagacacagtctggcacgaacgccagtacaccagctcgggcatgatcctcggtctctcacctctcgcacacgctgcgctcgacatgcagtctcacgcagcggcgcaggagttcgccgcggcgtggttcggcggcggccttgtcccgctcgcccacctcaagtacgacgccgcagccgtccccgcgagagaagctgaggcgatcaagctccgccacaagctcgccatcgagaacggcgacgcgctcgtcacaggcaaggactgggagtacaagccgatagacgttgcgtcggcacaggcgaacttcatcgccgcaatgcagttcagtgacactcagctgtgccgattcttcggcgtgcccggcgacctaatcgacgccaacaccgctggctcatcggtcacctacgcgaacatcacgcagcgcaacctgcagctgcttgtgatgaacctcggccccgccatcaagcgccgcgaggtggccctctctcgggcgcttgcgcagccccggttcgtgaagctcaataccgacgcgctgctccgcatggatcccgagaccgtctcgaggatgctcggccagcag

SEQ ID NO: 99770 - DNA, 1374 bp, Glycine max
  Peptide Sequence Number=SeqID_216548
atggtggaaagtgttcggcgatgccggcccccacgcgcgcagcgcggtgggcgtggcctcgctgccgcagggcgtggcggtcgaggtggaagccgtcgtcgcactgacgcccgcctgatgccccggcgccggacgcaagcccggcgcgtttttcctggaaccctcatgcccgccgccgtcctcaccgccaccaccctcgaagcgttacgcgccgccacgcccggcacgcgcaccaccgtccacttcaaccatgccggcgcatcgttgccgtcggcggccacgctcgatgccatccaggcccacctgcggcgcgaagccgaacacgggccgatggaggcggtcgtggccgcgcgcgcccacaccgagcaggcgcgccagttggccgcgcaactgctcaatgcccagccaggcgagatcgccctgaccggcggcaattccccagggtggggcgccgcattcgccgcgctgggaccctggcgccccggcgaccgcatcctggtgggccgccatgaatggggcggcaaccttgccgccatgcggctggcggcacaacgcgcgggcgcgagcatcgagacgattccatccgatgacagcggctgtgtcgacgccgatgcgctgcgcgccatgctggacgaacgggtgcgcctggtcgcgctgacctggttgccggccaacggcggcctgatcaacccggcggccgccatcggccgcgtcacacgcgccgcgggcgtgccgtacttcatcgatgcggcgcaggcggtgggacaggtgccgatcgacgtggccgaggtcggttgcgacgtcctcagcggcgccggccgcaaagccctgcgcggcccgcgcggcaccggcctgctgtatgtgcggcgcgaattcctgccgcgcctggcgcccgcgttcgtcgacacccattcggcgccgctgggcgccgacggcgagccgcaactgcgcgacgatgccacgcgcttcgaatccgccgaagcttcgatggcgttgcgcgcaggcctggccaatgcgttgcaggaagcgctcgatatcggcctggaagccatccgcgcccgcatcgacctggtcgcccaggccttgcgggcggagctgcgcgccattgccggcatcgaggtactggaccagggccgcgaactgtccggcctggtgtcgttcaatctcgccgggcacgaccctgccgccgtgcagcggacgctggccgcgcagggcatcaccatcggcagcaacggcgtgccgtacacgccgctggacatgaacgcgcgcggcctggcgcacatcgcgcgcgcctcggtcagctacctgacccgcgacgaggagatcgaccgcctgctcgacgcgctgcgcgcgttgtcgcgccagggcgcatag

SEQ ID NO: 99771 - DNA, 597 bp, Glycine max
  Peptide Sequence Number=SeqID_216549
atgaaggtcggagccctcatttctgggcagattacttctatggcccagtcgaactcctctagactcgggttccctgctcttatcatatctttatgtaggtctagaggagtcacttctgacagcttggtctttgagagtttgagcctggtcattaatttggcctacatgaggaagaattgttggaaccctgatgatccaacaattattattaggggggccagaagaccaagggcaaggccagctgagacttcttctacatcagcaactcctcatctagcttttacatcagcagctcttcctccagctcgtattgtagcagctccttctaccccatctcctgcagattttcaatgcttcgaagcatacattaggggcagattattttgctgcaaagtctccagctgggacgacgaggatcctaccgctcaggtaccacatcagccggtggatgagtcatcaaagtcttccactcttgagcccttgatcaggaagagaagggtagttgtaactcaggaagccgcaaccactcctgaaaagtctcctgaggccactccaaagcctctagcaccaatggcagataccacttctccacagtag

SEQ ID NO: 99772 - DNA, 492 bp, Glycine max
  Peptide Sequence Number=SeqID_216550
atgcgtgccaaagctaaagtgatgagtgaaatagaggaggtgcaagagcagatgaaggccaacatggaggccatgaaagagcaaatggccacaatgatggaagccatgatgagtatgaaaaaaattatggaggtcaacatggctacagtcattaccgcaagtactgccactgaggtggacccaactcacccatccggccttaatcaaataaatcatacaaccatagatatggtaggtcagggaggcaaagcgttgagaagtgaggatggcccccattttgtgcaagttcagaacaagcattccttcccaccatatggcttgcctcccaactatacaccacccaatgttgcatacattccggatgagaatgtcgataactctgcttccatacccatcgagacccaacaacctcagtttgatcatgcacatgtctctcaacccatgggggagatacatgaagtacctcacctcagatatgccactgaggggtaa

SEQ ID NO: 99773 - DNA, 225 bp, Glycine max
  Peptide Sequence Number=SeqID_216551
atggatggatcaatctggctgagtagtatacatccttcgagatttagccatttcagatttagggcctctgcaaaatgtggtaacttgcttgtaggcctgagatcttcttcatcaatggattccattgcttcttggaagatgaatggcagcggaatggagaaggaagagagagaggagatgccacttcaaggagaagatgagtctagaagaagctcaccaccatag

SEQ ID NO: 99774 - DNA, 198 bp, Glycine max
  Peptide Sequence Number=SeqID_216552
ttccaaatctttgtcaaaggcaaggagctttggggtcatgttgatggaactgattatgctcctgacaaaactatgcataaggaggcacatgccaaatgggaggtcaaagatgcacaggtcatgacttggatcataagctctgttgagcctaatatcgtcctcaatctcagacccttcaccactgcagcaaagatgtga

SEQ ID NO: 99775 - DNA, 363 bp, Glycine max
  Peptide Sequence Number=SeqID_216553
atggaatccattgatgaagaagatctcaggcctacaagctccaatggagcttacatcaaaatatttctgccccaagctaaaaggaaggaggccctaattaatcttgagcgggtagatctccaaggatatatacaacttaagaagattcatccatctattggtcttctaagaaaggttattgatctgaatttaggtgactgcaaaagtcttaccaagttaccacattttgcagaggccctaaatctgaaatggctaaatctcgaaggatgtatactactcagccagattgatccatccattggtcttcttagaaagcttactgttacgaatgttgagtctttccggatgttctcaactgtataa

SEQ ID NO: 99776 - DNA, 336 bp, Glycine max
  Peptide Sequence Number=SeqID_216554
atgaagacagtgatatacaagcccgtctttgaattgcggaaacactacttcaacgacattgctttggtgaacaccgtggtgctctctaccttccttagtcatcgtcactccttcgtcaccccgacttatggtggtcatcatgactcaggtcactctttttgcggtggcgcacccctagcctattgtgactcaggtaacaccaatgtagaaagcgcaggttactacgtcgtgcctgacgtcaccaccgatgtagaaaacacgttttcgaagtctgacgtcatccccgtattcgaaaggcacccttctacatcggtggtttggttggcaccgatgtag

SEQ ID NO: 99777 - DNA, 345 bp, Glycine max
  Peptide Sequence Number=SeqID_216555
atgaacgaggtcaactttgttgggggaggaaacaattcttataatcagtaccctagcaatttcaatcaagaacaaggcttcaggcataatcgaggaatacagttgggaaacctcccttcacaacctaaaccaaatcctaagagggaggatgtcaatgttgtgataacaagaagcaagaggattcaagaggactctaaggagaaggaaggttatttcccaaaagttgcagatgacgttcttactgagaaggacaaagcacctaagaaacttgaggttcttattgatgggaatttagtaccaaagaagaaaggggatgaaaagaaggagatactgacatctccttag

SEQ ID NO: 99778 - DNA, 357 bp, Glycine max
  Peptide Sequence Number=SeqID_216556
atggctcctgaagttctcaaacaccggagatatgataagaaggttgatgtgttctcctttgcaatgattctgtatgagatgcttgaaggtgaaccccctttttcaaattacgaaccttatgatggagccaaatatgtggcagaaggacacagaccttcttttaggggaaagggttatatccctgaactgcgagatcgtatggacttcgaccttgcattgcatgttcttaggttaactgagcagtgttgggatgctgacatgaagcaaagaccttcattcatagagatcattaaacaccttgaaaagatcaaggaaaatttgccttcagatcatcactggcacttgttcacttcatga

SEQ ID NO: 99779 - DNA, 399 bp, Glycine max
  Peptide Sequence Number=SeqID_216557
atgtgtggtaagactcgacaggataaaattagaaacaaagctataagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagaggggttatcaaaaaggatctcgaaattaatggtttggatagaagtatgagtaaatcattttgccctaaagaggtaggtggttcaaccagaacaaaatatcatcaccagaaacagttcagttttgaaatggttacccatagccagggcatagctgttgtgattggagccacaatgagacagttttag

SEQ ID NO: 99780 - DNA, 908 bp, Glycine max
  Peptide Sequence Number=SeqID_216558
atgtctcttataaagctaaaccattttcctcatagaagcttaaacataacaatagagagagcgagagcgatagagaaaggggggagggagtggaccaccgtgaccagagggagaggtagacatagagaagaggtgagaacgagagtggatcccagacagagctacgtcgatactaggtttggacaacatcaaaggtatcatcatgcaaactcgagggagagagatgatatcacaactttttatttcacgaggttccccgaacatacaacggagaaggatctttgggcccagttcaaaaaatggggggatgtgagggaggtcttcatctccaaacataggaacaaaggtggcagaaggtacggtttcgtaaggttcaaaggggtgtccgacgagcacatattagaaagactgctcgacaacatcatagttggagaactcaagatgtacgtgaatgtcccaaaatacgggagaggaaaggcaaggtctgaagagcacaaagtcaaacccaggacccaggcagatggcgataacaaagaagtggaagcacctagacaaatggcaacgcactgcaaggcaacttccatgtcatacgtgaaagtggtggcaactgccaaaacgaacgtcggacaacagagccacccacagcctagaactttcaaacctgatggatcatactcatcgatccagcttgagatcccggcgggggagaggaaatggtacactgatatatgggtgggccggctaaagaaatcggggatattcgaaagggtcgaggacgaactcccttgggagataggaacaaatgtggtgccgaaatacattggggatgatatgatactcctcctaggtctctcagataccaaagcggaagagctcatcatcaaagaaatcagacatggcacatcccc

SEQ ID NO: 99781 - DNA, 312 bp, Glycine max
  Peptide Sequence Number=SeqID_216559
atggctgatggctttctaggggagatagcacggacaacaatccacccacatagagcagataattgggtttggaaatcttacccaagtggacactactcaacaaaaagcacgtatgatctgctatgtggagaatcactgggggaaaatcaggatgttgtttttaaggagctatggaaactcataatcccagcaaaatcatcagtatttgcatggaggctgatcagagatagattaccaacaaagctaaacctgaaaaggaagcaagtggtgcaaaaccctacctttatggtgggagtcattgtcctggattaa

SEQ ID NO: 99782 - DNA, 432 bp, Glycine max
  Peptide Sequence Number=SeqID_216560
atgagtgaggtcttcgaagggtacgagcgccagtactgtgaactctctgctaatctctctcgcaaatgcagttctgcctctcttgtttctgaccaagaacagaagccgcagaagttgtctgagatcaaagcggggctagatgatgctgatgttctgattcggaaaatggaccttgaagcgagaagtttacagccaagtgtgaaagcaatgcttcttgcaaagttgagggaatacaaatctgatctaaccaatttgaaaaaggaatttaaaaggctaacatcacctaatgctgatgaggctgcccgtgaagaattgttggagactggaatgacagatacacatttgtttgggactttattagttagagtcttagagagctccaaatacgaaatatgttttcttctctttggatcaccaatgaatatatcttga

SEQ ID NO: 99783 - DNA, 405 bp, Glycine max
  Peptide Sequence Number=SeqID_216561
gcaatcaattcgtggggctccggacttgatggtggaggatgcatgaacaacgctaggcaatcaattcacggggctccggacttaatgatggaggatgcacgaacaacgctaggcaatcaattccgcttgacagtcaattcatggggctccggacttgatggtggaggatgcatgaacaacgctaggcaatcaattcatggggctccggactcgatggcaatcaatttgtggggctccggacttgatggtggaggatgcatgaacagcactaggcaatcaattcatggggctccggactcaatggcaatgagttcatggggctccggacttgatggtggaggatgcacaaacaacgctaggcaatcaattcgtggggctccggactcgatggtggaggacgcatga

SEQ ID NO: 99784 - DNA, 562 bp, Glycine max
  Peptide Sequence Number=SeqID_216562
gttgaattggagaagcgtaacttccataagcgcctcaccaatttagctgacagtagcattgacctagcattggtgaaggagttctaccccaacctctacagtcccgaggggccttcacctaaacaagtcagaatctggggccacttaataaggattgatgcagacagcctcaatgcctttctagaaacacctgtggtgcttgctgagggtgaatctctacccgcttactcaagatactgcaggatgcctactgacattagagaaattgaggctgctctgtgcatactcggccgagggtttattttaaatgctgaaggtcaccatgggaagatcctcagaaaatatctaaccactcttgcccaggtctggagtgttctctcatactccaacctggcttcgactttccacacctcggttttggctgtggatagagcgaggttaatctttggcttaatgactcagctagacatgaatgtcgaagctctcatctctgggcagatcacatcaatggcccagtctaactcctctggacttgggttccctgctcttatcacagctttat

SEQ ID NO: 99785 - DNA, 231 bp, Glycine max
  Peptide Sequence Number=SeqID_216563
atgggtttgataagccaaaaccagcttggcccgttagggattaatggaaactctaatagagatgcggagatattgacctccatgtgctatttcagaaagatcttcatgttttatgtacaaggggaagttatcattatacacctgtcataccctaatttcgtccggggacctttgctcgatgacgtgcgaccattctttggtcctcgtgaggtgcttggcacccatcattag

SEQ ID NO: 99786 - DNA, 558 bp, Glycine max
  Peptide Sequence Number=SeqID_216564
atgtcaaccttccacccgggttcgatttatcccacagatgaagagcttgtagtccatttccttcacagaaaggcatctcttttaccttgccacccagatgccatccctgatcttgaagtctacccatatgatccatgggaacttgatggtagagctttggcagagggaaaccaatggtactactacagcagaaggacacaaaatagggtcactggcaatgggtattggaaaccaacgggaatggaagaaccagtggtttcaagcacaagcaacaaaagggttggcatgaagaaatattttgtgttccatgtgggagaagcccctactgctggtatcaaaaccaattggataatgcaagaatatcgtctatcagattctgcttcctctaccagatcatccaaaagaaaaccacaaccaaaaatagaatacaataaatgggtgatatgtcgtgtttatgagcgcaatggagacgatgataatggaacagagctctcatgcttggatgaagtattcttgtcattggatgatgatcttgatgaaataagcttaccaaattaa

SEQ ID NO: 99787 - DNA, 312 bp, Glycine max
  Peptide Sequence Number=SeqID_216565
atgttgccagtaggagcagggctgataactcttcgttacacagtagttgaagccatgaaattttttgaacaaatcaaagttgttccacaacaagatagtttagctgaaactttcacaaaacaactcattgatgcagaagatagacttccaacgtgggagttcgttcaaaagttgtggattgagattatgagctatgctggtgctcaatgtagagtagatatgcatgcccatcaactcagaagaggccctgagtttctctctcatgtttggctcctgcaagctcattttggtttattggatcaattccaataa

SEQ ID NO: 99788 - DNA, 153 bp, Glycine max
  Peptide Sequence Number=SeqID_216566
atgaactgttttctgcgttttctggaaaatgcgatgaactcgctaagcgagcatgctgcactaaaactagctaagcacgcttaccgtgctaagcgaggtcatcctttgaggatgaatactcatcctcttgctgaactacctgtggctaagtga

SEQ ID NO: 99789 - DNA, 225 bp, Glycine max
  Peptide Sequence Number=SeqID_216567
atggtcttttcatcgtgggagcccgatcttgatatctggggcaaaaaaaattcgtgtgcaaggtgtcggtctcgggttgaatttccatattatttctacgaggcacgcgtaacaatgatgatttggaaacaacgtgcaaaattagtcatggccacaactaggtgggtactcaagcatccagtttatggcatttgtgatactaaggcttgggatttacacaagtag

SEQ ID NO: 99790 - DNA, 174 bp, Glycine max
  Peptide Sequence Number=SeqID_216568
atgaggcaagcgggaatggaggacatggctgagatgctagagaagcaattggcttcagaggttcgtaaaggaggaaatatggttcttgctgcaaaatcttgtgatgatatctttaacaacctgttgcaagatggggtttctccagatgagctttataagacagtgttcaagcag

SEQ ID NO: 99791 - DNA, 1113 bp, Glycine max
  Peptide Sequence Number=SeqID_216569
gaaaaagccaaacagcaagagattctagagcccaaagcagaagacaaactcgcacccgccagtgaagctgaagaagccacctggaatgatgtgttgcctgtggacaccattggcctggaagtaggctaccgcctgattccgctggtggataaaggccagggcggtgaactgctcaagcgtattaaaggtatccgcaagaaatttgcccaggaaatcggctttttggcaccgactgtccacatccgtgacaacctgacattgaaacccaacgcctaccgcatcaccatgaaaggtgtggaaatggcgagtggtgaatccaactatagccagatgctggcgattgacccaggtgccgtaacaggtgagttggatggtgctaaaaccacagatccggcttttggcctgccagcagtgtggattgagcctgaccgtaaagaatatgcacaaagcctgggctataccgtcgtggatgcggggaccgtgattgcaacccacctcaatcatattatttcactcaatgccggcgaattgcttggccgccaggaagtacagcagctgctggatcacttgggtaaagagtccagtaagctgattgaggaaatcgtgccaaaaatgattacgctgtcgagcctgcaaaaagtgttgcagaacctgcttaatgaaggtgtgcatatccgcgatatgcgttctatcctggaaaccattgctgatcatgcgcaatatacgcaggatgcgaatgacttgaccgccatggtgcgcgtcaagctgggtcgcgcgattgtgcaagacctgttcccgtacagcagtgaaattaccgccatgaccctggacggtcagctggaaaaactgctgttgcaagcacttcagaataatcagtctagccagagcgtgatcgagcctggcattgctgaaagactgtcccaacagacagaaatggcagccagacaacaagagcaaatgggcctgaccccggtattactggtggccgccccgctacgccaggctttatcaagatttttaagaagaaccgtcccgcatctcagagtgttgtcacatgatgagctgccagacaacaaatccattcgtgtcaccagtttaatcggagcgcaataa

SEQ ID NO: 99792 - DNA, 195 bp, Glycine max
  Peptide Sequence Number=SeqID_216570
atggctcttgcggtggtcgacgacggcggcgacgagagtgatgctgatgtgattggttttggaaaaagcgaagtgcaacgaaggacaggaggtggagacggagacggagacgagggtattgctattggcacttccaaatttgctattgacacttctcatgtgggtgcctttgggaattgccaaattgccccttag

SEQ ID NO: 99793 - DNA, 2868 bp, Glycine max
  Peptide Sequence Number=SeqID_216571
atggataaagaaaatccagcatatgcagcatgggaatatcaagatcaatcactgctagtttggcttcagtcgttcttatctgaggcaattctgaataccagaaaaggtgaacgctccatagttgaatttctcactcgtataaaaacaattgttgattctttactagccattggacaaactgtttctgttcaggaacagatagatgttattcttgaagaacaaaggcttgaaaagttaagagaaagtgttgttgctcctgcactgaatttgactcgagctcaaacagcaaaggcagaggatactgactcggattcaacacctcaagtgcagtttactcaacaccatgataggggcagatcttctaattccagaggaattttggaaatggtgatcactgaaattatggaaatactgatagctcaacagtataatcagaatcattctgggaatcagaacagaaactactcctatcataggcctaattctcaacctcagaacaataactctcagtcacagcacaatgcacaagctcctcaagcctacttagccaatgctaatcctactcagcagtcacagaattggtacattgattctggtgcaactcatcacgtcactgcatctcctcagaacttgatgaatgaagttccaacctcggccaatgagcatgttttccttagcagcggtcaagatgacctctatgtcttctcaaatcttttgaattcttctgtcaagtctactgttggaagggctgctgcctctgttcatatgtcttcactttcagctttgtcttctcattgtaataatgtcaattctaaagaattgtgtactgcctgctgtattggcaaatctcacagacttccctcttatccttctgattctgtctattgtgctcctcttgagttaatattctgtgatctatggggacctgcacctatgctttcttctatgggtttcaattactatgtctcatttgttgatgcttacagctgttacacttggatctattctttaaaacagaaatctgaaactctgtctgtgttcaaacagtttaagagccttgctgaattacagcttatctgtcctcatactcaccatcaaaatggtgtagtggaaagaaaacacaggcacattgttgaaatgggtttgactcttttgtcacaggcttccatgcctctttcttactgggatcatgcttttcatacagcagtttatcttattaatagatttccttctgcctatctcaaaaataccatcccttatgaaatgacctttaacaaatatcctgattattcttttctaaaggtgtttgggtgtatgtgttttcctcatccaaggccctttaacaaagataaacttgatttcagcttccctttttctgttgctaagcctcatgtttcatcccctccttctagtgttccctctcaattacttcgtcttggtgtccttcctatacctactgctcatcctaatcctccttctcattctatggagtctatagagtcccttagttcattgtctcaacctgttgagttgaattctcttcagctagttcccactaaacaagctgcatcctctattccagcaaatgatgagtccagtccctctactttaccctctactactcctcctcaacctcaaaatacacatcccatgcagactagatcaaagtcaggtattgtacgaccacggttacatcctaccttacttctaactactgctgaacctacttctgttaaacatgctctctcatctcctgagtggaaggaagctatgcggcaagagtacaatgctcttatggccaataacacttggtctctggtcccgttatccttaggcagaaaagccattggctgcaagtgggttttcagggtaaaacagaattttgatggctctatcttgaagtataaagctcggttggtggccaaggggtttaatcaaatccctggtcaagattattcacaaacttttgcaccagttgtgaaatctgtcacaatcagaataatgttgactattgctcttaatcatcactggtctattcagaaaatcgatgtgaacaatgcttttcttaatggctatttggaagaattctacatgacacagcctcttggatttgctgattctgataaaagtatggtctgcaaactcaagaaagctatctatggcttaaaacaggcacctagggcctggtatgaaagattaaccaaaacactactgaattttggctttgttcaaagcatgtgtggtccatgccttctagtgttcaagactgattctgagtgcctttatctgttgatatatgttgatgatattatcatcacaaggtcatctcctgttcttattcaaaaattaatgaccaaactacatgctgtctttgctcttaaacaactaggaaatttggattattttctggttattgaagtaaaacatttgagtaatggttctctactgttatctcaagctaaatacattcgtgatttacttgaaaaggctaagatggttgatgccaaaccaatactcactcctctgccctctgatcttaagttaactaaacttggtacagctaagcttgtttcagtccctgttgctgatgctactctctatcggtcagctgatgggacacttcagtacattactgtaacctggccagaattgagctacagtgtaaacaagggtactatagactatgggttttctttaaaatctgctcctcagggagaaccctatactttagaagctttttttgatactgattggggaatggatatgtcctctgttgctcgttcgactacagaagctgaacatcgaagcttggctgttaccgcattagaacttctatggattcaatccttactaagagaactctattaa

SEQ ID NO: 99794 - DNA, 289 bp, Glycine max
  Peptide Sequence Number=SeqID_216572
gctcttggacctttttcctcttcaaacatgcatggctatttatagaaaacaaccattgagtgcagggaaactcgcccaggcgagctgcttgcttagggttgaaggtatcagcttgcccagacgagtgacttgcttagggctgaagttttctcttagcctaggcgagctagatgctagtctgggtgaatttagggttagaaatcttcatgaaaagaccattttgccattccatttagctttgttctcggatctaacaaacaaccatcaaaacctaaaaaattatggatga

SEQ ID NO: 99795 - DNA, 255 bp, Glycine max
  Peptide Sequence Number=SeqID_216573
atggatggcgaagaattgccttcgcccatgaactccgatcaaagagcagaattgtctcaggtcacagttagaagtcaagacaagttgactgcggaaatcaaccaaggtacatggggacggatgcaagtggggatagggtcacgaccgaccgatcgttcccctttcccggcgctaaacaagcagagaacatcgctgcaaggcagcccagtatcctttgcattcgcggtttcttttactattgtttgttttaaataa

SEQ ID NO: 99796 - DNA, 312 bp, Glycine max
  Peptide Sequence Number=SeqID_216574
atggtggatgaggtcctgattgatacaccatggagttatgttagctatccaaattgcactacaacgtttgatccattaaaaataatgggtgtctgtcgttcgtgccagaaccaagttagtcatacggttcccaggtataaattagttttgaaatggaacacaatggggagaaagctaactttcatttttgggatgcaacgtgtatcaaaatgttcgggtggtgacgagatcaaagtgttccctgagtgtgtggatgatttggttggtaagacattggcgctaaggttcaagtaccgtgtaaacatgcgctag

SEQ ID NO: 99797 - DNA, 234 bp, Glycine max
  Peptide Sequence Number=SeqID_216575
atgtccgaaatccctctatcaccttcatccgcgttgttgagcatctccaccggaatgggtggcacccgcggcagcgcaacggtggaaacatggagcatggtggtgaaagagaaaattgtgaggttgaggattcaacgctacggtggaaacatggaacatggtggtggcttgcacttcacggttgctgctgctcctaacactcagttacctcaagcttgtctgttttattggtga

SEQ ID NO: 99798 - DNA, 174 bp, Glycine max
  Peptide Sequence Number=SeqID_216576
atggtggatgagtttggtgatggcatccttcaaacgcttcgagttggctttcgagcggactcagccattgtcgagctcaacgagagcaccaatttgttaggaaaagggaaagctagcctgggcttcgagggatatgctaataacagaatggattctgcactatggaattggtag

SEQ ID NO: 99799 - DNA, 492 bp, Glycine max
  Peptide Sequence Number=SeqID_216577
atggctctcaatcttcccacgatgtctcttcaggtagaaggtcgtcccacagcaccaacacctgaattttccgtgttacaacgacaacccagaattaccaagggagcaatcagaggttggcagttcatgcaattgacaggcagagctttcaacagcttcttgcggattaccacgaaggcctcatctctgattttcaaaacctcatctactatgcccaatgtcaaggtgactgtaatgtattgtggtatggtgaggggtttcttgctgaaagtcatctcgtatggggacaaactagagccggagtggaccgagcacctttgtctaaccatcgatctgcggatggtaggcggagctcatccgcaaggtcatgccactgagccgaaacaagttttgctagaagcggctcagaaacaggggaccatggtctgcgatcaagctccgaggcatgccgtgaattttacccatgatatccatgaagagaacgacaactga

SEQ ID NO: 99800 - DNA, 741 bp, Glycine max
  Peptide Sequence Number=SeqID_216578
atgaggataacgatagggtgcttggaaaagggaagaaaattgaatgaggagcttctgaatgggcgaaggcagggtgttagggatgaattaagggggatgagggtctattggtgtaatctggagatgaaattgatgaggagtgttgagatggagggatgcatcggtgtctccctgaagctcaaccaagtgcccttctcaaatgaatttcatggacaatgtgttgtagtctgtcaataccggatccagagatttcaaccattgcacatcaagaacaagggtggcctcgcaaaggaggtgacaatccagcgtatggccattgcccaccattacctgcaagggagccggtacaaagcaacttggcccaccaggcataaagtttctggagcgagatggcctgaaaatgtatgcaagctaatttgggcctggagtgggtcatgggtatcaggtggttcgggtgagggctccaacaaaggagcagcgtcttcaaaaggcttagacctcgtggcggatatcgggctagaggctcgagacaaagtagctcagaaggaattgcaatggaagaccgacgatcctgttggccaaatcctcaaacttcgccaggtgggggcaaatctggtttgtagtgcttacaggaacactggccaggaggtccaacctatcgaaatgcaacacttccagcttcaggcgatgagcagaagatggggatgtgggagttgggatagctatggaagaggaggatga

SEQ ID NO: 99801 - DNA, 1332 bp, Glycine max
  Peptide Sequence Number=SeqID_216579
atgctgcagaatggactaattcatccaagcaccagcctcttctcatctctgataatcctagttcgtaagcaggacatctcttggcggttttgtatagactatcatgctgtgaatgccattacgatgaaggatcgttttccgattcccaccattgatgagttgttggatgaattggggggcgcaacgtggttctctaagttggacctccttcatggatatcatcagttactaatgcatgaagatgacatttctaaaacatcttttcacattcatcatggccactttgaattcagagtcatgtcgtttggcttatgcaacgctccatcatcgttccaggcgatgacgaatgccattttccggccatatctctgtcacttcattatcgtcttctttgacgatatattaatcttcaacaagactctccaagaccatgtcattcacttggaaaaggccttccaaatccttttgagggagttcattctcggatattcttccattgcgagaccgctaacacgactagttagtcaagataccttcacatggacccccgtaacaaggctttcctttaatgaattaaagcaggcattgaatactgcgcctatcatgcaattaccagacttcactcttccttttacggtggagacagatgcgtctggtgtcgacatgggcgcagtgctgtcccaaaagaatcatccaattgcgttttcagtaagccatttacacccagactccatcgtgcctccactgatccaaatgcctgaacaacaaacgtatttggccaaattgatggggtatgactactccattcagtatcgctcgagcaagttgaacagtgcggctgatgccctttctcggattccgaaaactactgtcggtactatgctattgctttcaatttcgtccatgacttttctcaatgaattgaagaaccaactcctgcaacatcctgattttctcaagttgcgacaagagatcacccaacatcctgacaaatatccggagtatcgaattgctcaggatttaatcatgtaccaaagccgcatttggttactggtggggtctcccttcattcctaccttactcgcagagtatcattcctctcccataaggggccatatagggatcacgaaaactctagctcgtctcagcgaaaattttttttggtcagggatgctcaaggatgtcaaaagctttgttgctcagtgccttgactgtcaacatacgaaatatgagaccaagaagctggctggactcctctatcctctgcctgtccctttccggccttgggaggatctctccctcgatttcatcattggcttgccaccattttag

SEQ ID NO: 99802 - DNA, 213 bp, Glycine max
  Peptide Sequence Number=SeqID_216580
atgctttgccctttttgtaaccaaatcagacattatcttcttgatttgttgagagtaactcctcgtgatgccaactatactggacctggttcccgattttgtatcttgagaccagaattaattactgcctattgccaagcccaagcagcaaaggcattgaaatctaaggagaagaattttcaagaggtagacaatttggccactgaatcctga

SEQ ID NO: 99803 - DNA, 2310 bp, Glycine max
  Peptide Sequence Number=SeqID_216581
gagcaagttcttctccatttaggggttgctgaccttgattatgctctccgtagggatgaaccaactgagcttacagattctagcacttcagaagaaactgcgttatacgaacgatgggaaagatctaactgtctttctattatgttcatcaagatgagtatctctgctagtatccgtggttcaattccagaatgccaaaatgtcaaggatttcatgaaagtcatagatgaacagtttgaaagttctgagaaggccttggctagcaccctaatgtctaagttgttatctatgaggctcaacttaagtcgctccagatctatgattcatatttctaataccatgcaggacttctcaagccagagggagccaaatgaagcattggatgcctttaagattttcaaggcagaagtagagaaacaatgtggaaaacaaataaagattgtgagatcagatagaggaggtgaattttatggcaaatacactgaaaatggacaagcacctggtccttttgcaaagtttcttcaagagcatggtattgtggcccaatacaccatgcctggctcaccgaatcaaaatgccaagtttaaaacatctgcgtgtttgggttgctcatctgaagttaggatttataatccaaatgaaaagaagttgcacccaaggaccattagtgcatatttcattggttatgctgaaaggtctaaggggtatagattttactgtccaactcatagcactagaattattgagtcaagaaatgcaaagtttctagaaaatgatgtggctagtgggagtgatttaactaaaggcattggtcttgagaaaaatcaatacgagggagcagttcctacatcaagttataagcttgtggtttttagcgatactcaccaaaattgtgtaacacaagctccacatcaagttgatcatgtcctagaagatccagttgaacaacatcaaacacaaaatgttgagcaactttttgaacaacatcaaacacaagatgttgaacaacctgttgaacaacaaccaaaaggtgtggatgtaacattgagaagatcaactagaataaagaaacctgtaattcctagtgattatcatgtgtattcacaagagtctcaatatgactttggagttgaaaatgatcctgagtcatttttgcaagcaattaacagttgtgattctaagctatggtatgatgctatgaaagatgaattggaatctatggtaaataataaagtatgggatcttgtagagtttcctaatgggataaagcctattggatgtaaatgggttttcaaaaccaagaaggattcattagtgaaacaattcctttctaagaattttgatatgaatgatatgggggaggcagcatatgtcattggcatagagatccatagaaaccgatctcaagggattcttggcttgtctcaaaaggcctatattaataaagttctagaaagatttcggattaaagattgttcagccaacatggcacctattgtgaaaggtgatagattcaatttgaatcaatgtcctaaaaatgagcttgaaagggaacaaatgagaaacattccatatactttcattataggaagccttatgtatgcgcaggtgtgtacaagacctaacattgcttttgtggttggaatgcttgagagatatcaaagtaatccaggaatagagcactggacagctgcaaagaaagtgttaatatatcttcaaggaaccaaagattgcaagcttatatatatatatcaaagatttgacaatttagaagttgtcggctattcagactcggactttgctagttgcgttgactctcgtaggtcgacatctggatacattttcatgatgactgatggagcaatatcttggagaagtgcaaaacaatcattagttgccacttctaccatggagactgagtttatttcattattgaagcgacatcacagggtatttggttcaaaagtttcatggtcagtctccaaactagaagcattctttgcaatagacgagtgttgtcaaattcaccaaggatatatgggaagagctgtgacaggagggtgtactgagttcgaaccggagtggtttcaagtgttggacaatatttattggaaaccggttattctggttgggcggctacctagtagtattggtcctgttggagcgaaatcgaggcaggatgaagtgattgagatcgctttgggattagagaaattgaagccttcgtttttgtgggtgttgaggcttcagcatgggccgtgggacccaaatgtgttgcagttaccagaagggtttgaagagcgaacgcaa

SEQ ID NO: 99804 - DNA, 912 bp, Glycine max
  Peptide Sequence Number=SeqID_216582
atgggatcaaatcaggcaccctcttttaagaaaagattctaccatgtgaaaatcaaaagcctagaggtagctggtttgcaagaactagggcagggaatgggtcagctccaacttcaagccttccgcaagacatatggaaagatctgggatctcgctatgatagaactcttggaagaaaacgcgaaggctttggcggatcaaggtgaatgggcttcattccttgatgtcttagcgctattggtgttcagagtcatcctctttccaaatgtggatgggctagtggatctagcagcgatcgatgccttccttgtttatcaccacagcaaggaaagtctggtcattgttattttggctgatgcctatgacacatttgattggagatgcgagaatagcagtgcaaggattgtctattgcacccctattctttatgtatggctaacctctcacatctttcgtcatcaaagtagacccgtctgtccccttcaaggtcaccacatgtgtgccgagaaagggaaagcaaattgggagcagctcctagctggtatggaaggaagggctggagttttgtcctcatgtaaagggttcacaaacgtccccttgatgggaacgaggggttgtatcaattataatcctatactttccataaggcaacttggctaccccatgagaggaacaccatcagaagaaagtattgcgcctttcatcgcacgaggcttcagtgaccccaatgcaaaagtgcttcaaagagttcggaaagcatggaatacggtgcaaagaaaagataaggagcttaggggaagcagcaatgggatcgtcggcggctatcacaagtggctgaaggctagaatgcaagagataacttggctcccgaagctaaagatttcaagtgaggaagaggctgaaaccccttag

SEQ ID NO: 99805 - DNA, 451 bp, Glycine max
  Peptide Sequence Number=SeqID_216583
aacaccggatgctatgctcaacctgcttcaatcaaccatcactcctactcatgatgcaattatgtattacaacgggaagtggaacataccacgtcaaggtgagttttttggttactcatttactggaactaatccaatcagatttggcattctttcggaatgtggcatggagaaactcaaggatttaatcaagcaagttgcacctacaggggtccccctgatggaattcacggatcacaattggttagacgattgttctttcgacaaccagcggttcttggagaacgtcgtaggcttctttgaggtgttcaaagacgtcgtaggggatgtcagtgttggcttctgcgttttctggaaggttttggactttaggcagtggaaggttcacgaaattgatatcaacaatgagtttggccagctcaaggtttgggatcatgtgaccaaaggctag

SEQ ID NO: 99806 - DNA, 372 bp, Glycine max
  Peptide Sequence Number=SeqID_216584
atggaaggtgcagcagctggtgtctcgctaagcctggaccatgtgcttaacgagtatcatctgctaagcgagacatcatcccgcttagcgagtaagaggaatcttgaaaggaatttgctatgcaagcacgcgcccagtgcgcaaccagctcgcccaacgagtcatttgtctcttctggcgcttagcgcgcctggcttgcttagccaaagatcacttactcgtgctaagtgcgaaaatggcgctaagcacgccttcgaggacagaaagccctttttaaagcctgaaatgaagaaaaagagagaaaaaaggcagataaagtgtgaagaacagagaataaaggcacaaaatagagcaaggaagcaaaaaccttag

SEQ ID NO: 99807 - DNA, 948 bp, Glycine max
  Peptide Sequence Number=SeqID_216585
atgcccgctgcagggttgatgcccactgcaggtcacctttcgactgcgaaagatgtgtttctggctccaccggctatcgaggctcttgctccactgaccgtcgaggctcttgctgccgctgctagtactcctgttattcatgctcctttacctcttcccgttgttgctattcaggaggttgctcttgctattgtgccagccactcaggatggtattgttgtggtgtcgttgcccaccatcgtggaacctttgttaagtgctggtgtggctgccactggtgcttccacgatgatgcctccttcctctatgactctgatggcttttccctctgttattttagcgatggtagcatcgctttcttcactctcttgccctcgtgtcttgcttggtcattcgtatacctctagtgatgttgactcactgtggggtgcaacttatacgatggagcacaagaccccggttggctttgtgtcagccttcgacaagaacctcattaggtcgactagggtgcagaatgctactgactctgccaaagtggggcaccctaaggtggccaatgccatcgttgcttttgctaaggctgccaagaagatggacttgggtggcaaagtggagagcttggcgactgagaaggatgggcttgccaaagtagttgttgacttagaagcccgacttaaggagtcggagaccaggctggaggagtccaagttgtgggctgccaaggaaaggaaggtcagtagggagctcgaggaagagctaattctgtataagaaggaggtcgtggagcagtatgagaaacagtttcagaaggccatcaggcatgtcgatttctttgcgaaggatgtgaaggagggtgttctgcttgatgaggaagaaattaatgtggaggaggaggctgctgatgaagggcagtgtgctgcggagcaaggtgatgatgcatgtatctaa

SEQ ID NO: 99808 - DNA, 537 bp, Glycine max
  Peptide Sequence Number=SeqID_216586
atgtcttcttttttgtctgattctgccattggattaggcgacaacaattttggaggctcgattgaggaatccatcatggatcgagagcaagtcctcctcctcggagagggtgaggacctcacaccaaactggtgtgagcacttctctccctcgcagaagggcatgaccttatgctacttccggggagcctgtcccggttactgtgatcctccccattctgcttatgagggtgtgaggagaggtagtgtcaatggagatgtgagggtgtttccccgcgtgcaacgtagcaagagtgatgggtcagcatcgtctaccctggtcattgctggctatgaatgggtgagggatgacgtgttgaagtataagtcttgtctaaccttagcgacaagtgttgttgggcttcaatgtcaggtgaagttggcaaacctcaaggactcttgtaagctggccgctcaggctcgcgggagtaatgacttctcagtttttagggcggcgcctggttgtccgcccttcttctttatgtactggagcacttga

SEQ ID NO: 99809 - DNA, 255 bp, Glycine max
  Peptide Sequence Number=SeqID_216587
atgaccatattggcctctgcttgtcaatcgaacttggggtcttcgaatgacgaggtgtggataactgtaagggcgagaaattcactagcacacaggattttggttggtgtcgcaagctaccctttggcgggagggcaacgcgagactcataggtacatcttccaagaaaggaaaatgcacggagtcgccaccaacgtttattggaggaaaacgtcggaaaaaccggaaaaggtgtggtctacgaactttaagtga

SEQ ID NO: 99810 - DNA, 1091 bp, Glycine max
  Peptide Sequence Number=SeqID_216588
gtcgactctagaggatcccacataccattctgtcctcgcgggtgattgtcggtcgtccggaccgcaaaacgccgctgatgcgcagcgcgctcaacaatgtggtgctcaatccgccgtggaacgtgcccaccacgctggtgcgccaggatatcgtgccgaagtgatcgatccgtcgatgattgactggcacatggtgtccgccgccagtttcccgtatcgcattcgtcaggcgccgggtgccagcaactcgctgggccgctataaattcaacatgccgagttcagacgcaatttatctgcacgatacgccgaaccatggcctgttccagcgtgatatccgcgcgctcagctccggctgcgtgcgcgttaacaaagcttctgagctggccgatctgctgttgcaggacgcgggctggaacgacagccgtatctctgacacgctgaagcagggcgatacgcgctacgtgccgattcgccatcgcattccggtcaatctctactacctcacggcctgggtggcggacgacggccagccgcagtatcgtacagatatttacaattatgataacccggcgcgctccggcagccagatcggttttgcgcattctgtgacagattgcgggttgactgctctccaggctgcggttactgttcggccttcggctggattgtcactgctgccgggtgcagcgctggcgtcagtttccacctcccgcccccgggtattaacgctcagtaacatgcataccggtgaaaccctcaaaactgagttttttaacggtaagagttatgacaaggatgagttagctcgcttaaaccacttcttccgcgattaccgcgccaatcaggttaaacacatcgatccgcatctgtttgaccagctgtatcgtttgcagacgctgctcaacacgcgcaaaccggtgcagctgatctccggctaccgtacgctggcgaccaataatatgctgcgtgaatcgggccctggcgtggctaaacacagctatcacaccaaagggcaggcgatggatttccacattgagggcatttctctgagcaatgttcgcaaagcggcgttatctatgcgcgccggtg

SEQ ID NO: 99811 - DNA, 141 bp, Glycine max
  Peptide Sequence Number=SeqID_216589
attttcaggaagaaggatagatctcctccagcacaagccgttgcagcccagaaacgcacatggctatataatcacgaaggctgcacgagttctgtaccaagtccgggattgaagagttactttgtgagttttgggacttga

SEQ ID NO: 99812 - DNA, 273 bp, Glycine max
  Peptide Sequence Number=SeqID_216590
atggtggtggatcccgaggcaaaacccatctaccaaagaagacaaaagatgggtgcagaaaaagggaagaagtcaaaaagcaagatcatgagaaagggcactgagtttaaatgggatgaaaagtgtgaggcaacctttcaaaaggtaaaagagacattatcatcaccacttatgcttgtgaaactagaaatgggcaaaaccctctacctttatcttgccatggaaaacgaggtaataagcgttgccttagacttggaaacagatgagcactag

SEQ ID NO: 99813 - DNA, 246 bp, Glycine max
  Peptide Sequence Number=SeqID_216591
atgaattttgatgcatacacccatcgagaatttgctaagcgcaaccttcagtggctaagcgcgaggaagaatccagaagaagatgagctgtcaagttcactaagcgcatcactccaggtcatcaagcgcactgcttcagctcatctgctaagagaaacaagcgcgctaagccaaaatctacttatgcgcgctaagcgatgcagatctgtgctaagcgcacaagcacgaacaaggccacctatctaa

SEQ ID NO: 99814 - DNA, 501 bp, Glycine max
  Peptide Sequence Number=SeqID_216592
atgcatggaggtacctttaccaggaatgaagctgatggaaaattggagtatgttggtggggagttagatgtgtgggataagatagaaactaattatttaaatttctttcttctaaccaatctggtcaagcattgtagaaaatataacaatgtgggtgacattcactatgttatggataaggaagtggatttggaagagggtaatctgaatccaattccagaagttgaggaagaaggaaataaagatgatggtgatggtgatgtgggtaatgatgacagtaatggagtggatgatgtagatgttgatgtgagggtaggccgtgaatggtggagtgatattccagaatacaatgatgaagtccaacaggatgaagctaaaccagttggttatgaatctgaaaagttagatagcccgagaagttttgatgatgaaggtggatttgaaaaagaagtcttccctcaattcaatgaatgcggcaagtttggtaatgtgcatttggag

SEQ ID NO: 99815 - DNA, 255 bp, Glycine max
  Peptide Sequence Number=SeqID_216593
atggaggtgcggtggccgaatatgggtagatcagcccaaaacacaccagatctggtggtcgtacgtatgaaaggtcattggagttgcaacggggagggagttactatagcggcgatggttgaaggtgaaaaatggacggagggtgaaggatttagtagtgggtgcggatgcaaggttttagaagaacacagcatgaacggtctgcgaacaaagcaagtaccaacaccatgttggttgtgcccaaagtttatgtga

SEQ ID NO: 99816 - DNA, 546 bp, Glycine max
  Peptide Sequence Number=SeqID_216594
atggcgacgagggcagcagtggcggcgccgcgcgtttttcggcggtttttctgcacaaactcagcctctccttctttccccttcgttcctacgccgcctcctggcgccacccccactccaactcgacccacggcggagcccaaccccaacctcttcgtctctgttctgggtggtttaggttttgaagaggttaagacatggctcaaaaacctggaaaaaggatttgacatacctttccactactggtccagtaatatcagggatggattttgtcttagcaaacgtactactacagaaaggcttcgagaggagtttgcaaagtttggtgaagttgttcatgcaagggttgtaactgatcgagtctcaggttactctaagggttttggttttgttcaatatgctacaatagaagaggctgcaaagggcattgaaggcatggatggcaagtttttggacggttgggttatatttgcagagtatgcgagaccaagaccaccaccaggccaatctctaaataacaacagtcctcagtatggccggcagtga

SEQ ID NO: 99817 - DNA, 420 bp, Glycine max
  Peptide Sequence Number=SeqID_216595
atggtgacatcgaatctgacagtgatggtggagccatttgtaaaggactttcttagtggagacaaggttctaggcacaaagatcaagatgaatccgaagaggaagaaggaaatcgatttagttaagaagcctgatgtgctcatcgaaaaagttgggcctcagagtcacaacttcaagggtccctcaaatatgagcatggaaatggaataccacaagatttatacttcaatgattgatgcaaaggccaatggattctccgatgtgttgttcttggactcagcaattggaaaatatatagaaaaggccacaacatgcaatgtatttgttgtgaagggcaactttatcttcactcctgatatggatggaaccatcctgcctggaatcgtgcgaaaatccatcattgagattgccatttgttag

SEQ ID NO: 99818 - DNA, 348 bp, Glycine max
  Peptide Sequence Number=SeqID_216596
atggagtcatcagcttcttctagaaacttagggaacaacaccttccaacaaccaaggattaactttttaagaacgcgcgatttcttctgcaccgtcgttcttgaccttcttgtggtgcctctgcttctgcttcctctaccggtcgaacagatttgtgagaatgggacggcttcagcgagttcggcctttggcagtggtggtgaggacgcagtctgcggcgacacggacttggagggtagaggtatggcgcggctccaacgagttcggcctttggcagtggtggcgaggacgcggtctgcagcggcacagacttggaaggcaaagcaaagtaagggaatggaggtttga

SEQ ID NO: 99819 - DNA, 222 bp, Glycine max
  Peptide Sequence Number=SeqID_216597
atggatcttgactatttttatcttataatttggcatcttctcttcttgccacaatttggtgtttgtggaaataaagaaatgttggaatacaagtgtgagacatctagaccattagttgaggtttggaaatcacctaagcatcctttcatgaagcttaatactgatgaagcgtggttgtctcataatgccatgggaggaggaggagtgcttcgtgaatcttaa

SEQ ID NO: 99820 - DNA, 651 bp, Glycine max
  Peptide Sequence Number=SeqID_216598
gacatcttccaagctttgatgagaggaccagaggtttcctttggtgctaatgttattgccagcaacgccaccgatgatggggttaatgtcgcttcatctaaccctgatgaggaggttgacatcttcgagcatataaggcaaaaggatgaagctactgagaaaggaaaaaaatgtaggaagataaagaaacgtgaggcaaaaagggtcgatacttatacctctatcttcttgaccactaaatttattatcgacctgaaggaaagggtaaaacttacctacgacaacaattctgattgggttgttgtcgatcactgtcttcccagtgagagggtcgaaccatcaggtggtaaaggcgatcgaccaaaggataaggttgcaaagatgaccaaagtcattcatctggtggattttgacaaagttaaaggcacaaaggagaaaacccttaaaaaacaaacctctttgaggtcggatgccaaaaagatcactactgaaggttgtggcgctattgattcattcctaagaaaacaaatcccctcaaagccaaatattgagaagaccactactaatggtggtgatgtagtcgatttgggtagttccacaaatgtggagaagctgacttcaactcctacaacgttgactctaaagactgca

SEQ ID NO: 99821 - DNA, 333 bp, Glycine max
  Peptide Sequence Number=SeqID_216599
atggatgcaatgctttggtttcgacatgttcaaggaatacaacaaattctctttgatcaggaccatggagcacacattcttctccatgataccaagcagctacatagcacaaaatcccctatgttagtcagatggaaccctcctacacctcaagctatgaagataaacactaatgggagctccctcggagatccatgtgcaactggtttcggtggaattcaaagagatgacttgggcaattggattatggggttcaagggttattgcggtttcagttcaaacatgacaagaaaactgtttggcatcttccatggccttcgtattgcaaattaa

SEQ ID NO: 99822 - DNA, 246 bp, Glycine max
  Peptide Sequence Number=SeqID_216600
atggagattcggtttagaggttggatccacaaacgcgaattccaatggcaatccatgatagtgccaaacgagttcaacggaggcattgtggtgccaacaatcactctagcacttaagctggaaaatcagttatccatctatcacgatgttccagctatcattacttgtagcacacgtttcatgttatatgatcacacataccgcgtgagattggttattactaccaggaagccaacatccgcctaa

SEQ ID NO: 99823 - DNA, 1189 bp, Glycine max
  Peptide Sequence Number=SeqID_216601
atggctggggtgggagaggcactaatctctgcttctgtggagatcttactaaacaagatagcttcaacagttagagatttccttttcagcacaaagttgaatgtttctatgttggaagagttgaatacgaagctgtgggaacttacggttgtgcttaatgatgctgaggagaagcagatcactgatccttcggtgaaaacatggcttcatgggttgaaagatgctgtctatgacgcagaagatttgttggatgaaatcaatacagaatctcatagatgcaaggtggagggagaatctaaagcatttactaccaaggtcagatcatttgtttcttcacgctctaaaatattttataagaacatgaattccaagctcgaagatttatctaaaaagctagaaaattatgtgaaccaaaaagatcgtctcatgttgcaaattgtttctagaccagtctcttatagaaggagggcagattcattggttgagcctgttgttattgcaagaacggatgacaaagagaagatacggaaaatgcttctatctgatgatgatgagaagaacaataatataggagtgatcccaatattgggcatgggaggtctcggaaaaacaacccttgctcaatccctttacaatgatggtgaagtgaaaaaacattttgattcgagagtttgggtatgggtatcagatgattttgataattttagagtaacgaagatgattgttgagtctctcacattgaaagattgtcctattactaattttgatgttcttcgtgttgaattaaacaatatcttaagagagaagaaatttttgcttgtgctagatgacctttggaatgacaagtataatgattgggttgacttgatagctcctttaaggagcgggaaaaagggaagtaagattattgtgacaacccgacaacaaggagttgcacaggtcgcacgaacattatacattcatgcgctggaacctcttacggttgaaaattgttggcacatactagctagacatgcatttggtgatgaaggttatgacaaacatccaagattagaagagattggtaggaaaattgcaagaaaatgcgaaggtctgccattagctgctaaaacgttgggaggtcttttgcgatccaatgttgatgtcggggaatggaataaaattctgaacagcaactcatgggcacatg

SEQ ID NO: 99824 - DNA, 2403 bp, Glycine max
  Peptide Sequence Number=SeqID_216602
atggcggaaggctttcttcaacaaagccatggagataatagagcaatggaatcaataggtgatgattgctttaatgaattattatctagatctttgattgaaaaagacaaagctgaagcagagaagtttcgaatgcatgatctgatctatgatttagctagactagtatcaggaaaaagttctttctactttgaaggtgatgaaatcccaggaactgttcgccatttagcatttcctagagaatcgtatgataaatctgaaagatttgagcgcttgtatgagttaaaatgtttgcggacctttctaccacaactccaaaatccaaattatgaatattacttagctaaaatggtgtcccatgattggttgccaaaactaagatgcttgcgatcactgtcattgtctcaatacaaaaatatcagtgagctgcctgagtcaattggcaatttggtgcttctacgatatcttgacctttcctatacttccatagaaaggctgcctgatgaaaccttcatgctttacaatttgcagactttgaaactttcaaattgtaaatctcttactcagctgccagggcagataggaaatttggtcaatctacgccaccttgatattagtgacataaagttgaagatgccgacagaaatatgcaaactgaaagaccttcgtacattgacttcttttgttgtaggcagacaagatggactaaggataagagaattagggaaatttccttatctgcagggtaatatttccattttggagctacaaaatgttggtgatccgatggatgcatttcaagcagaattaaagaaaaaagagcaaattgaggagcttacgctggagtggggcaaattctcacaaattgccaaagatgtacttgggaacctgcaaccgtcattaaatttaaagaaactcaacatcacatcctatggtggcacaagctttccagaatggctgggtgattcttcgtattctaatgttacagtccttagtatcagtaattgcaactattgtttgtcacttccacaatttggacaactaccttctcttaaggagcttgtcattaaaagcatgaaagccatgaaaatagttggtcatgaattttactgcaacaacggaggctcccctacttttcagccatttccattactagaaagtctccagtttgaagagatgtcaaagtgggaggagtggctaccatttgagggtgaagatagcaactttccttttccttgtcttaagcgtttgagtttatctgattgtcccaagttgagaggaagcttgccccgctttctaccttcattgacagaggtcagtatctcaaagtgcaatcaactagaggcaaaatcatgtgatctgagatggaacacatcaattgaagtaatatgcatccgagaaagtggagatggcttgttggctttgcttctaaacttttcttgtcaagaactatttattggagagtatgatagtttgcagtctttgccaaaaatgatacatggtgccaattgttttcaaaagttgattcttagaaatatccattatttaatttccttcccacctgatggtttgcccacatcattgaaatcacttgaaattagagagtgttggaacttagaatttctctctcatgaaacatggcacaaatactcatcacttgaagaactgagactttggaatagttgccattccctaacatcctttccattagacagtttccctgcccttgaatatctttatattcatggttgttccaacttggaagcgattactactcaaggtggagagacagctcccaaattattttattttgttgtcactgattgtgagaaactcaagtcactttcagaacagattgatgatctccctgtccttaacggcttgtggctttataggcttccagagctagcatccttgttcccaaggtgtttgccttccactttacaattcctttctgttgatgttggaatgctatcatctatgtctaaacttgagttaggtttgttattccaacgcctgacttctctgtcttgtcttcgcatctgcggtgttggggaggaagatctggtaaacaccctgctgaaggagatgttacttcccacttctctccagtctctatgcttgcacggttttgatggtttaaagttgttggaaggaaatggtcttcgacatcttacttctctccagaagcttcatgtctggcattgtagaagcctcgaatccttgcccgaagatcagttgccaccctctcttgaattactgagtataaatgactgtcctccactagctgcaaggtatagaggtcgggaaaggaaatacaaattctggtctaagattgctcactggtcaaagattgctcacatttctgcgatccagataaatgatgatgtgacaataagatga

SEQ ID NO: 99825 - DNA, 333 bp, Glycine max
  Peptide Sequence Number=SeqID_216603
atgggcttagaaatctaccctgaggttcatgagaatcctagggccttcttcagcagctctagcccaatcctcttggagcctcttgctcatggctctagtgactggtcccttcctagtgacatggctataggcctatcttgggttctgtggactaagcacacatccaccgctaagcgcagctccagcgcgcttagcgcgacagaagaatctggcagggcatcatcatcaaggccgcgcgctaagcgcgagaccagtacgctaagtgctgcagttgtcttccgccaggttcagcgcacgactggcgctaagttcaaatccagttacttgcgctaa

SEQ ID NO: 99826 - DNA, 397 bp, Glycine max
  Peptide Sequence Number=SeqID_216604
gcttcttgccggttcattggcttttgaaagccgcatccttcattatctaattgtccgcatcttgcttccgagatcttcaaaccttgcacaggcttctgaagaagatctcattgttatgtgggcctttcataaaggtctacaaattgattgggcacatcttggtgctcgacatgttggtgaagaaggacatgatggagaagattcatatcttatttcaaagattttggataggtttgatggtcttcaaacctttgttggtgaaaggtttgacactttggaattacaagtggacatgcgcttcaatgagatggagtcaagaatcaccaaggttgaagaagatgtttcttatattcgttcaagcttcgatctaccaccaccgccgccaccatcatcttag

SEQ ID NO: 99827 - DNA, 441 bp, Glycine max
  Peptide Sequence Number=SeqID_216605
gtcgactctagaggatcccacaacagcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 99828 - DNA, 213 bp, Glycine max
  Peptide Sequence Number=SeqID_216606
atgatgttttttctaagctacacaaaagcaaaggctgaaaacgctcaagtgagaaatggtctcggacacggaaatgtcgcgcacactccagacatcttctcaaagatcccaacgggtgttacaccacatcaatacttccctctactagatttgctatcttcttatgccagttccttctgtttaactccagctgaaattcctcaaattcattaa

SEQ ID NO: 99829 - DNA, 351 bp, Glycine max
  Peptide Sequence Number=SeqID_216607
atgatgagttacaatacccgttgttatgttcatgtcgctcagtgtgaaccatccgaggagaaggagtcaagttcttgcatatttttccaatggattgatgatactgaggctggcaataacgtgtttattgaagggagtgagttggtcaagtatgtttgggaaaatgaagagctgaagttgaaaattgcttcgttaatggaggaagctaaaggaaatgcaaaagaaataacagatttgaggaaaaaaattgttgcagcagaggaagaatgtcgtgcatccttagttcaaattgtgcaattgaatagtaaaattggaaggaaagagaataatcttgcaattgaaaggaattga

SEQ ID NO: 99830 - DNA, 480 bp, Glycine max
  Peptide Sequence Number=SeqID_216608
atgtctgggacatccaaggttttgcctgctctccactctatcaaatcgttgcctcccaagttcaagattatcactggtaatccgacttctgatctaatggaaaatcatggagatgctaagctgagaagcagtgatgtgattggatcaggtagtccagaaaatgatgttttgatagcggaggttgctgaggaagcttgggaccgtgctggtgacatgggtgtttacgatgaggactcggtgtacaacaaaaaatgtgtgtcattagaagacaggccatcaattgctgatgaagacttagaatctattcctctgccttcccatcaatttcaatctcctctagggaacacaggtggagtgatacgacaccttatgcttcgaagaagatgtaccataaccactaaagagtatgctttcaaagtcatgagtgctggcttgcaacagtaccagaacatcttgttgaaatttgacattagtttgtaa

SEQ ID NO: 99831 - DNA, 162 bp, Glycine max
  Peptide Sequence Number=SeqID_216609
atggatacaatctcagggactaaattgcctattcactctagaaagaagagcaaaagcctgagggcgctgatattgctttacttatgcaaaggtatggcttccaaacacatcttgaaggagctcaacgatctgcaggaggatccttttacgtcatgcagataa

SEQ ID NO: 99832 - DNA, 231 bp, Glycine max
  Peptide Sequence Number=SeqID_216610
atggttaaggatttgttgttacaacaaggttctctaaaggcattgcacgctattaaacctactggaatggatgatctacattgggaggagttgaaggagagagttggaatgaccatatgggaatgttctcaaggtgaagtcagttctgtaagtgaaggagaatcaggaatgtgggaggacacaaggcaaggggggttctgggagaaaactataagcaatagaacagtgtag

SEQ ID NO: 99833 - DNA, 558 bp, Glycine max
  Peptide Sequence Number=SeqID_216611
atgcatgactctgggtacgcagcaatacaacacgtatcacgtagcaccctcgcgcctgacacaacatctaaacaacaaaatctctgtctgtttccaattccagaagcaagttcaataggtgaaaatgtgatagaacaatcactgatagatcatgctgacaacgaggaaaatgttatagaacaaccacctatagataatactgacaatggtaaaaacgtgatagaacaaccgcctataaataatactgacaacacaaatagtcataatttcaatcaagaactagaatacaatattttagaaataggagtagaagggaatgttgagcttaataacacttctagtgaagtaccaacaaatatttatgacccaggactatggaaaaatattgatggaaaatttagagatttaatgatagaaaagggtcctatcagacatgacaattttcaatatcccaaagatgaaaataataaatatttctattcatcatgttatcaacgaacactgtcaacagggccatgcaagatgaaaggcaaattaggcatcagtctaaggccctaa

SEQ ID NO: 99834 - DNA, 297 bp, Glycine max
  Peptide Sequence Number=SeqID_216612
atggaaacaactaaatcaactcaacgagcactccaaagtgtagaaatccaagttggtgagctggcagaagcagtgactcaatttatggtcagacaagaaaaatcctttgtagaggttgaagctcaaaagaaaagccatgtaaaagagcatgagtcaagagaaaaagatgaggagaaagatggggaacaagcacaacaacaatgggagaagtactcaacagtagaaaaccaacaagaaaatattctccaaagcaataaccttcctcatcaactgattgacaagaaaggaaggcaatga

SEQ ID NO: 99835 - DNA, 149 bp, Glycine max
  Peptide Sequence Number=SeqID_216613
atctagttaatcctactggaattgaacgggttctcaccgagaaagaccttcttgctgactcatatttagaccaagaggcttctatccttgatgagaaagaatttctcctgttaaaggtcagggaacaaacagtgtggccttatccataa

SEQ ID NO: 99836 - DNA, 234 bp, Glycine max
  Peptide Sequence Number=SeqID_216614
atgggtattgggttcgcttcagtatatcctgatgagatgagcattcctcatccttcagataatcgagttaatatcagagtgcagacaacaggggatccagcaagagaagtgttgaaagatggatgccaggatctgatgctaatgtgccagcatgttaggagcacttttgataatgctatgactgattttaaaaggacccaaactaatactgaacaggaaatggataccaaataa

SEQ ID NO: 99837 - DNA, 351 bp, Glycine max
  Peptide Sequence Number=SeqID_216615
atggctgaagatgatgagaagaaaggagatgagggggttccgcaaatactgaccccctatgcattgacttcgaatgacaatccgggtaatataattacccaagttcagttgaaaggtgagaactatgatgaatgggtgcgtgttatgcgtactgcattacgagccaagaagaaatatggcttcgtcgatggatccattaaacaaccaggggacgattcaccagagcttgaagattggtggaatgtcaattcaatgcttgtctcacgggtgtttaacaccattgaacctgcacttcgatcaaccatatcttatatggagaacctgaaggatctctggaaagatatcaaatag

SEQ ID NO: 99838 - DNA, 252 bp, Glycine max
  Peptide Sequence Number=SeqID_216616
atgattgatggaattaaaaaggtggtggaagtgaatgatgataaagaaacatgggacacaacaaaagaaacaacagtgagagaagtagtgaataatgtgaatgagaacatgaagaaagatgaagagcaagtttgcacgcaaggtagtagtggagggtgcttttcctggataaggaagaaatttagtcaaagagagaaagaaagacaacaaagaagggataacatgtttttcactcacttcaaagtttgctag

SEQ ID NO: 99839 - DNA, 498 bp, Glycine max
  Peptide Sequence Number=SeqID_216617
atgggacccacatacagtgatatggggtgcaaactagcccttgaagacaaaaaaagagtcgcatttaggaggaggcataggcatgaacatgttgatgcaacaaggcatgccaaaccttgcaattgttcaagtttggcctctcagcaacaaaaagcctgtgtctgttgtttcatcaagctaccatgcagaatctgtcatcaagcactgaggtgtgcccagaaatgggcatgttatggatcaaagaataatagggctgggtttgtgaattccttggcttttgcaaaatcaggagaattcttagttgctggagttggacatgtgaaaattttctcaaactgtgtcctgcttaccgttgtcctcaaagttggtatgtcatgtcaagggtgtgctggagcagtaaacaggattttgggaaaaatggaaggtatttttattcctgcaagctatctctactatcagatccaaaatgaaaatgatctagtaattgtagcaatgtag

SEQ ID NO: 99840 - DNA, 414 bp, Glycine max
  Peptide Sequence Number=SeqID_216618
atggatgccacctccactcttccgacactggcatcaccgacattgctttgcactcctccgggatcaagtcagaaaaaggaatatacaccagacatatctggactttgtgcaatgtcgcgctgctttccatttccaccaccaggatatacaaacaagggatatgaaaaagaaggctacaacagaggacgtggaattactgacaaagcattggcggagaaagttagattggtgctcaatgagtatccacaactcaagctaacccaagggagaaaagtgctagagatatgtctaaccattaaatgggacaatggcaaggctcttgaatttttgttagaatcattggggtacgagaattcgaatgatgtatttccaatctatattggtgatgatcgaactgatgaggatgcttttagg

SEQ ID NO: 99841 - DNA, 213 bp, Glycine max
  Peptide Sequence Number=SeqID_216619
atggttgtggaggaagccaagagcactatggggacaaatgcagaagaagaaaagatggtaatagtaaggtttggggacttgcaaataatgagaagagtgaggactgggaagagattattaatgaagaagaagcaaatggttgcggctgcagaggctgagaagtctcttccggtgtctccggcgggtggtcctcagcctctacccttgttatga

SEQ ID NO: 99842 - DNA, 165 bp, Glycine max
  Peptide Sequence Number=SeqID_216620
atgacgacagagatggaggctatttccattcaggctgtgtcccagaggatgtttctgatcttggattctcatggagatttacatttgctatccctgtcaaattctggcataggagtagatatcactggtaatgtcaggcaactacctcgtattatgaaagtgtga

SEQ ID NO: 99843 - DNA, 288 bp, Glycine max
  Peptide Sequence Number=SeqID_216621
atggtggttatggcatctcgattgggcttgcgcctgctcttttgcgcgccagacttggctaaacagcgcacttctcaggcgcgtggcacaccgtcttgggctgcgcttctactgcaggagtcggccctcttgtgcgagcataactcaagagttttgcctcaaatggagcatccttgcggacacaccattggagcttgctctctcttcctagcaatattccccgatttcaccaagatccttgagttgtcttcaaaatattggtttgaagcttccaaatgtggttcttaa

SEQ ID NO: 99844 - DNA, 774 bp, Glycine max
  Peptide Sequence Number=SeqID_216622
atggcctcaactgtagaggtgcaatcatcttatagtgccaagaaacaagatgattcagatttcaatttgacagaatgggcagtgaaagatagaatcagtagagagaacagcaactccagaaggtactcatcatcatatataagaagctttagagaagacacaaggtcttttagatcaaacgttaccatttctagcgttgcttcttcacctggataccctttaaaagatgaaatagacccttcaacctattctttcaccactgctcttaaagcattgcaagcaaggtcagcctatagaagttgggagtgcctatccccagaagggtttgccttgaattcaaagtggaatgaagcagaaaaatatatatgcaaccccttttcaggagaggtaccaatggagtgtttatctgccaaaactcttagtggaagatcatttagaaactcaacaacaaacagaattaccatgtctgcccctcttgtgtattcctcaagatatatgcaaacaaagccatcatcaacttgcaacagttgcacacaagaagaagaagtagctcttcaatttcacatttcagaaaagggaaaagagggaatgacaagagatgcaggtactcaaagtacacctccttctcttgtttcaagcaaccccagcactgatttaactccatccatcataaagagcccaataaagctttctgaagactcactaaattcaaatacaaaagctataactgaggaagagggtattgctaaccaatgtcctaaaggcatttgttaa

SEQ ID NO: 99845 - DNA, 503 bp, Glycine max
  Peptide Sequence Number=SeqID_216623
atggacagcacagtgcccaaaatcgcaaaccaaacagtaattaaagaaggcccaagacggtgtgccacgcgcctgagaagtgcgctgtttagccaagtctggcgcgcaaaagagcaggcgcaagcccaatcgagatgccataaccaccatcatgtagatcggtggacaatgatgctgatggtggggtcacctgccaaaaaggtcgtcaaagctctggcaaaaaatggcggcggctgccagaaaaggggcagcaagcagaaagatcaactggaatgcagaaaaaggtcgtcagaagaagagcggagcaaaagggctcaccggtggcaatggatcgctggaaaagtgacggtgcccgatagtggctggaattgtcactggaaaaggagaaagggtcgtcaaaaagcagaagcaagttgtcgaaataagtgtgatgaccagaaaggtccaccgggaacctatatgggacggttttcgttattccctcaacctgactctgataccat

SEQ ID NO: 99846 - DNA, 592 bp, Glycine max
  Peptide Sequence Number=SeqID_216624
tgttaccattcctcacaaggaggcagcaattaagtgttgtgatgaggttgatccagtggctaagtcaataggagctgtgaattgcattgtaagaagaccaactgacgggaaattgattgggtataacacagattatgttggtgctgttactgcaattgaggatgggttacgaggtaagcataatggtagtagcacaactatttcgccattagccagtaagttgtttgttgttattggggctgatgttgctgggaaggcacttgcctatggtgcaaaagcaaaaggagcaagggttgtgattgcaaaccgtacctttgagaacttgctgatgcaaattggaggagatgctttagccctttctgatttagataattaccatccggaggatggtatgattcttacaaatacaacatcaattggaatgcaaccaaaagttgatgagaagcctgtttctaagcatgctttgaaatattactccctagtttttgatgctgtcaatacgcccaagattactagactcttgaaagaagcggaagaatctggagccactattgtaacaggattggagatgtttatggggcggacaatatga

SEQ ID NO: 99847 - DNA, 288 bp, Glycine max
  Peptide Sequence Number=SeqID_216625
atggggactatgaatttgttgggccacgggggtgcaaggcccattaaggttatgagtctgtttatcagagaattcaaaaggtggggtgtgtggaccgttggggtgagaaatactcgttgttttttggccagagctggggttatctccctcctcaaagggaccatctgcaggcgctttgggggaagagctggccatgctttatccagccttggatggccattttacagtgttttccagccaaggccagcacttcagtttgcggcccctgttctaacatttctctgctag

SEQ ID NO: 99848 - DNA, 774 bp, Glycine max
  Peptide Sequence Number=SeqID_216626
atgttgcacaagatattgaatgaagaagttgattcccatgcttctcaacaagacaaaaataacatggagggaagtgggtcaaaattcagtgaagcaaaggctagttcttgggcaagaaaggtggaactacccagctttgatagaagtatacaagggggaactgatttgaagggtagcagttttgagtgtgacagtgacccattgcagttcttgaaattagaaaacagaagtaaagaaggttcagtaatcaataaccacaccctttgtggtggagaagaaaccaaaaatgatgaagcaaagttagcaagagaaaacaagattgaaaaggttatggaggaagaagttgatccatcgataaagaaggagaagcacaaggaaaatggagtgacaaataagggctgcgaagatgattttattgataacacaattacaaatttgatcaagaaggaagtcaaagttggtgattcaaccaagccacattgttttcaaaatttagatttccataaaaagattgttatggagaaacaaaaatcattcatgaaggtggttggaacaacaatggtgttggaatcttggaatgtcaacttgttgggtaagcctttagcattaaattttgttgcatctatggctgatagcttagccatggtgctaaggcagaaggaatgtattgagtcagtcaagctgattgaagttatatggagtccacctttgtccctcccaccatcgaagccactggacctctgtttgcatgcaggggtagtgggtcattcctag

SEQ ID NO: 99849 - DNA, 777 bp, Glycine max
  Peptide Sequence Number=SeqID_216627
atggttgttgtccaaggctccaaggtccatctcccacacccttcctccctctctccctctccccaccctctcccaacaacctccatcctctttgaaccctcctccctttctcttgccctcacccactctgactcctccctctctctctacccttccttctccccccaaaccctaaccctagccctaaccatcccctcctcttccaaaaccacccataccctacctgctcttcctcctctagccggcatcctccttcgcctctaccgccgtcgtcgcgaaaccccttccttcgcccgtgtcactgacgtccgctgctcccataaagacctcctccgctttgaacctaaccttggcgtcgtgctcgacgccaagcatggcgccgcggttaggctcgccggctcggtaaattacttcgcgctccacgccccctcaagtaacaaggtttgggtctttgccgtgaaagacgacggcgacggtggtggcgacggcaatgacggtgacggtggtgtgagattgatgaggtgtgcggtgattgagtgttcaaggccggtgttttccgtgagcgttgcgtttgggtttctgattctcggtgaggagaatggggttagggtttttggattgaggaggctcgtgaagggaaggagcgggaagagggttgggaattcgaaaccgctgaagaatggtggtcgaggaggcggtttggaggcggtgaactgcaatggtgatttggaagggaagatggaaagacatggtggtgttactactgctggtaggtga

SEQ ID NO: 99850 - DNA, 183 bp, Glycine max
  Peptide Sequence Number=SeqID_216628
atgcccctactttcgtctccaccactatctcattacacagtcgaaatcatcacctcgcctgatgacgacaattatctcatcgcaaccgctgacaataacacattgatgaggacaaagaagaagactgacaatgtccgattttggataaggaaagttaaacaattacgaaagaaccaaaactga

SEQ ID NO: 99851 - DNA, 471 bp, Glycine max
  Peptide Sequence Number=SeqID_216629
atggctaagttctttgctgctatgatcttggcactcattgccatttccatgcttcaaacagtggttatggctgctaatgagcaaggaggccacttgtatgacaacaagaatgaaaaatggggttttgggattttgatttctaaggggtcaactagtgctgatttaagcttcttaattgtgtttttcttcagagcaaatatggaagtgggagtgtcaagagataccaatgcccatcacaatgctcgaggagatgtagccagacccaataccacaagccctgcatgtttttctgtcagaagtgctgcaggaaatgcctgtgtgtgcccccggggtattatggtaataaagctgtgtgcccttgctacaacaactggaagaccaaggaaggaggacccaagtgcccttgaacttcaacttcatcaaattgttgcttttcactatatttttatcatctcccttgggccaatttaa

SEQ ID NO: 99852 - DNA, 4422 bp, Glycine max
  Peptide Sequence Number=SeqID_216630
atggcactccagaacttcgctgatttttctacaaactctgcgaatccatactatctgcatccgaatgagaatccaactctagttcttgtttctccttctttaacggccaagaactaccacacttggtcccgttcgatgcacatcgcgttaatttcgaagaacaaagacaagttcatcgatggatctcttcccaaacctcccgtttccgatccgttatatgcaccgtggatccgctgcaacactatggttctcgcttggattcaccgatcaatttctgattccatcgcaaaatcggtactttggatcgataccgctgctggtgtttggaagaatctacgtattaggttttctcagagtgatatcttccgcatttccgatctacaagaggatctgtatcgtttccgtcaaggaacgcttgatgtatctgattacttcactcaattgaagatctactgggacgaattggagaattatcgtccaatccctcactataagtgctcaattccctgttcttgtggtggaattgattctgttagggtttatcgcgaacaagattacgttgttcgctttcttaaaggcttgaatgaccggttttcgcattctaaatcacaaatcatgatgatgaatcctctcccggacattgatcacgttttctccctggttattcaacaagaacgtgaaatgctaggctctaattctgattcagtctctgaagctacttctgactctgctatggctatgcaagtcaattccaatcagagcaatttcaatggtaaagggggatattacaacaaaggcaagggctcttctaaaggtggtaatcgagtttgcactcactgtggcaaaacaaatcacatcgtcgacaattgttttgagaagattggctaccctcccggatacaagaccaataagtccaagaattcatcatcatcatctcaggccaacaatacctcaaatgcttctgctctggaatcaacccaacaaggttcctctgcacagtccagttttcagtttacacaagagatgtaccaaggcattcttgaagctcttcaacagtcaaaagttggttctcaaccaaaggccaattcagtaaccacatctccctttgctttgcattccccttcctccaatccgaatggtaagaatccttctctttggatactagataccggtgctactgatcatattacttttgatctttcctctcttaccacttatcaaaacattgtccctgtccctgtttctttacccaatggatcacaggttctagcttccatctctggtagtgtagttatctcacctttaattactatccatcatgttctttacattccttgctttcatgtcaatttgatgtctgtcacaaagttagctagtacaaataattgccatttaagtttcactactgatttgtgcaagattttgcagaatcattctctggaaacgattggtacagctaagcttcaaagaggattgtatgtgatagatactgctgatatgattcgttcttgtaattcaatttcttctcattcttttgagctttggcattccagattaggacatgtatcaaattctggtatgcaagctatttctaaacaatttcctttcataccttgtaagaacaacatgtcaccttgtgacagctgtcatttttctaaacaaaagaggcttccttttcctaatagcattactacttctttatctccttttgaactattgcatgctgatgtttggggtccatattccaccatttcccttctaggacataaatattttctcaccttagtagatgattattccagatttacctgggtcatttttctcaaaaataaaagtgaaactaaaaaccacattattaactttgttgcttatctagaaaatcaattcaacacatccttaaaatgtcttagatctgacaatgggactgaatttgccttaaatgatttctttctatctaaggggattatccatcaaaaatcatgtgttgagacccctcaacagaatggtgtagttgaacgtaaacaccagcatattttgaatgtggctaggtccttcttttttcattccaatgttcctctcactatgtggaatttttgtgttcaacatgctgtccatgttataaacagaattcctagtcccttacttaagtctaaatccccttatgaactgttattcaaattaccacctacccttctccaccttaaagtctttggttgtttgtcctatgccactactatacaagcacatcgtaccaaatttgactctagagccagaaaatgtgttttcattggttacaaagatggtactaaaggctacatactttatgaccttcactcacacaatattttcctctcacgcaatgttattttctatgagcattgtttgcctttcaaaactgttcctggacccactccctcaaatactccatctaattttccactttatgatgatcctttggacatctcacctcatccttgtgtggactcctctcctttatccaccggtttgatagacagtacaagcaccagccctgcatccattccacccatagatcacactttggactctagttccttacctacccctgctgctacagctcatcctactcatcctacttctgatcttgatcaaaattcaatagatcaaacatcatcccacattactaatgttcctgttactttagagccacccttacccttatctaccagagtgtcaactcgtccaaaacgacctcctggttatttacaggactatcactgcaatgtcatatctagctgtaccaatcagttttcaagtaatgttgcttaccccctttcttctgttttatcttataataattgttctcctgattacaaaatattttgttgctctatttcttccaccattgagcccaaaacctataaccaagcttccaaatttgactattggaagaaggccatggatgctgagattacagctcttgaggtaaataaaacttggactgttgtggatcttccttgtggaaaggttccagtaggttgcaaatgggtatataaaatcaagtaccatgccaatggcacaatagaaaggtacaaggccaggcttgtggccaaaggttacactcagatggagggtgttgactattttgacactttttccccagtagccaagatgactacagtacgtgttttactagctgttgctgctgttaggggttggcatcttgaacaactggatgtcaacaatgctttcttgcatggtgacttgaatgaggaggtttatatgtctcttcctcctggttatgatgcttcttccccttccaaggtatgcaaattgaacaagtccttatatgggttgaagcaagctagccgtcaatggtattccaaactctctactgctcttacttctttgggctatcaagtctctcaagcagatcattccctttatgtcaggtctgatggcacttcctttacagctctattagtctatgttgatgacattgtgttagcaggcacttccatggaagagataaagtctgtcaaactattccttgatcaacaatttaagatcaaagaccttggtcaacttcgattctttcttggcctggaaattgcaaggtcatcttctggtattttcctaaatcaaagaaagtacactcttgagctacttgaagatactggatttttgggttccaaaccggcttcagtacctcttgatcctcacaccaaattatctgccactgatggtgttccctttgatgatccctctggctatagaagactcattggcaggcttctttatttgactcacacaaggccagacatctctttctctgttcaacaccttagtcaatatgtttcaaatcccttagtgcctcattatcaagctgctacaagaattctaaggtacctaaaatcttgtcctgccaagggaattctattctctagtcacagcccacttcaactccatggttttgctgactccgattgggcttgttgtcctaatactaggcgatccatcaccggctactgtgttttacttggtagctctctcatttcctggaaatctaagaaacaaaacactgtttctcgttcatctactgagacagagtatcgtgcgttggcctcattaacatgtgagttacagtggttacaatacttgttccaagatcttaacattacctttccccaatcagcttcagtttattgtgacaacaaatctgccatatatcttgcccacaatccaacattccatgaacgcagcaagcatattgaactggactgccacatcattcgagaaaaactgcagtcaaaactgatccacctcctcccagttccttcgcagtcacaactggctgatgtgtttactaaaccccttcattctccctctttttcctccatgatgtccaagttgggattgtgcagcatacaccatccaacttga

SEQ ID NO: 99853 - DNA, 1008 bp, Glycine max
  Peptide Sequence Number=SeqID_216631
atggcgcatttagatgtggatgggagaatgacatcttcaggaacttttactgtcctatcatacaatgtattgtctgaagcatatgcctcaaatgatctatacaattactgcccttcatgggctctttcttggccatatcgcaggcaaaatttgttacgggaaattattggttatcgcccagacattatttgtcttcaggaggtgtacagtggcaacacaaatacaattgatgggtgtgcaacatttttccgtagagacagattttcacatgttaagaaatacgaggttgaatttaacaaggctgcacagtctttgacggaggctacaattccaaccactcagaagaaaactgccttgaatcggctggataatgttgcactaatagtggttctagaagcaaaagttaacaatcagccatttgataatgctgggaaaagacagcttctttgtgtggcaaatacacatgtaaatgtctcccaagatctaaaggatgtgaaactctggcaggttcatactctcttaaaaggtttggaaaaaatagctgcaagtgcagacattccgatgttggtttgtggagattttaattcagttccgggaagtgctcctcatgcacttcttgcaatggggaaggtagatccttcacatcctgatttagcagttgacccgcttaacattctacgtcctcacagcaagttggttcatcagttaccactggttagtgcatacacatcttttgcaagaacagttggccttggatatgagcagcataaaaggagactggatggtggaacgaatgaacctttattcacaaatgtcactagagattttattggcactctagattacatattttacacagcggattcattggttgtggagtcattattggagttgctggatgaggagagtttgaggaaggacacagcacttccttcacctgaatggtcctcagatcacattgctctcttagctgagtttcgctgctgcaagaataaatctaggcgttga

SEQ ID NO: 99854 - DNA, 1071 bp, Glycine max
  Peptide Sequence Number=SeqID_216632
atgaggaaacatttgaaacggtacctggtttccgatcgaaagcagaagcagaagcaggaacctgagttgacgcgaatggagggagaatcgaaggaagatgtttggtgcagagaaacagtgccaaaggtattgaaacttgtctgttccacattacctctgtctctgtctcacacaaacctcgtttctctccttctggtctctccctcccttcatcgcacccttctctgttctcaacccctttggcagtcactcaattttcgcgagttaaacaatgctgggaatcgccttatagctgctctttctctgcctatgtttgattatgttgctgaattttactcttttttttttgaattacctaatggtgcacctagatattgcaatgtgaagcagattaaccttgagtttgcgagagatgttgaagacgcacatctgattctcattatggataagtgttttaattctcttcaaagcttggagtctttaaatctgaatggctgccaaaaaatatcggatacaggaattgaagctataaccagttgttgcccccagctgaaaagcttttcgatctactggaatgtcagggtaacagacagaggactacaacatatagtgaagaactgcaaacacataattgacttgaacataagtggatgtaagaatatttcagaccaaggtgcacaacttgttgctgataattatccagaactagagtcactaaatttgactaggtgcatcaaattaacagatgatgggttgaagagtttattgcacaaatgtctatttcttcagagtttgaatctctatgcactgtcaagagcattactcctattcagtttcacagatgaagcttacaggaaaatatgccttctagcacgtctcaagtttttggatctttgtggtgcccagaatctttcagatgaagcactctcctgtatttctaaatgcaagaaccttgaatctctcaatttgacatggtgtgtacgtgtgactgatgaaggggtcatatccattgcaaagggttgcacctctcttgaatttctaaggtatcagaagtttgtagctcttacataa

SEQ ID NO: 99855 - DNA, 861 bp, Glycine max
  Peptide Sequence Number=SeqID_216633
atgcctgcggtggttacctacaaagaatgcctcaaaaaccacgccgccaacttgggtggcctcgctctagacggctgcggcgagttcatgccctctccgaccgccaccgccgccgaccccagctccataaaatgcgccgcctgcggctgccaccgcaacttccaccgccgcgagccggaggacccccccatcacctccaacaccacgcacgtcatcgagtaccagccccaccaccgccaccaccctcctccgccgcttcacgcggcggcggcagcacgcagccccaattccgcttccccgccgccgatctcctcctcttactatccctccgcgccgcacatgctcctcgccctctccgccgggctagcggctccgccggagagcaccgcagcgccttccgccgcgctcagcagaaagcgtttccgaacgaagttcagtcaggagcagaaggagaagatgcacaagttcgcggagaaagtggggtggaagattcagaagcgggacgaggatttgattcacgagttctgcaacgaggttggggtcgatagaagcgttctcaaggtttggatgcataacaacaaaaacaccttcgccaaaaaagataacaatattgttattagtaatgatattaatattactactagtaataatattaataccagtattattgatgataatgatgcaaatgggggtgatgtcaaggtttttgaaaaccctaacaacaaccatggtagtggtagtggtggtggtgaagatcctgctgaagatccgagtcgtaatcactatggtggggtgaatgttggtgctaacggtttttatattgtgaatgagaccaagatgatggatgatctatcagcttaa

SEQ ID NO: 99856 - DNA, 411 bp, Glycine max
  Peptide Sequence Number=SeqID_216634
atgtgtgatgctagtcgttataaagttggtgcaatattgggtcaaagaaggaataaggtgttttatgccatatcctatgctagcaaggttttgagtgaaactcaactcaatcatgccaccacaaataaagggatgcttgccattgtctttgccttggataaattccattcatacttgattagtgccaaggatggcccatacttgttcatagttggtgttgacaatcttttcaagaggtgtgttactggggctgaggcaaaagatattttggggcattgtcacaactctccttatggtggtcactataatggagatagaactactgcaaaggttctccagttaggcttttgttgggctacttggttcaaggatgcacaaatcatgacaagagttaagataagtgtcagatga

SEQ ID NO: 99857 - DNA, 468 bp, Glycine max
  Peptide Sequence Number=SeqID_216635
atggttggggcaatacatcaagagagtcttgtacctctcccaagtttcgcacaatgtaaaaccctagctagccatcatcgtaacgtaatcgatccctctgactctcactctagaaccttcgactcgatccgaatccctagatcggattgcaaggctggcgggtattctggtcaaggttaccgcgctgtgacgattgttattgttttttccaagaagaagaagaagaagaagaagagtgtgaagaagcatgctgagcgtggtgcgcgtgcacctgccctcggaaattcccattgtaggctgcgagctcacgccacaaatgactgtggtaatagagagcctgaaaaccttgagattgcggaaaattacaaacaaatgagcatagagcccaaaaatcttgtcgtcatcgattcgcattttgtggtcgctgactattttttaaagccttgggtgtctatgttatatatataa

SEQ ID NO: 99858 - DNA, 1077 bp, Glycine max
  Peptide Sequence Number=SeqID_216636
atggagaaaaagaaaaagagagtgatagaggttgttggagtgagggctagagatatgagcactaaggaagaaaagttgaaagccaaaacccttatcactacgaagcttccttatccgaaaaatccaactaagaaggataaggagagacaatttgcatgtttccttgatatcttcaatatgtttatgatcaatatcccattctcagaagccttggagcagatgcctacatatgataaaatcatgaaggagatcctaacaaagaagaagaagtacattgcaaaggataccattaagctagagccaaagtgtagtgcactcgttcataaaatgttgcctgctaagcacaaggatcctggtagcttcgccattcctatcactattagaaatctctctattggtcaatcattgctttatttaggggcaagtatcaattggatgcccttatctatgttggaacaagttgacgttgttgaggtgaagccaacctgcatgacactgcatcttgcaggagaattcaagctcttcattcagaatgaggagattactttcaatttatttgatgctagggatcacccaaatgatatgagtggttgcttccaggtagatatgcttgatgagataaaagaagatgctagaatccatttgcatactcattcttctcttgatcgagtcttacttaatcaccatgagggactcaaagaggaggaaaaaaagggtggcatatttttttatcttaaaggcattgacccttcctattgtatgcatgacatccacctagagaaaaatgtcaagccacttgctcaacctcagaggtgcctaaatcctattatgaaagaagaggtgagagaggaagagttgaatcttttggaggctgggatgatctatcatatttctaatagtgcatgcatgagtccagaccaagtggttccaaagaaaggtggtatgaaagttgtgaggaatgacaataatgagcttgttcccataagaacactcactagttggcgaatatgcattgactacaagaggcttaaccaggctacacggaaggaccacttcccacttttgttcatgaactag

SEQ ID NO: 99859 - DNA, 509 bp, Glycine max
  Peptide Sequence Number=SeqID_216637
gggaacccattgagaatggtggttttaaggcaatcaaaagtggcaaaggaactaagtttatgaatgctaatgatttgtttgatgataggactagtgatgaggactttgttccaaattatgaagatgctagtgaggaagaatcactatatgctagtgacatagaaaaagaggctaaagataacaactatgtgtatcgggaggaattacttagtgggactgattcaaaggatgaggatgttaatgttctagtgtatgaaaagtccaatgggcctactatcagtaaggacttcaagtggagtattgggatgaagtttagttcatcaaaagagttcaaagaagcaatgtcgaagcattctgttctcaatggtagacaattgaagtttgagaaaaatgatgaagttagggggattgatggatgtcatttgaagaatcagtttggtggaataatgttagttgttgttgctagagatgctaatgaacaaaatctacctcttgctttgttgttgtag

SEQ ID NO: 99860 - DNA, 273 bp, Glycine max
  Peptide Sequence Number=SeqID_216638
atggagggagttgctacgtgcacccagcaaacagtgaagtggcgaaactgcccttcagcaattcttcttccggaagaagattcttccggaaactttccggaaaaattatttccggaacttttccggaagaaccttcttccggaagaagaatttgtgtcttccggaagtactcacagacaacttccggaagaacgtcatccggaatgttcccggaagaagcttcttccggaagatttccattgtcttccggaagaagcttctttcggaagttag

SEQ ID NO: 99861 - DNA, 369 bp, Glycine max
  Peptide Sequence Number=SeqID_216639
atggtgtggtgttgtagggcttccggtctcgacgatgcagagatgcgaagctacaacagagcgggaaaggaatatatgccagagaaaggaaagcaattattgctcatccttggcttggtcctggagtatagcaattattttaagtttattcatgtaataggatcttttttaggcaaagtagatgtactggttaccctatggaatcttgatatagagtcgtcaaaatggcccgattggcacggcctgacccaagctatgtgggccaagtgtcaaaaggcccacaggaccaaaaacaaccctcatcaaaaagcccacatggctaaaaagccccaaaagcccatagagctaggggtagcccgtgggccttga

SEQ ID NO: 99862 - DNA, 362 bp, Glycine max
  Peptide Sequence Number=SeqID_216640
caatatattccccatctggtgcatcctctggtgttggattttctattccagtggacactgtaaatggtattgttgaccagttggtgaagtttgggaagggtggagtgcttgtcttagatgctcctgccaatggtcctgctgggaaagcaggcttgcaatcaacaaagcgtgactcttatggtagactcattttaggtgacatcataacatctgtgaatgataagaaggttactaatggaagtgatttatacagaattcttgaccagtgtaaagtgggtgataaggtgattgtggaggtgttgagaggtgaccacaaggagaagatacccgtcattctggagccaaagcctgatgaatcatga

SEQ ID NO: 99863 - DNA, 620 bp, Glycine max
  Peptide Sequence Number=SeqID_216641
tgaaagatgaattaccaaaaagtgcatggctggtaagcaagatgggaaggttgactgctggggtgcagtatgagccacaacaaggaaatgcaaaactttcaaatttgatgaactggagttgtgccatgggctatggtgttggatcaggcagccccttgtgtccatccttcaatttcaaccttgagcttgtcaaaagctctcagtttattgcctcgttctatcaacatatggttgttcaaagacggatatatattcaaacttattgcagtagcaccaatatggtacaatctaatttttttttacgtgtcagtgttgatgacgccatagcagaaaacaatatgttagaccccacctttcgaataggggcatcctggcaggctaataaaaacttcttgctgaaggcaaaggttggacctcgtagctcatcaatggcattagcattcaagtcatggtggaaaccttctttcactttcagcatttcaggtggttctagaggaatttttctattcaatcttgcttcagttctgtataccccgttgcctattcctttttttagtgtgactgggacttttcttttcctttgtatgtgtattaggaggccaacacttatttggtcataa

SEQ ID NO: 99864 - DNA, 273 bp, Glycine max
  Peptide Sequence Number=SeqID_216642
atgaaggaaagatcggtaaaagagaaaattgtgggagagaaaaagagatggggaaaaaatgttgagaataaagagagacaatggggtgttgatgagagggaaaaagagaaggagtgtcaagggaggtgtggagagaaaaaaagaaggtttgccaaaagaaaaggacttatttttacagtaacccgcttgaataagggtacaagcaggttgatcatttcaacccactccttatcaatggcacttggtgctcacacagagtatatatcaaagtag

SEQ ID NO: 99865 - DNA, 307 bp, Glycine max
  Peptide Sequence Number=SeqID_216643
atggttgagggcactctgaaaatcttgacgttggacccaaaccttgatactgtgggaaattgtggacaaatgcggctggattttgcagatgagatcgtgcgcttactatcccaaatatggatttggggcttttggagtgtttcctctgctgttgaagaaaagcttgcgcatcatccatggattccaacatatggtgttgataaagttaatcaattctacagagaatcctcccaagattatggcttgatggggttgagatatggttctggaaatctatcctttggagtcacacttttgccttttgcca

SEQ ID NO: 99866 - DNA, 321 bp, Glycine max
  Peptide Sequence Number=SeqID_216644
atgtcaaaagaagaatcaaacaaagttgcttcaaaagataagcatggcttcaagattaatacaagattgcttcagcaaacaaagccttgcttcaagattaactcaagatcaagcctttccttaaaacaaagtgctttcaagacaccatcaaaggcaatttatctaggcggtttaacaatggaagtgcttcttagtccaatagctcttaaggtggttttcccttgcttcttgactcaaattcttcaagggatggcaccaatcctcctttccaattccctatatggaaactcacaaacaaggaaacaaagagacaagcaataa

SEQ ID NO: 99867 - DNA, 807 bp, Glycine max
  Peptide Sequence Number=SeqID_216645
atggacccagtcaagtacatatttgaaaagcccactctcattggacggattgctccgtggcagggagtcagagacaaacgctcctgggtgaggggccagtggatccctttcaatgaggatgccattaaccagtttctggggcatccattgatcttggaagagagccaacgttgtgagtacagccagaggaggagccaagcctcagcggggagacgggtgcggatcatgcgcacaagcatgaccaacctcacacagattaggatgacgttgctgcttagcaacattctccccaacgaccataacttagacctccccctgtcgaagtatcagctggtctacgccatcctgactcaggtgagtgtacatgttgcccagctgatctcagatgctatgtatcagtttgtagggatagcgcctcctagaaacccagtggacccggagaagtccaatagggccctggggtttcctgctttgatcacaggcctgtgccaattctatggagtgccggcaagcccagcagcaggaggagggccagcagcagccagctgtagatgtgccactaccgcctctacaggagacaccatccctggagtctatctccactcacctgcgaaggatagagctctagatgcacaggacaccagtcctttcctgtggcctacccctgagcagttcgaggccacgattgcctggcctggtgatgaacccaattttgagacaggagcaggacctgcaggggaacctggggacgatggaagagctcaggagaatgacgatattgtcgacgtgctggatttcttcacttga

SEQ ID NO: 99868 - DNA, 1125 bp, Glycine max
  Peptide Sequence Number=SeqID_216646
cgagtgaacatgggaacctccgcgaacgctgtcgcaggtggtcgtggcggcgcccctgtccccaaagacgtcgactacgccaattacttctgcacctacgctttcctctaccaccagaaggagatgctctccgaccgcgttcgcatggacgcttatttcaacgccatttttgaaaacaaacgccacttcgctggcaagaaatgttttcaagagcgtgaggcgagccctggcacaacgggtaaggctgcctacataccttcgctcagcgcagagcctctgggcaccggagtaggtgcgaggaaggtgtatgcagtggaagctaccaagatgtcggaacacgcacgtgcactcatcaaagcgaataatctccaggacgtagttgaggtcatcgagggatcgatggaggaagttaccttgccagagagagttgatgtgatcatctctgaatggatgggttattttcttctgcgtgaatctatgtttgattcagttatacatgctcgtgattgctggctcaaaccgacaggagtgatgcccacaacaagactagatgctgggtttggacctaaagaggcccaatatttggaaggtttatgtctatgtgcaagtgtgttctgggcttctgtgcaagtggctggatgctgtgtctctgtgcttgtgtttgtgcactgcatcattacatcattgtggaacagccttcatccccatcaagtcataggaactgctggtataataaaggaaattgattgtttaactgccactgtggctgacatagagaaagttagatcaaatttttctatgtcaataaccgtggaaaacacaaagttatgtggatttggagggtggtttgatgtacattttcggggaagaagtgaggatccagctgaacacgagattgagttaactacagctcccagtgtagattatggtacacactggggccaacaggttttcctcttgcatcctcccatgcgtctgaatgaaggtgatgatttaagggtttcttttctaatgagtcgctcaaaggaaaaccatcgtttgatggaggttgaacttggatgtgagattcatcagcattctggcaagatacttgcacctttcaaaaataagtactacattgagtag

SEQ ID NO: 99869 - DNA, 306 bp, Glycine max
  Peptide Sequence Number=SeqID_216647
atgggaacaaggtatggggataaatatgggtatgaatacgggaacaggacaggtaatgacatccacatctctggatacaagaacgggacagctaatgacatccacatctttgaatacaggaacaggacagttaatgacatccacatctctagatacaagaacgggacagctaatgatatccacatctttgaatacaggaacgggacagttaataacatccacatctctaaatactggaacgggacagctaatgacatccacatctctaaatacaagaacgggacagagagagaaagaggtgaataa

SEQ ID NO: 99870 - DNA, 567 bp, Glycine max
  Peptide Sequence Number=SeqID_216648
atgacactgctctcgccaagcacgtttttggcgcatctaaggttgcagctactgctaaggaacttgggagtagacattcaaattgattacacaaaggagaattttgaagagcttgcagagaagtctgatgtagtgtacagtagagttaagacatggttgattccaaaaagagggcagagtgacaaggcattgaaggctatcaaagaagagggggaaagttgtgacaatagcaccaccttcgattccacctgctatgccgttcattatcacttcagatggtgttgtgttggagaagttaaagccttacttagagagtgggaagtttcagatttgagtttgaatttggttaagattaggcctatgtcacattcactctacaagtctacatcaagaacaaaacaaaaacagaactacactcttaaggaagaaatcccaagagcatcagacatcaacaaagaacgtaacaaaattggacaagaagtcaaaatgtacataggttctgttgtagatgaacccttcttggaaagtcaatttgcacaccagttgacttctctgagaacatgctga

SEQ ID NO: 99871 - DNA, 756 bp, Glycine max
  Peptide Sequence Number=SeqID_216649
atggcaagcatttctagcattccatcacacataaaaacttgggtttattctgaatatgggaacacagaagagattctaaaatttgatcccaacgtacctataccagacatcaaggaagaccaggtgctcatcaaggttgtggctacagctcttaatcctgtggattataagagggctcttggctatttcaagaacactgactctcccttacctagtgttccggggtacgatgttgctggtgtggtggtaagagtgggaagtaaagtgaggaaattcaaggttggggatgaggtttatggtgatatcaatgagtatgctgtgaataatccaaagaccattgggactttggcagagtacactgctactgaagagaaattgttggctcacaaaccctccaatttgagctttattgaagctgctagccttcctttagctatcatcactgcttatcaaggacttgaaagagttgatttttctgctggaaaatctatacttgttctaggaggtgctggtggagttggatcccttgttattcagctcgccaagcacgtttttggcgcatccaaggttgcagctactgctagttccgcaaaactggatttattaaggaacttgggagcagactttcctattgattacacaaaggagaattttgaagagcttgcagagaagtttgatgtagtgtacgatacaataggtcagatgttgaaattgaacttaaattatttgtttcacatgaagtcagtttggtcatga

SEQ ID NO: 99872 - DNA, 309 bp, Glycine max
  Peptide Sequence Number=SeqID_216650
gaaattataaatgacgaagatggaaggctaaaaagattgaaaaaggaaatgggtgttggagcatataaagcggtcgtggcagctctgatagaaatgaatgaatacaatccaagtgggaggttcatggtaagagaattgtggaacaacgaagaagataggagagctacattggaagaaggaattgaattcgtgttaaatcaaacaaaaacaaaaagaaggaaaatacatcaaatggtggatgatgaatcaggtgagaatagtgaggaagtgtctagtgttcgaaggccctctgcaagaaaagatgtataa

SEQ ID NO: 99873 - DNA, 489 bp, Glycine max
  Peptide Sequence Number=SeqID_216651
atggatcaatatcacaatgaatctggtgtttatttccaaagttccactccaatacccattagagtacctaatgattatggttttgaaacactaaaaagcaaaatacacgatacccttcaactaacgaacgatcaatatttggatgaaatttactaccgacagtcattcgtggatataggtaaccaatttgccttttggtctatgcaattgaaaaatgatgatgatgttaatacaataacaccggatgatatattaaacttacttcaagccactatgactcctactcatgatgcactgttatattacaacgggaggtggaacatgtcatgccaagatgactttgtgggttactcattcacaggaaaaaatccaaaaagatttaacattccttcagaatgtagcatcgatggactcaaggatgtgatcaagcaagttgcacctcaagggatttccccttatggtattcatgaatcacaaacagtaaaatga

SEQ ID NO: 99874 - DNA, 648 bp, Glycine max
  Peptide Sequence Number=SeqID_216652
atggagaaccatattgatctagccttggtcaagaagttctactccaacctttatgaccctgaagaccgctcccccaggcagtgcaaaagcaaggttggtctatggcttggtcataaagatggatatggatttgggctctatgatctcaggatagatttctcagatagcccaatccaactcgtctcgattgggctttccggctcttatcaccgccctatgcttagccagagggggtcccgcaaggccaaggttcgggctccatcagcagatgcaccagtccctccacctccagcaccagctccagtaggtccttctatgtcatccaccgccaacaatgaccacatcatgcctatgctgcagagcatccaccatggcctctacctggcccaggcagctgagggcactccagaggacgaggaggctgctgaggacaccctagaggctcagaatacaactcaggaggctaaggaagacataggtgcagcggaggtagagacagatactaattatgtagctgatgtcaccgcagcacaagggactttggacccatggcccactgccatatatcctaatttcgttcggggaccattgtttggtggcatgaaaccttcgcttgaccgcctcgagatacttaacccccatcattag

SEQ ID NO: 99875 - DNA, 873 bp, Glycine max
  Peptide Sequence Number=SeqID_216653
atggaacataaggcatactgggctttaaaatttattgattttgatgaagttctatctggggagaagaggaagctacaactcttggagctacaagagatgaggcttaatgcatatgaatcttccaagttgtacaagcaaaaggtgaaggcctaccatgaaaagaagttgttgcagaagaattttcaaccaggccaacaagtcttgcttttcaattcaagactcaagctatttctagaggttaaccaccatcctgcaattgcaagacccctagagggtgtcatccgtcaagctagtgaagttaaagaagcgcttactgggaggaaacccagctttcttaccctttcagcctttatttttaataagacttggttaagatcaacatatccattcactaagcgcatcttgtgcgctaagcgagctaccctctatgcgttaaagtgctcactaagcgcgacactcgcgcttagcgagcaatttgtaactgcaaaaagaaaacataactgcaatagggtagttacttttgctcctcactataactatgcattttcttctcctctgcctctaatcatccacatttcactcatactcaatcactatgcattccaacctcaagcttctaagcctgtatggtggcttaaggagttgaggctcacaagcctcacgttctgggtttgcgatgaacttgctaagcgaggttgtttcgctaacgagtcacactcgcttagccactggtctcttctagctaagcgagttagtggcgctaagccattgttactggaactgtgttgtcgcgctaagcacaccctacgcgctaagcgcctgatggtcactctgcaagattggctaagcgagccatgttcgcttagcgcctaa

SEQ ID NO: 99876 - DNA, 234 bp, Glycine max
  Peptide Sequence Number=SeqID_216654
atggctcttgatgcaatttgggacgactccgacgaggggcaggtggtggtggtgtctggcctccatttggtgcttgaccccccacgaatgttcaccccatggtatttgcaaaaagtcgtaatgagtgccgaaaatcccaaagtgagaatttggcccaagtcaatggacctgctctcgatgatggatggtaagccacttcctttttggtaccagatgcctgcatggtgggcttga

SEQ ID NO: 99877 - DNA, 159 bp, Glycine max
  Peptide Sequence Number=SeqID_216655
atgttcctttcagtgttgtggttcagtggaaagcaacggcagctcgtggtggccatcagtggaggaggaggaggtattagggtttggatctcgcttagcgagacgagctcgctaagtgagagtccacttttggcgctaagtgtgactttttacgcttag

SEQ ID NO: 99878 - DNA, 600 bp, Glycine max
  Peptide Sequence Number=SeqID_216656
atgtgggagtataggcctatttctctaattaggaatctctacaaaattatcactaaaatcttggcaaaaagcatgagcaaagtgttgagcagtgcgtttgatgctagaaaatcggctttcttaggtggaaggaatattttggatggggttgtgatagctaataaagttgttaaagaggccaaggctaagaaaaagtcatgttttgccttcaaagcaaattttgagaaggaatatgactcagtgaggctaaaagttaattttcataaaagtagcttggtaggtatccatgtggaccaaagagatatcaccaattatgctacaatgctttattgtagcactaggattatccctaaggtgagagatcggcatgagggagtacggaggtgggatttaaggtggagaggaaggtggttacaatgggaagactcagtggctcaacaattattacacaatgtcggagaagtctctcctttcgcaaacttgtgtgatggtttgacatggtggaggggtgcaaataaaaattatgtggtaagagaagtatatgaagtgatacataatatgggaaaccaagacctagaaagattttacaagaagctatga

SEQ ID NO: 99879 - DNA, 240 bp, Glycine max
  Peptide Sequence Number=SeqID_216657
atggatcagcagaggttgatatttgttggtaaacaacttgaggatggaagaacccttgttgattacaatattcagaacgagtccactctacatttggtgttgaggcttcgtggaggtatgcaaatatttgtgaagactctaatagggaagaccattaccttggaggtggaaagctgtgatactattgacaatgtgaaagctaagattcaggacaaggagggtatccctccagatcagtag

SEQ ID NO: 99880 - DNA, 267 bp, Glycine max
  Peptide Sequence Number=SeqID_216658
atgatggaaaggctcaaaagggtgggaacatataagccacaatcatatgaaattatcgataggtatcctaatgagtctagaaacttgactaaaaggaacactcgaaaggtgggagtaccggtggtgggagcagcaggtccacttcggcttcaagtacttcacggcgagaaacaaaacgtcagggtggtagcgggacggagttcacgacgggatgaagtagttcaggcaatagcgggggcgctaggtgtttaccgcgagactatataa

SEQ ID NO: 99881 - DNA, 414 bp, Glycine max
  Peptide Sequence Number=SeqID_216659
atgaatcagcaaaaaaaggggcagggtgtgtatttagtaaacaagggggtacaaatagcaatcaggcccacttggaccttcgccttctggtggaagcaacctagctcgcctgggcgagctggaaaatccaagccgaggcacttccataacgcttccgagacgtttccatgggcgatttcacgaaggttttccaccgttcttcatcgttcttcgttcattcttcatcattcttcggtcttcaatcgccgaattgagctgcttgacaccagttgccgggcaatccaaaaggtttttcaatgtttcggaaaagaatacgaaaatacccaaaagggagggcaaaagggtcatttggaagccttttctgtcccctggctcgcccagggtagcctctggctcgcctgggcccccaaatga

SEQ ID NO: 99882 - DNA, 246 bp, Glycine max
  Peptide Sequence Number=SeqID_216660
atggaagttgaggatggcaacgatacgatagagaacacagagagatggaggaagaagcttggatttgcggcgttgtacagacacccaatggtggtgggtgtacagcatcacccacctaatagccaaaataatgaaaatgatccacccaaaagctggtcagaaaagggagttaacttggaaacattttcaaatgttttaaggatgaggttgactgaaaagacatcaatgaaagcaaaagttgtttga

SEQ ID NO: 99883 - DNA, 390 bp, Glycine max
  Peptide Sequence Number=SeqID_216661
atgaccatatttgtctttgtgtgtcaacaggctcgcttgcctctggttgacgaaggggagactaaaaaattaacagaggactttgagtcctatgaagctgaggactttgagtcctctgaaggcgaggacattgagtactctaaaggcgaggaccttgagtcctctaaaggtaaagactttgagtcctatgaaggcgaggactttgagtcctctaaaggcaaggactctgagtcctataaaggcgaggactttgagtcctctaaaggcaaagactctgagtcctatgaaggtgaggactttgagctatctgaaggtgaggactttgagccctctgaaggaaaggactctgagtcctatgaaggcgaggaccttgagtcctctaaaggctag

SEQ ID NO: 99884 - DNA, 384 bp, Glycine max
  Peptide Sequence Number=SeqID_216662
atggctggctgtattgatacaagaagatctattactggttatgtcatatatcttggtaattctttgatttcatggaagtccaagaaacaggctactgtctctagtagctcctcagaagctgagtatcaagccttagctagtgctacttgtgagctacaatggctaactttcctgcttgaagagttcaaaatcctctttcaacaacctgttgttctgtattgcgataataagtttgctcatcatatagctgcaaatctcacttttcatgagagaacaaagcacattgagattgaatgtcatttggcatatacacttaaggctttgctacctggtgcttttcaatttttgtattccaagctaggaatgtccaatatccattcctag

SEQ ID NO: 99885 - DNA, 279 bp, Glycine max
  Peptide Sequence Number=SeqID_216663
atggcattcggagaccatcctggtcatcatttgcattttgaagatgagaatcttccgcttatgagtgcacagctctttcaagaatttagcatatcttggaatttgctttattgcatccagcagagggaatggaagagggatatgcagcttctctttagattcacctgcatagaaattgttaggaagatgttgctggttgaggtccttgacactactttcccgacctcaataggtcataattgttctgttgtggctgattttgttgctgaggttaaggag

SEQ ID NO: 99886 - DNA, 573 bp, Glycine max
  Peptide Sequence Number=SeqID_216664
atgccggagataggagtggacaaaaacagagctacaatcaagatgtatgtcaatgtcccaaaatttaagagagccaggtctgaaaagtcaatcccagaagcaaaacgaatggaacatggtgagcaagaggaacaggaggcaccttggcgacgacaaccatactcgccactgtatcaagggtcgtatgcggaggtagtgacgtggaataatagaaatccaggctcaaagagaacaccttggaagaagagtcagagaagtgaagcatcatggtcctcgatgtgtctcaacatacagaaaacaaggaacaagtggctcaatgaggcttgggtgggtagactaaaaaacctggcgttgtttgatagagttgaagacgacttacaatgggatattggagcttatgtatcaccaaagtatatgggggatgacatggtcttgctactaggcctcactaaggctaaagcacaacaaatgatggaggaagaaaaggaaggaggggacactttgttctacagcctggagaagtggaacctgagattacgcacagggcacaggatgacttgggtcacctgctag

SEQ ID NO: 99887 - DNA, 1299 bp, Glycine max
  Peptide Sequence Number=SeqID_216665
atggtggacgatgacgttgactttgtttggagattggatagggctcgggtcctcattaaaatgccgtggaggccatttctacagcacaccgtcaatgctcacatccaagggaaagagtatagtgtgcacgaactcgaatcaaaacaaagtgacgtcggaatgccgttcaaggaagtgggccgtaggtcagcggcagatgatgcgtcgcacttcgcggagggtgcgtcgcactacgcaatggatgtatggcaggtcacagtgacaaagcatatggcggagggtaggaggcatggagtgtcggaaggcgtcatgcagctcgcggcaatggggaaggatgtcgtgcagttcgtggccaaggggagtgggccacttgtcgcagtggctccggcaagcaacgaagcatgcacaagcaccaacaccgtgtcgtcgtcgggaacaatgaaccacggcataaatagtttacccaacggaccaaacgataatcaatttcagatgggtaatgacattacccactgtgtaagcagctcaacgaataccaagcagccaggggatagagatatccgtgcaatggctatttttgagagtcagcctaagttccatcacgtggtactagctggccgagatgcaaactttcacaaaaatggtgacatgcagagcacgggaaacttaatccctacagtgaggagtggattggcatgcgaaaaaggaaactgtggaggagaagtgcactgtggcttatcagaagtcagttgggaggcacaatctgcatcacactcagcgagtggaattctatgcctatggagtgaaaaatcattcaagttagaaaggaaattcattggatctggtttcataatgctggtagggaagtggcttcaggaggcacaacaaattcacatcatcaacatttactctccatgtgacattcagaacaagagagtcttatgggatagtgttaagcagttgaaaaaccaaactcaagagggactatggtgcatagtgggtgatttcaataacatcagaacaccgtcagaaagatctagaatatgtcaaagggggtcgggagaaagcaacaccagtgaattcaatgactggatagaagagctggaggttgtggaagtgccatgggtgggaaaaaaatttacatggttcagaccgaatagagctgctagaaacaagttggatagattcttggtctctccagaatggcttgataaatggcccggaagcacccaacatacattggacagaaacttctcagatcattgtccaatcctgcttagatctaaatttgtagattga

SEQ ID NO: 99888 - DNA, 369 bp, Glycine max
  Peptide Sequence Number=SeqID_216666
aaagttgtggctagatccagtacaaaagcagagtatagaagcctggctcctccttctgttgaagtggcttggattcagaccttgttgtttgaattacaagtcagacacactgcaccagtggtcttctgtgataacatgatcacagtggctctagctcaccacccagttctgcactccagaaccaaacatatggagctggagttgttttttgttagagaaaaggttatggagaagagtcttcaagtaattcatgttcctgctattgaccaatatgttgacatcctcaccaaatctttgtctccttccaactttactattttcaaagacaagcttagagttgttgacaaaactttggtcaacccctcatga

SEQ ID NO: 99889 - DNA, 600 bp, Glycine max
  Peptide Sequence Number=SeqID_216667
atgaaattagaggacattgaagagaatgtgagattgaagcagtcagaggcttcattggctggagaactatcagtcaatcccactcactggattactgagctagctccagaacctcgcgatgtgtactggcctttcttctctgaatcattcacgcgaagatggatttctaagttggtggttgtacttgtgtgtactactttcactgtggtgttccttatacctgtagtaattgtacaggggcttaccaaccttaatcaattggaaattttgtttcccttcttgacaagtataactataaaatttgtcagtcaaatagttacagggtaccttcccagtcttattcttcagttgtttctgaaattggtgcctcctgccatggagttcctttcctccattcaaggatacatctcacatagtgatatagaaatgagtgcatctagaaaagtgctgtggttcacagtatggcatgttttttttgcaactgtgctttctggctcaattctatctatgctgaatgccgtccttgatcccaagagcattcctgggaagctagcagttgcagttccagcacaggacactcgtggaaagaatatcttttga

SEQ ID NO: 99890 - DNA, 159 bp, Glycine max
  Peptide Sequence Number=SeqID_216668
atggggcatctagcttgggccgatgcatttgttgtcacaacagattcagttagcatgataagtgaagcttgcaacactggatgtttaggttcattgttaaaccatcaccaccataccgctaatcccgaagaatgcactgttcaagacgcacacatgtaa

SEQ ID NO: 99891 - DNA, 378 bp, Glycine max
  Peptide Sequence Number=SeqID_216669
atgggaagtgcaactaggtggagcacaagagtaatgtacaatgctgagttgctgaccaagtcaaatatttggctatctgcatcattttttattacctatgttgtcacgcaaggatggacaagtgtttcatcagaactcttccgtgtaattccttttattttcagttggataacgaggcctttcactagtcaagacgatgaatttgaagttccatctactccataccacaaggatattccaagggtccttttctttggacttcttggtattacatatttcttcctagctccattaattttgccgttcctattggcctacttttgtcttgcttacatcatttttcgaaaccaggtcagcatttttttggatgttatttga

SEQ ID NO: 99892 - DNA, 549 bp, Glycine max
  Peptide Sequence Number=SeqID_216670
atgagtgaagagagcgagaaagagacgaatccgtcgtcggcgacggcggcgccgtgtccgacggcgagtcagcgggaccagtggatggtagagtcgcaggtgtttcagatttaccaactcttcgccaccattcctcgcaacgcccaaaacctcatgttggagcttcaacgcgataatcacgtctccaaagatctccgccatctcaattccgcattttccgtcttggacgctaagtcagttgtcatgcaacttgccattgtaggcatgaagcataccccattgtcgagaggctcttcgctatgcgaaggtatgagggaggaatattgtacgcagccttacccttacatatgcaaagaggttgtttccggattcaaacccatgaccaacaagtcaccaaggcacaactttaccgctgcaccaggctcgccctcagctgattttaaaaatattgcttataaatttgttaatgagtggagagcacaagaaccacgttttcacagtattgctttacaacaatatattctcttatgtgcacagatggatgactag

SEQ ID NO: 99893 - DNA, 363 bp, Glycine max
  Peptide Sequence Number=SeqID_216671
atgggtcaaaacacaaaaacatcaagaacactcaagtttatcaagcaattctcatcagaacatcaattggctcacgtgtgtattccaacggtgatagcggcatctctagcaatttcctgtgatttctcaaacttttcctttgattgctctgatagagtttccaaacgtcaaagagaaggagaagagattgaagcctccatttgtactgtattcaaaaagctacgatgcgaagtgtatttctctcaactccaacatgatttcaaaattcccaacggtgagaatgctcggaattgggttacgaacctggtgcttaaatttcatgacgatccaacggtgaatgagttgaaattgtcgtttttctaa

SEQ ID NO: 99894 - DNA, 714 bp, Glycine max
  Peptide Sequence Number=SeqID_216672
atggagtgtataaagaaagaacatgggctgattgcaaaagaactgaaagaaagtaaggtcctaaatgctattcagcacaagaaaattactgcagagaatccagagaaacaaaggcaaattttggcccttcaggaagctatgaagctgcaagaaggtaataataataataataataatgttttcaaattgacggaagagttaaagctggaattggaggataagcatcttaaagggaagttagatgtgatgaagcacacggaagatgaatgtatgaaaacagtgggtactttacatatgaaagaaattgaaaaggaagggttacttaaagacttggaagagttcaaccaatcactaatcattaagcagcatgagagcaatgatgagcttcagaaaactcgaaagaaattgattgaaagcattgcggggatgtcaagtcatcatggtaatataggtgtgaagagaatgggggaaatagacattgaaccagttcataaagcattgagtgcaaagagaagatataacaataaagcggaagcagagcatagagctttagcaatgtgttcattatggcaaaaggatctggaggaacctaattggcatcccttcaaaataatcacagctgatgggaaatcaaaggaaagtatggatgaggaagatgaaaagctgaaaggactaaaaagaaattgggtgttggagcgtacaatgcagtggtga

SEQ ID NO: 99895 - DNA, 285 bp, Glycine max
  Peptide Sequence Number=SeqID_216673
atggagttcaaatgccgtgttggacaaaaccaagaaacaccttcaccaacactgtgccttcttcccactgttgcctatgagaactcaaacgtctctggacactcattacaagttttcccaaggccaatgtcaactaatgccaatgaagcatttcgccaagggctaaagaaagagaaaatcaagagagaaataatggccaacgagataacattggcccgagaacaagagatagagaaggaagttaggatgaaaaagatgttagagaaagcattggaaatatactga

SEQ ID NO: 99896 - DNA, 744 bp, Glycine max
  Peptide Sequence Number=SeqID_216674
atgagagagaaaaatgaacgtcggggtctctgggtcttcaccggtgagcttcacttcaacgatcttggtgctgatgcaggcataaacggagaggttgagggagctatcgtgggcccaagagatggagaggggacgaatcaaaggggtgaggccatggtggagaaggccctaaatccaggcccaaaccaagacgtagttctgcttctcagttctctcgaatcaatccggaatcccaaacccctaatccctaatcaatcgcaagttcgaatccctaatttcaacctgttcttcctcaacgtgcgtcgtgagcgagttaaggttaagggcatgcttgatgcagggaaagacaaagcgattatggacggttcacgacggctactaggacagtctgtaggggttttcaatgaagggatttgtttagttttatctcgctggtcggctcttcgatcggctgttgagaatgaatggggcggccgtgagtcccgccttaaagccgatcaacttgccggtgacattcttacctggttcactcaatccaaagagccactttatattgatgacttagaagacatactggatcaaggtatgctttctctcaatgtagaggtcgaggatggcagcgttgaagaggtagctgaaaaactaatggttatgcatgaagaattcttagaaggtaattttagttcttttgaagatctcaggaaagccaatcttgagcaagctactcttcctcatgtaacacag

SEQ ID NO: 99897 - DNA, 359 bp, Glycine max
  Peptide Sequence Number=SeqID_216675
atgaaccatttgttcaagtaaaaaggtcttttgctattggtgttggtgcgattatcttgtttggttaccgtaaggatgatgatggtcagtgggttcgaaaacaagacttacctcagccaatccctgacgaacgtactctttctcctccaccgcaaagggttgattcctcttcacttctgaacgatgttctctctgaactccacagtcttcgagcttttgtgggtgaccgatttgatgctatggatactcccctggatgccatggatgctcacttcgatgggatggatacgaggattactcgacttgaggacgatatgagcttcattaggcgttgcttcgatccaccagccaacccttag

SEQ ID NO: 99898 - DNA, 297 bp, Glycine max
  Peptide Sequence Number=SeqID_216676
atgcatcttgtgagtagtgatgtagataagtctgatgaaagttgtatatgcatttccccctttttacatatgacccaaattgtaaacgaagacgattcagatgaagatggtgatcatgatgaaaaaatgattgtggatgataattcttcaaacatgaatccggagatttcaacatctgattcaaacatgaattcagtgaacaggccagtaaatgagcctctaccaaaggtttcaggcaaagcagatgatggatgggttgtagtttcaaacaaaagaaataagggaagaaaaaattag

SEQ ID NO: 99899 - DNA, 453 bp, Glycine max
  Peptide Sequence Number=SeqID_216677
atgagtcacggagggatgttttgggctctatcactagtgcaagtgattctcatcgcatattggaactgggaatgtgtatttgcacatctttgtgaggttttaatgggatgcttaggggctttagatggatcttacatagcagtcacgccaagtgctaatgataggcttagataccgtacaaggaaaggcggacttgcaaaaaatgtcttaggttcttgtatcagggatatgagatttatatacgtactagcagggtgggaaggatcagctttagactctagaatattatgcaatgcgataatcagacaaaacagattgaagtggagcagtgggagcagcggtcgacgtgcacctcaaaatcgtgaagagttatttaattataggcatgctcgagcaagaaatagagagatgttttggcctcttgaagaaacgatgggctatactgagacgtaa

SEQ ID NO: 99900 - DNA, 183 bp, Glycine max
  Peptide Sequence Number=SeqID_216678
atgggtgcttattgcaacggagacgtttcgttgccaccatcctacgacgtcgcttcaggagaagatcccaggcttcgcgagttgaaacaactaggtgagttaattccacgtttcttgaatccaattaataagagaaagtggtttagaagctactttgaaattcaatacacttgcattgcataa

SEQ ID NO: 99901 - DNA, 465 bp, Glycine max
  Peptide Sequence Number=SeqID_216679
atggaagatgacgaagatgctgaaattctgtacaaggtagatacactacaaaaggatttaagagacaaggagcagtcacttcaagacttagatgcattgaaccaaacactaatcattaaagagcgcgagagtaatgatgagctgcaggaagctcgacaggcattggttgatgccattaaagagttacaatctcatggaaatattcgtttgaagagaatgggggaacttgatactagaccattccttgaagcaatgaagcaaagatataatgaggaggatgctgaagagagagcttcagagctgtgttcattgtgggaagaatatctaaaggacccagattggcatccattcaaagttatcatggttgaaggaaaagaaaagtttcacctggtgtcatctaagggtattctttatattgatcctttcacttcagggtatgtttggaagttgggttttggagggtga

SEQ ID NO: 99902 - DNA, 1215 bp, Glycine max
  Peptide Sequence Number=SeqID_216680
atgacactgttaaagagtatagcttcacaatttggttttacgaacatggtttatccaggtgctgtgcattccagatttgagcattctcttggtgtgtattggcttgccagtcaatgtgtggaaaagcttaaaacttatcaaggcttggagcttggtataaatagatttgatattcaaacagtgaaacttgcaggacttctgcatgatgtgggacatggccctttcagccacttgtttgagcgcgagtttcttccccaagttatcagtggttctgattggtcacatgaacaaatgtcagtcgatatggttgattatattgttgatgaacaccatattgatgttgaccctcaaatgataagaagagtcaaggagatgatactggcaagctctgaatatgctcctccaaggagctcaagtgagaaaagtttcttgtatgatattgttgcaaatggccgaaatggaattgatgttgacaaatttgattatcttctccgtgactgtcgagcttgtggtctaggatgcaactttgaatttcgaaggttattggagacaatgcgggttttggatgatgagatttgttatcgtgctaaggacttgtttctaattgtcccttgcttttggctgtgcaatttgctagacctcaccatccacaaaatgtttgtcacccgtgctgatctttatagaacagtttatacacatccaaaagtgaaggcaatagagcttatggtggttgatgcacttgttcacgctaatagttatttggggatttcgtctaacatacataatccttctgagtactggaagttttgtaatgagtatcctgtaccgaaggatatgctggacaattataagaaggtcactgctcaagatattgtttgttctcagaagagtggtggagttacactgaaagaggaggatgtagctatttgtaatgtcaaaattgatttgactcgtggaaagcataatcctctggaaagcatccactttttcaaggattacgaaagtgatgagaaatttacaatacctgatgatcgcataagccacttgctacctacatcttaccaagatatgatagttaaggtgtacgccaaaaagccagaactggtggaggcaatttcagaggcttttgaaaattttcagttgaaaacatatggcatcaaagcacaggcacattcaacgccacagaagaagcgtcgttacaatccatttatataa

SEQ ID NO: 99903 - DNA, 1113 bp, Glycine max
  Peptide Sequence Number=SeqID_216681
atggctcacagcagctctgatgaggatactgatattagtgaatctgaaattagtgagtatgaagataaatcctatgaagaactgaaaagtggaagccaggatgtgaaaacatcggatgagactttcacttgtccctactgccctaaaaagagaaaacgggattatttatacaaggagctccttcaacatgcttctggggtgggtcagagtagttcccaaaagagaaaagcaagagacaaggctaatcatttggctttactgaaatatttggaaaaggatctcatgaatgtagatgttccatcaaatgattcaaaacctgaagatgaaagtgatccttctgttaattctaatgatcagtttgtgtggccttggattggagttgtagttaatattccaactagacggacagaagatggacgctgtgttggtgagagcggttccaggctgagggatgagtacagaagcaggggtttcaatccatttcgagtcaatcctttgtggaatttccgtggccactctggaactgctcttgtggaattcaataaaaactggccaggcttacataatgcattggcatttgaaagagcatatgaattagatcatcatggaaaaaaggattggtttactaattctgggctgaagtctggcctttatgcatgggttgcccgggcagatgactacaagatcaatagtatctatggagaacatctgcgaaggatgggcgatgtcaaaaccatatctgagcttatggaagaagaagctcgaaggcaagataagcttgtctcgaatttaactaacattattcaggataaagatcaactcattcaagcttataatgaagagatacagaaaatacagttaagtgccagggatcacttccaaaggatttttactgaccatgaaaagctcaaattgcaactggaatctcacaaaaatgagcttgagttgcggaaagttgaattggaaaaacgcgaagcacataacgaaagtgaaaggaaaaagttggcagaggaaattgaggagaatgcatcgaaaaatagctctcttcagatggctgctttagagcaaatgaaagctgatgaaaatgttatgaaactggctgaagatcaaaag

SEQ ID NO: 99904 - DNA, 492 bp, Glycine max
  Peptide Sequence Number=SeqID_216682
atgggaacatcagagctacagatacaaacagaaaatggtcatataggcatgccgagtaatgtttgttgtgttgttgttgaatattgtcctgggggtgcactgaagtcttatctcattaaaaaccgaagaaggaagctggcttttaaagtggttgttcaactggctcttgaccttgcaagagggttgagctatctccacacaaagaagattgtccacagagatgttaaaacagaaaatatgcttctggacaagacacgaaccttgaaaatagctgattttggagtagctcgtattgaggcctccaatcctcatgacatgacaggtgaaactggaacccttggttacatggctcctgaggttctaaatggtaatccatacaatagaaagtgtgatgtgtacagttttggcatatgcttatgggagatatactgctgtgacatgccatatcctgaccttagtttctcagaagtgacatcagctgttgtacgacag

SEQ ID NO: 99905 - DNA, 378 bp, Glycine max
  Peptide Sequence Number=SeqID_216683
atggagaagaacaaggagaaggaggaagaagaagaggttgaaggaaggtccacaagaagcagacaagaatgggagattgacccctctaagcttgtcatcaagactgtcattgctcgtggcacttttggcactgtccatcgtgggatttatgatggccaagatgttgcagttaagctccttgactggggggaagaaggccatcggtcagatgctgaaatagcttctttgcgagcggcttttacacaagaagttgctgtttggcacaagcttgaacatcctaatgtaaccaaggtggaaatattggaaaacattctaggacgcaaatattgccaaaacctcagattgttgtctcttcatagtatgattgtgatagcttga

SEQ ID NO: 99906 - DNA, 291 bp, Glycine max
  Peptide Sequence Number=SeqID_216684
atggctttgtgttcaatttttctcaatcttcatcttctgttttttgtttgtttgacgatagaagcgttaggtgtggcaaagccttcagtagctagttacctttgccaggagatactggcagagcaagaagctgatagagtgcatgaattacctgcgcagcctccggtgaagttcaacaatatggtggttatatcactgttaatgaaactcaaggaagagcactgttctatttgtttttcgaggccactcacaaaccagaacaaaaacccattcttttatggttcaatggag

SEQ ID NO: 99907 - DNA, 147 bp, Glycine max
  Peptide Sequence Number=SeqID_216685
atgaagcttcattgtaagaactgtgatgacgagagtgatgagcaaaatgatggcgacagcgatgaagtctatttcgttgaagcctttgggaagagacggcaccgtgaggcgccatttggtggaggagattccgattgtggtgccaag

SEQ ID NO: 99908 - DNA, 621 bp, Glycine max
  Peptide Sequence Number=SeqID_216686
ttgatcctgaccggccagctcggcaacgtgatgaaggaatcagcgtcggcggcactgtcggtggtgcgttcgcgcgccgtgggctttggcatcgacagcgacttcctgcagaagcacgacgtgcatctgcacgtgcccgatggcgccacgccgaaggacggcccgagtgccggtgcggcaatggtcacctcgctggtgtcgatgctgaccaaggtgccggtgcgtgccgacgtggcgatgaccggcgagatcaccctgcgtggtcgtgtcaccgccatcggtggcttgaaggagaagctgctggccgcactgcggggcggcatccgcacggtcatcatcccggaagagaaccgcaaggaccttgcagacattccggccaacgtcacccgcgatctggagatcgtgccggtgaagtacatcgaagaagtcctggacctggcgctggagcgtccgctggcaccgaagaaggcgcgcaagagtgcgcagcgtgtcacggtgcgcagcaaggccaaaccgacgatgactgaatcggcgaaccgtttccacatggcggccgcatgcagaaggcgtgcggttgcttccctgtcgaataagcggaacccaccgccaaaggagttgtag

SEQ ID NO: 99909 - DNA, 228 bp, Glycine max
  Peptide Sequence Number=SeqID_216687
atgttattaaaaacaaaagtagggaaaatcagaacaagagttatctttaacgaaagacaaaaacatgatcataatcagccaattaacctagatttgagcatgaaagtcactgcatggctctttgtgagatatgcaagcaagaccttcattgtcacgcacggttgggtcggagattgcagtggagatgaaagcaaggtcgggacaacgatatttttggatcgacggtaa

SEQ ID NO: 99910 - DNA, 903 bp, Glycine max
  Peptide Sequence Number=SeqID_216688
atgggcactcgagaggtgtacgaagagaaactaaggaccggaaatctccaccacgatcccaccatcaaccctggcctcggttccgctcgatgccctcgttgtctctctctcctcaaccctaattccgaaagaggcgagtggaccatcactcccgtcttgcacgatgccactgccgtcgctggctccgggattggtggtatgcttggttttgttcatggtttcaatacagatttgcggccagacgacggttgtagaggggaggttgtggtggtggctggagttgccaccgatgcggtgttccccggtttcgggaaaatcaatggcagtgcaaggagggagaatgatgtgggtgaaggagaaggagaggaggtgatgcaatcctaccccgcaagggcattggatagaagaccccaagtagaatgggccaaagatgcaagagaaggccctagggttcttatgagccttaggatttcaaagctcatttggagcacaaaatttcgtgctcttctctccctctcccttcattcatctccttcttcctccaagctcttatccatggcctcctatggtggagcaaaggaatccattgatgaagaagatcctaggcctacaagctccaatggagcttgcatcaggagggagaatgatgtcgcactgatgtgtttacctcttcttcaaaatggtttgaagggaccaaagtggcttccttttgttgttggggctaaggttgcagttattgacagttgcttagtagaactccaggaatccatcaaggctgctgcaatggctgaaggcactgttcgatcttgcttgaagtcattaagacgactgagaagcaggtggcgagatccacagcagaaattaacagtggtggtggtccttcttaatcgggaagcgaggtag

SEQ ID NO: 99911 - DNA, 282 bp, Glycine max
  Peptide Sequence Number=SeqID_216689
atgccatcagccactgacaagtttgcaccagtcacactgccctcagccataggccatcacccacagattgatgaactgtcctgcatggctattaactacctgtcttgcttaaattttcagaagacttggtctctgacagtgtttaaaaaactgaatcagacctgcagtgaccctgaaccagagctggtttggagttttcaaacagatcatttgatagataataataacatagcatgccaccaagtggaatgtattataacagtgaaagtacagctttcctga

SEQ ID NO: 99912 - DNA, 1077 bp, Glycine max
  Peptide Sequence Number=SeqID_216690
atggacaagacatcatcaacaacaacaacctccgagagagaaactcacgacttcatgaacgtcgactcgttctcccaactccccttcatccgcccggctcctcttgtcagagagaagtcaggcattcgcctctttggcatcgaatttgccggcggaaacaacaacagcagcaataacaataacaattttgttgttgtctcggccgaggattctgagtcggccgaaataacaacagcagccaacaccaacaccaacatcaataacaacaaactcaactcattcgacctcgatccttccaacaaggaggaaaacacccccactgccaccagtactggcaccaccgacacgaatggcgagagcagccgccgcttcgagtgccactactgctgccgcaacttccccacctcccaagccctcggcggccaccaaaacgcgcacaaacgcgaacgccagcacgccaaacgtgcgcacctccagtccaccatggttcatggcagcaccttctccgacgcgcaccatgtctacaatctcatgaactaccgctacggttcttccattccaacaccaccaccaccaacaatgccttatccaacatggaacaacaacaacaacaacacgcgcttctacggaacaacaacaacgacgtcgttttctcaccaccaccaacaccaacaacaacctattaacggaagccccttagcattttggcgaattcctaatggcaccaccattaataataataaccctagtttcagccacgagcgttcttcgacgttgccgcctttgttcgcgactgaggaaatagcgaacgtgagagcctcctcgcaggttgttgtcggagcctcggggccgatgacgacgcaaaaccgctacgtgtatgactcgaaacaacgcgaccatgttatgcacgtcgtcgtttcatggtgtggacgggggggggggggggaggtggagaactgtttcacacgtgtggggataatggaaaggaaagaaagtgatatttcgatgccattagcaggcaccaatattgctctcctaaaattaattaatttctttcaaagtttacatatgtggtga

SEQ ID NO: 99913 - DNA, 111 bp, Glycine max
  Peptide Sequence Number=SeqID_216691
atgggggtagtgcaagatcgatcatacaagcgcactggtggacacacacgcaaaggtagggtattttactgcatcaagaaacttgacagggtattactcgttttatcatag

SEQ ID NO: 99914 - DNA, 840 bp, Glycine max
  Peptide Sequence Number=SeqID_216692
atgaatgtcataggaaccggtaatgcagctggaaaaagtggcagaagccaaagaacttttcaaatggcattagcagatatcactaatactcagccaaatagtcaacacatgccaaccagacagaggaaaactatcaataacatatttagccttcgtagtaatttgtacagtgactttgtggctgcatcttcagcttctactggactactggataatgaaatcctcgatcgttcctttgtacctcaacatgcaaatgattcacttcatcatactaatgaagccttatcagataacaatgctgaaaatgcaggatatgttggtcttggcgacctgtctcaaatatgtgcatattgccaagctgctatgtggtatcaagaaagtacgaggaaaaatagaaaccaagctaatctcaaatatagtctttgttgcagcatgggaaggatacaccttccttttctcaagaatcctccaatgcttttccaacaactactatgtgaagaagaatcatgtgaaagcaaaaattaccaacaaaatatcagggcttataatatgatgtttgcattcaactctcctggggccaagatagatacaagtctgctcaaaggaaaagttattgttggtgatgcaagtcaacctatcaatcgagacataatacttgaaaagaaaaatggacgattacaaagaatcaatgagttttatccaggttatcttggattgcaatatcctctgttgtttccttatggtgaagatgggtaccgcagtgatatcaaacatagagatatgaatgattctcatgaaaggaagagaaacaaactaactatcagagttcttgtgttttag

SEQ ID NO: 99915 - DNA, 1140 bp, Glycine max
  Peptide Sequence Number=SeqID_216693
atgacgcgtaagctcaactccattatggacatcactgctcaaaaggctgcaaggattaacattggaatgatcttgatggatgagaatgctgataagattgttgctcaaattaaagatgttgatcctgataagtggaatgatgttgttaaagtggtccgctcgttgtcatggattcaaaagttaataaacctgagcttatgggcaaatgttatcggggagttagttgatgtattgcaatggagcctggatggaaaacccaaaaaggtggtcctcactatgaaggataagtgtggtaccattgtcaattgtactctgtgggaggattttacattcttgctgaaagattatttggacaaacatcaaaatggaccaattatacttctgcttcatttggcaaaaattaaggaagcacgaggggcttatgcagtgtccattcaaaatttaatgtatggttttaggctatttatcaatgaagatttgaaggacattgaagattataaaaatagatttgatccgagtcaactaagccttgtgacttgcagtcaaaggttgagtcaagtctcttattctgcccaacctacttcagaggatagatttctttataatgctcaagttaaatcattaagtgaactttgtgagttgaaaaaggaatgtgtttgtgtggctgttgccatgataaccaagttcttagttggcaatggttggatatatgaaagttgcccaaaatgtaacaagaaagtggaatgtgagaaatttccatacacctgtcaaggttgtggaaatgaaagtgcaacaattgtggccaggttaaatcatgctatactatataggtttcaattggaagtgagagttggccaacctaatgaaactgctaactttactttatgggatcgtgagtgtaatgcactcattaaagaaagtgcaaaaggtgaatttgatccaaaggacattgtagaggctattgataggatactgggcaaaaaattagcttttagatttaaggctatatggaacaatacccggtattctgtgtcacaaatctcagaggatgaagatctaattatgttattattgaagagacttcctacatatgagcttgccggaattgagcccgaaatgtcagattcgtttgtgaagtag

SEQ ID NO: 99916 - DNA, 447 bp, Glycine max
  Peptide Sequence Number=SeqID_216694
atgtcactccatgaagtgacacttatgcaagagcatgacatgtgcaatacaccatactcgacaaatccaaggttcgcccttggtgagtcttggttctccaatggcttgcaaaacacagggtctgcccttagtgagtctcgccaaaatccaggacggatgcatcactggtcaatcctccaaaggctcatcaaacttcccttacttgacatgctcgggggcttgacaagccacatcgacatgcaattctctcacttgtcaaggttaccacactcgacatcggacaaacactcgtccacacccgtgggcttgacaaactcgtcaccctctgcttgtcaagaccactaccttagacatcagatactctccctcaacacgggacaatctccttcgacactaaacaatctttttagcccgcaagctggctcagagcttagggggcttatgtaa

SEQ ID NO: 99917 - DNA, 255 bp, Glycine max
  Peptide Sequence Number=SeqID_216695
atgtggttttggagttgttggggagtatcaatttatggcatggttgtttgtagagggttagagccttcgaaagggatctcgtgtctaaggtcagaccgagtgctaaccatggatgaagaagatagagttgacgagagaccgcgggatatgatttactgcgaccccacggtgggcgccaaatgtttttaccaaaatccgaaaccgtggcacaatagggtagatatggctgagtggatcccgaacttcacacattga

SEQ ID NO: 99918 - DNA, 159 bp, Glycine max
  Peptide Sequence Number=SeqID_216696
atggagagcatggacagatctaagggagggagaaacatcgatgttattcaaggttcaaaaggtgaagactccaacgaaaaaagcaaccaagctaatggtatacttattctaccctttctcaccattcttagaattacgctgatttcttgtttcaattaa

SEQ ID NO: 99919 - DNA, 279 bp, Glycine max
  Peptide Sequence Number=SeqID_216697
atgaaaaggtggtcaacaaagcctaacgatgttgttgacatgatgaacaccagtgggtttggatgggatgacacaagaaagtgtgtcacttgcgacagcagtcaaaaacatcctaaagttggcaaccatgttaataaagagtttaaagagtttgagaagttgcaaagtatttttggaaaagaccgtgcaaatggttgtggggccgagggttgtgtagatggaatggaaaatgaaattggtgagaaccaagttggtgatgatgatgagtggctacactaa

SEQ ID NO: 99920 - DNA, 819 bp, Glycine max
  Peptide Sequence Number=SeqID_216698
atgggttatttgaatgaattgtgcagtccaactttctataaaattataaagaataaggcggtggaggagttcaagcctgatccttacattgctacggtgctgaattgcgctttctgggtgttctatggaatgcctttcattcaccctcacagtattttagtggtgaccatcaatggcattgggcttgtgttcgagttcgtataccttaccatctttttcacctacgcaaccaacaaaggacggaaaaagctactgatttgtcttctcatcgaggctattttctttgctgccattgttcttataacaatgctggcagtgcatggcaagcataggtcgttaatgattggtgttatctgtgatttcttcaatatcatgatgtatgtctctcctcttacaatcatgcagtttaaggttatcaaaaccaagagcgtgaaatacatgccattctggctctccctgactaacttccttaatggtgcgtgctggacaacttatgcactcatccaccccttcgacctgtttgttctgatcagtaacagtgttggagtagtctctggatttgttcagctcatactatatgcttgctactgctgcagagaaaacaatgatgatggtgatgatgatggtgctgtccagaagaagacaactggcgttccagtttctgaatccccccgttttgctaagaaactagggaggaggttgaaggagtttatcaaggtagaggttgattctcaagtgattgttttccatgtgtatcgtgaagctggtgccattgctaataggggcattggtatggaggaggatttttttgttgtatga

SEQ ID NO: 99921 - DNA, 898 bp, Glycine max
  Peptide Sequence Number=SeqID_216699
tccaactttctatggaattgtaaagaagaagacggtggaggagttcaagccagatccttatatagcaacggtgttgaattgtgcgttttgggtgttctatggaatgccttttgtgcacccaaacagcattttagttgtcactatcaacagcgttgggcttgcgttcgagtttgtctatcttaccatatattatgtctatgctaccaacaaaggacgggttgttttctttgctgccgttgctcttataacaatgctggcattgcatggcactcgccaaaggtcgttagtggttggtgttctctctgatatcttcaatgttatgatgtatgtctcccctcttacaattatggcaaaggttataaaaactaagagtgtgaaatacatgccattctggctctctctggctaacttccttaatggtgcgtgttggacaacatatgctctcatccacccatttgacctttatgtcctggcgttagtgtttaagtggtgtagacctactgcatccgcacgtaggcaacgggaagctgcccctgttgctgagaatgttcctaagatgactgaggacgtacctgcacctggtgcaaaagctagtgatggtgttgagggattagctggtgatgatgctgagggattcccaagtaggtcacgtgacccatcaatgctgacttcgtttgctgacgaagatgcacggaggagagcggaggagaagaaaaatacgaagaagaaaggcaaagggatcagcaatggtatcggagcaatctctgggcttattcagcttatattgtatgcttgctactgctcttgcaagagtaaaaatgatgaggatggtgatcaagatttgaaaccaagtggctttcagctctctaacttaaacggaagagctgcagtagtctga

SEQ ID NO: 99922 - DNA, 558 bp, Glycine max
  Peptide Sequence Number=SeqID_216700
atggagatgaagagagaaattaccaaggaggaagagcacaaggaggatagcatgcacactatagtgttcacagcaggtacatttcttctgatggtgtgtctaaagcactttctagttgagcagtggcgtgcttgggtgttcctcatcctcaatgtcattttgttagctatcctattcatgtctatgaggccagccaagttggaggaggatcacagttcagaaagtgaaagcagtgttgaagaagtgaaaagtgacaataaattagagaaaaagtggccaagtggggggtctcaagaagaaactgaaaaaggaaaagattgctacataaaacaatgttgtagtagtagtagtagtacctatgctcttgttgagaatgaaagagaagatgatgaggaagaggaagaggaggaggaggaagagcaggttccagtgctgtccaaggaggaattgaatgagagggtggaagctttcattgcaatgtttaggcagcatttgatctctgatgtcaaacaagctgaaagtttcaggctccacaagattgaagtgtcttgctgttga

SEQ ID NO: 99923 - DNA, 2742 bp, Glycine max
  Peptide Sequence Number=SeqID_216701
atggctccagtttttgaagctggaattcctaggaagtgctattatgctccaaaagaacttcagcagcaatcaaaggcatccttgaaaggagatgatgggaagaaactcattccagcaaggaagccacatgcagtacttgttgcaagtaggccagactctggtggcagagaaggctctgtgatctctcttcttgccaaccactttttggtgcaatttgatccatcacagaagatatatcattacaatgttgaaatcactcctcatccctccaaggatgttgccagagcaatcaagcagaagttggtaaataacaattctgcagtcctctcaggtgctactccagcatatgatggtagaaagaatctttatagtccagttgaattccaaaatgacaagcttgagttctacataagcctcccaatccccactagcaagttgaattcaccttatggagaaatgcctgatttgaaagagaagcatgaacagcttaaacttttcaggataaatgtcaagttggtctcaaagatcaatgggaaggagttgagtaattacttgagcaacgagggtgatgattggattccacttccacaggattatctgcatgctttggatgtagttcttagggaaagtccaactgagaaatgcatacctgtagggaggtcattctattcaagttcaatgggaagaagcaaagacattggtggaggagctgttggattgagaggcttctttcagagtcttagaccaacacaacaaggacttgctctcaatgtggatttctcggtaactgctttccatgagagcataggagtgattgcatacttgcagaagcgcgtcgagtttcttcgagacctgtctcaaaggaagacagctcaattaactggcgaagagaggaaggaagtggagaaggcgttgaagagcatcagggtctttgtttgccacagagaaactgttcagcgatatcgtgtctatggcttgactgaggaggttactgaaaatctttggtttgctgacagagatgggaagaatctgaggttggtgaattactttaaagatcaatataactatgacatacaattcagaaaactgccatgcttgcaaattagtaggagtaagccttgttatctccctatggagctttgtgtgatctgtgaaggccagaagttccttgggaaactgtctgatgatcaaacagcaagaatactcaaaatgggctgccaaagaccggcagaacgaaaaaccattgtcgaaggagtcatgagaggaactgttgggcctaccagtggtgatcaggaaaaagaattcaaactccaagtatcaagagaaatgacaaagttgactggtagaattcttcaccctcccaaactaaagcttggagatggaggtcatgtaagaaatctgactccttcgcgtcacgaccgccaatggaaccttcttgacggccatgtctttgaaggaactactattgaaaggtgggcactaattagttttgggggcacacctgagcagaagtccaatgtccccagatttataaaccagttatgtcaaaggtgtgaacaattgggcatttttctcaacaagaacactgttattagtccccagtttgaatctatccaaattcttaacaatgtcacccttttggaatctaagctcaagagaatccagaggacagcctcaaacaatctccagcttcttatttgcataatggagagaaaacacaaagggtatgctgacttgaagcgaattgccgagacaagtgttggtgtcatgagccaatgctgcctgtaccccaacctcaacaagttgagttcacaatttttggctaatttggtcctcaaaatcaatgccaaagttggtggatgcacagttgccttatacaactcattgccttcgcagttaccgcgcctctttcatattgatgagccagtgatattcatgggtgctgatgtgacacatcctcaccctcttgatgatgtcagtccatctgttgctgctgttgttggtagcatgaattggccgacagcaaacaagtacatttcaagaataaggtctcaaacacatagacaagaaatcatccaggatctcggtgcaatggtgggggaattgcttgatgatttttaccaggaggtagagaaactccccaatagaatcattttcttcagagacggggttagtgaaactcagttttacaaagtgctggaagaggaacttcaatccatcaggtttgcatgttcaaggtttcctggctacaaacctaccattacttttgcagttgtgcaaaagaggcatcacacaaggttgtttccctttgaaactgaccagtcttcaactcaaaacaattttctatatgaaaacattcctcctgggactgtggttgattctgtgatcactcatccaaaggaatttgacttctatctttgtagccattggggtgttaaaggaacaagtaggccaactcactaccatgtcttgtgggatgaaaaccagtttacttctgatgaactacagaaactggtttacaacttatgctacacttttgttaggtgtaccaagccaatttctttggtgcctcctgcatattatgcacacttagctgcatatagaggcagactctaccttgagagatcagagtccttaggtttgttccgaagcacatctacactatccagagctgctcctccaaagacagcagctctacctaaacttagtgaaaacatcaagaagctcatgttctattgctag

SEQ ID NO: 99924 - DNA, 432 bp, Glycine max
  Peptide Sequence Number=SeqID_216702
atgttgcactcagtaaatgattattgttatgtatggattcacttgacttgttcgttcagcactgatttgagaaaaaacattgaaaaccttgagaagaatagtgtaaccagtctaagaactttggtcaatattgggtctgaagtatacctgcaggcagaagtgccagatacacaacacatatttgtggatgtaggatttggattccatgtggagtttacttggtcagaagctctgaactacatagataaaagggaagaaaagatagccaggcagatagaggagtacacccagttgattgcatcaattaaagctcagattaagcttatgctagttctcagagctgtcaatattagccagcttactacacacagccttagaccacatgagataggcaaaaagcttataaggctgaaaagcctacaaagtgcctaa

SEQ ID NO: 99925 - DNA, 132 bp, Glycine max
  Peptide Sequence Number=SeqID_216703
atggtattgttgaacattggacattttgaggtgaccacagaaaggatagattcaaagagaggcagcagacatgtatgccaggctgaccctcctatcgtttggactttatatgattatataaaggcttactag

SEQ ID NO: 99926 - DNA, 6567 bp, Glycine max
  Peptide Sequence Number=SeqID_216704
atggagctatcggattccaccggggccgaccgcaaccccaacgcgccgccgccgcacagcaaccaaaaccaagacgcgcgttccggtctcggaatcgacctgaacgagatcccctcgccttcctcttcgtttccagaaaccctaccggactccgtcgccgtcgacgtcgtccgcgcataccatgacaacccagctccgccgccgggtggccccgccgccctccctcgcggtggctcctctccctgcgccgcctgcgccaagccttcccccgccgccgtgaaccaccaccaactcgtcgtgtgcgacggctgcgagcgtgacttccacctctcctgcgccggaattcgcggcggaggccgacaggcggcgaacctcgacgagtgggtctgcggcgagtgcgtcgccgccggagttaagagcaagcggtggccgttgggagtgaaacaacttctcgatatcaatgctccgccgccaagcgacggcggcgacgaggaggttcaggattcgagtttgaagttgaaccctttaaggaggtttttcagtgaggatgttggaaatgagtggcatggcttgttggtttcaaagaatgaagaggttttaagggtggcgggatcaatgtgggtgcacactctgggtgataattcttttggtgccaatccatttggtgccccagcgacgaattcaaacttcaacaatgggaatgctattggcttccaaaaggcatctggagttgtgacgcatgctgttagagtgggttttgaggatataactcaatttactagaagctttgaggaggctcttagagattttgtatctgaacggcgtggtgtactagaggaaggttggcgagtggaatttagacaatcagtgagcaactctgaactgtatgcagtttactgtgcaccagatggaaagatatttgattctgtgtatgaagtggcttattatttggggctagcgcctctcccttctttaggtgggcctctatccaaaaaaagaaagttaacaagaactacagcagctaacggttctatggaaaagcggggaaccttgatgaatagtaattgtaaggatcctccttctgatggtttaaatgtggaatgtgctagtgctagggggaatatcccaaaactctctgaaattggaggaaaagaggattgccactcccaccctcaacaatctgctgatggacttcctctacagttcaaggatttctttgttctttctttggggaaagttgatgcgagaccttcatattatgatgctaatcttatctgtcctggtggtgattctggacctatatttaggatccgaaggtgttcctgttcagaatttcctgttccagttgggtcaaccatactctcaatgtcaaaactttgtcaagttgtgagtcaaaccaatgaagaaggtgagggaaaaactaatggtagtatggatttagatgatgatgaaagtctccaaatgatgcttttagacccttgtgtgccaatggaaaatgatatccttagttgctttccaagctgctcaactgaggaacatgatactcatacatcagatgtattacaccctgttgctagttcagttcaagataatgctagaaattcattagctgataacttagggtttaatgatggaattggtgaaattttggtggaagagcggtcgtcattctctgcatggacagttatttctcaaaagctggttaacgcttgcaaggatatctgcaaacagaaaggaaatctcaatttctattgtaaccatgttgataaatgggatttaaggaatggaaaaagtgatacatactttacttcgatggataaattttgtggttctcttggtgcagttggaatcccaaatgtaatttatgcagacaatgatgtggaaggtatctacgaggcactgggaaaatggttggagcaggatagatttggattagatgctgaatttgtgcaagaagtattggaacaacttcctggtgtccaagactctttgcagtatgaacttttaaatactagaaataatagctcatcattgccaacagtagaaaatggtttcttagtggttgaatggagagatggatcaaaatatcaggaagaaacagttcaagctttatatgggaggtccaagaaggtgactgagaaaagcattaaggaaggtcgtcatccaccacttgggaagccagtatgctctagggctcctggtgagctcattggtgacatttttcagtcttgggagcttttaaagcgatttcatgaaattctggacctgaaagagccattgacattagatgaacttgagaaagaactcattaacccttggtttgatgaattagattttcttgagaaatctgagagggacatggatgaaagtcaagttttaatttcccaaggagctgatggtaattgtagaccattgttgtccccaagatgtgaagctgatccatcaggttccatagaaagttctcatgcgtttattcaagtggaaacagaagcaatgaaagaggcagctcaagttaagtttgcatctttcacatatgccagatgctttggtgtagctttgaccaaggctcataattcattgctaagagtgttaataggtgaattgctgtcaaaggtggcttccctggtagatccaaattctgaacctggagaatcacgaacaagacggggaagaaggaaagatatggatagtgcagttcctgctaaacgaaccaagctcaatatgcttcctattaatgaattgacttggccagaattagctcgtaggtatatgttggcttttttgtcaatggatggtaaccttgagtctgtggaaattactgctcgcgaaagtggtaaagtatttcgttgcttacgtggtgatggtggtttgctgtgtggttctcttactggtgtggctgggatggaagcagatgcacagctgcttgcagaggctacgaagaaaatttttggttctttaagtagagaaagtgatgcactaaccatggaagaagaagagtctaatgcaaagggtgtttctgaaatttttttggcaaatgatggtaatgttcctgaatgggcacagatgctagaacctgtcagaaagctaccaacaaatgtaggcacccgaatcagaaagtgtgtctatgaggctctggaaaagaatccaccagaatgggcaaggaaaacgctggagcattcaatcagtaaggaagtgtacaagggcaatgcttctggaccaacaaagaaagcagttctttcagtgttggctaaagttggtggtgaaggatttcaatctaatcccaataaaggacagaaaaagaaaattgttatatcaatttctgacattatcatgaaacaatgtcgcatagtattacgtcgtgccgctgctgcagatgattcaaaggttttttgcaatttgctgggaagaaaattaacaaattcttcagataatgatgatgaggggcttcttggatctccagccatggtagcccgtcctcttgactttcgcactattgacctaagattagctaccggagcttatggtggatctcatgaagcttttcttgaggatgttcacgagctgtggaacaatgtccgtgttgcttttggggatcaacctgatttaattgaactggctgaaaaattatccctaaactttgaatcattatataatgaggaggttgtctcgtatgtccaaaaatttgtggagtatgctaaagtggaatgcttaagtgcagaaatgagaaaggaagttgttgattttattgagtcaacaaatgagattccgaaggccccttgggatgagggagtatgtaaagtatgtggcattgatagggatgatgatagtgttctactatgtgatacttgtgatgctgagtatcatacatattgcttgaatcctccacttgcaaggatccctgagggaaactggtactgtccctcttgtgttgatggtaagcgtgcaactcaagatgtcacagaacgtacaaagattattggtaaacgtcaaagtaaaaagtttcagggagaagtcaattctctatacttggaatctctaactcatttgtcatctgtaattgaggaaaaagaatactgggagtacagcgtgggcgagagaactttccttctcaagtttttatgtgatgagttgcttaactcttccctgattcgccagcaccttgagcaatgtgcagagttgtctgctgagttacatcagaaattgcgtgcacactctgcagagtggaaaagcctgaaaactagagaggatattttatccacaaaagctgcaaaaatggatacattctcagtaaatactgctggagaagttggtcttaaggaagggtttactggtaaatgcccggtccagccacatactgcagttgacaatcctagtaattttggggtatttgttgatagtctgccttcagaagaggttaccaaagagaggtataggtttgatagtgttgataaaagcatatctgtgacaaattcagattctgatagccaaaatatgaattccatagatgtagagggacaatttagaaatgtctctgctgctgtggagtctcaatgtactgacaaatcccccaaatcttttccatcaccaaatcatatgtctcaagaaataaattgtgctggtggagaagctcatgtccagggtaaccaccagaaatgtgagggaacggacagacctattcctgtgtcttaccagcaaggaggagtgcctgttgatgttcctcagattggcttgaatgagtcagaaccctaccaccttgagctcaatgccatcaaacgtgatatttcactattgcaggactccataactagtgtagtatcacagctgctgaagctctctgttcgccgggaatttttgggtattgattccattggtcaattgtactgggcttcggctttgcctggaggacattcacgtataattgttgatgcaagtgctgcattgctgcatggaagaggaatgccatttagcagagactatgcagagaagttttctgttctgcagcattgtgcactatctgacaaggattcctctttaatgtctcagcctagtaattctttgggcaataggtcaccgtggattgcttatgaaactgatgctgaaattgaagagctcttaggttggctggattatagtgaccctaaagaaagagaactgaaagattccattatgctgggcccaaaatcaagattccaagagttcattaatgcacagactgaagatcagggcgaggaccaagggcatatttctatgccaagaaatagagagaaaacagtatctaattctcttgttacaaaggcaacttccttgctggaaaagaaatttggtcccttcgttgagtgggataatgttgaagtgttgaagaagcaaaatagaaaggcccgaacaactaatgatgaaaagttgtataggtgtgagtgcctagaacccatatggccttctcggaaacactgcacatattgtcacaaaactgttgtgagtgatgttgaatttgatggacacaatgatggcaagtgtattgcaggtcttccagctgtagagaagaaaaaggataaaaatggatcatctaaaggaagagggaacttaaaatgtgatgcctcacatgagaaattcagagctgatgctgaaacagctgtaacctcggttagtgggtcttctaagcttagctcaagattgattaaattttcaaatgaagaatccacatgcccatttagttttgaagatatatgttccaagtttgtgaccaatgattccaacaaagaacttgtcagagaaataggtcttattggttcagatggtatcccatccttagttccttctgtatctccttttgttagtgaatatacactctcagctcaaaaggatgaaagaattgttggtggtgtgtccaaagcatcagaaagccaggtctctcagggaaacactgatggagctggcacatgtcttgaccgtaaatcaagcatttctactggaaggttggctgcaaatgaaagcaacaaatccaacaaatcatcctcgagagaacaaagagatgggaaattatctttttgtaatcctgcttctggtatgggagctgatggctactgtgtggttccttcgccttcgttgagaccattagttggaaaagcttctcatattttgaggcagttgaagataaatctacttgatatggatgctgcacttacggcaattgctctaagaccatcaaaggctgagtcagacagaagacaggcttggcgtacatttgtaaaatctgcaaagactatatatgagatgattcaggcaacatttacactggaggatatgattaagacagagtacttgaggaatgactggtggtactggtcatcattctcagctgctgccaaatcttctactttgccttcccttgcccttcgcatatactcccttgatttagccattatatatgagaaaatgcccaattcaagctttactgacagctctgaaccttctgccatagtggaaccaaaaccaccgatgcatttggatgcagaaaaatccaaagcaagccggaagtcaaccagaaaaaggaaggaatcagattgttga

SEQ ID NO: 99927 - DNA, 222 bp, Glycine max
  Peptide Sequence Number=SeqID_216705
atgaatgagatgggagctgtttcagcaagcaaaagtcacaatttagggcacgcaaaacggttaaaaatccaggttcatgtgaaccaggtcacacaacccaacaaaaaaatctccaatttcaggattgcagaacttgcacgatctcatgatttcactaataagatctcatcaatttgcaatttcagtcacggtacagaatgcgacagggtagcgagattgtaa

SEQ ID NO: 99928 - DNA, 489 bp, Glycine max
  Peptide Sequence Number=SeqID_216706
atgacatttggaagattacaagtaactcttagggcaaccaattgtcgttgtcccataatgctcaacctgcatccgagacacattatcatagtccatctcaatattcaggcaaagagtgaggtttcaaaggaggaggagcatttgttactaagaagtatgttgaaagtgaagtggaaagcagaaccagaggtggcctcccatggcgttgaagaggtggaagggcatgtggaaggtgaggtgcagtcgtcctatatggggaagctactccaaaatgatggtcatgtgccattctcagcctttgaagggaggtgttttggggtatctgaactagaattatccctacccaaattggttgatgaggatatatcgagatttaaagagtgtaaaccatggaaaggttcttttatggtgaatgtgctatgcaagaatgtagggtttgtattcttcaaggaagttgaggagagactagacgaagaaatgctctattaa

SEQ ID NO: 99929 - DNA, 798 bp, Glycine max
  Peptide Sequence Number=SeqID_216707
atggagatgtcaaagtcaaatattcctaatcagtataaaggctctcgattggttgtgttaaacaaggatggagaaggagctaaaactaagagtaagcgtaataggcctatgtccaacccaaataagaatggtggtggaaataaggtaggatgtgagaatgggcaaaaattgacccaagtgcaattcaaagcgaaaaaagagaaagcaatgaaggtgacccaacctgtgaaacaagtcacaaggaagaaaaacatgattatcccaaatgggacagtgaatagaaccaagaaaggtataaggaatatgcaaggtgggacgcgaaacttggataaggtgcctagagaaattgaaaaggataaatcaaatgaacattcgaggaaagagttagaccttatcctggcctaccaaaaattgggtgtgagtttcatggttaggcaagaaatgtataatggtgtggtctttccaaatgtagagatggatgatactagaaggcaaagtgtgaaggggtcgagtattgagatagaagatatgtctgtttgtcagactgagaattctggggggtttgcgagtttggtgaaggagataagtaaggagcacaaagcttcttttgtggggttatctgatgtttgtggtggtctaatgcttggaagggtgattttaacaccatcatgcacccatcaaagagaagtggaggagagcgaacttctctctaaaaggaatgagagatttttaacatatggtgtagttgtgtcgcctattggatatggggttaacaaggccaccatatacttggagtag

SEQ ID NO: 99930 - DNA, 237 bp, Glycine max
  Peptide Sequence Number=SeqID_216708
atggttcatacaaagaggagaaaccacttgcatcaaaagaagatgaatgacttagtctatgtgataaatttaagtgattcaactttggatgtatttggtattgacaatttggttttgattgacgatgttggagatcacttctcaaccgaggaagagcttgaagatgatggagatgaagatgatgatggtggtggtgatattggagatgatttaattagaggattaatggacatttga

SEQ ID NO: 99931 - DNA, 1572 bp, Glycine max
  Peptide Sequence Number=SeqID_216709
atggcaatttccaataaatttcaaccaatcatagagagagttttagagagagagtgcctatgttctcactggcatagaagtataagtggaattggtgcttctgctgctgctgatgtggagcctagcatagcaccagtgcaaattgatcatagtcagcttctaattgatggacagtttgttgatgcagcttctggaaaaacttttccaacctttgatcctagaactggagatgtaattgccaatgttgctgaaggtgacactgaagacgtaaatcgtgctgttcgtgctgctcgcaaggcttttgatgagggaccatggccaaagatgacagcttatgaaagatcgcgtataattttgcgctttgctgatttattggagaaacacaatgatgaagttgccgcaattgaaacatgggatagtgggaagacttatgaacaggctgctaaggttgaaatacctatggtggtacgcttattccgatattatgcaggttgggtggataaaattcatggtctaacagttccggctgatggaccataccatgtccaaactttgcatgaaccaattggtgtagcagggcagattgttccttggaatttcccacttcttattttttcatggatggctgcacctgcattagcttgtggtaatacagttgtaataaaaacttcagagcaggcaccactttctgccctttatgtgtcaaagccatttcttgaggcaggacttcctcctggtgttctgaatgttatcactggctttggtgctactgctggtgcatcgctgtgtagtcatatggacgttgataaggatctactagcactgcaatctgaagtaactctggagctgggtggaaaatctccattcattgtgtgcgaggatgctgatgttgatgcagctgttgaggctgcacattttgctttattttttaatcaggggcaatgttgttgtgctggttctcgcacatttgtccatgaaagcatatatgatgaatttgtggaaaaggctaaagctcgtgctcttaaacgtgtagttggagaccctttcaaaaatggagttgagcaaggtcctcagattgattctgcgcaattcgagaagatcatgaagtacataagatcaggcgttgaaaatggtgctacactggaatctggtggtcaaagaattggctccaaaggctattacatccaacccactgttttctcaaatgttcaggcaagatacttacaattaacaatggacaacatgttgatagcaaaagatgagatatttggtccagtacaatctatcttgaaattcaaggatctagaggaagtgataagaagagccaatgcaacttcctatggcctggcttctggagtttttactcaaaatatggacactgccaacaccttgatgcgcgcattgcgagttggaacagtatggatcaactgctatgatgtctttgatgcagcaataccttttggtggatataagatgagtggacaagggagagtaaggggaatctacagccttagaagctaccttcaagttaaagctgttgtcactgctttgaagaatcccgcatggttgtag

SEQ ID NO: 99932 - DNA, 621 bp, Glycine max
  Peptide Sequence Number=SeqID_216710
atggaagaagagcatcaatgttctagaagtggtgaagaaccacagacacaggaactggatggagaagatcaacagctgcagcatcaatgccaacaacctggagctgaagagaaacttgtattgcaatttatggattcaatggataactacctatccctctttgatgtagtgtcctccacccttcgacagggatggtttgacttagctagtgctcgacattccatgggtgcttctcgcattaatagttctttattggacctgaaattgcattcagccgctacaacattgaagataaccaactatgatggtacacagccacgcttcatgttgcataaatgggtatcctctgaacatgaaagtactcagttagaagatgagaatgtgcagtcacaagatagtagtagtgtgaaatcttctggtatgcaatgcatgttagctatttctcattttattatatgtttggttgtacgaactgctgaggtgaccatggctaagaactcatcaggacttgcagataatgctgaagttcaaaatgagcgatccaagtccttgtcagtttttggagttttaatttccccaaagcttcgagcctcccagctgtcatttgagaaaggtgggtaa

SEQ ID NO: 99933 - DNA, 555 bp, Glycine max
  Peptide Sequence Number=SeqID_216711
atggggtacatactgccaaaaccaaacacagaaaaagggaaagtaaagagaaaagggaaagaagatgaagaggaacagagagctaggagaggatcaatggttgagaggagagcaaatgggggaagaagcatgtctatagatgacttggagaagcttccatgttatgattatgttgacaattccaaaggcaacaacacaagcagccctgtggattgtgcagtttgcttggagaacctaatcacaggagataagtgcagattcttacctgtgtgcaagcatagttttcatgcccaatgtgtggacgcatggcttctaaagacacccatttgtccaacttgcaggtgtaatgctcattctcatagtggaaaccaagttgtaggtaacaacaatgactactctgttgcaccaaatagtgggtctagggagagccaaagtcagcaacatgacaatatggttttggtgcagttgagagaaagccaagaaaatgttccatccagaaatgttgacagagaaaatccaacattaggaagtcacaacttggtcagagaggagtag

SEQ ID NO: 99934 - DNA, 1770 bp, Glycine max
  Peptide Sequence Number=SeqID_216712
atggcttccaagagcatgaagcaatcgaaatatctgcacttgttttgcaatttcaatttcaattccaatcctttaacccatcaacgcttttctcgcctagacagcaccagagagaaaagcaccataggtttgaggcagctcgttagaagcttctcaaccactgaacatgtgaatcttgataaattacaggtggagagagaaatgggaatcaaggttaaatcccagacaagaacaatgttctataagcacagcataaatggtgacgattgtagcgatggaaagaagtcacctattttttttctgaatcctattgatactcctgaatcatgttcacaagccacagttgatgttgacacactcaccagaaccatcaatgaccacccttttccattgcaaccccttcaacccacactcctgcacctcctccctccttccaccttctccacttcccttgtggaaaacattcttggccgcttgtttgcttcacattccaatggcctcaaggccttggagttcttcaactactccctcgtccattcccacttccccctaagtcctgcttcactcaacatgaccctccacatcctcacaaggatgcgttattttgacaaagcatgggtcctgttgcgagatattgcaagaacccacccttctttgctcacccttaaatcaatgagcattgtgctctccaaaatcgccaaattccagtcctttgaagacacccttgatgggtttagaaggatggaggatgaggtgtttgttggcagggagtttggcactgatgaattcaatgtgcttctcaaagcattttgcacacagaggcagatgaaggaggccaggtctgtgttcgcgaagctggtgccacggtttagtcccaatactaagtccatgaatattctgctcttggggttcaaggaatcaggtaatgttacttctgttgagcttttctatcatgaaatggtccgacgcggttttagtcccgatggtgtgacctttaatattaggattgatgcttactgtaagaagggttgttttggtgatgctttgagacttttggaggagatggagaggaggaatgttgtccctaccattgaaactataactactttgattcatggagcagggttggttcgaaataaggacaaggcatggcaattgtttaaggagatcccttcaagaaacatggttgccgatgccggtgcttataatgctttgattactgctttggttagaactagagatattgaatctgcttcttccttgatggatgagatggttgagaaatgcattgagcttgatagtgtaacttaccatacaatgttcttgggatttatgaggtcaagagggattgaaggtgtgagtaagctttaccagaagatgactcagagtaattttgttccgaaaacaaggacagttgtgatgttgatgaagtatttctgtcaaaattatcgacttgatttaagtgtatgtttatggaagtacctggtggagaaaggatattgtccccatgctcatgctttagatcttttggtcactggattgtgcgcaaggggcttggtgcatgatgcttttgagtgctccaaacaaatgttggagagaggaagacatatgagcaatgcatcatttctgatgttggagaggtttttgttgcaggcaagtgacatggacaagttgaaggagcttgaccagatgattaaaaaattgcaaactgtcttaccaccatctagaggacatgctactggtatttctacctccggggttataatgtag

SEQ ID NO: 99935 - DNA, 147 bp, Glycine max
  Peptide Sequence Number=SeqID_216713
atgaatgataacaccttcacaaaagttccaagtagcgtattagagtatgatatcggtggtggtgctggtggcattgttgacgatgaattgatggggtcctcaaatgagttatttcaatttacgtctgcatctactaatatattctaa

SEQ ID NO: 99936 - DNA, 135 bp, Glycine max
  Peptide Sequence Number=SeqID_216714
atgtcgtcgaaaatatctctggctacggcagatggaggtcgtctccaacgacagcaaatgaaggccgatagtgatggtcatgaagaagatgtcaccttgtacgaggttgaacacttagacaagatctctaattga

SEQ ID NO: 99937 - DNA, 243 bp, Glycine max
  Peptide Sequence Number=SeqID_216715
atgacaaaggaagggtgcgggcgaccatatattgtctccgcgtgtcatcggacttgtcgtctctggatgacgaaatgtgcggataaccataaggtgtgtccgcgtgctaccggaccctcgggccacgatagcagaattgagactttttcacggtctcgacggaaagatgttgacatctccgagaagggtgtagatgaccacattggtctctgcatgtcaacaggcttgcttgcctttagttga

SEQ ID NO: 99938 - DNA, 303 bp, Glycine max
  Peptide Sequence Number=SeqID_216716
atggaagagtttgaagaaatcttgggatgtccgctaggaggaagaaagccatatcttttttctgggttctatccctccatggcgagaatagccaaggtggtcaaaatctcggtgcaagaattggaccaagtaaaacaaaatagaaatggggtggtcggaatactgaggaagcacttggaggggaaagcagaggctttggcgaatcaagatctagcggtgatcgacgacttccttgcttaccaccatagcaaagaaagctcggtcgttgttgtgttggccgatgcctatgacacatttgactga

SEQ ID NO: 99939 - DNA, 453 bp, Glycine max
  Peptide Sequence Number=SeqID_216717
atggttacacaccaatcagatactcaaagaacctcatccaccaaaaggtcaaaaggatccttatccaccaacttaaaccagaaaataattgaagcgtcttcccttcgaagatttacctttaatgatctgaagttggcaaccagaaattttgagtctaagaatgttcttggtgagggagggtttggaactgtgttgaaaggttgggtcaatgagcatggaaactttgcagcacgacctagaatgggaattccagtagcagtgaagactcttaacccaaatggatttcagggtcacaaggaatggcttactgaaataaattatcttagtgagctccatcatccaaatctggttagattgattggctattgcatcaaggatgacaaaaggttgctagtatatgagtatatgtgtcgagcaagcttagacaaacatttgttcaagagtatgtcctaa

SEQ ID NO: 99940 - DNA, 1269 bp, Glycine max
  Peptide Sequence Number=SeqID_216718
atgcagctggtgccggagctgcgcaatgaagtgatgccgaagaacatcctgatgatcggcccgaccggcgtcggcaagaccgaaatcgcgcgccgcctggccacgctggccaacgcaccgttcgtgaaggtcgaagcgacccgcttcaccgaagtcggctacgtcggcaaggacgtcgagcagatcatccgtgacctggccgatacggccgtcaagctgtaccgcgaacaggccaaggtgcgcgtgcgtacccaggccgaggaacgcgccgaagaccgcatcctcgatgcgctgctgccgcgccgcagcggtggcatcggcttcgatccggaagtcgcccgcaacgaaccgtcggcgcaggacaacgagacccgcatcaagttccgcaagatgcttcgcaacggtgagctggacgagcgcgagatcgagctcgacctggccgccaatgtcagcatggacatcatgaccccaccgggcatggaggaaatgggccagcagctgaagtcgatgttcgccaacctcggcggcggcgccaaggcgcataagcgcacgctgaccatcaaggccgcgcgtccgctgctggtggaagaagaggccggcaagctggtcaacgaagacgatatccgcaccgcggcgatcgaggcctgtgagcagcacggcatcgtcttcatcgacgagatcgacaaggtcgccaagcgtggtgacaacgtgggtggcggcgatgtctcgcgcgaaggcgtgcagcgcgacctgttgccgctggtggaaggctccaacgtgtccaccaagtacggcacgatcaagaccgaccacatcctgttcatcgcctccggtgcgttccacctggccaagcccagcgatctgattccggagctgcagggccgcttcccgatccgcgttgaactgggtgcgctgagcaagggtgatttcgtgcgcatcctgaccgagccgaaggccgcgctgaccaagcagtacgaagcgctgctggccaccgaaggcgtcaaggtcagcttcactgccgatgccattgatcgtctggccgagatcgctttccaggtgaacgagcgccaggagaacatcggtgcccgtcgcctgcacaccgtactggagcgcctgctggattcgctcagctacgaggcaccggaccgcgacggcgagaccctggccatcgacagtgcttatgtcgatgcgcatctggtcagcgcgagtgccgtgtgcggtaggcctgcagcatctggtcgatcaccgcgctggtgcgggcggcgctga

SEQ ID NO: 99941 - DNA, 450 bp, Glycine max
  Peptide Sequence Number=SeqID_216719
atggcaagcttcttcttccgcgctttgaaatttggttcccttcttttcctccacaggcattggcatcctccattgaatagctttgttcgtttcttccgccatccagacgaaggttcttccgcgagaagaaccttcttccgcgcatgtggaaggggcagttggatattgaagcggaagaaggagttctttcgcgggaacctgcgaaagaaaggggagaaggttcttctgcgggttccggcggaagaaggttccgaaggttcttccgccggaacccgcagaagaaccttctcccctttctttcgcaggttcccgcgaaagaactccttcttccgcttcaatatccaactgccccttccacatgcgcggaagaaggttcttctcgcggaagaaccttcgtcttcaacctcagccaccacacatcactcatgtcgtctatccgacggccattaa

SEQ ID NO: 99942 - DNA, 432 bp, Glycine max
  Peptide Sequence Number=SeqID_216720
atgttgtgtatttctatattaaaatcactatcaccctacttctctctccatttttcttctttattcttcttctcatcctcccaaaatacaactcattctcctcttcttttcctctcgccacacaccaaaatttccctccctcaattcgacccgcccgtcgctgctgatgaccgccccgacaagcgccttaagaccgatgctaggggtttgtgtgaaaatgacccatcgatcacgactggacctatcatggtggttcacggggattgggctgctaagcctcaacgcacggtgcgagcacttggtggagctgagcatcctcggcgttgctgcgatggcgcatgcgcagaacctgcggaagttgtggctagcgaggtgcaagatggtgacgaatatggggattggatgtattgtgatggggtgcaagaagcttaa

SEQ ID NO: 99943 - DNA, 1599 bp, Glycine max
  Peptide Sequence Number=SeqID_216721
gttaagagagacaaacttgataaaaaggcggaagcgggaatctttgtaggctatagctcaacatcaaaagcctatagaatattcttgcctcaaagtaataaagttattgttagcagagatgtgctattctttgaagaagaaaaatggagcaaggaaagtgagaagcttcaagttcaggaggagagcgaagaagatgtggatgaccagccagttagaggaactagatctctctctgatatttatcaaagatgtaatgttgctgtaatggagcctgtagactacaatgaagctgcaactgattcgaagtggctcacggagaaacctaaagataaaaatgtcattggagtgaaatgggtttatagaaccaagcttaatgctgatggttctataaacaaacataaggcgaggcttgttgtgaaaggatatgcgcagatgttcggggtagacttctcagaaactttttctccggttgccaggttggataccataaggttgttgttagctcttgctgcacaaaaaggttggattatacatcacatggatgttaaatcagcctttttgaatgggcacttggaagaagaaatttttgtagagcagcctgaaggatttgtagttcatggacaagaggagaaagtctatcggctgaaaaaggccttgtatggcttaaagcaggccccaaggtcttggtatggcagaattgatgcacatttgataagcttaggctttgaaaaatgtctaagtgagtttaccttgtatgtcaagaagacggatgttggaatagtcattgtttccttgtatgttgatgacttacttatgacaggaagttcaaaggagctgattgaagagtttaaaggaggaatgaaagaagcctttgaaatgactgatcttggaaaaatgtcatttttcctaggtatgcaggtgcaacaagatagaggtgaagtctttgtaaatcaagaaaaatatgcaaaggaaattcttagaaagttcaagatggaggaatacaagccaatttcaacgccaatgaatcaaaaggagaaattcagcaatgaagacggagctgaaaaggttgatgaaaaactgtacagaagcttaataggatgtctgatgtatttgattgcaaccaggccagacattacctatgcagtaaatagtgattgggctgggagtaatgatgacatgaaaagcacttcaggctactgtttcacatttggttctggagttttttcattgcgttcaaagaagcaagatgtcatagcacaatctaccgttgaagccgaatatgtagcagctgttgcagctgcaaatcaagcaatttggcttagaaaacttatggctgatctacacatggagcaaaaggagagtacacaggttcttgttgataatcaagctgcaatttcaatttctaagaaccctgtgtttcatgggaaaacaaaacattttaagataaagttgtatttcctaagggaggtgcaaaagcaaggtgacgtgcagctgctatattgcaaaactgaaaatcaacttgctgattttttaacaaaatcacttcctcaagcaagatttgagtatcttcgacaaaaacttggtgtatgctaccattga

SEQ ID NO: 99944 - DNA, 828 bp, Glycine max
  Peptide Sequence Number=SeqID_216722
atgagtagcgaaaagtctccttcatcagcttctgcttcagcttcttcttcgagtagctacgagttgagcaaaggcatcaatggcctcgacaaggttattcttcgcgacccacgtggtagctccgctgaggtgtacttgtacggtgctcacgtgacttcatggaagaatgaacaggccgaggaattgctttttctcagtagtaagggaggaagagaggatttgatagactttagatcagatctcattgagttttcaaacctcggtcctctcgactcgcatggatttgctagaaatcggttctggaccattgatgattctcctcctccttttctgacaaatactccgagtaaagcctttgttgatttgattcttaaaccctcagaagacgacatcaagatttggcctcacagggtagctcttggatctggaggagatctgatgatgacatctcggatcaggaacactaacattgatgggaagccattttcattcacatttgctaatcatacatatttctctgtgatatatctaagcactcctacaaagattgcaattcttgatcatgagaagaagagaacaattgtattacgtaaagatggtcttcctgatgctgtggtgtggaatccttgggacaagaaagcaaaggctatgtctgattttggtgatgatgagtataagtacatgctttgtgtagaggctgctgctattgaaaagcctatcactttgaaacctggcgaggaatggaagggaagactagaactttcaactgttccttctagttattgtagtggacagcttgaccccaaaaaagttattcaaggaagctga

SEQ ID NO: 99945 - DNA, 884 bp, Glycine max
  Peptide Sequence Number=SeqID_216723
tgccgttttatccactagctggtcgtttacattggataaacaatggccgtttagagcttgattgcaacgcaatggggattcagttcatctcatcaaccctagaagataatctcggtgatttttcaccttcttcagaatacaactaccttgtccccactgcagactacaccctcccaattcacgacttgcccttggttttagttcagctaacgaggttcaagtgtggtggcgttagcattgccataacattttcacacgcggttgtggatggacccagtgcgttacacttcatgtgtgagtgggcaaggcttgcaagcggcgagccaatgcaaacggtgccgtttcatgatcgaaaagtgttgcgcgccagggagccaccttcggtgccaacaacagagtgtcacgctcacacggagttcgatgagcctcccttgttgctcggccaaatcgagagcacagagggaaggaagaagaagaccgcaatggctataactggtcacatatatatggagaagtgcatcaaggcaagagggcacaaagaggaccaaccaaccgcacttactgttatagttgactcgaggggtcgcatggaacctcctttgccaaaagggtattttgggaatgctactttggacactgttgctactagtcttgcggatgatttggtgtcaaaatcgttaggttatgcgtcgagtagaataagggaagctgttgagaggataacttatgagtacgtttatatgattccagcaacgcatgactttgacgaagattttgtgcttcttcctggtcctgatggggatggatctttgctagttgttttaggtttgcaagtggggcatgtggatgcgtttaagaagcatttttacgaggacattgagtaa

SEQ ID NO: 99946 - DNA, 2619 bp, Glycine max
  Peptide Sequence Number=SeqID_216724
atgagagatctggatccagctttcaagggagctggacaaaaggccggattggaaatatggcgtatcgagaattttaatccagttgccatccctcagtcatcttatggaaagtttttcactggggactcctatgtgatcttgaagacaactgcttcaaaaagtggtgctcttcgtcatgatatccattattggcttggtaaagacaccagtcaggatgaagctggcgctgcagccatcaagacagtcgagttggatgcagctttaggaggacgggctgttcagtatcgtgaagtacaaggtcatgaaactgaaaagttcctctcttatttcaaaccatgcatcatacctcaagaaggtggggctgcctcaggttttaagcatgttgaggctgaagaacataagacacggttgtttgtgtgcaaagggaaacatgtgatttctttcgctcgatcttcactgaaccatgatgatatttttattctggataccgagtccaaaattttccaatttaatggttccaattcaagtattcaagaaagggctaaagcattggaagttgtacaatatatcaaggatacctaccatgatgggaaatgtgagatagcttctattgaggatggaaagttgatggctgattctgagagtggagaattctggggttgctttgggggctttgctcctcttccacggagaacagtcagtgatgatgacaagcctgctgattctcatcctccaaagctactttgtgttgacaaggggaaagcagaaccaattgaatccgattctttgacaaaggaattactggacacaaacaaatgttatattctagattgtgggttggaagtttttgcatggatgggaagaaacacatctcttgatgaaagaaaaagtgcaagtggagcagcagatgagttaatcagtggcactggtcgaccaaagtcccatataattcgtgtaattgaaggatttgaaacagtaatgttcaagtccaagtttgattcttggcctcaggcaagtcatgcaacaatgtctgaagaaggtcgtggcaaggtagcagcacttctaaaacgtcaaggattggatgtcaagggtctcgtgaaatctgagcccgaaaaagaagaacctcaaccccacatagattgcacaggacatttgcagagctttaacataatcatacaggtttggcgtgtgaatggtccggaaaagattcttcttccagccactgatcagtcaaaattttataatggagattgctacatctttcaatattcatatcctggagaagataaggaagagtatcttataggaacatgggttggaaagaatagtgttgaggaagagagagcttcagctctttcactagcaagcaaaatggttgagtcaatgaagtttcttccttcccaggctcgtatctatgaaggcagtgaaccaattcaatttcatgccatcctgcaaagctgtattgtttttaagggtggacgtagtgatggatacaagaattacattgcggagaaggaaattccagatgagacatacaatgaggatggtgttgcattattccgcatccagggcactggaccagacaatatgcaagctatacaagttgaaccagttgcttcctccttgaattccgcttattgcttcatacttcatagcgggcccactgtttttatttggtctggaggtttagcaacttcagatgaccaggagcttgttgagagaatgctggatttgattaaggttgactcaaagagtagaatgcaggctctaacaattggcgagaagtttcttgagcatgattttctcctagaaggattatctcgtgaagctccaatatatattgtcaaagaaggtagtgagccacctttcttcactcgcttctttaaatgggagtctgcaaaatctgcaatgctaggaaactcatttcaaaggaagcttgcaatcgtgaaaaatgggggtacaccacttatggttaaacacaaacgaagagcatcagtaacttatgggggaaggtctagtggtgccccagataaatcccagcgttcccgtagcatgtctgtcagtcctgatcgtgttcgtgtgaggggcagatctccggcctttaatgcactagcagctaattttgagagctcaaatgcaaggaacctttcaactccacctccgatgattagaaaactttacccaaaatctatggcacaggatacagcaaaattggcaactaaatcttcagccatagctcatcttacttctagttttgaactaacatcagcacgagaaaatttgattcctcggtcacaaaaagcgagttcagttacccccaaatcaaaccctgagacaagtgatgaggagggttctttgagcagcaggatagaatctcttaccatacaggaggatgcgaaagagggtgaagctgaagacgatgaaggtctcccagtttacccgcatgaacgcgttaacacagcttctacagatcctgtagaagatattgacgtgactaaacgagaggcttatctgtcatctgcagagtttcaagagaaatttgggatggcgaagaatgaattttacaagttgccaaaatggaaacagaacaaactcaaaatggcagttcagttgttctga

SEQ ID NO: 99947 - DNA, 186 bp, Glycine max
  Peptide Sequence Number=SeqID_216725
atggccttaattaatctcatgtgcttaattaagtttaaccttataaatgatgatgtatgggaagaatatatgtgtagcttccttatcctcagtttgtcagatttatactgcaaggagagtagggcaccttattcttctcattcattgtgtcctgtggaagcttataaatatctaagagctgattag

SEQ ID NO: 99948 - DNA, 858 bp, Glycine max
  Peptide Sequence Number=SeqID_216726
atggatcttgagtctgtgatccacaggaacacaattaagcatgatcatggtggtggtgatgtgatgattgcaggaagaatcatggaagacggtgttgactttggcctatcaaagcttggggacaccaatgaagaaatctatggagtgttgtcttttgtgttctggacactcacactgattccactgctcaagtatgtgttcattgtgctgagagctgatgacaatggtgaaggaggcacctttgcactctactcattgctgtgtcgccacgcccgggttagcttgctgccaaacactcagcttgcagatgaggacttaactgagtacaccatggataatggaactgttcctgttgataagaaaaatgttgggttggggctgaagaacttgttggagaaacacagggtgctgcaaagggtgctacttgttcttgccttgatagggacttgcatggttattggggatggtgtgctcacaccagcaatatctgttttttctgctgtgtcaggattggagctttccatgtctaaagaacagcacagatatgtggaggttccagtggcttgtgtaatactgatatttttgtttgcccttcaacattatggtactcatcgtgtggggagtctctttgcacctgttgtcttgacctggctgctatgtatcagtgctattggtgtctataatatcttccattggaatccacatgtttatgaagctctctccccatattacatgttcaaatttctgaagaagacacaaaagggaggatggatgtccttgggtggaattctactgtgtataacaggttcagaagccatgtatgctgatttaggacacttttcacaattgtcaattaag

SEQ ID NO: 99949 - DNA, 1092 bp, Glycine max
  Peptide Sequence Number=SeqID_216727
atgaacacccaaaacctcatacccctaataatccttcttcttttcatacctttctcagtttcattctctcccacagataactttcttcttagttgtggatcatacagcaatgcttccctcttcaacagagtcttcatgggagattccaccaacccaggctccacttttctatcttcagatgattccatttcactcacataccaaaagccacctcagaatttgtctactttgtaccacacagccagagtttttagaagcactgcgaggtacaggttcaacatgaagaaaaacggcactcacttggtgcgttttcatttctcccccttcaaggctcaaagtacttttgatcttaaatcagcaaaatttaatgtcttccttaacggggtttcggtgttgagcaatttccaaccacctaatgatgtgctgctcaaagagtttattttgaagattgagtcaaacgtgcttgagattttgtttaggcctgttggtgaatcaggttttgcctttgtcaatgctttggaggtgtttactgcccctgtggattttgttatagatgttggagccagattggttggtccttctggggtggaggagtacagaaacctttcatctcaggttttggaaactgttcataggatcaatgttgggggtttgaaaataactcccttcaatgacaccctttggaggacttggattcctgatgaggattatttggtgtttaagggtgcagcaaagcctgcagtgagcactcacacaccaaattaccagaagggaggtgcaactagagaggttgcacctgaaaatgtttacatgacagctcagcagatgaatagggaaaactcaagtttggcttcaaggttcaacataacctggaacttccctgtgtctcctggtggtggtgttccacacttggttaggttgcatttttgtgatattgttagtcctgctctcaacttgctctactttgatgtgtacatcaatgggtacattgcatacaaggatcttgatttgtcagcccttacaatccacacacttgcatcacctgtctatgtggattttgttacaaattcagttgattcaggttttgttcaa

SEQ ID NO: 99950 - DNA, 699 bp, Glycine max
  Peptide Sequence Number=SeqID_216728
atggtaaaagtgatgctgcacatatacgatgtgaccaatgggtcggagagcaagaagagaaccattgttggcatcaacaacgtcttatatggcactattggtctcggtggtatattccacagcgcggttcagcaggtttatggagatgatgaatggtcatttggattctgtgagggaggagatactggagtttttagatgccctgcgggaaagaacacgatgtataaatatcgcaaatcatttgttctaggggatactaacttcaactttttccagattcctatgaccccttgtccaaaaactgcaaccacttctgtgatgaattctgtgcaaggctgggtgtggaaaaacttcctgtatattttgatgacaggctgggttaataggtttgctaacgctggtgatgttactagggaaagggttgagaatgcagcattacggttccggaaagccaaaacaaatattgtatcagcaagcaaagttgcataccggttcctctttggcggttttacaaaaaataatgttaaaactgatctggattcttcccctagaaaatccaatagaggaggaggatctcctagagttcaagctgttttgttgaaaagccttattagccgcaccaaaccattcaggtgtttaagctctagctggaaacggagtgagcttgagcctcaacaacaaacacgaaacaaaatatga

SEQ ID NO: 99951 - DNA, 279 bp, Glycine max
  Peptide Sequence Number=SeqID_216729
atggttaaagcagtgttgatgcgatgtggacatcagttatgtgctgggaagggtgtactggaatcagagtgtagctgtggggtgcagattgattactattcttgtgttggccttttcaggatgggcaagtgcaagggttgtgggcagataggaagaatgggaacaacaaatgggtcaatgagttcttatgaattttcgttgatgttgtctcctgttgtttctttttgggattgtatgttccgtaaaatgaggtattcctacagacctgagtgggtgtag

SEQ ID NO: 99952 - DNA, 309 bp, Glycine max
  Peptide Sequence Number=SeqID_216730
atggttcaaaggaggaagatgctaaggttttgggatgtgacgaggagccttgacgggtgccccatggtcgttaggaggaacattgatttggggaagaagggagtggagaagggttggtggagaaggtggcattttttgcgatggtgtgtggggttcttaaaagtggttcttgatggaccacttatcaaagtggttcaccctaaacactgtcaacaaaagatattaaattttgatggactaataaaatttactgagttaaatttttttgttcttggcccaactgagctaggactaagtgagctagactaa

SEQ ID NO: 99953 - DNA, 174 bp, Glycine max
  Peptide Sequence Number=SeqID_216731
atggtcctgagggaagcccggtcgaagatattagcgaataaacaagagggaatgaaattttattgtgacccgaacctaaagcaagtggtacagtttgcaaagaaaatggagaagatcacgcgaaatgttggtgcggattcaacagttccatgtggaaacccaagtgcgaaataa

SEQ ID NO: 99954 - DNA, 489 bp, Glycine max
  Peptide Sequence Number=SeqID_216732
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccatattagaccctccaagataaggcaaggaagagctacctacgtggcatcacaaaaccccaatacttctgctccatgtaagaccccaactcgattctcatcacacgtggcacgtgcgacgcttcagtattatttttccgtcattgtcatggggatcctctag

SEQ ID NO: 99955 - DNA, 273 bp, Glycine max
  Peptide Sequence Number=SeqID_216733
atgtcggcagcaaatgaaaaagatgccgatgtcggcggaaacacaacttcggttgagctcgaacgaaaaaacctaatcacctacattgaaaatattacaggcgaaaccaagaaaaaaacatcctttaccttaaacaaatattatcggccagcgtatgtaagaaagattgcgcaatgtcggctgaaaaatatcaatcgcggcttcacaacgaccgatgtcggctattgtattttctattcaatccctgacaaatatttggatgatgtctattag

SEQ ID NO: 99956 - DNA, 516 bp, Glycine max
  Peptide Sequence Number=SeqID_216734
aaccccattaaagctcaaagatcgagcctccatagaagccccacaagcaagcttccatcaagtggtaatcagagcacaagagaactacacgccctcgccttcaaaggactacacgtcctcgccatcagagggctacatgccatcacctttagaggactgcatgtcctcggcatcagaggactacatgtcctcactgtcaaagagttgcacgccctcaccttcagagggctacatgtcctaacctccagagggctacacaccctcaccttcgcaggactacacgtcttcgccatctgcgggctgcacctcctcgccatcagaggacaggacgtcctcgccatcgaagctgcacgtcgtcgccatcagaggctgcacaccctttccatcagaggctacacgtcctcgccatcagaaggctacacgccctcgcctttagaggactacacgtcctcgcctttagaggactacacgtcctcgcctttagaggactacacgtcgtcgccatcagaagcatga

SEQ ID NO: 99957 - DNA, 606 bp, Glycine max
  Peptide Sequence Number=SeqID_216735
atgtacaaccgtgtcttttctatgcaggattcctttgaggagcaggcgacacagggatccttcgtcccccatggacagcaccctggacgtgtccgtgctgctggagccggggtcaccatcaagcaatacttcggatcggctccacgaacgtctcacagctcatcctccttgcctcctgaagaattgcaacaactgacccagcaaatcagggaccagttagaggagtcgatcacagaaaaagtgactcgacaactcatggcatcgttcagtcagatgcagtcccagattcagtctcatatgcaatctcagggacttgcactacctcctaagcctctggttggtccctcaggtcctcatgtaagcacaaaggggagttgtgttgatcccttaggaaacgatcctgagacaggtgactcaaataggtgcggcttgtacatcaaagcaaatcctaactgcctgattgccttggggagagtttatgagggatccactattgttcataacactcctttgttgcctggccaagtaaaggtgggtgtggaggaggttaaagatgcagatgctccagttcctgtacccactgatgaggtttccttagtggggtag

SEQ ID NO: 99958 - DNA, 351 bp, Glycine max
  Peptide Sequence Number=SeqID_216736
atgaagctgtgttcacaggtcattggtgcgatctccttagttcttatattgggatcactaaatgtgaaagtagtagaatgcaaggtaggcagaggattgaaaaacactgaatattatgccataaattgccgaaagcatagtgcagttttgacagattttggtggagttggtgatggcaaaacatccaacacaaaggcctttcaatcagcaataagaaaactcggccaatatgcatctgatgggggtgcacaacttattgtgccacctggaaaatggctaacaggaccttttaatcttacaagccatttcactctttttctccacaaggatgctgttattcttgcatctcag

SEQ ID NO: 99959 - DNA, 1161 bp, Glycine max
  Peptide Sequence Number=SeqID_216737
atggcatgggttaagcatcaaatccggcaaaaagatggttacttgagctactcaccaccccttttgtcttcatctttttcttcacctccataccctcttggtgctactttccacaaggattcatcattgccttcttcaacaccaccaccaccaccaccatcatctggcactagaattagtcctgctgttctattcatcatagtggttcttgctgtcttgtttttcatctctggcctcctccacctgcttgttagatttctcataaagcacccttcttctgcatctgctcaatccaacaacagacaccaagaactttccacatctgatgctcttcaaaggcagcttcagcagctcttccacctccatgactctggcttggatcaggctttcattgatgctcttcctgttttccagtacaaggagattgtggggttgaaggagccttttgactgtgctgtttgcttgtgtgagttttctgaaaaggataagctcaggttgttgcctatgtgcagccatgcctttcacataagttgtatagacacatggcttttgtcaaactccacatgccctctttgtagaggaacacttctcactcaagggttttccgttgagaatcctatatttgacttcgatgatcttagggaggatgagatgtgtccttggaatggggagaatggattcaatacccggcagaaaacagttgtggttgaagaaagtgtggagaaagagaaaggtgttttccctgtgaggcttgggaaattcaagaagctaagtagtgtggaggggggtggggagagtgaagtgggagagacaagtagcagtaatttggatgcaagaaggtgtttctcaatggggtcttaccaatatgtggttggaaattcagacctaagggtggctttgaaccatgatgaaattagtaaaggtcaagtcacaaggctcaacaaaggaatggaacttgatgatgggaagctttcagtggaggatgtggaaggaaagaagattagtagtgtcagtaaaggtgacagtttttctgtgtccaaaatctggttgtggccaaagaaggggaaattgcctacttctttggatggtcaaattggcatgccaatgccatcttttctaaacacagattttccaaggatgagggatacagaaggggcatga

SEQ ID NO: 99960 - DNA, 348 bp, Glycine max
  Peptide Sequence Number=SeqID_216738
atggctccagatagaacacaacaacagaacatgtgtaaaaaagagcatgagtcattcaaggaatacgcacaaaggtggagggatctggcagctcaagtagtgccccaaatggtggaaagagagatcatcacaatgatagtagacacattactggtgttctactataagaacatggtgggttacacgccttcaagttttgccgatttagttttcaccggcgaaatgatcgaagtgggtctgaaaagaggcaaatttgagcatcctactttgacaaataaaaagcctggggcaaatagagaggatgagaaggagaaaggaacgcatgttgtgactgtcgttcctacatag

SEQ ID NO: 99961 - DNA, 390 bp, Glycine max
  Peptide Sequence Number=SeqID_216739
atggcaagaagatggtctttttacatggatatgctgccagttttggtgattataggcaaccaattaagtttggtagcattagtcacactgttcaaagaagccacgctgcaagggatgaacaaccatgtctttgttgcttatacttctgctgttgctgccactctactctttcctatcacttttttcagaagaagatcaagagtggttcctccacttagtttctccatagcatccaaaatcatgttcattgggatgataggaacctcatctcagataatgtattatgttggagttagctacagttctccaacacttgcttcatcaatcgccaatctgggccctgctttcaccttcattcttgccatcattttcagtttttttcctgcatga

SEQ ID NO: 99962 - DNA, 180 bp, Glycine max
  Peptide Sequence Number=SeqID_216740
atgtggggcaaagcaacagaggagatagaggaagatgttggtagcctggagtcaccaactacagagaatgttcctatattccaaatccatgaaactataaacggctataagggtcaaaattgtggtttcactgtcttttcttatctcctttcactatcaaggaaagctgttaagtggtga

SEQ ID NO: 99963 - DNA, 270 bp, Glycine max
  Peptide Sequence Number=SeqID_216741
atgagacagttccggttgccggtgaatgcggacttggagaaggttacggcgaggcttgaaaatggggtgctgaggatcacggtgggcaagtttggtgaggacaagaagaggcagcctaaggttattgacattgctcagagggattctgctgctgagaatgtgaagcccaccaagcctcaaattttacaagttgtaagttgcatcttcactttgtttgggacatgggatttcagtgatgatgtgatgttgtttgtgtctaatagtttctag

SEQ ID NO: 99964 - DNA, 138 bp, Glycine max
  Peptide Sequence Number=SeqID_216742
atggtaggtcctgctttttaccctctagcttcaacttcttcatttcagattcacacacaccttcctaacttccttggccgacagcaaggttgcgatgtcgtgggcatgcgtgtcccccaaccttccataagggattaa

SEQ ID NO: 99965 - DNA, 180 bp, Glycine max
  Peptide Sequence Number=SeqID_216743
atggctcagagctctaagaagatggatctggaagaactggagttgctagagcaggagggagaggagagggattcaaaggtcagagaatcagatgtgactcctcgggccttgcataaagcaataataagggctggaaaacctagcctcgaggagtcatgttgtgcgatgagagaaatctga

SEQ ID NO: 99966 - DNA, 213 bp, Glycine max
  Peptide Sequence Number=SeqID_216744
atggcgataacaaggagaaagagcgagaagctgcaaaagaatgatgtgttaaacatgttccatattcagaatattaacaggaatctagatgataagataaagcaagagtttattcaggttcacttgaataaattgagcaagtgcttacactttggaggagttgcactggctgtgggagtatcatctcgagagatcaaattcttcagagtatga

SEQ ID NO: 99967 - DNA, 252 bp, Glycine max
  Peptide Sequence Number=SeqID_216745
atggggttagactttggtgacttaaaaaggcaagctttgcttcaaaaacatgcttcaggggcccaaaaaggagagaaaaaggtgagggcagagccggtatttcacacaaatttgacaaacggcaacatagtgacgctatcagacacatacttgtctttcgaaatcgacattatttgcttgaaattaccttgctgccctcaaaaagttttttctatagttttccattgcagagtaccgttgaagttgaattga

SEQ ID NO: 99968 - DNA, 540 bp, Glycine max
  Peptide Sequence Number=SeqID_216746
atggccaacaacttttataacaatgcacaattctctaaactttataacaacccagacccaaaaggatgcaagttgtgcaaccaagttttcaccaacactcaggcccttctaacccatgttgagtctcacatggcacaagaaaaggatgtagttagaaggcttaattcatcaccacctcaacatgtcaattctcaaatacaattgggttcacatcaattcccaccaccacctacgatggatgatatcaggattttccaatcacaatcacaacttatggggatgcctcaaccaattagtagaaacccatttttcaattctaaccaaattggttcatcatcatcatcatcaatgccaatcaggaaaatgcaagttctaccacatgcttttccttatgttgggaatattaatggtgatggctttaaggcatttatctcaaatttggagaaacccatcaagaagattgatttcattgatttggttaacgtggatgatgacaacaactcagacgtggaagtaatggatttggatctaaagctctag

SEQ ID NO: 99969 - DNA, 219 bp, Glycine max
  Peptide Sequence Number=SeqID_216747
atgacaacaataacgacaacgacaatcataacaatgaaggtagtggcgattgatgatggggtgacgacaataattaggatagtggttacaaggatgatcatgatggtggcaaaaataacgattcagggtagtgacaacaattacgatagtggctgcaaggatggtcataatggtggccgcaacaatgacgatcatggtgacgaaagcagtgatagttga

SEQ ID NO: 99970 - DNA, 720 bp, Glycine max
  Peptide Sequence Number=SeqID_216748
atggagactgctgtaaaatcatggcatgaaacttcttcagtggatgctaaagtttactttcttcttgataaggaaaagacagacaccgataagtatgccccagttgtgaatattgataaggcctttgaatcaccacatacacatggcaactgctttgcatttcttaggcagtatgctgaggagtctttctccaaagcagcctgcttggtgactcccaaaaacatcattgcttatccgcaggacaaaaatgccctctccctcaacctctttgatcctcttcctcttcccctccctcctccttatgcccctattactcctcccctcacctctccacctcctccatgcgttccctcctactctaccctttccccctcaccctctgcacagagctcgaggtctttgaaaggagttggcacagtcgtgaggttgatgtatgacacggtgtggtggacctttgacagactcacggtggtggatgcatcatcgtcttcattgccggcgattagatctggatttggtggcagcgccgattgggtggcgtgccagtggtatggtggtggtttggttggtgatggtggtggtggcggtgttggtgtttgggctgtggtgttttgtggagcagtggttatggagaaagggagtagggatccagaggttttggacattggtgctcatgaagttcttccccggttattcaaagaaaagcagccccgttcttag

SEQ ID NO: 99971 - DNA, 576 bp, Glycine max
  Peptide Sequence Number=SeqID_216749
atggcagagacgaaagaaggttcaggttcggagatgtctctgaaggatcagggcaacgagtttttcaagtcaggaaagtatctcaaagctgctgcactctacactcaagccatcaagctagacccttctaaccctaccctctatagtaatcgtgctgcagcactactgcaattggataagcttaataaagctctagatgatgcagagatgacaatcaaattaaaaccccaatgggaaaagggatatttcaggaagggaagcatattggaggctatgaaacgatatgatgatgctttagcttcctttcagatagcattgcagtataacccacaaagtcaagaagtatcaaaaaagataaagaagataaaccaactggtgaaagatagcaagcgagctcaagaagtggagaatatgagatccaatgttgacatggccaaacatttagatacattcaaaactgaaatggaaagggtaagggagaaagagaagggaatatggtattcatggagagacacaaaaaggagggagaaatacagtagaaaggggggacaagtacacaaggaaggagaaacataa

SEQ ID NO: 99972 - DNA, 795 bp, Glycine max
  Peptide Sequence Number=SeqID_216750
atgacaatcctttgcgccgcgcggctttacgcgacatgggcaaagggaaaaatacatcgctacctcgacgccttttccctgccgggaaacattttaaatatcaggagaaaggttccagtgaaattcgcaaaaggtatcacccttttcgcactcgctctcagtgcgcacaccgcgtttgccgccgaacaatccgtcccaaccgacagctcactgcatgttcaggctgatgccgcgctgaaaagcctggtgcccgccgacgtggcgaagcgcggctatattgtggcaggaaccaaccccaacacgccgcccaccaccttctataaagaagacaacaaaacgctggccggccgtgaaattgacatcatgaacgcggtcggtgagcgtctcggcattcaggtgcagtggcgtgacaccggcggcttcgacaacatcattccgggactgaaaaccggccgctacgatgtggccttgtccaacatcaacgccacgccggcgcgcgccaaaattatcgactttgtgagttactacgacgccagccgtcttggcattatttcgcggaaagacgccaacgtcgcgccgttcaaaaccctcgacgaggtgtgcggtaaagaagtcggcgccggttccggcaccactcaggtgacccgtctggaagaggccagcaaagcctgtgaagcggccgggaaaaaaccgattaaagtgtcagtgttcccggatcgcccggcgggtgttcaggccgtggtcagcgggcgtgtgccgatgttcctcggtccgtacgaaggcctgttgtggcag

SEQ ID NO: 99973 - DNA, 594 bp, Glycine max
  Peptide Sequence Number=SeqID_216751
atgtggtctgcagtaacagatcccattagagctttttttgcaaattttctccgccatttcatccacaaagacttccatgaagcagtggccagaatgaccataatagatgctttcctattcgttattgtgcactccattgataagttggggatatggccacgcttgccggttttcttagggctattgtacctggcgattcggcggcggcttcatcaggagtacaacctcttcaacgttggaacaacaccggtgggggttaggtttaaccattctgattttccatacagaacagctgatggaaaatataatgaccctttcaacgaagttgctggcagccatgggactttctttggcagaaatattctccctgtggatcagaaaaaaaagctattgaaacctgatccaatggtggtagccacgaaactacttgctaggaggacatacaaggatactggaaagcaatttaatgtgatagcagcttcttggattcaatttatgattcatgattggatcgatcatcttgaggacacaaaccagaatttttcaagtcttatatacatctcacctagtcaaacacgtcacacacaagtgtaa

SEQ ID NO: 99974 - DNA, 357 bp, Glycine max
  Peptide Sequence Number=SeqID_216752
atggcggagaagggaaagttggatcatatagaggaaaggcttggagccgttgaagggggtggaagttatgcttttgctgacatagaggaattgtgcttagtgtctaacttcaataagtacaaggggactacttgccccaagaaccacctgaaggtgtattgcaggaaaatgagggcatacacaaaagatgaaaatttgttgatgcatttctttcaggaaagtcttactggggtagttgtcacctggtacactaatctggaaccttcccgagtccattcttggaaagacctaatggttaccttcattaggcagtatcagtacaattctgatatgactctggataggacgcagctatag

SEQ ID NO: 99975 - DNA, 330 bp, Glycine max
  Peptide Sequence Number=SeqID_216753
atgaagacccttagtctagtacaagctgctgccattgctgcagaacgcagattacagtatgagatatgttgtggttctcaatctggtggtgactatgaagttgccaagaacattgtgcagcataaggggaaaaatgtaagaagttcaagtttacctgttaactcatcatctagtactcctaattttgtagatttgactatggatacacacaaaattggatctaaacgacgaatatgccgtggatcagaaagcacttcacattctcaatgcaaatcaagtgtgtcatctagtgataatagaactcttcattctgaagaatctggaatgtga

SEQ ID NO: 99976 - DNA, 147 bp, Glycine max
  Peptide Sequence Number=SeqID_216754
atgcagaacaggcttgtgagacttgtctgtgtttttctgcaaagcctcattcggaacaatattattaatgttatacaattggtgataagcggaaggtgtagaaatagcatacttgaacaggttcagaatttgtttaaactgttgtag

SEQ ID NO: 99977 - DNA, 408 bp, Glycine max
  Peptide Sequence Number=SeqID_216755
atgtttggcacaaaactagcaggtacattggactactcttgctccaaagcccctgcccctgttcaagaaaagtcaacaaaatccaatgagtcgatttttgatgcttgccactggattgattgtggtggtggctcatgcaacaagacatccaagttctcctatagttgtgagtgtgatgtaggctatgacaacctcctaaatgtcactaccttcccttgcttcagagaatgttctcttggcttgggttgctctgaacttggaatatcagtgaaaaactcatctacttctgcaccaccgactttgaatgataacagcaagaatgaaggtagctcaattctacaaggaaattcccttcggctggtcatgctaattatgttcgtggcaaagctccatttgcaaataggataa

SEQ ID NO: 99978 - DNA, 326 bp, Glycine max
  Peptide Sequence Number=SeqID_216756
attacgatcttgatttccttgtaatccagcaagtcctggtggagtttgcaaatgatccaaaacttgtatatcactgtggactgacaccaagaaagttgccagacctggtggaaaacaatccccttattgcagttgacgttctcactaagttgataaattctccagaaatagcagaatactttacagtacttgtcaatatggacatgagtctacattcaatggaagttgtgaacaggctgacaacagctgttgaactaccatctcaattcattcacatgtacataactaattgtatagcatcttgtgtgggcatcaagattgtgtag

SEQ ID NO: 99979 - DNA, 472 bp, Glycine max
  Peptide Sequence Number=SeqID_216757
atgttccagccgcatactattttagatgttgatggttttcccgtctatcgtagaagaaacaacggtaatgcaattgagaaaaatggtgttacagttgataacatgtatattgtaccttacaatccaagattgctcagaaaataccaagcgcatatcaatattgaatggtgtaaccaaagcacttctatcaaatatttatttaagtacatcaacaagggatatgatagagtgactgttattttgattgatgaagataacgatcaaactgagaatggtggcactcataatgatgagatcaaagaatatctagattgcagatacatatgtccctgtgaatctacttggagaatctttggatttccaatacatggcagaaaacctgctgttgaaagattacacttccatcttccaggccaacatagtgttctctatgaagaccatgatgatattgaagatgtactgtctaagccaa

SEQ ID NO: 99980 - DNA, 678 bp, Glycine max
  Peptide Sequence Number=SeqID_216758
atgcctgttgagataaggataatttcttggctacaggcttcctgtaatgaagggtcagaaaaagttgagagggcatttattctacagctactaggtctcaatagctccaacagtgggaaagagtggtttgtaatttctgaggtgttttcttttcctggaggattgcagtttcttaaacagtctgcatcagattatgtgaaaggatttgatcagtcattacatgagttccctccactagatcaattgaagcagcagttttctgataaagttcatctagaactataccattgcttatttaaagatggctctgtaaaaaatgtagtccccgacccagatgttcccccaagttgtgatgcagattctgtagagtttgatttgcgacctggaacaaaacctaaacatggtgccggagataaagatgaggcactagttgggttgttgtcaaatctttcattggaaggattaagtcctcactggatcagaccccttccaccaaggctgccgataattgatggggagctagtttggctcaatcctgatgacaatcatgaacttatgtgggactatggtatgtgtgttgataccagcagaggggctgcagtaagggacttaattgcgaaagctctgaagggagcccttgcacctgcacagcaagaggtgattattgttattatttga

SEQ ID NO: 99981 - DNA, 561 bp, Glycine max
  Peptide Sequence Number=SeqID_216759
attgcaatgagaagacaaatgggatggataggtcaactgaaggagattgccatgagaagacaaatggaatggataggtcaactcaagaagattgccatgagaagccaaatgggatgaatagatcaactcaagaagattgccatgataagacaaatgggatgtataggtcaactcaagaagattgccatgagaagtcaaatggggtggatatgtcagctcaggaaggtgatgacggggctagggacaagattgacgtgtgccttaaagagaattgttttgattctgccagggatgataaggatattcttctacctgaagatgccaatagtaaagagatgagagctgagtctaagttgagtgggcctttgaaagaactattagataataatgcgactctaaattcattggtaccgtctaatgctgcaacctgtgagccgcccagtggggcgtctgaaagggttcagtctgaatcgtgcatggaggagacatcacagaagtcagggtcaagggattccataataaatgaaaatttgattaggaaatgtgttgagaatgataagg

SEQ ID NO: 99982 - DNA, 387 bp, Glycine max
  Peptide Sequence Number=SeqID_216760
atggtgaatcagccgaataagctctgggttgaagttgtcaggaacaagtattgcaaaaacaaccctttcttgcatttggagaaaaagaaagcttcaaaaggacccattgatttggttgaaggaggaagctatgggctcgaggcaagctcatttcctaacagacatttggagcatttgacgatcaattcaaggaactcatttttctttgatcataagcatactaccattcaccttgctgaggtgattattgtgtgcttccattttgatatggagcaagagccaaggcaaacactggtagatggcaatagaccaggccaatgtggtcaagctggatttggagataaagattggatttcaaggttcaatgggagtttgggagatgcataa

SEQ ID NO: 99983 - DNA, 811 bp, Glycine max
  Peptide Sequence Number=SeqID_216761
atggcagatcttgctagctttgggagtcatgagcgtgatgttgagcaagcattcattactttaaaaaagggcactcagttagtaaagtatagtcgaaaagggaagccaaagctttgtacattcaggctctcatcggatgaaacgaaactgatttggatatctcatggaagggaaaagaatctaaaattgtcttctgtttcacacatcatcccaggacagagaacaatttgcaaggaccaagctgaggtagaggtatggttttcaagccttaaggcattaatttcccgtggagagcgtattaggcgtggaaaaagtgatttatccaatgaaagtgttgacttaattccaaatgatcgtcctaatgctggaacactagagtttgcatcaagcattgcccgtggcaggttttcttttgaatcagtatctcatgaatctacatcatcttgctctagatcagatacaaatatgccagtaaggacaagttgtggagatggttctcgtgttagtgtatcaagtgttagccactcaagtagtgtaggatcaggactagatgacatagaatctctaggtgatgtttatatatggggagaggtttgggtagatggcaattcatctgatggattggggagtctagcctcttgtaagaccgatgtgctgactcctaaaccattggagtctgatgttgttcttgatgtccatcagattgggcctggtgatcgtcacattgctctagttacaaggcagggagaggtttttacttggggagaggactctggtggaagacttggtcatggatttgaaaaagattttg

SEQ ID NO: 99984 - DNA, 297 bp, Glycine max
  Peptide Sequence Number=SeqID_216762
atggcagcgtacaccaccacaccccgaccacaacatttggtcaatggcacaagacatggttcaagccctcagcgtcggcgagcacctccaccgcgtgatggcaacaagtctggactatgggtaaccaaaaggatggacatggaatactgtttcacacgttatgttgtagacctggtcaatgagagggttgttcggattgatctgttatcatcagcccataacaagttctggaaggaaatagaaaacagagttcaagtgttcaggaagaccattcgttacaatgctggtcaagcgtga

SEQ ID NO: 99985 - DNA, 195 bp, Glycine max
  Peptide Sequence Number=SeqID_216763
atgtcgcgaccaggaatagagagggtagtgagacgtttccagatgttctttcaccggttggacaagatgcaagccccaacagcatcttttaaaaaatacactcttgagaagaaactaagagcttttgacgtgactgagtcccagattggaattagtctcatggccaaccaaaaactccgaagtttgtgggggtaa

SEQ ID NO: 99986 - DNA, 624 bp, Glycine max
  Peptide Sequence Number=SeqID_216764
atgtctcgcaagaggctaggaaaaaagcttcaacctgccaagaaggcatggaagagcttctccaacacagtccaacacaaactccacaaactcaacatccccaagtccatgaaaaccacccttcaacgcctcctctcagcctttcactcccttggccatctcatacactctagacttcatcgctcactcaccactataaggccacgtggtgccacttctaattactaccatgctcaatacaagcactgtgcagccatacacatatatgacctctttgaccacaaggctaattctgtgtccatgcatgccaccaacaaggcaagtgctcgtgcaacacaagtgcaaggggaaacaagcaaaggcaaagagaaagaagagcatggtatttacaagggtaataattttgttggtgagtgtcgcaaccagcagggtcacggcggtgagagtagtagtagtggcttgaacaccatagaggatgcatggaaggttgtggttgccaagtctccacaactacacgtggatcaaaaggcagaagaattcataagcaagtttcgtgaagatatgaggcttcagaaagagaggtcaatgcttgaatttcaggagatgctagcacgcagtacctga

SEQ ID NO: 99987 - DNA, 2190 bp, Glycine max
  Peptide Sequence Number=SeqID_216765
atggtgcaggacttcttggtcatggcactgattggtcctttagagggacttcaggttgtatctgtagcatgtggaacatggcattcagcattagcaacctccaatgggaagttgtttaccattggtgatggaagatttggtgtattgggccatggagaccgagatagtgtggcatatccaaaggaggtacaattattgagtggacataaggctattaaggttgcatgtggagtgtggcactcagcagccattatagaggttatgggtccttctggttcaaacacttcagccaagaggctcttcacatggggtgatggcgaccaatatcgtttgggtcatgttaacaaggaaacttaccttgaaccaacttgtgtagctgcagttgctgagtataattttcaccaggttgcatgtgggtacactatgactgttgcactcactacatctggtcatgtttttactatgggaggcacagcatatggtcaactaggaaatccaaattctgatggaaaagtgccaattctagtccgaggtaagttagtaggagagtttgtggaggaaatatcatgtggggccaatcatgttgctgtgttgacttcaagaagtgaattatatacttgggggagaggtgccaatggaagactaggacatggagacacagatgatcagaaatctccaacaatggtggaagccttgaaagacaggcatattaagaacatctcatgtggttcgacctttacatcttgcatatgcctacataaatgggtttctggagttgaccaatctgtttgctctgattgtcgacaaccatttggttttacccgaaaaaggcgtaattgctatcattgtggattggtgtattgccatccttgtagttcaaaaaaggcttcaaaagcagcactggctccaacacctagcaaaccacatcgtgtgtgtgatgcttgttatgctaagctaaaaggttctgatagtgcttccaattttaatagggacattagtcgtccatctagttccatatatggaagggaaagttttcaccggggagaggtaaggtcttcaagagttctcttgcctcctaccatagaaccggttaaataccttgagattaggactaataagcctggaagtacacatgactccatagtccgagctgctcaagttcctacgagtttacaattgaaagatgtttcatttccaatttcattgagttctgtgcagaatgtttacaaacccgttatacagccaagtcaacctccaactccaccaacatcagctactccaatacccatgtcaccatatgctagaagaccaccaagcccaccgcgttctacctcccctggattttcaagaagccttattgataatttaaggaagaaaaatgatcatttgaatcaagaagttacaaaatggcaaaacaaaaatcaaaatttggagcagaagagtgacatgcaagatatgaagattcaggagcttcagaaaaatattgaagaagccatgtcacaatttggagaggaatcttctaagcttagagaagcaaaggaatttattaagtccttggcagataagttgagggaagtgactgagaagttgccacctgagattcctgacaaagagaccttgagaaccatgcatgctcaagctgaagaatttctacatgaagaaaaagattttgaatcttcttcctccccacagagccttgagtctgagcaacaaagtgcacctgatgtacctgcctcagatagtgactcttcaaaactccaacagcaaagagtggaaggaaatgatgatgcttctggggttgttccatctatagatggagaaaatattcttgaagaaagcagcaactcatctgtatctagtctagtagtgattccaccaagctcaggaaatggttcaaaattgcatgactctggtatacctgtgaaagaaggagaaaaatcagtcattgaacaatttgagcatggtgtttatggcacactcgtagtactacctagtggttacaaagttttcaaacgaattagattcagtaaacgaagattcaacgagcagcaagcagaagaatggtggaaccagaacaaagataaggtgcttagtaaatacagtccaccagccacaaaaaattcaaaaactggatcatctattacccctccacatgctgaagagaatagtgaggctttaccttcttcctaa

SEQ ID NO: 99988 - DNA, 156 bp, Glycine max
  Peptide Sequence Number=SeqID_216766
atgaagaaagagagaaaccaatatatagcttttaaagttggataccttatggagattgctggaccaacattacaaggatggtatggtggttctgttatggcttttgcttttggggcagtaaggattggttcagtgccagcccatggctacaattga

SEQ ID NO: 99989 - DNA, 843 bp, Glycine max
  Peptide Sequence Number=SeqID_216767
atgtcgcgccgttcgctcccgctcaatgccattgacgcattgttagtcaccgcgcgtcatcggaatcttacgcacgccgctgcggaactttcccttacgcagggggccgtcagccgcaagatcgcctcccttgaggcgtggtttggttttccgctgtttgagcgccacgcccgcggcctgcgcctctcaccgcagggcagcgccctgcttccggagctgcaatccactttcgaacagctgctgaccgtggccgaccaggcccgtagccagcataccgtgatccggcttaaggcccctacctgcgccatgcgctggctggtaccgcgcctgctggaggtggagcacgcgcatccggatctgcagatcgcgctgacgaccaccaccgatcataacgtcaatttcaaaaccgaatcttacgacgcggccattgtgtttggcacgcatatgagcgcaggcgatctgctgttcgaagaggcgctcacgccggtcctcagcccggtgcgggcaggtacaacgctgggttcactgacgttccttcacccgacgcgggataagaccgactggtcactgtggctggcgaagcaggaaggtcacgggtttgttatgcacaaaaatcaacacttcgatacgatggatctcgccattaccgccgccattcaggggctgggcgtcgccattgccgacgaaacgctggtggcagaagatgtgggtgccggaaggctgatgcggccctatgagacaagcgtaaaaaccggcgcgagctaccggctggtactgcgcgaaacgcctgacgaagaaaatggtctggcggcgtttcgcgcctgtttacttaatcgaggctga

SEQ ID NO: 99990 - DNA, 417 bp, Glycine max
  Peptide Sequence Number=SeqID_216768
atgactttacgaacgccggtacagacgcgctccaaactgccagatgtgggaaccaccattttcaccgttatcggccagctctcggcgcagcataacgccattaacctttctcagggcgcaccgaatttctcctgcgacccgaagcttgttgcgggcgtcactcgcgcaatggaggcagggcataaccagtacgcggcgatgaccggtctgcagccgctcaaggagcgtattgccgataaaattgccaccctctacggcacgcagtatgacccgggccgcgaggtgctggtgaccgccagcgccagcgaagggctctactcggcgataagcgggctggtgcatccgggcgatgagctatgcgccaattgttcgtctgcagggggccaccccgatcgctatcaggctcacggtgcctga

SEQ ID NO: 99991 - DNA, 489 bp, Glycine max
  Peptide Sequence Number=SeqID_216769
atgccgtttccgccggcgccggtattgcctggctgccggagtggctgtgtggccctatatgccttaccaaccgctcaaagtgcggctggcggtggacaaactggtggcggagctgccgggcaggctgacgcggctcgcgtcggcctgagggtgtatgtggtggcaacggtccaagggacgcttgccgatgtcagagcgtgcgctgttgcgttgatcgtggcagtgacggagcccaaaaatgcggagaaaagcataaatttaagcatggaattggcttcgctgccggcgacgttatattgcgaacgaataagcttggatacgataaaaccgactaacagtatcgtccccaatattccgaagttagcaagtagggacagaggcagagaagatattcttgcgctaccgataccgacgcccaagccaaaggctaaaacgcggactgaaaatgaatgtgccgcacagcgacgtaagcagggtaaaatagcctga

SEQ ID NO: 99992 - DNA, 617 bp, Glycine max
  Peptide Sequence Number=SeqID_216770
acgaacaactgcgaaagcatttgccaaggatgttttcattaatcaagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggaatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaagtgcgactcccgggggcccggagacg

SEQ ID NO: 99993 - DNA, 447 bp, Glycine max
  Peptide Sequence Number=SeqID_216771
atggctttgaagtcgaagatagcattactcatcacaggcctgttggccatgctccttttcatttcctcagaggtagctgcagccaggaatttgaaagagggtgaggtagtaagagagacaaatagagttggtgatgccaaattagttggtggtattcatgatgttagcaaacttagcatcccaggcattggtgggaatttcattggtggtgttttcccaggcaatattggtgggggttacattggtggttccatcccaatcattggcgggggttacattggtggtttccctaacattggtggtggtggtggtttccctaacattggtggtggtggtggtttccctaatattggtggtggcttccaaggccaagcgttttgcagattcagctgttgtgttcaggatgcaatgggaagatgcttaaggtgctgctcaatctcaagataa

SEQ ID NO: 99994 - DNA, 312 bp, Glycine max
  Peptide Sequence Number=SeqID_216772
atgtcattgcctagcgctgttcatgtgtcctccattatcaagcgcgaagcctctggtgactgggaagcacgttattctgttaagaaaaaagaaggagtagagacgagagtcgtcatcacgaaaaggcagggcgaacgaaatcagtgtcctatctttgctttcctcttatctccgatgagagggggggtgcaaatagcaaccaagcccacttggaccctccagaagattcctccagaaggctgttgcttctggaggaagcaaccttgctcgcttgggcggcaagaagtgaagaagaaaaggacagcctcttag

SEQ ID NO: 99995 - DNA, 387 bp, Glycine max
  Peptide Sequence Number=SeqID_216773
atgagaatttttcgtagtgtcggtcggaagacctctgacatctccggaaagggtgcagacgctgacatcaccggaaagggtgcagatgctgacatctccgagaacggtgcaggtgacgacgatagccactgctcgctatcgcgctttgagttctacggattgcaaatgagactttttcgtagtctcggctggaagacgctgcatctccggaaaggtctcggccgaaagacgctgacatcttcgggaagggtgcaagtgacgacgttagtcactgcttgctatcgtgacgctcatatctccgaaaagggtgcaagtgatgatattagtgtcgcaacctacccttcggcgggagggcgacgcgagactcgcgggatgcgtgttccatga

SEQ ID NO: 99996 - DNA, 175 bp, Glycine max
  Peptide Sequence Number=SeqID_216774
atgttggataaacagggagttgtgtctccagcaaaacctgcagataggccggatcctgagttacatgaagaactgaatgcagagttcaaaacgggatgtctacctggaagtctacctgaatggaatgctttgaaaggagttgatgatactccacaacctaaattcaaggctgcag

SEQ ID NO: 99997 - DNA, 117 bp, Glycine max
  Peptide Sequence Number=SeqID_216775
atggtacttagggacggacacaagcagaggctaggatcacgatcgatagatcgtcatttcatgcccagcactggacaagcgggaagcgcagctgggggacaacctagtatcctttaa

SEQ ID NO: 99998 - DNA, 291 bp, Glycine max
  Peptide Sequence Number=SeqID_216776
atgagtcaaaaatttatttgtgatattgataaccatggctgcctcagtggtagtgtggatttggatctaaatcttgattaccatggcactctgaagggtttccttatatcacatcttgatttcacgcaacaattttccatggggatctggtgcctgctacaatatacggtggaaaggctgtggctcagtgatgacatggatgtagatctacccctccctcagacatacttgaacttcctttcattgcatcttgatttcacaacttcatcgcacaattctgtttggaggtga

SEQ ID NO: 99999 - DNA, 352 bp, Glycine max
  Peptide Sequence Number=SeqID_216777
gagaaaagagggaggtggttgccgcccagctcgcccaggcaagttgggttgcttccaccagaagatcgtgcaacaatgcttcctttcaacttccggcatgttgcggaacttcatggattgcctaacgattggtgttaagtacctcaaggcggttaagagaaggttgcatgccaccaaacaatggtccccggacgaaattaggaacatcatcatccggccggttaatatcccgaccagcggaacctgtcatttagaaagaaagaaaagatatcagaagcgtcatcaaaacttcagtgtcttgaaagcgataaagtgggacaaccacgacacttccccacgccatcgaacttga

SEQ ID NO: 100000 - DNA, 1482 bp, Glycine max
  Peptide Sequence Number=SeqID_216778
atggacatggttgtggctgggggtgctaagttcaatttgagaagaggcaatggttcttctcataatgttgtcaatggctatagcagtgatggagatctttgcagaattagcaaaagtgggtgtttttcgtcggtggctgaggtggatagagatccttcttgcgtttcattcaccactttcaacattctggctccgatttacaaacggattgacccacagaaccagggcctgcgagaaagtgacttcagagcattctggttggccaggaatgagaggattcttgattgcttgctttctgaatcatcttccattatgtgccttcaggagttttgggttggaaatgaagaacttgttaacatgtatgaggagagacttggggatgctggctacaatctcttcaagctcgcgcgaaccaacaatcgcggagatggtctgctgattgctatacgtaaagaatgtctaagagttatggattataaagagttgcttttaaacgattgtggcgatcgcgttgctcagttgttacatgttcagtcagctaccccctttgtacaaaacccaaaaggcagtgttcctcaagagtttctgattgtgaacacccacctgttatttcctcatgattcaagtctttgtgtagtgagattgaatcaggtttaccaaatattgcaatatgtggaattgtatcagagagaaaacaggctcaaacccatgcctattatactctgtggtgactggaatggaagtaagcgtggacatgtttacaagttccttaggtcacaggggtttgtatcatcatatgatattgctaatcgatacagcgacagttatgcagatgctcacaagtgggttagtcaccgaaatcataggggaaatatctgtggtgttgacttcatttggctttgcaatcccaaccaagcacgtaaacctttgaagacaagttgggctgaagctgtatttagtatactaaaagagttccaggcaagtccatcagcaatttttactaagcttcccataagtagaaatttccagttacgaaaagcatcagtgtctgaagatgacgcatttacctttctgaagggtgacaactatgctgattctgtgacttattttagtttttctgaagcactccgtcaggtgaagttagttggtgtgccttatggactatgctttcaacagttgcaagacctatggaatcaagcagatgttgatggaaatggtgtcatcgactttgaagaattcaagcagaaaatatggaattctacatgtccagagcatgtgttggaaaatgtgaatgggtgcatggaggatggtaacacagaacaggagcaagaagccattggttttaaggtgaagaatgcaatgctgtatccgcgtgaagtggagaaaggactatggccagaagattattctctttctgatcatgctagactcacagctgtgttttcaacagcaaggatgcgatgttctggcgtacaaaactga

SEQ ID NO: 100001 - DNA, 848 bp, Glycine max
  Peptide Sequence Number=SeqID_216779
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatctcggtgatatgcaacctctcggccaactcttctacctgaggcagcgacggcttaacgagcagagtcaggcacggacggttatcgcccagcaacaccgcgtgttcgaagagggggtccttcatgagcgaattctcgatcggctgaggcgaaatattcttgccgttaagggtgacaatgatgtctttgaggcgatcggtaatgacgagaaaaccatcttcgtcgatgtgcccaatatccccagtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 100002 - DNA, 228 bp, Glycine max
  Peptide Sequence Number=SeqID_216780
atggtgatactgtcatgcatagggacacgccaatttgactggcgagttccactaggtaggctcaggaggtctagctttgcaggagtcagtccatacagctttgcaggagtctgtcagtccatacagatgtgcagggttcagtgttcatcagtgcatgagggaaccgccaatacggatggcgatttgcattttgtgggaattgccagcgtggctggagagttgctttaa

SEQ ID NO: 100003 - DNA, 144 bp, Glycine max
  Peptide Sequence Number=SeqID_216781
atgtataggtcattgcctcttggtttggatcgaagacgtaatcgatactggcagttcacaacatctgctcaaaatgatccaggttgtggcaggatttttgtggagttgaatgatggtcgttggaagttgattgattctgaagag

SEQ ID NO: 100004 - DNA, 1146 bp, Glycine max
  Peptide Sequence Number=SeqID_216782
atggtatgcgaccagcaccggcgtcttgccgcgccgcagcgactggcccagcgcggccttcagggtcagcttgcgatcgggcaccagcgcgccgagcgcggtggcgcccaacgcgatgatgacccgcggccggatgtcgtcgagctcctgttccagccaatagccgcaagcggcgatctcggcttgcgccggcgatttgtgcatgcggcgcttgccgcgcagttgccacttgaagtgcttgacggcgttggtgatgtagaccgcatcgcggctcacgccggcctgctccagcgccttgtccagcagcgcgccggccgggcccacgaagggatggccagccaggtcctccttgtcgccgggttgttcgccaaccagcatgatggtggcgcggcgcttgccctcgccgccgaccgcttgcgtggcgttgcgccacaagccgcagcggcggcaatcggcaagcttgcgagggtgctggtcggggtcgatctcgtcgtccgcgtcatcggcggaccgcgggtgggcattcatgccgtctcctcgatcgggcttgcacgcaatggcgccttcaaggcgaggccgaaggtcaggaacggttgtccaccggcggcgcgccgggcgtggcccggcccgggtcccatacgtcctcgggggccatgcccggaggtatctggcggccggcgccactgcggttcgggtccgccggacggtccgacagggttcgttcgttttcaggcacgggcttgtgcggcgcgtcggcctgggagtcctggtgggagtggggtttggtgctcatgtcggcgtcctcgcaggcgtgtgctcgccgccacggcgggacgccgtggcgggcaggcctgtgcagcaagtgatgtgccgcgctatggcaggttctcgcgcaggatcacctggctgcggttcatctccaccccgctcatgggactgcgcttgtcgcgcacgttgcagaagatgcgcacgcagctcatcagcgcctcgaccgggctctgcgtgatgacggcgtccatggtgccgtcgatcagcagcgcgcgcgtgtccggcgtcaggccatggccgatgaacaccacgcgatgctgcaggccggcttccttgagcgcgcgcgccacgccgtcggaggcgccgccgatgttgtag

SEQ ID NO: 100005 - DNA, 636 bp, Glycine max
  Peptide Sequence Number=SeqID_216783
atgaatatcttgacggcacacgatcaagaatgggaaaaggagttaagtccttacaatcaatatgaagaagaaagaactcttaatcttgaaagtgtgtttgaagaattcagggcataccatgctagctcaaaagctaatcaaaatttaatgaaaaatcatgaaattcattttggtacgagctactcaatagaaaactttcaagggagaccagagttacaaccttactatcaaaatgaagtagaaagaggttccaatctggataaactattgatgcaattcatggaaacaactaaatcaactcaacaagcactccaaagtgtagaaatccaggttggtgagctggcagaagcagtaactcaatttatgtcaagacaagaaaaatcctttgtagaggttgaagctaatgatcttcttcatcaatggattcctttgcttcttggaagaggaatggcagcggaatggagaaggaagggagagaggagacgccacttcaaggagaagatgagtctagaagaagctcaccaccataggaggccatggataagagcttggaggaagaaggagatgaatgaagggagaggaagagaagagcatggaattttgtgctctaaaagagctctgaaatctaaagtttaa

SEQ ID NO: 100006 - DNA, 519 bp, Glycine max
  Peptide Sequence Number=SeqID_216784
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggcaaaacctgaggctggaaaattaatgattggtacagtggctctgttgattgcagccacatcaagtatattagttgtatgcttcttttactacctcccccttcctgtccctctctcacacacagttactaaaatttctgtcagcatgtatctgcaaaaatttggtgggaagataattgacattgtctcaagggaaatgcaaactccagaggagaaagatgaagctttgaatgctgttaagaacaccatactagaaatttttctgggtaccgagctcgaattcgtaatcatggtcatagctgtttcctgtgtgaaattgttatccgctcacaattccacacaacatacgagccggaagcataaagtgtaa

SEQ ID NO: 100007 - DNA, 270 bp, Glycine max
  Peptide Sequence Number=SeqID_216785
atgccggtctccccctgcggaagtatcagttggtctgtgctgtcccgacataggggtagcgcccacaagacacctagtggacccggaggagcccaacaaggacctaggatttccagctctggttacaggcctctggatcacgcctgcaagacactcagtggacccggagaagtccaacagggtcctggggtttccagctctgattatgggcctctatcagttctatggagtgcctgtcactcccagcaaggccatgaagccccctactaa

SEQ ID NO: 100008 - DNA, 249 bp, Glycine max
  Peptide Sequence Number=SeqID_216786
atggctaagtttgatcctgaaatagtcatggagttttatgctaatgcctggcctacggaagaaagggtccaagacatgcgctcttgggactttgcccagaccgcagtggggagacgggttcggatcatgcacaccagcatgaccactctcacgcaaatctggatgacttcgctctttagcaacattctccttagcgaccataactcggacctccccctgtcgaagtgtcagctggtctacgccatatga

SEQ ID NO: 100009 - DNA, 200 bp, Glycine max
  Peptide Sequence Number=SeqID_216787
atgtgtttgttgatgccctatctcttccgactccaatgagaaagagggcggcttatcgttatgggaatgctgatccaaataggggaactcggaatcgaatcaccacatcctcataccagaacttcgccacctctctggccatgcctcaccgcccttgcttcgacccattagtctcagcagtcttcggtagcggggagtga

SEQ ID NO: 100010 - DNA, 153 bp, Glycine max
  Peptide Sequence Number=SeqID_216788
ggaatagaagagaagactaccaagttgaaaggaagtgagaaggctctagttgcacggcatgaagttagtcatgctgtagtaggtactgcagtagcaaaccttcttgctggacagccacatgttgaggctctggttatcagactcctggtttaa

SEQ ID NO: 100011 - DNA, 141 bp, Glycine max
  Peptide Sequence Number=SeqID_216789
atgggggattcagcgacgtgctcgaaattgaatcttgaaaatggacacgacgctctcaccaaccatggaaatagctctgctctagtcatgaatgctaagaaaggcctacgagtcccccgaactaaccgaaagtgcccttag

SEQ ID NO: 100012 - DNA, 261 bp, Glycine max
  Peptide Sequence Number=SeqID_216790
atgaaagccaacaaaacaagaaatgaattgaaagcctcacttcgcctatttataggaaaaggaagaggttgccgcccagcttgtctaggcggcctggttttcggaaattttacagaagcattacggaagtccgggaagccccggaagccattttttaacaaaacgagggaggtggttgctgcccagctcacccaggcgagctcagctcttctaggcgaactaggttgcttccaccttaagcaaggaaatgccgagatttga

SEQ ID NO: 100013 - DNA, 279 bp, Glycine max
  Peptide Sequence Number=SeqID_216791
atggaagaaagggagaagttggatctcatagatgagaggctgagaaccattgaagggatcggtgattatccattttccaacatggtggacttgtgcctagtgcctgatgtcatcatccctccaaagttcaaggtgccagatttcgatatgtataaggggactacttgccccaagaaccacttaaaaatgtattgtcgaaagatgggggcatactcaagagatgagaagctcttaatgcactttttccaagaatgtttggtcggggcggcaatcacctag

SEQ ID NO: 100014 - DNA, 516 bp, Glycine max
  Peptide Sequence Number=SeqID_216792
atgtcgtcgccggacattgtctcgatattggataactcgaaggagctcgatcgggttaggaaagaacaggaggatattctgtcggagatcaacaagcttcacaagaagcttcaagcaactcctgaagtggttgagaagcctggggataactcattggcaaggctgaaatttttgtatactcaagcaaaagaactttcagaaagtgaagcaagtatttccaacttactgataaaccaaattgatgccctactgcctacgggtccacaagggcaaacacgaagaagaataggaaaagctgacagtacttgtgttacagaaggtaatgagcagaaaaggaaacgagtgaagactgagtcagatatttcaaggctaactcctagtatgcgaggtcaacttgaggcttgtgccaatcttaaaggtgaacaggtagcagctagggtcacaccacgaaatgccgataaggatgaatggtttgtcgtaaaagtgattcattttgataaggaatcaaaggagtaa

SEQ ID NO: 100015 - DNA, 1440 bp, Glycine max
  Peptide Sequence Number=SeqID_216793
atgtatggagctagtgatgcttctgagttccaaaactccatccctaaggttgacaccataatttttcacattgaggatgaaccaactattcacatagagcatttctttgacatctcttctctggaaagcatggagctaatcagaatgttttggcagaaaactaagttcaacataggacacactatggtctccattgtgctaggaaagacaatgactctcaacatagagaccatagcccaagctattggctgcatgagggaaggaagcaaatacaatagcaagtgggaacaagtgtgcggggataatgttccaagggctctttacaaggacaacgctcagaaggcccaaggaaaaaaggattccatctctgacctacacaagttcatgctcttccatctaatggagtgcattccatttgatttgccttacacaatctacctcaacatcttgcacattacaaagaaattgggggaagtgaatagaagtataagactcggagacctcaatgaaacagaggaagaaatggttgctccactccagaggaaaagaaaggccaaggtaactaaggaacgtcctactagaaatgaacctgtacttgtgcctaatgtgccaaagaagttgaagaaaaatgcaactcatgcaaacccaactatccttgggaaatcatggactccaccttctcaggtaaatccttttgaggaaagagagaagatggtgaagaaagcttctaggaaggccatttccatcaacatccccctcgcaacattttccagaagtcacatgaattcttccctagaagtggatccaccaaagtactcaatgttaggtgatattcttgcccagatgtatgcttcaaatcaagcagttgcatatccacctagtcttcatatcagtaaagccactgatattttgatggtgcctaatcgatgttgtcctagactacctctaaaggatgacggtagaaagaaagacttcaaactgtactttaatcaagaaatggcaagcagacaacaaaaagtggagcttaagctagtgaagagacctgatgtatttgatgccaagacattctggaatcaaatagtttggggtgacactaggaaagctttgtcgtccagtttcaatggccaagacattacagaccataaagacaatattcaggtgttgcgttcagtctcgacatatcactttgatgatgcttgtgtatgctttgtcaaagacaaagtggacaatgaccctattgaacaactacatgaagtggagaagcttgcaaaagaggagtatggaaaagcctttgatgttgagttagaagctacaagaccaaccgaggaagttcttattaacctcactttatacgaagaagtaccccctgctacgttcaatgttgccaaggatgataagggtatcccaactgttcctattgaacttgtgtccaagcaataa

SEQ ID NO: 100016 - DNA, 528 bp, Glycine max
  Peptide Sequence Number=SeqID_216794
gagtctaagggttgtgccagtagtggcctagagaataaatgtaaagcttggaaagccaggagtgacagtgataatgaaatactgcttgagtattctaagacatctaatgcattcaaagtttacaactctagaaccttggtagttgaagaacctatccatgcgaagtttaatgacaccaagcctgataagaaattatcagagctagatgagtcctttgtagatctgagattggacaatggcattatagataaggtgtcatccagtcaaaacctaggaactgtagcttccactccaccactcgatggtacccaagaagaaataagggaaccaattagacacgtgatgagaaaaaaccattcgaagagccaaatcattgttgacccaacagaaagcgtccaaactagagcttcactcaaactaaaaggacacactgcattgatctcacagattgagcccaaacacatagacgaggcaatgcaagatgataattgggtgaaagccatgcaagaagagcctaaccagttttag

SEQ ID NO: 100017 - DNA, 210 bp, Glycine max
  Peptide Sequence Number=SeqID_216795
atgaaattgagcttagctcatcagtggcctaagtgcgcatccattgctaagtgcagcttcagcgtggttagcgcgacagaagaatctagcagagcatcaatattaaggccgcgtgctaagcgcgagatcagtgcgctaagcgcaacagttgtcttctgccaggatctgcgcacgactggtgctaagcttaaatccacttactcacgctaa

SEQ ID NO: 100018 - DNA, 204 bp, Glycine max
  Peptide Sequence Number=SeqID_216796
atgtccttacggacagtattcctacttccccatcaggctctgataccagagatcagcggaatacgatcaaacggacggataggaagtaagaatgcaatatcaagggcacaccgaaacggcttacaaacccaggtttttgaaaacaaagaaaccgaagcggcggcagagccgcacaggatcggtgaggggagaagggagatatga

SEQ ID NO: 100019 - DNA, 870 bp, Glycine max
  Peptide Sequence Number=SeqID_216797
atggttcctaaatcgagtctcacactgtgttcactgcttcaaaaggggatcaaccgccgcccaaggaaagtggcccgacgaattctccacaaaccaactcgcatttacaacaccagggccaatcggaagaggatggatatagttgaacaagaaaatcagagtctcagggaggaggttgccactctacgagagggaatggataggttgacgaccatgatgagtgcactcctgtcagcccagaactctcaagctgccgccgctactgtagagcagcctttggtgagcacaaccccactatctacggtgacttctccacccctctttttgcctccaggttgtacatggggaatgccacctccagtctgtggaggcccccagcccgctgtatctgaagttccacctccttttgctcagcagtcagcaccagttccgcaacccagtacctctttccctcaagctgcaatgacttattcagctccactgattcatactattcaacaagaggttgaaccaattttccaagctgaaaatgttgtagccttcgacaagatggaagaactccaagaaagatttgatggtatgcaaagggaagtcgaagccctccgaggaagagatctgttcgggaaggacgcctgtgaattatgcttggtcccaaatgttactatccctcacaagttcaaggtgccagacttcgagaagtataaaggaaactcttgtccccgcagtcacttggtgatgtacgcacggaaaatgtccatgtatactgacaatcataagctgcttattcatttctttcaggacagcctgactggggccgctctgaagtggtatatgaatttggacggtgcgagcattcgtacgtttcaatga

SEQ ID NO: 100020 - DNA, 339 bp, Glycine max
  Peptide Sequence Number=SeqID_216798
atgagggttcattgtaatcaagcaagtcggagacctagcacgaccacaaattcacctccactccttatgttcccacggacccagatcataaggaaagaaataaagaaaaaggaacaaaggagaagtcatggtaaggaaagcacattgattgattggcctaactctctaacaagggtccccagtggagtcgccaactgtcgcaacctacccttcggcgggagggcgacgcgagactcacgggtgcatcttccaagaaaggaaaatgcgcggagttgccaccaacgtttattcgaggaaaacgtcggaaaaaccggaaaaggtgtggtctacgaactttaa

SEQ ID NO: 100021 - DNA, 1577 bp, Glycine max
  Peptide Sequence Number=SeqID_216799
gtgtgttcgctggattcgcgcatcagcaggccgtaaatcaggccgccgaccatcgaatcaccggcgcccacggtgctgaccacctcacaggacggcggtttggcgatccaggcaccggaggcgttaacccacagcgcgccttccgcgccgagggagatcaccacgtgggcgatgccctgctcgcgcagcgcatgcgcggcctcgaccacgtccgccagcgccggcagcgggcggccggcccagatctccagctcgcggcggttcggcttcaccagccacggcgaggccttcaacccagcgaccagcgcttcgcggctgctgtcgaaaatgatgcacggacacttggcgcgcagctgggtcatccagtcggtaaaggcatcgggatcgacgccggccggcaggctgccgctcaccgccaccatgtcaaactggcccagccagctcagcgagtcgctgacgaagcgatcccagtcctgcggcgtcacttcaaaaccggagaaattgaaatcggtgacttcgccgtctttttccgtcagcttgacgttgatgcgggtgcggcccggcactacctggaagcggttggcgatccccagatcgctgaacagcagctggaaaccgtcctgattgtctttgcccaggaagccgccgacggtgacgtcgatgcccaaatccttcaacaccttggcgacgttgatgcccttaccggcggcgtgcaggccggcggtttttacccggttgacttccccgcgttcgatctgcgggcaaaaccccaccagatcgtacgccgggttcagggtgatcgttgctactcttctgctcatgctgcgccctcgcccagtccttcattaatcgcttcgccgatcgccttcagcgcggcttcagcatcttctccattggcgcgccaccaccttcatcaggctgcgcccgttggccggcttgccgctgccgtccagcgccgtgcccggccgtgcgtgcaggccgtgctcgttgcggatcacgaactcggcgctcagtacgctgctctcctcggccacttcgctggtcagcagcgccagcaccccggcggcatccgccttcagcaggcgttcagctttgttggccagcagcaggtcgctgagcgccaccggctcgccgtcttccacgaaagcctgcgccgggcggctgacggtggccgcgctggccaggttgccttcaacgctgtcgctcagccagatgccctgccccaggttcagcggcttgcgggtaatggcatcgctgacgaactgcgcgttgaccgcgccggccttttgcagccggccggcgttcagcgcctgcagcgtcatcaggctgtcggccgcgacgtcgagcgcaatcagcgaaacgtcgaactggaattcggcgctctgctgctcgcccatcagcaggccgcgcagctcttccgcggaggtggttttcgccagccgctccgccacgccgtcatcgctcagcacgtgagtaagctggcgcagcagcgccaaatgctcgtcggaacgggcggcgatgccgatcgccacataggcggtctggccttcgccccaggcgatgccctgcggaactga

SEQ ID NO: 100022 - DNA, 231 bp, Glycine max
  Peptide Sequence Number=SeqID_216800
atgtgcaaactattcaaaacaagggcaatagggtcacttttgaggcatttttcagcccttgggcccactaggaagcttagggctgaagtaactagctcgctaggacgcacccgtgagtctcgcgtcgccctcccgccgaagggtaggttgcgacagccaacttatatgactaatcctcatgagaccaaggagattgagtcccaagttagggaattgttggagaagggttga

SEQ ID NO: 100023 - DNA, 231 bp, Glycine max
  Peptide Sequence Number=SeqID_216801
atggcggcaggcaatggtggctcgtggtggccaccggtggtcgtgggtggtggaggaggaggtgttagggcttggcacactcaacgcaattctctctcgggtggaattgtgcttagtgcgcttctcgcgctaagtgaatggtcaaaaattgttattttgcaaatcacaatgctccatgtggagcttgtaggccttggatcttcttcatcaatggagtccattgcttcttga

SEQ ID NO: 100024 - DNA, 199 bp, Glycine max
  Peptide Sequence Number=SeqID_216802
atgggatcgagcggcaggggaagcgaacgcaggacgcgttcgcgatggctcaggccgtgggcaaatagggctggccgctcagccatagccggatggcggtgcggctggcttcgaaatgcggttccggcagggcgtcgggcgcgcaccagcgccactcggcgcacttttcgggttctttcaactcggcgctgccgccggg

SEQ ID NO: 100025 - DNA, 282 bp, Glycine max
  Peptide Sequence Number=SeqID_216803
atgtcagctcttagggatggtactatgataggggacataggtattatggcacagaacattacagctactgttcatagcaagcttaagcagctacctgtttatttcctcttgaaccaagatgtgtaccaacaagtgcaaatgttgaagaataatcataaagtgatgcaattctatcccgcaagggcattgggtagaagactccaagtagattgggctagagatccaagggaaggccctaaggttctcatgagccttagggtagatttcgagcccatgggctaa

SEQ ID NO: 100026 - DNA, 381 bp, Glycine max
  Peptide Sequence Number=SeqID_216804
atgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcgggttcgctgcccgcgacgttgtgagaagtccactgaaccttatcattttagaggaaggagaagtcgtaacaaggtttccgtaggtgaacctgcggaagggatcattgtcgatgcctcacaatcagattga

SEQ ID NO: 100027 - DNA, 498 bp, Glycine max
  Peptide Sequence Number=SeqID_216805
atgaatatcttgatggcacacaatcaagagtgggaacaggagttaagtccttacaatcaatatgaagaagaaagaactcctaatcttgaaagtgtgtttgaggaattcatggcataccataccagctcaaaagctaatcaaaactcaatgaaaaatcatgaaattcattttggtaagagctactcaatagaaaactttcacgggggaccaaagttacaaccttaccatcaaaatgaagcagaaagaggatccaatctagataaattgttgatgcaattcatggaaacaactaaatcaactcaacaagcactccaaagtgtagaaatccaggttggtgagctggcaaaagcaatgactcaatttgtggtcagacaagaaaaatcctttgtagaggttgaagctcaaaagaaaagccctgtaaaagagcatgagtcaagagaaaaagatgaggagaaagatgaggaacaagcacaacaacaatgggagaaatactcaact

SEQ ID NO: 100028 - DNA, 183 bp, Glycine max
  Peptide Sequence Number=SeqID_216806
atggttctgccattagatgaagtttcagtggattcaattggtggaagtgaaagaggagtgaaaaagaggaagattgggctttacgggacggatggaggaggcacgagggaaagccttggctgcgtaacaactctggattcgtgggatgttgtaatcgattacaggctgcctgttcttgtgtaa

SEQ ID NO: 100029 - DNA, 234 bp, Glycine max
  Peptide Sequence Number=SeqID_216807
atgtcaaaaacactgtcgaatccaaccaaaacactatcagaaacaatcagaaccatgaacaaaatactgtcaaaaacaaccaaaattaccagaaccatgatttcactgtcaaaaaaaacttcgaaagaaaaaccataccgtgagagcgagagtgacagtgacacgtacaccgtgagcgagagtgagaccgatagtgatgataccgtgagcgacatggcaatggtttcaccgtga

SEQ ID NO: 100030 - DNA, 315 bp, Glycine max
  Peptide Sequence Number=SeqID_216808
atgaacgaagagtcagtttgggtgatggccagcatcgcaccaacttgggtaagcctaggggcaagtgaaaaggtgatacaagtatcttgtagtatgctttcacatttacatgataacactttctttgtcaaagcattagggcaagtactaacaggtgctaggcccatgatcagatcgatcaccacccagtgcccggctaaagacgttaaagaagcgctcctaggaggcaacctagtatctctaactttgctctttaatttcatgttcgttttcttgaattatcacatgaattcccctaagcttatacataattaa

SEQ ID NO: 100031 - DNA, 285 bp, Glycine max
  Peptide Sequence Number=SeqID_216809
atggtggaaccatcaaagaagcaaaaaggttcttcgagtagaagccaacgacactccgaggctcaggatactccaattccttcctccatttcctcatcctcattgttctcatcagaagaacaacgtacacggtactcaaacctcttttcctctcattctatcattgaccctaagttcatagatatggatttcttttctgatgagagtttcaaatgcattcaagcatttcataactcaaatctcattccctttatgtctttaaaattgcctgtatattatgaattg

SEQ ID NO: 100032 - DNA, 309 bp, Glycine max
  Peptide Sequence Number=SeqID_216810
atgaatcatggccatagaagaaaagccatgaagaaagaagatccaagaaggcgtatattgcttgggatgacaatgactcatccgatagttcggagaaggagatcaaccttctatccaaggactatgagagcgatgagaacatctctcaagaagattaagcgaaaagcaaaaagttttttagatataaagtattttgaacccctttcaaatcctttcaccctaagaattcattcagcacttaattctgctaaaatgctctctggtaatcgattaccacaatgtataatcgattacaacaaggcaggctaa

SEQ ID NO: 100033 - DNA, 770 bp, Glycine max
  Peptide Sequence Number=SeqID_216811
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttg

SEQ ID NO: 100034 - DNA, 318 bp, Glycine max
  Peptide Sequence Number=SeqID_216812
atgcgagggtaccgcatggttatcttcacctttcgtcaaccaagggcaaacgagcctgttgacgcgcagagaccaacatcgtcttccacaccttttgtcatccagggacaacaagtcaggtggcaagcagagataccttatggtttttactctcgtcgtccggagacattcaagcccgacgacgcacgacattcttctctgttgggtggggggcgatcaagttcgatggcgtggggaaatgtcgtggttgtcccattttatcgctttcaagacactgaagttttgttgacgcttctgatgcattttctctctttctga

SEQ ID NO: 100035 - DNA, 570 bp, Glycine max
  Peptide Sequence Number=SeqID_216813
atggagggacggccacgtcagcctgtctcaccaacaacaatggcggcatgtccacccagagtctcatcctctctcagcctcccttcccccaaaccccacccattctcaatctcaaacctcaccgatttcccttctctcctcacacacttttcttcccatacccccactctccccatcgcctccacctccaaatgggcccgacccagcctaatgcccctcctcaaaaccctctccgtccttgatcgtgccctcatcggcgtcgccgcgggcggcctcgctggtgccttcacttatgtttgcctcctccccctcaacatcatcaaaaccaagatgaagatcaagggcgcgacacagatttacaaaaacaacctcgatgcaatcgtgaaaaccttccaatctgaaggcatcatcagcttctacaatggcatgtccacagtcgtcgtttgctcaaccacattgcctcgcgccacgcgctcatcgaagagaacaagaatcgtggcccccagattggggaaactccaggtgagagtcacgtgtaaaagagagagagagagaggttcgcctccatga

SEQ ID NO: 100036 - DNA, 1478 bp, Glycine max
  Peptide Sequence Number=SeqID_216814
tgctccgggacgttcttcactcctcccaccgcttcttctggatcgacctccgcgccggccccgtcgactacggtcccgtcgatctccggcgacggcgtcatccccgcggcgagttccaccccctcgccgcgctccacggccgtccgaaatccaacaaggccttcgccgccgacctcgcctctctcgtctggagcgcctaccacgtcttcctcgccccctccctccggatccccgtgcccttcgagaattcactcgtgattcagttcgtccacgtgcacagcgagaacgagaaggatttggccggtttggattggaaatcgatcgagaagagcttcaggtttgagggtaagagcaatggattgcttttaggggatcagagtttgagctttaggaagtatgagattaggtattcagagtgctcgatttgctcgttcgcgatctcgcggtcgattaattcgtatacgtctaggtttctgtttgataattataccttgattgtgagtgagtatttggattcgaagcgattacaccagattttgtctgattccggcgatgagttgagaaagctggctggtgttccggaggaggactttggcagggttgttcctgtgtatgtttttgacttggattacacttcgttgttgttgcttgatcggtatcatcagtcagtggcgtttaaggatatggtgattgcggttaggacgaggaacacgcagactgtgagtgattatagttgcaatggtaggcatgtgttcatgcagacgaggcaacttgagcggccgattgttgggtcgattcttcagagtatgtggggggtgtctccaacacatttgaattggagccctcaacacaatgagactttggtggattatacgtggagtatggggcagacgccattcgggccgttttctgagatgctgagtttgtcctttgtgcagaaggatgctgccaggaggaatgttctgttgacgtcgttgaattacagcataacgagtgctatagatgttcttcagagtgttgagacgcatggcggggccaagagtctgctcaagcagaagcagcatgtggagtttgtgcagagatggaaccttttcaagtacaagctgaacaaggccgtgtctgcattgtcacatttggattttgacatggcgttgttttacttgaggtcctctgatcacgatctgtatgccattcactccattgtttatcacgcctcgcaggaaattgaggcgtcccttgccctgatctctctgccaccacagtgcaaccacatcgcattgttgcctctgccacctctccaagccgaggcttttgcatctccaaccaccctttttgtaaaacacataagcgttaagaaaaccacattgcccaagattgagtcgtcgaagctatggtgctctagccaaattccagtcgtcgcgatggtcctcgaggaagatgagcatggagggttgctggctgatagaagcaactcgttg

SEQ ID NO: 100037 - DNA, 501 bp, Glycine max
  Peptide Sequence Number=SeqID_216815
atgcagcctcatgagaagttgttagctagcattgctaaaactaagttgtgcatttctaaaaatgttcatcaagtttctagacaaagaattgcagacatgactggctttgagctcacgggtgacgtgggaaagtatttaggtgtccccttgcttcactctcgggccactaaagccacctatcattatcttcttgataatgcgcataacaaattatcctcttggaaggaaaataatcttagtttcgctggtaaagcaacgttggcacaaactgttcttcaggcgctgcctagttataccatgcaaattgtcttcttgcccaaaggtagtattttaaaagatatggttgttgaggatattccttctaacttgatccataagacaatggaccaaatggtgggaaatgatggttcttggaatttgaatgaagtattgcatcttcttcctcattctgctcctttagagattgctggtagccctactccaagccctttgcctgtgtag

SEQ ID NO: 100038 - DNA, 1068 bp, Glycine max
  Peptide Sequence Number=SeqID_216816
atgacttcagtatttcgaggcgatacacaaggggagcaaaatgttttagttacctccagctgtgatcactccattcgtctttggtggaagagaagttggatgatatgtgtgggaagtatggttatccctccttattttgggatcaaaagtgaaggttcaagcctgcggtgctttagaggtcacaatggtcctgtgttgtccctatcaaataaattattgggagaggatggcagcaaagtattggcaagtggaggagaagatggtactgttcgactatggtcccttggctcaagtggcaaacgaggacagcgtgctttgaaggctacattctatgggcatgaaaaacctgtaaatttgatgtcagttgccgggcacaaaacttcgcttttggtgaccatctctagagattctaaggtaagggtttgggatactggcactgctacatcatctgctgttcgtacctcctgttgcgttgggatggcttctgttcctggtacacccctaaacatgaaatgccatgaatcactattgtatgtggctgctggttcctctgttgctgcatttgatttaaggacaatgcagaaagttatcaccgcagctgtacatcaaccaaagctgtgttcctttgatgctgtcccttcaaagtatttaatatgcacaggcggtaatggcagggcaatgctctgggatgttaggagaaatcaagaatcattaaaaccagaaccgatagccgagttggatggacattgtggccaagtaactttactgcacatggatccatacaaaatagttactggcggccctgacaatgcttatgtgaatgtatgggaagttgacactggtgtacaaacaaattccctgctttgctcttcaactgatgatgctggatctggctgtgatgccatgactgtagatggttgtagaattactactgctagctattatgaagatttgggtgttctgcgttttagggacttcaaccatgcaacaaatcctgtaacgaaactagaaaatgaaccgtcatcaaaattttggatttctatgtctgatgatgacagggatgactga

SEQ ID NO: 100039 - DNA, 1233 bp, Glycine max
  Peptide Sequence Number=SeqID_216817
atggaaagcaagcaaattcaatcacaaaggtcagatgagtgggtgtggatgacagactccagtggtcaattctcaacaaaaagcgcatacaatgctatgagggaggcctcattagacgggatagaagatacagcttttgcagaattgtggaagttaaaggaggacacaggacacatgttttttcattgtagcaaaattagtcctctttggtgggaatcgttgtcttgggtgaactctgttggtcctatcccgataaaccccaaacaacatttcctccaacacatatctggggtggctcaggggcaccgaaataagatactcttctccaatgacacatttgatgctaacaaaatcatggacgatgcatcctttgtaatgtggacatggcttcagagcctagagaaggactttgagattagctacaaccacttatcaagtaatcttagatcagggtttcctaaagatgagtccgagccttggtttctttctgctgtttatggtgcgccttggtttctttctcaatctaagccatggattttgtgcggagattttaatgcttattctagtgctttagagaagaaggggggtggtcttccagatttgcttagtattgctagttttaatggttgtattcaggaagcgaatcttattgatttaggcttctttggttatccttatacttgggaagctagaggagtcaaagaaaggcctgatcagtgtctctgtaatactatttggcttttgagttttccccaatcctttgttactcttctgcctactttcaaattagatcacaaaccaatcctgggtgatatggattggctatgtcgtcttcatacttttaaaaatttagcttctgattggagtcatcattgctttggaaatatttttcattctaagagaaggattctggctcacttagaaggtattgatagacgtttaattaacaatgctaatagagctcatatggactggataaaatttggtgatcgcaatatcaaaattttccatttatctgctgtcattcggaagaataaaaattctataagagggcttttagaggataagggtgagctgggtttgtttcctgttcttgaacatcagtttattctttggattcaagcaactccatctgatgaggaaataaaggaagttgtctttggcatgggaggaatgaaggcacctggaccagacgacattcatgcgatttttttatcaaaagaactggactaa

SEQ ID NO: 100040 - DNA, 174 bp, Glycine max
  Peptide Sequence Number=SeqID_216818
atgtcgaggcgactacgggctcaatgtagctcgcaaagagagcagaccggatacaacgtgcatcgagtacacccagtggaggttacagaggatcgaggtgaccattcgaacatgtcgtctgaggagatggaggaagtactaggaactactgaggcagttggaactgacgtttga

SEQ ID NO: 100041 - DNA, 483 bp, Glycine max
  Peptide Sequence Number=SeqID_216819
atggccgagcaatcccggtcgccggcgacaccggcaacgacgataaccgacctaaacgaagactgcatagctcactgcgccggccatctgagtctcggcgacgtttgcaatatggcgatgacttcctccgcactcaaacgcctcgcctattccgatttcatttggcaacgcttcttcagggagcactggcatctagagttaccttggcattcgagtggaaacggaggaggaggaggagcgaggggagtgtatatggtcagacacgcggcgttgcgacagttcaagtttgtcgaccctttcgttctcgactttgatgcacacgctaagcctttcgaccagttgctcctccacaaaaatcaccttttctactcacagggttcacgtgtggaagtgatagatttggatggctgtctaaagagaacaacaacagattttttccattcgttatgttatcataaagcaagaatcacttgtatgaggtaa

SEQ ID NO: 100042 - DNA, 1403 bp, Glycine max
  Peptide Sequence Number=SeqID_216820
atgtcacgtgaacaggggcgtgaggtcagtgtactgaccagttcagccgagcgcgcgctcagctttgccaaatcaccggcgctcaaagaccggcttctccaccgcagccgtatgcttgatggcaccttcagccttgctccccagagtacggtcatcgtggaaagtgcggaaaagctcagcctgaaggaaatgctggtgctgaccggagaggctcagctgcagaacgcgcagctgctgtttctggacagcgccggccggcagtcaaacgcgaacgcactgtccgtgctgaccgcagcgggggtagaacgtcagagcctgaacgcaccgtctgacggtattgaggtccgcgtgaccagcattcaggacaagcgcgagcgctatcgtgcactcgcagagcgttttgccggaatggaccccgcagacggtcccgtgacggcggttgtggccggtccgcgtgagcaggcccagctgaccggtgtcatccggaatgcgctgaaagatgccggacgactgggggaggcgccggtcagcattgcggcgcgcacgccggtgtatatgacagcaaaagagcgtcgcctccctcagacctaccgcgccggtatggtgctggaagacaggtcggagagaaatgaaacgcgtcactacgtcattgaccgcgtacatgatgaaacccgcatgctctccctgattgacggggatggtgtactgtcccgtgtaaagctcagcgcactttccggtgactggcgcctgtttacacagtctcagctggaggttgctgtgggggagcggctgtttgcgcttgccggcgacaaaaacgccgggctgaaggcacgtgatcgcctcaccgtcacgtccgttgagaatggcgcacttgtcgtgcagcgggaggggcagaaaaagccgctgcgtatcgacccggcaaatccgctttacgttacatacggctacgtcagtgcccccggaagccgggacaacgagcacggtaccgtgctggccagcctcggggctcaggatctgtcggtcaacatgattaacgcgctggcgcagtctggccatgaggccgaaatatttaccggcgaagccctgagccgggcggaagataagctcggccgcctgcgctcaacacgctccccgctgtctctggtccgtcaggccagcgggaaggaagacgccagtgaggccatagacacgctcagtacgcagctgctctctgacgcgcagaaagccgttacgcgcggcgtcgcgcagatgcgggaggtcgctttctcccggacaaaactgcttgatgaagcgctgacgttctgtggtgacctgaagctcatcgaaaatgaaattacccggcaggtcaaggaaggtgatctcatcggggtacagaccagcgccgggccccacttcgttgcgcg

SEQ ID NO: 100043 - DNA, 417 bp, Glycine max
  Peptide Sequence Number=SeqID_216821
atgaatgaaggcacttttggcattcttttcaaatacgtgagaaagcctctctcagggttcatgttgaaccaaattttgacttatcaagattcacgtcagatagcacaacaacttagtcccgtactatcaaggactttagaatcagaccagttcccactgttgaatgaccctaacaaagcatgcatctacgtgatcaagttattgaggccacaaggtccaacacaattaagcttagcagatatgaatggcgctaagctaaatcaaatccagtttaaaccacaagaatatccgcttagccaacagattatgcgctcagccccatggccatcaattcagaccgcaatgaatagcacttggcgacatagggttgtgcttagccaagggaagccatcgctaagcaatcagtttgtcgcttag

SEQ ID NO: 100044 - DNA, 386 bp, Glycine max
  Peptide Sequence Number=SeqID_216822
gttgcatgttgtaccatttgtggtgaggctcatgaaacaggccaatgtattcctagtgaagaacacactcaagaagttcactatatgggaaatcaacagaggcaaggatatactcaaggaggattttcaagcttccagcagggtccttataaccaacaaggacaatggagatcacaccctggcaatcagttcatcaaagactaggaggactactaagctagaggagactttgactcaatttatgcagaatcctaaggaggaatgcaaagctgtgatgacaaggagtaagaggtttgtggaggcagaggatgaggacagggttatcatgcctaagaagaaagctgctgaaaagaaaggtactgatgataagaaagatgatgtgagag

SEQ ID NO: 100045 - DNA, 292 bp, Glycine max
  Peptide Sequence Number=SeqID_216823
atggtccgcaccaagaaaattgggcaaatgacttctaaggaagctaaggaaattgctgaaaagattgcctcacagggttcctttgtcacccatggacgtcaggatgtactgactccaaggacctcccgcacgtcttcatccatggctcccgaagacctagagcagctgacacaacaaatcagggaccagctagaggagtcgatcatagaaaaacctgaggttggtccttcaactgctcgtgttagcacaaaggagagttgtgttaatccttcagggaacgatccagacacgg

SEQ ID NO: 100046 - DNA, 276 bp, Glycine max
  Peptide Sequence Number=SeqID_216824
atggagggatatggcagctcaagtagtacccccaatgatggagaaggagatgataacaatgatagtggacacgttaccggtgttctactattagaagatggtgggaagcctggggcaaatggagagaataagaaggagggaggaacccatgttattgtgactgtcgttcctgcatggccaaatttcccaccagctcaacaatatcaatactcagccaatatcaacccttctcattacccactaccttatcagccaaggacacccaatcatccataa

SEQ ID NO: 100047 - DNA, 174 bp, Glycine max
  Peptide Sequence Number=SeqID_216825
atgcacgataactggcctactgtcagccgctcccagattgagttagatgagctggaaagtgtttccattctgtccatgacccttgcatgggatgaattttccttctctacttttcaagaagcccattattcgcttcaagattctctagaccaggtgcctgacatgcctttttga

SEQ ID NO: 100048 - DNA, 411 bp, Glycine max
  Peptide Sequence Number=SeqID_216826
atggtgacaccgccaaggtcccctccgcagtcagatggtaatacggagccacaacctaagaagacaagacaaagcacacgtcttagaaggctgactttaagaagtttagatcagcctagaccaacaatcccgattgtccactgcaattggaaaaatgtgccagaaactcttaaggacatggtatggggggacactttggctaaatttgatatcccagaagctgaaaaggccaagaaaaaagtaatgtccacggtggccactagatggaggcaatttaagtcttcactaaccactaaatttgtctatgctgacacacaagccggacaggaagaaaatccttcagtaaaatatggtatagataaacaaacttgggacaaacttgttgcaagtggcaagaccccagattggcag

SEQ ID NO: 100049 - DNA, 633 bp, Glycine max
  Peptide Sequence Number=SeqID_216827
atgttgttgcccttggggcaaatatgtgacgggggatctgccattcacaatgtcacttatgctgatgatgttgtaagggtgagtgttgacaaagttatagaaggtgacgccgaagtgcccttcccgacatcagagattcaatatgtcagcctatattacatgtacgacacacctgttgagttgaagtgggatggaagcaaatttgggctttcaaatgttgatgcttcattcttcttgacattctctgatgtaaatgaaatagtagcaggatacaaatgtttgaacatatctatactacagttatggatgttgtttttggatgagtggagctcaactttaggtcatgcttccgtgtatggattccttgagccacaatcgatacaccatgcaaaggatcgacgtgctgaatgtgagcattacttacaagcatggctcaaggaatcgcaacgagaggggccattggcaactggtagtactgtgtcctacgaccaatacgttgatcatgctattattataagcagtgcaatgaagtcagcaaacacaactgcgaaaggtacaaataatccagcaactcctaagtggattgaagtcaagagccatgttcaaagcggagggtatgagtgtggctactac

SEQ ID NO: 100050 - DNA, 174 bp, Glycine max
  Peptide Sequence Number=SeqID_216828
atgaccctttcatcatggcagaacaagctagacaagtattttacgtgcaagacccttgtgatgaaaggtggaaatagctacaaaggtggttcgaaaattcagtatccatgtgaagcatcagctttgtttattgaggtgaaatctgaagaccaatgtatttatcccattttatag

SEQ ID NO: 100051 - DNA, 579 bp, Glycine max
  Peptide Sequence Number=SeqID_216829
atgaacctcaaaggagatggtttttccaacattacaagggccatcggaaaggatatagattacccttggaaacaagacatcataggtgatccaacaacaaatgttataacaaattggcaagtgaaggatggtgagttaatccaatcagaattacctcccgcaacacaatatcaactaccgaatatcaaagacagtaacaacaaacatgtcatggcaattccattcaaaacaaaagatgtcaacgaggaagtaacctctaaagacattaagagcctaatggaacaggcaaattataccaataaatacttacaagctttaggagaaaccattaaaactaaggtagttcctaaacaaaaatcaattgaggaagcttcaccaagtatccccattgaaaaacctttattcaaacctttcaaagttagtgagaaggctaaacgaaaaattagggaacttagaaaaactaaatccttaattgaaggcgtaggtgacaaccatagtgaattactaaacaagattggtagtttactaaggtcattccaaatactccccaagcctcggaaaatacttccaaaatggtaa

SEQ ID NO: 100052 - DNA, 507 bp, Glycine max
  Peptide Sequence Number=SeqID_216830
atgaagtcagctgacaagcgcgagtaccatatggtcatccgcacctttcatcaaccaggggcaaacgagcccgttgacgcgcagagactaacgtcgtcttctgcaccttctgtcatcctgacccatgaagtcaggtttactttagtcgtccgaagatattcaagcccaacgacgcacgagattcttctctgctgggcggtgacgatcaagtttgatagcgcgtggaaacgtcgtggttccgttggttgggatattgaccggtcgaatgatgggcaactgccataccctaatttcatccggggaccattgtttggtggcatgcaaccttcgcttgaccacctcgaggattctctcgaaagtagtgaggaaaattttttctgtggaaaacatccatgccgaggtgcttccgtaacgctttcgagacttttccgtgagcgatttcgtgaagattcttcaccattcttcatcgttcttcgtcgttcttcgtcgttcttcggtcttcaaccg

SEQ ID NO: 100053 - DNA, 406 bp, Glycine max
  Peptide Sequence Number=SeqID_216831
atgagcaggtttcctaaaggcagtatcgttaaacataaatctggcgagatcaaaggcgaagtggtcaatgtctttgagcagggaaacgcgctaaccggttattatgtgaagtgggacgatggcaacaacagctaccatgtcgagcgcgagctgtcatgggccaatggtgccgctgaggtaaggtgcgcattcatgcaccctgacataaactcagaaaggagagatgatcctcacggcggaatgtggaatgatgacgccctggaaactgaggagagaatgtcggaccttatgtcggaacagcgtcgttataccctgcctgctaaagcaggcgaccatcgtcagctcggtcagctggtcggcgccgcgcaggcggttgagtgtgccagcatcaccgaacgccacagcg

SEQ ID NO: 100054 - DNA, 1020 bp, Glycine max
  Peptide Sequence Number=SeqID_216832
atgcgccaaccgcgccgccgccttcgactcgcccgctacaaaaagaaccgccgcaaagtgcatcagcgctttcgccagcgcatctttgagcgcgatcgtcaggttgaacttgccgcccatccgcagccgcacgtggtggtgctgaccggtgccggaatttcggcagaatccggcattcgcacgttccgcgcggaagatggcctgtgggaagagcatcgcgtggaagatgtggcgacgcccgaaggctttcgccgcgatccggcgctggtgcagggcttctacaatgcgcgccggcgtcagctgcagcagccagaaattcagcctaacgcggcacacaaagcgctggccgaactggagcaggtgctgggcgataatttcctgctggttacgcagaatatcgataacctgcacgagcgcgccggcagccagcgcgtgctgcatatgcacggtgagttactgaaggtgcgctgtgagcacagcggtcaggtgctggcgtggacggaggacgtcggtccggacgatcgctgtacctgctgccagttcccgtcgcggctgcgtccgcacgtggtgtggtttggtgaaatgccgctcggcatggaggagatttatcaggcgctggaacaggccgatctgtttattgccatcgggtgcgcataccgtggagctgaatctggcccccagtcaggtcgtgcgctgcgcgtttcccctcatcccggccttctcccggcgggagaaggggaaaaacgcgctggattgaaactcaggctaaatccagtagggtctttcccacaggctaaatccggcacgcatgaaccctctcccaatgccgaatccagcacgaatgaaccctctccctctgggagagggcagggtgagggccaggccgcaccgaatccccacctcagaacctcaccgtcccgctttcagcttctggaacagcgtttcgtactgcacgctggcggcaccgacatcgttctgccactcgccgtttttgatcacgtcagccggcggatagagtga

SEQ ID NO: 100055 - DNA, 1809 bp, Glycine max
  Peptide Sequence Number=SeqID_216833
gatccccccgttgatgaaggagcatcctgccccgaagcgatgatggtcaggaataccgcgcagatttccctgttcagcaactataggaagccacttactctggagtctgcgatgaaaaccctcaaggcgatactgttacttggcctgctgaccagttcagcctccgcgctggcggagaagattggcgtgtcgatggcctattttgaccagaacttccttaccattattcgtcatgccatcgataaagaagccaaagcgcgcggactggatgcccagtttgaagatgcgcgcggcgacgtcggcctccagaccgaccaggtgcagagttttatcagcgccggcgtggatgccatcatcgtcgatccggtggattctgccagcacaccacagctgaccagactggcgcagcaggcgaaaattccgctggtgtacgttaaccgcacaccaggcgataaaactctgccgcccggcgtggtgtttgtcggttcggacgaacgcgaatccggcacgctgcaaatggaggcgctggctaagctggcgaattataaaggtaacgtggcgatcatgatcggcaacctgaccgatgccggcgcgctgcagcgcaccaaagatgtcgagcaggtggtggcgaaatacccgggcatgaaagtggtacagaagcagccagcaaattatgcgcgcaacgaaggcatggatctgatgctcaactggattggcaacggggaagcgatcgatatcgtcgcggccaataacgatgagatggcgattggtgcggcaatggcgctggcaaagagcaataaaaagattctggtgggcggcatcgacgctacgccggacggcctgaaggctctggcgcaggataagatgcaggtgacagtgtttcaggacgccatcggtcagggcaaaacctcggtagacgtggcgcagaagctgattaaaggcgagaaagtggcttcacacgtgtggatcccgttcgagctgggtcgctatttatggcgacctgggttgcctggtgcgcatgaatgcgcaccctacagatattctgcgaacactgtaggggcaccatttatggcgacctggttcctggtgcgcatgaatgcgcaccctacagatattctgggcgccatttatggcgacctggttaccgggcgccctggttccaggccgacgcaaccatcactcgcgcagtatcgccatgacgatgatgtcgtggtactcgccctcgcgcaggcaggctttgcgcttcacgccttcctgctcaaagcccaggcgctgatacagacgcagcgcgcgctggttgtcgtgaaacacttccagctcaacgcggatcacgcccagccagttaaaggcatagtcgataccggtgcggatcagccgctcaccgatgccacgaccgctaaacgccggatcgacgccaataccaaaactgatgctgtgacgcgtacgcagccgctgttcggtaaacagcgtcagctcgcccaccatctgcccgtcgatttccgccacaaagccgatatagccttcgctgtccatacgctcgaattttttctgccaggtggcgacgctgggaaacggcagctgcgtggtccagcgatacacctcgggatgactgatgccccccaccgattccccacccgccagcgtgtggccgttttacctctattatctgcgtcaggtgtggccaagttttgtcgcgctgctgattgtcggactggcgcaggcgctgatcgaagtggcgcttttcagctatctcagccgtattatcgatctggtcaatcacaccacgcccgccacgctgttcagcgataa

SEQ ID NO: 100056 - DNA, 420 bp, Glycine max
  Peptide Sequence Number=SeqID_216834
atggactgtccccttcatgacagtctgcttcgtgttcattacaagggtactgttctcaatgaagaaaagagggtattctatgatacaagggtagacaatgatggtcagccattggagttctattctggagaagggcttgtgccagagggatttgaaatgagtgttcgtctgatgcttcctggagagatagctcttgtcacatgccctcctgactatgcttatgataagtttccaaggttgctgatgaaatgcgggcaattgcctattgaatgtgatttctatcttatgatccattgtcattctgttctattcctattcttcattggcatacttcctccttttataactaggcctgtaaatgtccctgagggtgctcatattcagtgggaaatagagcttctaggttttgaaacgccaaag

SEQ ID NO: 100057 - DNA, 630 bp, Glycine max
  Peptide Sequence Number=SeqID_216835
atggaaagcatatgggggccatttggattatggctccgaatttatgttggattgatttctctgtggggaactcaacagtgttcgtctctgaacgatgaaggattaaccttgttggaatttcggggaagaataacttctgatccttttgctgctctggcaaattggaatccaaatgattgcaacccttgcaaatggctgggtgtccgttgtgttgatggtcaagtgcaatcactggtcctacctgatctatctttggaagggacattggctcctgagcttgggaaacttagtcatctaaaatcccttgtactatacaagaacagtttttctggtaccattcccaaagaacttggagatctagacaagctggagttattggatttaagggggaatgacttgactggatgtatcccagcagaaattgccagggtgttgttgtcaaaaaacctgttggtttgtgacaataaatttgaaggcagtgattctcaagagctcagaaagctaaggttgccctctaataacaataacagaaagtttgtgcaccaatggagtttctgtatattgtcttcaatcggtacaaatcttcattctgaatttctgatggcacttcttattgttttaactccttaa

SEQ ID NO: 100058 - DNA, 1599 bp, Glycine max
  Peptide Sequence Number=SeqID_216836
atggaagattcatttgttattccacttaaaggagcactaaaaaattacctcaatgctgtaattgctgtggcactgccactgttcaagctaggaaaggctactcctcatgcctatgaagagaaatattgtgataatctgactaagtttgtccagaatgtagttgattcagcacgacgtaagttgcttgatcagtccagtaaccttgcagctgaacatttcagtggtgggcctgctatagagatcagttctattccaattgcccagagcagtggagctttcccagctgtgccagacaccaataagaaacaaaatcagtcacctgcaccattgccttcaccttctgtttctccacatgtgaatcaagcaagtcaacaaaattcacctaatggtgcatctggaaaattatggaagtatatcattataatcacaggtgttgctgtcttggtcattcttgttgtgatcatgctttgcatttggcgaaaacgagcagcaaaagtaataaagccctggaagacaggaataagtggacagttgcagaaagcatttataacagctcaatccaaaattcctgctaagtgctatcagggcatagatttattgtcctggatagggattctggaagaggttataggttcacgttacggggtccccaagttgaatcggggagagctggaaacagcctgtgaagatttcagcaatattattaatagttttgatgaatgcaccgtatacaaaggaacactatccagtggagtcgagattgctgtcgattcaactattgttgcttctgccaatgattggtcaaagaacatggagacagcctatcgcaaaaagattgctgcattgtcccgtgttaaccataagaactttaccaatcttattgggtattgtgacgaagaagaaccattcacaaggatgatggtgtttgagtatgctccaaatggaaacttatttgagcatctgcatggtaacaacttccaacactctctaaaggctcaagaagttgagcctcttgactggagcacaaggatgagggttattatgggcacggcttattgtcttcagtatatgcaccatgatctaaatccacctgtagctcattccaacctcaattcaattgctatattattaacagatgactttgctgctaagatatcagagatctctttcggcaagcatgcaaaaaccaacacaactggagatgaatcacataaatcttctgagttgccaccccaggctgatcccgaaaccgatgtctataactttggagtattgttgcttgaaatcatttctgggaaactaccttactctgaagaacaaggccaccttgccaactgggctgctgagcacttgaacgataagcaaagcatcagctatctgatcgatcccacgctgcagtccttcaaagacgaagaacttgatgtcatctgtgaggtgatcaaagattgtcttcaatctgatccaaggttaagatctacaatgaaggaaataactcccagattacgggaagtgcttcatgtatcacccgagcaagctgtcccaagactctctccactctggtgggctgaactggagatcttatcagtggaggccacttaa

SEQ ID NO: 100059 - DNA, 144 bp, Glycine max
  Peptide Sequence Number=SeqID_216837
atgggagaaaagggtgcaggaaaagaagtccctttgtgcgttgaaactgaaggatcaacaatgtttgatgatatgatgcaatgcaatgcaatgcaatgcacgttggtggtgacaggtgtggggggggaggggggggagagataa

SEQ ID NO: 100060 - DNA, 206 bp, Glycine max
  Peptide Sequence Number=SeqID_216838
tgttttctgctgcttatgtatgtggcttgttgggtcacacatgtgacacttgtgacatcatggccgctaatgatggagttcgaccatgggagccggagatacgtgcagatgtgagaagagctggtggtggtggcggcggcggcggcagatcccgctggctacgtggtgagggtgaatcaaacagtaaatggatcaataatgactag

SEQ ID NO: 100061 - DNA, 372 bp, Glycine max
  Peptide Sequence Number=SeqID_216839
atgaattgcgtttttgttcatgtgttctccaccttcgagtttggagctatgcgtagtgattgcttagtgcaattctccattctcaacctttttcggagccccatgaattgcgttttcgttcatgtgtcctccacctttgagtttggagttatgcgtagtgattgcttagtgcaattctccattctcaacctttttcggagccccatgaattgcgttttcgttcatgtgtcctccaccttcgagtttggagctatgcgtagtgattgcttagtgcaattttccattctcaaccccttttttcggagccccatgaattgcgttttcgttcatgcctcctccacccaagagtttggagctatgcttcatgattga

SEQ ID NO: 100062 - DNA, 396 bp, Glycine max
  Peptide Sequence Number=SeqID_216840
atgtcatttcttttccggaaaagcttctgcctccactttcaaaaagctttgcttcttgttttccactttttcctacggcattgtctctggttcgtgggggtagcaacgttgagcgcagcggtgaaggtgaagtttccggcgtcaagctttgcggtggtcggtggcggcaaacgaggtacacagatggtgtttgttcgtcgcggacgtacggatgacttccggatcaagttgatccgtaagtttcagatcaacttgatcctaatttctgaacgagcggatatggattatgaaaatgcacaatcatgtggtgcgaatgaaccacatgttgattgtttggatgcgttcaagacttctcaggtgtttgagtgtcaagaggatgttttgcggtgggcttga

SEQ ID NO: 100063 - DNA, 1305 bp, Glycine max
  Peptide Sequence Number=SeqID_216841
gttttggaagcaaatcctgcacatgtcaagggtctttatcgtcgtggaatggcctacatggctgctggagattttgaagaagcgagggctgatttcaaaatgatgatgaaagtggacacgtcaactgaatcagatgcaactgctgctcttcaaaaactgaagcagaaggagcaggatgttgagaagaaagctaggaaacaatttaaagggctatttgataagaagcctggagagattgcggaagctaaagctgatgtagatggagatctgatcacaagtgaaatccagaaggacgatgaagtacatggggactccgatggaacaaattcagaggactcacatgaagctccacctgaggcacaacgaactggtatttttgtacgtattgtgatccctccatcacctcaaaagaaaaaaaagaagaaaagtaagtccaggaagagggctaatgagatagatgtggttgagggtgctcctcgtggtcaaaggcttcgcctacaaactattcattttagcaatgttggtgttgataccgaggagctcaccattcctaagttgtgtcttcaatccacttgttgccatgaacttgatgcatcgtcctcgatcgacaaggagttattggccaataaagagaaatttcttggagaagttgaaaatttgatgaaggaccgtgcctcatcggtaaaggttcttaagggtgctcttatgaccaatgaagagctcaacaataagattgagacattgcaaagtcgggtgaagcttcttaaagacaaggaaataggttgggagcgtaaggtgaaagaggctaaggattatgccacgcttgcttggattgaggtggggaagctgaaaaagtctttacttgagaagaaccatattatagatattgagaggtcggttgaggtgaaagtcgagggatttgcgtccttagctaaaggcgaagtcgtagagcagcatacgaaatggtttgaaaaggctaagagacatgtcatcttccttggttttactaatgtagttgatcttgatgtcattaaagatgtttatgactgtgaaattaggccccttgctgaggtatcacatggcttccatgatacgcctgcaactcacgttaccaatgttgctaagccagaagtggaggcttttgaggtgccatctacccctaccaagacttgtactacgcactcagaggagattggcgaaatgagcaagaagaggaacatgtctttgacagtgatgaggaggcttaggatgtatggtaaatttaactatggtaaggatgaggcatatgatggttttagttcatga

SEQ ID NO: 100064 - DNA, 1145 bp, Glycine max
  Peptide Sequence Number=SeqID_216842
gcggcctgacctcgcgcgaattgcaggtgacccggcccctgctcaagagcggcgcggtgtccgaggtcgacctgctgcgcctgcaacgcgacgtggcccgttactgcggcgaacagaaaggcgccgaggcccagatcgaccgcatccaggcctccatcaaggaagcccagagcaagctcgaggaatccgagctgaacatccgcaaccaggcccgcaacgagttgtccgagaccaacaccaagctggccacgctgcgcgagggcaagctggccctggccgaccgcgtcaagctggcggaagtgcgcgccccggtgcgcggcacggtcaagacgctgttcaacaataccgtgggcggcgtggtgcagccgggcaaggacatcatcgagatcgtgcccaaggacgacacccttctgctggaggtgcgcatcctgccgcgcgacatcggtttcctgcaccccgaccagaaggcggaggtcaagttcaccgcttacgacttcgccatctatggcgggctggaaggcaaggtcgagcagatcggcgccgacaccgtgaccgacgagaaaggcaattcctattacgtggtgcgggtccgcacggaccgcagcacggtgggcgacaagaacctgcccatcattcccgggatggtggccgaggtccacgtcctgaccggcaagcgcaccgtgttgcagtacctgctcaagccggtgctgcgcgcgaaggccaacgcctttaccgagccactggcgcgccctggatccggcgcgctggctggcggcccgcgggcgcggcctggcggacctgcagcgctggcgcgagcagggccgcgccctggcggtactggacaccgacctgccgcgactgccgtcctggcaggaccccgcctggaatgcccagctcgccgggctgcaggtggtggtggccagcgccagccccaacgacgaacagggcgcccaggcgctgggcgccggcgctttggggtattgccacagctacgccccggcgccggccctggcgcaggcgctggaggtggtcgcctccggcggcatctggatgggtcgttcgttggtgacgcgcctgctgcggctggtcacggagcgcgcgcaggacagccggtcctgggacaacggcaccctgaccgagcgtga

SEQ ID NO: 100065 - DNA, 492 bp, Glycine max
  Peptide Sequence Number=SeqID_216843
atggcattaggggtcatggcagctcgcccaagcgagttgttgcttcatcctgaagtaaccttgctcgcccaggcaagctgcacttcgtacaacatcctccttagaggaccacctcttaacagtttgggagccatagtgccaacacctcacttcgcgatgaagtttcccttagttgaaggaaggatagctactattcatgttgtccaaaagatgaccagggagtgttatgccgccaaactcaaaatgactccattgtgcactcgtatgggtacttggctctcgaaaaaatgtgataagcagattaccaaggtccttcaagctaatgcaaacctattcgcatggacgactttcgatatgttgggcaccgaccccaagttccatttccagaggatcttgattttccctgatgcaagacttactgctcaaaaagaagagaaagttgggggaagaaagaagaaaggtagtgatcgaggaaactgcaaacttgattga

SEQ ID NO: 100066 - DNA, 723 bp, Glycine max
  Peptide Sequence Number=SeqID_216844
atgggagccaagagaattatatgtcaaactgaatctaagatagcgacagatcacataacagggacctcccaagttaaaaaagcccaccaccttggatattatcacaaagtgaagaacttggtgcaagaatttgatcatgaaaaggttaaacatatcttgaaagatcaaaactctagagccaacgaacttgctaagctagcaagcaccaagaagccagggcaacaccacattgtcattaaacacaccctattagacccgagtgttggcggaaaggaatgcatggaagtgacaatggaaccgtggcattttttaggaaaaaggaaagagaagtctcagacctcagcttggcacaataagcaaagtcgtagccttaacaagctaggaccagagatcaaatattatacaaaacataaattgaaagtccaaggtgcaaggtacactaccattataggggagttgtataggagggggttcttcgcacttcttctaaagtgtctcaccaagacacgatcagaatacgtcttggaggaaattcataagggtatatgtggggtgcatacaagaggtcaatcaatggccactcatgtccaatgtgtcggatactattggcccacaattggaagcgattgcatagactatgtgaaaaagtgttcagactgtcaaaagcatggtaatctaatacaccaaccagccaacgagttgcacaaaatagtctctccatga

SEQ ID NO: 100067 - DNA, 252 bp, Glycine max
  Peptide Sequence Number=SeqID_216845
atgtcaacatttacacgcgattctcctcaaatttcagccagcccgcatcaattagaccttgcaccttacgcttcagggccctacaatgctcaatggaacgccccggggcttctccatgacaagcacacgttgcgttcgagtcgtattctcggagaaatggtggttgatgaaccttggctagggttatggctaccattgaattatcaagtggtgttcgtcattggaagtgcggtagacaggctttgtggataa

SEQ ID NO: 100068 - DNA, 135 bp, Glycine max
  Peptide Sequence Number=SeqID_216846
gtttttactctcgtcatccagagacattcaagctcgacgtcgcacgagattcttctctgctgggcgaggacgatcaagtttgatagcgtggggaaacgtcatggttatcccactttatcgctttcaagacgctaa

SEQ ID NO: 100069 - DNA, 219 bp, Glycine max
  Peptide Sequence Number=SeqID_216847
atggttttgggattgggtctgaatcaagagggagaggctgtgatggactcttcaaagtctaggccatggggtaaatacacccgtgtgtggtctgtcttttcatgtactcctaagcgcccaacaaggtttttcacttacatggagcagatgactaagtgggttgctttaaagaacctcatgttggaggacatcgggacacaatgctctaataggatgtga

SEQ ID NO: 100070 - DNA, 474 bp, Glycine max
  Peptide Sequence Number=SeqID_216848
atgcacaagtttgtgctctttcatctgatagagtgcataccatatgacttgccacacatcatctacctttatgttctatgcatcacaaagtttatgggtggccttgaagatatctattatacttctctagtcaacaaaatcttatgggagcaaggagtttatcaagtcttcaatggactggatgaggcaagcaggaacaagattatggttaaggggtccatgatagccaaacaacaaaaccttgggcctttaaacatcaagtccataaggttagcaatgaacataggtcaaagagaggttcctcaagtgaacaaggaagaaatagccaagaagagaaagaaaggcctaggatcttcttcatcaatggattcctttgctttttggaagatgaatggcatcggaatggagaaggaagagagagaggagatgccacttcaaggagaagatgagtctagaagaagctcaccaccatag

SEQ ID NO: 100071 - DNA, 533 bp, Glycine max
  Peptide Sequence Number=SeqID_216849
atgagggcgagccctggtgcagcggtaaagttgtgccttggtgacttgttggtcatgggttcgaatccggaaacagcctctttgcatatgcaaggaattcgcccaggcgaatttgagctggatcagcttgcccaggcaagccaaattttgctggggcaagtcttgcaggctacaaatatgtccagtagcataaaacaaccattttcaccttcatctcttcccttaaaccctcccccaacatccccaacctcctcttccaccaccgatgaccgccacgagaagcctttgcttgttgtcggaccaccgcacgaagaagaacaatttaatcagtgcgaaatcttcagaactcaactcaaggatttagtagataacaaagcctccaatccttccttcgtggtttcttcgaggtctatgttgcctgaagacccggggaatgtgaatcctgggcatgaatttatatgcatgtatgtggaatgtgatttctttgatgttgatgatgatgttgatgttgataataatactgagatgagatg

SEQ ID NO: 100072 - DNA, 350 bp, Glycine max
  Peptide Sequence Number=SeqID_216850
atgcccaaataccctaggtgtggggtatcacgctacaaagtgaaggatgatgacgaacgtgcaaaagaccttacatggcatggaaatgggagaaactgtgatggaatgctccgtcatccggctgattcctcccagtggaagaagattgatcgtttgtgtctagatttcgaaaaagaggcaagaaatcttaggcttggactagccactgaggaaatgaatccatatggtagtttaagcactcaacacagttcgtggctagttttgctagaaaatgacattgatgtttatctcagtcccttgattgaagacttaacaaagttgggggatgagggggttttagtgtttgatgg

SEQ ID NO: 100073 - DNA, 1135 bp, Glycine max
  Peptide Sequence Number=SeqID_216851
atgcggcgcattggtgatgaagcgcttgttgccgttgaccacatagtggtccccgtccctgatggcggtggtgcgcagcgaggccgcgtccgagcccgcctcgggctcggtcagcgcgaacgaggccatgatctcgcccgtggccagcttgggcagccaggccgcctgctgctcgggcgtgccgtcgatgaggatgccctgcgagcctatgcccacggtcgtgccgatcaccgagcggaaggccggcgcggtctggcacagctcgaagagcacgcgcacctcttcctccatggtcagctccagcccgccgaactgctcggggatggtcatgccgaacaggcccaggttgcgcatctcctgcacgatggactcgggaatctcgtcggtctcggccacttcgttctcggcgggcaccaggcgctcgcgcacaaagcggcgcacgctgtccagcagggcttcgagggtttcttggtcgcggatcattgcggacaggccgccgccgttggtgttgacggccagccgcccgccgggcgcgatgccgcccccggacacgaaggcgccgccctcgcccttggcgcaaaagcccaggtcctccaggaacagcagggtgttgatggtgaaggcgtcgtacacctgggccatgtccatgtcctgggccgagacgcccgccatggcataggcgcggcggcccgatacgctggcggcggtgacggtcaggtcttccatagacgagatctgccggtcccagacggcggtggcgttgcccagcacgtagaccggcgggcgcggcaggtcgcgggcgcggtcggcgcgcaccagcacgtaggcgccggcgccgtcggtgaccaggcagcaatcgcgcacgctcaagggatcggacaccatgcgcgcggccaggatctgctccagcgtggccggctcgcgcaactgcgcctcgggattgagttgggcccactggttggcggccagcgcgacctgcgccaggtgttcgcggcgggtgccgtactggtgcatgtggcgcgccgcggccagcgcatacgacgacagcgggctcaacgggtcgtacggcgtctcgtagggctgcggatcgaactgcttgcgcacgcggccgatctcggcgcggctcagcgtcgag

SEQ ID NO: 100074 - DNA, 264 bp, Glycine max
  Peptide Sequence Number=SeqID_216852
atgttctgtttgttccagcatatcacaagtaaaattatattggttaaaggttcttgtggcaagtcacttgcttctttccctcgaggatgtttctactctacaacagttagaggattgagatgctatgagaatccaaagaataagattactgcaatacctgttgaggaagaggaaatctggggtgcattcttcaaggtaatcttagagcttaagaagttagagttgaacatccattatgtaactaggattgccagttgcaactaa

SEQ ID NO: 100075 - DNA, 1094 bp, Glycine max
  Peptide Sequence Number=SeqID_216853
agctggatgaatttaaggctgaattggagaggcgtaactttcataaacgcctcaccaatttagctgacagtagcattgacctggcattggtgaaggagttctacgccaacctctacagtcccgaggggccttcaccaaaacaagtcagaatacagggccacttgataaggattgatgcagatagtctcaatgcctttttagaaacacctgtggtgcttgttgagggtgaatctttacccgcttactcaagatactacaggatgcctactgacataagggaaattgaggttgctttgtgcatacccgggcgagggtttattttaaatgttgaaggtcaccctgggaagatcatcagaaaagatctaaccactcttgctcaggtctggagtgttctctcttactccaacctggctccgacttcccacacctcagatttgactgtggatagagctaggttaatctttggcttagttactcagctggacatgaatgacggagctctcatctctagacaaatcacatcaatggcccagtctaactcctatagacttgggttccctgctcttatcacaactttatgtaggtccagaggagttgcttctgacagcttggtctttgaacgtttgagcccgggggccagaacaccaagggcaaggccagttgaggctccttctacaatagtagctcctcatccagcttctacatcagcagctcctccctcagctccctggccagggactcagcctcctcttcacagggaagacgaagatcccgccactcaggtaccccatcagccagaggatgagtcatcagagtcttccactcctgagcccttgatcaggaagaagagggtagttgtaacccaggaagttgcaaccacctctgaaaagtctcttgaagccactctagagcttccgacaccagtggtagattccacttctccacaacaggcaacagacccttccacgcctgaggatcaaaacaacccagtcctgtctccgaacacctctcctgtagctactcttgtacttcatttgtcgaaagaggaggagggtcagacacagaacacccaggaccaattacaggatctttaa

SEQ ID NO: 100076 - DNA, 252 bp, Glycine max
  Peptide Sequence Number=SeqID_216854
atggtggggatgtctcctccacctccaaaaacctcacaatctctcaaaaactccttcaaagctcttcaagatgcctcctttgcgagcgacaacacgttgagcgcatgcttgcaaggcagattctcttctagattcgtttgtctcgctgagtgcgctggtgcctcgcttagcgggacatactcactaagcgcacaaaccaggcttagtgcgacaccagattcagcacttcacaaaatctcctttttcacctga

SEQ ID NO: 100077 - DNA, 249 bp, Glycine max
  Peptide Sequence Number=SeqID_216855
atgacttcaggactaagccttagctcacctgggcgagctgcaactgccccaagtgacccttttcctataaataggcgtgctaggggggctgaaagggggttcgagcatgaagtagtgaaggaaattgagagaattaagagagaagaagaagagagaagaggaaacgaagtcgaggcactgctaaattgcgacggtgatcaatctctacgttgttccttgttcagcgttcttcgtgcaaccgtcggttag

SEQ ID NO: 100078 - DNA, 366 bp, Glycine max
  Peptide Sequence Number=SeqID_216856
atggagtatcagaagattcatgcttgccccaatgattgcatactgtacaggcatgaattccaagaaatgtccaaatgccctatctttgggacttcacggtaccatatccacgtcgaaaactcaaacaaggatgaagaggaaagcaattctgatgaaaactcaaacaagggccctgcagcgaaggttttgtggtatcttccaatcattccaaggtttaagtgtctttttgctaacgaggacgacgcaaaagaccttacatggcatgcaaatggaaggatttctgatggaatggtccgtcatccgactgattgcttgcagtggaagaagattgatggtttgtatccggatttcgggaagaaaacataa

SEQ ID NO: 100079 - DNA, 1092 bp, Glycine max
  Peptide Sequence Number=SeqID_216857
gaagatgtgccggtgagtctcgcgtcgccctccagccgaagggtaggttgcgacagtaagctaaacttgtatgttaatctacgaaggtttgataaaccatttagacctgggaacaatagcgaggaatatcatcagggagatatgaatgtggaagaatgtaatctagattggttcaaagggagtttagtagcaagggtacatgaagtcgggaacattcaaaacattaaggagctctttgtggtggaaggttcagaagagtggctgagtgagatctttgagtccattgacaattggtcagaagagacaacgatggagtttaggcttacctgggttagaatcagtaatgtatcactaaaagtttggaggcaacggtgcttcgaacaaattgtgtatgcaagagtgctcattcatacaacgacaacagagacgatggacttcacacaaagaagaaagaataatggaaaactccatatgatcaaaatggtggaggaaaccattttgaagaagattaacacacaaggcctttgtgagagatgcatgggggagctatggaatgaagattcagaggatgggtcatccgttaaggggctcgatatagtatgggggttcaagcatgccagaatgtttgccaaaccaaaggtgatgggcagaagaagatgtggtggtggaagccacttttctgtaaagggatgggtctccatgggaggctttgaattcttgtcagagggggagaaagagacttcgttgcactctttagacatgcctcatagtgagatagaaaaagattttgaagcgaaagaggtagggggctcatgtgattgcaatgagataggggataacttgagtgtgggacctagtgaggaacacttgaaaaagctcatattagaagaagaggagggtgatatttcacaagccaaatctgttatgggggaacatgaaggcacaaaaaataaccatggaggaggtaaacgtccttatgatattgaaattgaattttttaacaagggtgccaaggtgcatagggaggttgttcattgcttgtttggggaacataagatagaagacagggagggtggatgggttagaagatga

SEQ ID NO: 100080 - DNA, 168 bp, Glycine max
  Peptide Sequence Number=SeqID_216858
atgggtattgaacattttgaagtggtcaaacggaggtcgcatgccaacaaacaatgtttaattgaagcggaatggatatggaagaaagatgactggagacgccgcttcaaggagaagatgagtcaagaacaagctcaccaccataggaagccatggataagagtttga

SEQ ID NO: 100081 - DNA, 245 bp, Glycine max
  Peptide Sequence Number=SeqID_216859
ggtttaaaatcccaataaatctctggggtatctgcatctatgtgtttgtgcagtggggccacatggaggagagagagagagattggacagctatgaacagctgggaggagagaaagggttgggtctcctcaactcaacggcattactggaaagtcgccagtgagttttttaattataaaataactagtgggaatcagccaccacgtgcccttgtgaccgtccctttagtagggtgccccttataa

SEQ ID NO: 100082 - DNA, 345 bp, Glycine max
  Peptide Sequence Number=SeqID_216860
atgtccatgaagcaagaccaaaccactaagcgagacagcagtggcttagcgcatgaggataagcctgaagagagttcttccacgccagcacgcgcttatcatgtatgcagcttgctaagcgaggcagttgtctcttttgcgctaagcgcaaggttggcactaagccaaatatcacttactcgcgctaagcgcacctttgaggtcagaaagccttttttaagcctgatttgcacaaaaaaaaaagagagagagcatgacgacgtgaaagaggtcttaattgactacgaattgtgtgcagagaacagaggaaaagctgagcaagaaagcaaaggtcctaacttttag

SEQ ID NO: 100083 - DNA, 186 bp, Glycine max
  Peptide Sequence Number=SeqID_216861
atggatacaatttcacttttagtaaaagattttggaacttacttcatgaggacttctcaaagcaggttgggattttatgaagtgtggataaagtggatcaaaggttgtgtggaattggcatcagtctcgatacttgtgaatgggagtcctacggatgagtttggcatgcaaagagggttaagataa

SEQ ID NO: 100084 - DNA, 516 bp, Glycine max
  Peptide Sequence Number=SeqID_216862
atgagaaagcgccacgcttcccgaagggagaaaggcggacaggtatccggtaagcgccagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccctcttcttgcctccaaattgggtcgagaagcagactcgaaggagaaagtgtttgttctactggtcaggcccattttcgaggctctcggcaaacagaataagcatgtcctatccagctctgctctctgtttggctaggataattgacaacatacaccatcctcctctttcgcttttggggatcctctag

SEQ ID NO: 100085 - DNA, 711 bp, Glycine max
  Peptide Sequence Number=SeqID_216863
atgggtcagctccaacttcaagctttctacaagacatatggaaagatctgggatttggctatgatagaagtgtccgttgaagccattgcatccctcgttcaatattacaaccagccactaaggtgcttcacatttggggactttcaattagtaccgaccattgaagaatttgaagagatcttgggatgcccactaggaggaagaaagcgatatctcttttctgggttacacccctccatggcaagaatggccaaagtggtcaaagtcttggcgcaagaattggaccgagtaaaacaaaataggaatggggtggtcagaataccaaggaagcacttggaggagaaagcgaaggctttggctgatcaaggtgaatgggctttattaattgatgtcttagtgctattggtgttcagagccatcctctttccaaatatggatgggctagtggatatagtggcgatcgacgccttccttgcttatcaccatagcaaggaaagtccggtagttgttgctttggctgatgcctatgacacatttgactggagatgcgagaagagtggcccaaggattgtttgttacacacccggtctttatgtgtggctggtctctcacctctttcgttatgaaagtagacctgtttgtcccctacaaggtcactgcctgtgtgccgagaaagggaaagcaaattgggagcaacttttggctggtatg

SEQ ID NO: 100086 - DNA, 867 bp, Glycine max
  Peptide Sequence Number=SeqID_216864
atgacgggaagactgaggatgatactagctcaccattcgagtgtagaaccttgccaaggggctgtaactgagcatcgggtgcttggtccaaagataaatggatgctcatgggttgagctgtgtccacttaccggaagcatcagaaagagagagagagtaaactcaatttccatctgtcagaatatatttgggatgtcttcaacccagattatctctagaatatgttgtggaatcaccaacagggggtggttctgggttgagcttctgctcctgcaaagccagaactttggtttgattccaaggcaaccccactggaaaaaaaattctaaagtttataattctgaagtgagggcgagccctgatgcagcggtaaagttgtgccttggtgacttgttggtcatggattcgaatccggaaacagtctctttgcatatgcaaggtaagactgcgtacaatatccctctcctataccttcgcatagcgaagagcctctgggcaatgaggtacgaattgcgtgtccattgtgctgaagcacttggcacaccaatagtgggtgactataagtatggctggtttgtgcatagtcgatggaaacaaatgccacgagttgatatcgagccaacaactggaaaaccagaaggcctagatgttcagaagggaagtgttttatcaaaggttcctctattgcatcttcactgcagagaacttgtactccccaacattgctaagtttctgcatgttttgaacaatagttcagaagaactacgcacttcacttagagagcagcctgatgttcttcgctttgtggcaacaatgccttcacatatgagaattagttggaatcttatgtcttcgtatttagtctga

SEQ ID NO: 100087 - DNA, 2706 bp, Glycine max
  Peptide Sequence Number=SeqID_216865
atggcaggaatcatctctggcccaagtgggagcgagggtgttaatattttacttaatcatgacttctctagtgagctgaactcttggcatctcaataactgcactggctatgtaatttcggctgaatcaggtaatcaagggggaatttcaatggagtcgaatgttaattatgttgttatcaccgaccgaaaggaatgttggcaaggtcttgagcaagacattaccaacagaatttccattggttccacttacacggtttcggcttgtgtgggagtttctgggctttctcagcgatctagtgatgttatagctactctgaaactagaatatcatgattcagctactagatacttgttcattggaagaacttctgttaataaggatagctgggaaaagttggaagggacattctcattgtcaactatgcctcatagggttatattttatttggaaggacctgctcctggagttgacctgctaatacgatcagtagagatcaactgttccactccaaataatagtaccacaagcacaggatgtgtttcagctggagatgacaacatcataattaacccccaatttgatgatggtctgaataactggtctggaagaggctgcaagattatgttgcatgattccatgaatgatgggaaaattgttccaaagtctgggaaattctttgcatctgcaacagaacgcacacaaagctggaatggaattcagcaagagatcactggacgcgtgcagcgcaaactggcctatgaggtcactgctttagttagaatatttggaaacaatgtctctactgctgatgtacgggctactttgtgggtccaaacaccagatcttcgagagcagtatataggcattgcaaaggtgcaggcaacagataaagattgggttacaatgcagggaaaattccttctaaatggttctccatcgaaagtggtcctttatttagagggcccccctccaggcactgacattcttctcaataatttgatcttaaagcatgcagctaaaacacctccttcaaccccaccggatttaaagaatattgcttttggggttaatataattgagaacagcaatctggctgatagcacaaatggatggtttccccttggcaattgcactttaagtgttaaaactggttcaccacacataattccaccaatggcaagagattctcttggttctcatgagttcctaagcgggcgatacatccttgtaactaatcgaacgcaaacatggatgggtcctgctcaaactatcactgataaagttaaactctttgtgacttatcaagtgtctgcttgggtccggattggctcaggatcatccgggcctcagaatgtgaatgttgcccttggtgttgacaaccagtgggtcaatggaggacaaactcaggtttcggatgacatgtggcatgaaattggagggtcctttagaattgaaaagcagccatcaaaggttatggtttatgtccaaggtcctgcttctggtgtggacttaatggttgctggacttcaaatttttcctgtggatagacacacaagatttagatatttaaagatccaaactgataagattcgtaaacgtgatgttatcctgaaattctctggactggactctggcagctatgctaacacctcggtaaaagttatacaaacacagaatgatttcccaattggaacatgcatcagtagaatgaacattgacaatgaggactttgttaacttcgttgtgaagcattttaactgggctgtgtttgaaaatgagttgaagtggtattggactgagccacaacaaggaaatttcaattacaaagatgctgataatctgctaagcttgtgtcagaagcacaagatacaaactcgcggtcattgtatcttctgggaagtggatgaaactgttcagcagtggatcaagtcactgaacaaaaacgatttgatgacggctgtccaaaaccgcctaaacggcctgctgactcgctacaagggcaagttcagtcactatgatgttaacaatgaaatgctgcatggttcattttaccaagacaggctaggcaaggatataagggcaaacatgttcaagactgcaaaccaactagacccttctgccacactctttgtgaatgattaccacgttgaagatggacgtgacaccagatcgagtccagataagtacatccatcacattcttgatttgcaagagcaaggtgccccagttgggggaattggaattcaaggccacatagatagtccaatagggcctattgttagttcttcccttgacaagttgggtattcttggtctacctatatggttcactgagcttgatgtgtcttccgtcaatgaatatgttagagcagatgatcttgaagttatgctacgcgaagccatggctcatcctacggtggaaggcataatgctgtggggattttgggagttgtttatgagtagggacaattcacacttggtgaatgcagaaggtgacatcaatgaggctgggaaaaggttcttatctcttaaacaagagtggctttctcatagccgtggccatgttgatgagcaaggtcaatacaacttcagaggctttcatggaacatatgatgtgcaagttgtgaccccatcaaagaaaatttctaagacatttgtgcttgacaaaggtgactcgccactagtggtatccattgatttataa

SEQ ID NO: 100088 - DNA, 525 bp, Glycine max
  Peptide Sequence Number=SeqID_216866
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccaccaacatccataaacgagttgaacttggggaacttgctgcagctaaactgttcaaggttgaaccacataatttcggcaattacatgttgctttctaacatttatgctttggctggcaggcgaaaagatgttggcaaagttagggataaaatgagaaaacagggagtgaaaaaaacaattgccatggggatcctctag

SEQ ID NO: 100089 - DNA, 285 bp, Glycine max
  Peptide Sequence Number=SeqID_216867
atgaattcggattgtaaattgtttggccacagaggagccaagttgggtgggaatacatcttctaaaggacctaggaacaaaggggtgaggatgatgccatttgatgtcagggttgagccagcagccttgatgaggaggaagtcatcgtcgaaagttgtcgtggaggtgggaggaggaggggctgaaagggttcaatggagtagaaacagagggggtggagggagagaaggaagagaccatggtcatattagagagaaaaagaaagggaaagaaaaaataggataa

SEQ ID NO: 100090 - DNA, 1380 bp, Glycine max
  Peptide Sequence Number=SeqID_216868
atggtgccgagcgaggcgaggatcggcgagacgccgatccaggccaccagcgcgccgttgagcgcgccgatcgccaccgccaccagcaggccggccaccagcgccagcgccaggaacagcggctggtcagggtggctgacgatgattgccgccatcaccagcgaacaggcgttggcgccggcgatgatcgacaggttgatgccgccggtcagcatggtgatgcccatgccgagcgccagcaggccgaggatcggcagctgcgaggcgatcgactggaagttgccgaggctgaagaagcgcgatccgagcagcccggcgaacagcagcgccaccgcgatgatgatcgcgccctgcaggcgaatgatccgatcgcttgggatcaaccgagttaactgcgtcatgtcagatctccttgagcagcttgcgtttttcgttccaggcagtggtgctgatgctgatcaaaatgatcgcgccgctgaatacctggtgccaataggccgagacgctgagcagcgtcagcccgttttgcaggaaggccagcagcaccacgccgagcagggtaccggtcaacgagccgcggccgccgctcatgctggtgccgcccaacaccaccgccgccaataccgtcagctcgaagccgagcagcgagttgggggccaccgactgggtgatctgcgcctgcaccaccgccgcgacgccggccagaatgcccatgtagccgtagacgcaaaaatgcagccgcagcaggttcaaccccaggcgcgacgccgcgtcgcggttgccgcccatggcgtagatctggcgccccagccgggtgcggttcatcagcacgccggtgacgacgatggtcgccaacaggcacagcagcggcagcgtcaggccgtagtcgtagccgtcggcgccctggaacgagaaccagttgatgccgttcatgaaccagtccggaaagccgtacagccaggtaccgttggtggcgtacaccagcaggccgtagaacaggttgagggtggcgatggtgatgatgattgccggcactttcagccagtacaccaggaaaccgttcaccagcccgagcagcaggccaacgccaatcgccagggcgaacgccagcgggaagctgccgccgtgctggatcacccagctggccatcacgtactgagcgatggcggtgaccgccgggaacgaaatgtcgatgccgccggcgatcagcaccacgaacagcccgcaggccaggatgccgagaatggcgtagctggtggcgacgtcggtcaggttgccgagcgtcagaaactcgtcggtgccggcgctcaggccgatcgccagcagcagcaccaacaggccgagataaaactcgtgccgcccggccaggcgggccaataa

SEQ ID NO: 100091 - DNA, 456 bp, Glycine max
  Peptide Sequence Number=SeqID_216869
atggagcaatcgatctacgacaacaccatcgtcaccgtcttcgatcggctgcatacctcgctcgggctgctggatcacgccaaagcgaccgagctggtcaaccggctgatccgcgatctgaacatcaaggtgtccgacagcgcattgccggtgaaaaccctgtccggcggcaacgcccagcgcatcgccatcgccaagtgggtggcgacccagccgaagatcctgatcctcgactcgcccaccgtcggcgtggacatcgccaacaaagaggggatctaccagatcgcccgcgatctggcgcagctgggcatggcggtgctgatgatctgcgacgagatcccggaagcctattacaacagccatcgggtgatggtgatgcgcaagggcgagctgatcgccgagtttgcgccgcaccagagtaccgagcaacagatcgccgaggtggtgaatggataa

SEQ ID NO: 100092 - DNA, 213 bp, Glycine max
  Peptide Sequence Number=SeqID_216870
atggggatagatcagggcgatcggcatggaggcggcgcggtaagcgggcaggacttccaccagttcaccggcgtcgagcaggtgttgcacgtcgtagcgcgggatttgcatcagccccagcccggcgcggcagcaggcgatatagctctcggcgttgttgaccaccacccggctgggcagttcgagccgctgggtatggccgtcgtcggtcag

SEQ ID NO: 100093 - DNA, 269 bp, Glycine max
  Peptide Sequence Number=SeqID_216871
gaaacaattgctcagagagtgccacattctctccaacatcgaggctaaggaaatcaagggaatttcagtgcttgctgaacatggagaaatgccacttcagtggttaaagggaaggcagccattgatgttgtgggcaacccattgggggaagtctggagtaaccaaatccttggatatccactttaccacattgcgtaaagaggaagaacttgagaaagagatggaaagagtagctgcttttaatataccagtggtggctgagaatgagg

SEQ ID NO: 100094 - DNA, 729 bp, Glycine max
  Peptide Sequence Number=SeqID_216872
atggcagaatgcgtgacagacttggctcaggctgccgcgtgccgaaacagcgcggcggcaacacacttaaaagtgatttccatctgtacaatttttgttaccagcgtgatgggcgtgtcaacacccgtcatgctggcacgatattttcaaggaaaatctctgtatgatattgccatcttattgatcaaatgctttgctgctggtgtaattcttgccacctcattggtccacgtgttacctgacgccttcgccgcactctctgactgccaggtggcatctcagcatccctggaaggactttcccttcgctggcctggtgaccctcattggggtgctaatggccctgctggtagacaccgttgctagctcgcatatggagcacgggcactacacgccggtggagacgctggagaaggagggtggcagcagcgcgtggagcattgagctggctggtggtggtggtgaagtgcagagggttgaagaattaatgaggttgaagcagagactggtgtcccaagttttggagattggtataatttttcactctgttatcataggagtgactatggggatgtctcagaacgtttgcaccattaggccacttgttgttgctttgtcctttcatcagattttcgaaggcttgggtcttggtggctgcattgctcagcccgggggatccactagttctagagcggccgccaccgcggtggagctccaattcgccctatag

SEQ ID NO: 100095 - DNA, 216 bp, Glycine max
  Peptide Sequence Number=SeqID_216873
atggagttccaagctgaagctctcggccaactgacaagtgatgatcttgaaaaaatcaaggtttccattgtttgctcttctcatctacatatgtgcacgcctttgaatttgaaccgcaatgactttgtcttgtggctacagcttaataatggtgcaatcctccctaggaagggacaagtcactagcgccatgagcaagaggctccaagaggattag

SEQ ID NO: 100096 - DNA, 306 bp, Glycine max
  Peptide Sequence Number=SeqID_216874
atgacatcgatcaccaaccaaatccctcaactcacgtgggcttgggaacaactacacagggattgggagtggcagagttgttcttgggagcggttgaacaatgtgcataaaaaatttagtgaagaagagattagagcaaagaagatgagatttgtacctttcacaagtggtggcaataagacaatgatgaaggagagagcgcgagggactttttcgacaacaagggagagattcaccatcttagaagggtctagagtgaaggagaggctcaaggaagaaagctttgggagagggcatgagaagtga

SEQ ID NO: 100097 - DNA, 213 bp, Glycine max
  Peptide Sequence Number=SeqID_216875
atggatttcaatacattgacaacatgcactgtggttatggcattcacttcattagaagatgggcttgttgttgtgtttttaaatttgccaaagatgggtgatcatatcaatgttgttgtgcaccataaggataagttcaagagagatgaacatgacacattagagtatgtgaatggtgaatactgcatttgggaaggggttgataaacattaa

SEQ ID NO: 100098 - DNA, 384 bp, Glycine max
  Peptide Sequence Number=SeqID_216876
atgaaagtagattatggtgtgcacatagatgagaggaagattttcaagactttgaaagaggctaggttgatggttgaggatattgtggatttggagacaaggacaactagaggtggtttcttaatcatttgtgttcaagtcttggaaactaccaatagaatgattggaccttcatgtcagacattccgaaggatgagattatcagctcataatctgcacctcaaaatgaaaaaggaaaagatgttcaaccaattaacccctgcatttaggccaccactagttaagcctcctacaactatcataattgcattcccaagtgcactatcaccaagaatgatccaacctaattttatggacttcattcctacaccaaggttgtcatga

SEQ ID NO: 100099 - DNA, 207 bp, Glycine max
  Peptide Sequence Number=SeqID_216877
atgccaaagatactaagtgatgatgagttggttgatgttgttattgaccaagttgctgaagaagttaaagaacaaaatggtattgattcaaagattgaggaacatgaagtggttgcaaatggtgatcttaaaaaagtgactaaaattgatgatggaatagtgtctgaaaatgttaatgcaccagtgactgaaaatggtgatgcctag

SEQ ID NO: 100100 - DNA, 198 bp, Glycine max
  Peptide Sequence Number=SeqID_216878
atgttgcatttgttgaatgtgtgctggtgtttccatggggaagtcgcaccacacttgaggaataaagtgttacaagttcaggatatttttgaggaagctaaaatcattgcttggaagtggctcaggacaaggtctaaaggatttgtacattcctctggtttgttagatgataagctcaatagcatgtcttggagataa

SEQ ID NO: 100101 - DNA, 222 bp, Glycine max
  Peptide Sequence Number=SeqID_216879
atggttatccgcgcacacattttgctatcctacgacccgagagtccgatggcacgtggagaaaccttacggttatctgcaccccatcattcgcagacccgaagcccgattggcacgcaaagaccaatgtggtcatctgcacccttcccaaagatgtcagcgtcttccggtcgagaccgcaaacaagtctcaattctgcgatcgtgacccaagggtccggtag

SEQ ID NO: 100102 - DNA, 717 bp, Glycine max
  Peptide Sequence Number=SeqID_216880
atgccaccccctgcttcaccttcttcgtttcatcgcatcaaactggaggtccctcgtttcgatggtactaaccctcttggttggatcttcaagatcaaccaattcttcgaataccacccaacaccagagaccgagcgcctaaccattgcttccttctatatggaaggacgagcccttgcttgtactgttaatacttacctcttggagtttgaagacctcgccaatcggatcattggccttccaccgccgttccttttaagctgctttatctccggcttggctcccgagatttgtcacaaggtccagaccttgcatcctttgactttggttcaggccacaagattagcacgactttccaccctagtttcttctaccactttgccaccatcatcgttgccagtcgtgcccttatccccttcactttcgttgcctcctccaatgaaatcttatccacctctccagctcaagcgcttgtcgccggaagagttggcattgcgacaagaaggcgacctttgttttaactgcgatgaaaagtttcatcgcggccaccgttgcgcctctaaggtcttcttgttgattgtagatgaagacaagggtttctctttagataaccctgacttgggcttgtcacccgacccacctgacccacccacagtacctttggcccaaattagcttacacactctggagggtcaccttgctcctaaaacattgtga

SEQ ID NO: 100103 - DNA, 522 bp, Glycine max
  Peptide Sequence Number=SeqID_216881
atggaaggaagaagccaagcttctctcaccaacatgttggtcaacggaataagaatctcatctcctttgcacaacttaaaaaccactctagccaaaggagacatcaaagtgtgcaacccttctgttgacaaggatgatgagtacagcacttcccaagtatctctcttaacagggccatacaaagactttgagtgtgttgaagctggttgggcggtcaatcccagtgtgtatggagataggcaaactcggttatttgtatactggacagctgatgcttcaaacaaaacgggttgctttgatctgacttgtcctggatttgttcagattagcaattgccctgggtgcagcaatttatcccatatcaattcctggtgggcttcaaaatacataataattatttacatctataaggatccctataccaataattggtgggtgcaatatggtgagaagacaaacataggttattggccacctgagaaacaatacgttacaatgcggaatgtgtggagtggggggtga

SEQ ID NO: 100104 - DNA, 1782 bp, Glycine max
  Peptide Sequence Number=SeqID_216882
atggccctatcttctaccactttgccaccatcatcgttgccagtcgtgcccttatccccttcactttcgttgcctcctctaatgaaatcttatccacctctccagctcaagcgcttgtcgctggaagagttggcattgcgacgagaaggcgacctttgttttaactgcgatgaaaagtttcatcgcgaccaccgttgcgcctctaaggtctttttgttgattgtagatgaagacaagggtttctctttagataaccctgacttgggcttgtcacccgacccacctgacccacccacacacgatggtacttggagattttgtgttgattatcacgtgttgaacgcaattgcaattaaagatcgttttccaatcccaactactgatgagcttctcgacgagcttgctggcacgacttgcttttcgaaattggaccttctacaggactatcatcaaattttgatgcatgaggctgatgtttgtaaaacagctttccgcacacatcatgggcactatgaattcagagtgatgccttttggcttatgcaatgccccatcttcgttccaggcaacgatgaatagtgctttcaagtctaagaccttttgcgaccaccttaaccatttgacgaaggcattccaggttcttctcgacggacaattctttttaaaattatccaaattctcatttgcacaattccaagttaagtaccttggccatgtcgttttgacaaaagaggttgaaccagtacctgctaaagtccacgctattcatgggtatgagtcaatcacagcgccgctaaccaatctcctagccagagattcattcacttggtccacagaagctcaaacaacttttaatgatttaaaggcggctatcactactgctccagttctcatgttgctagattttatgctgcctttcaccgtggaaaccgatgctttcggtgtaggtatgagtgtcgtgttgtcacagaaagggcatcccatagcatttttcagtaagccctttagccccaaagtcctgcgcgcctccacatatgtttgggagctctttgctatcattgtagcggtgaagaaatggcgccagtatttattgggcaatcccttcataattctcaccgaccaccatagcctaaaggagttgatgatgcaggtggtacaaacgccggagcaacaaacctatttagcccaactcctcgggtatgattataccacccaatttcgttcaggaaaggctaatgtggttgcaaacgctttgttgcgcattccagagttacctccaaacaccatgttatctctttcggtgccctgcttaacatttcttgaagaacttaagcaacatcttgccagcaaccctgctttcaatgaattacgacagactatctctgctacgcccatagaacaccaagattattcacttgcgaataatttgattatgcaccatggtggcatttggttaccttcagcctcacctttcactcagacactgcttaaggagtatcattcttcacccattggggggcatttcggcatctcaaaaacgttagcacgtggttggcttgctctgtcctctcccagtaccatttcggctatgggaggatctctccctcgatttcataattgggttgcctgccttccacggacacacaactatacttatggtggtagaccgattctcgaagtggtgagggatgatagcagtaacgaacctcaagcacagcatggaccaaggcacaggcccgtaaggaaggtcactaccccaagctacttgaaggattacgtctaa

SEQ ID NO: 100105 - DNA, 1275 bp, Glycine max
  Peptide Sequence Number=SeqID_216883
atgcaatcaaggggtttgacccttgaagagggaaaggagagaatcaaccaatctaaacctttgagaccagtgcggctacttgtgttgttttttgctctctgtgttgtgttctcattgattagcatatacactgtcaagcattttgaaattgagagtgtggtgaccacagtgagttctagttttcagccatgttattatgaggaacctggtggtttggataagtggattaggccaccttcgagctcgatccacaatatgagtgacaaagagcttctgtggagggcttcctttgttccaaggatcaagggttacccttatcctagagttcccaagatcgcattcatgttcctgaccaagggaccattgcctctagcacccctttgggagaggtttctcaaggggcatgagaagttttattccgtatatattcattcactgccctcataccaacctcagtttccttcttcatctgtcttttacaacaggcaaatccctagccagtctggtggtggtaatgttgattttcttatcagtgttacttggttagtgcatcaggataagtctgtagctggggttaagatattgtcctactggattgtctacacatttaggattttacaggaaaatggaaaagtttctgagtggggaaggatgaacatgtgcgatgctgaaagaagactccttgctaatgcattgcttgatatctccaacgagtggttcattctgctgtctgaatcatgcatccccctctacaagttcagttttgtctaccactacataatgaaatccaaacacagctttgtgggtgcatttgatgatcctggtccatacggaagagggcgctacaacgagcacatggcccctctggtgaatgtcaccaagtggcgcaagggctctcaatggttcgaagtaaaccggaagctcgccatcaccatagttgaagacactacatttcatccaatatttgaacagtattgtaggccggcttgttacgtggacgagcactatttccccaccatgctcaccattcaagcagccaatgtgttggcaaacaggagcataacttgggtggactggtctaggggtggagctcaccctgctacatttggaagaaatgatatcactgaggagtttttcaatagagtacgtggaggtcacatttgcctatacaacaatagaaattcttcagtttgtgttctttttgccagaaaatttgctcctagtgctttggaacctttgttacatatggtggattcaaaggttttggactattga

SEQ ID NO: 100106 - DNA, 366 bp, Glycine max
  Peptide Sequence Number=SeqID_216884
atggtggcctctagtggcatagtttctctgctattgcctggaggtagaactgcacattcaaaatttaaaattccagttctagtttttgaagactcaacttgcaatatccatcaaggaactcaattagctgagctattaaatcagacacgtctaatcatttgggatgaagcacccatggctcacaaattctgttttgaggcacttgatcacagtcttagacatatcatcaaacacaactcaaaggacaatacaatctttggaggtaaagtcatggtctttggtggagatttccggcagatcccgccagtcattccaagaggtagccgcaataattccaaactgttatcttacttatatacattctaa

SEQ ID NO: 100107 - DNA, 1775 bp, Glycine max
  Peptide Sequence Number=SeqID_216885
atggacaggctcataaggttagacccttcaaacacagtcctaatcagggttgagccagggcaaaagtgccacggcaggatcaccttacacaacgtgatgtacacaatgccagtggccttcaggcttcaaccactcatcaagacccgttacacagtgaagccccaatcagggatcatatcccctttagccacacttaccatagacatcacctaccatctcccacaaggctcgtctctcccccactctttccctcactcgaacgactctttcctcttacacagcgttttggttcccggcgccgccatcaaggaaccctcctccatgttcgatgctgtccccagtgacttgttcaagaagaaacaggtcttcatcgacagcgccatcagggtcatgtttgtggggcctcacattctggctcggctagtaacacaaggtgcaacggatgaaataagagaagttttagagaaaagtgacccatcatggagaaatgttaactcgacagacccacaaggccaaacgttgctccacttggcgatttcgcaaggtagagctgatctcgttcagttgctcctagaattcgaggctgacgtcgaagccttaaaccgttctggctcaaccccacttgaggctgcatcgtcctgcaacgaagccttaattgttgagcttcttttggcccacaaagccaacacagaacggtcggaattgtccatgttcggtccgatccaccacgcagccagaggaggacacgtggaggttatgagacttctcttgctcaaaggtgccaaagtggattcactcgctaaagatggcaacacagccttgcacgttgcagttgaagagcacacaaaggactgtgttagactccttctggcaaacggtgccagaacagacgctaaaaatacaagagaaggtgacacgcctttgcacgtggcatcagcaataggagatgagagcatggtgaagctcttgctgcaaaagggtggtgccaacaaagacgtgagaaacagacaagggagaaccgcgtatgatattgcagtggaaaacggccatgcacacctctacgacgccttgtgtttgggggacaaactgtgcgtggcagcaaggaaaggggaagtgaggagcatccacaagcttctagagaatggtgcagggatcaatgggagggaccaaaatggttggacatcgctgcacagggcctcgttcaaagggagaatcgacactgtgaagcttcttgtagagaagggggcggaggtggatgcaaaggacgaagaagggtacacggcgttgcactgtgctgctgagtcggggcatgctgacgtgactgagtttttggtgaagagaggtgctgatgttgaagccaggactaggaagggtgtgagtgcgttgcaaatagctgagtcgttgcactacgtggggattacgagggttcttgttaatggtggggccagtagggaaaattgtgatgtgggtaaagtggcggcacttggtgcaattgcgtttgggactaaaatggaagctaggggtgtcatgaataaaaagaagaggggtggtggtggcagagccagaatgctaaatggtgagacactggttttatttactctagcaggtacccgtgcttgcggttgcacatgctgcatttatttcaatgatcatgacaacaatcacagcggtggtaataacaatagtcatgttggtggcaacgatggtggtcatgacaacgatcatgatagtggtagttacaacgatggtgtgatggttgtgacaacgatcttgac

SEQ ID NO: 100108 - DNA, 536 bp, Glycine max
  Peptide Sequence Number=SeqID_216886
ggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcggggtaaaccggcgggagtaactatgactctcttaagcgaaacccacagcccaagggaacggggcttggcggaatcagcggggaaagaagaccctgttgagcttgactctagtcccgactttgtgaaatga

SEQ ID NO: 100109 - DNA, 201 bp, Glycine max
  Peptide Sequence Number=SeqID_216887
atgtgggggtaccgtatggttatccgcatctttcgtcaaccaggggcgaacaagcccgttgacacaccgagacgtacatcgtcttctgcacattttgttatcccggggaaaacaagcctgatgacatgcggggggtgtcgtatggttatccgcatcttttgtcaatcagggccaacaaacccgttgacacgtggagattaa

SEQ ID NO: 100110 - DNA, 339 bp, Glycine max
  Peptide Sequence Number=SeqID_216888
atggcggagcgtggccatggaatgtattacacgccacaaatatttgctcagtatccttttgaaggtcatcacattgatacttctgcaagcgaacattcgttcggtggtgttgcggaaacacatcctaatttttcatggccgactataaccccttcacagcaatgtcatggcccaattccaacacctaataccccattaggtacacaatggaatgtaccgggaccaatacctaatgtggaagaaatcctgatcgccaagcacaaagatgggatcgaccatgtggcacttcctcacgtcatcagggacatcatagtgaatgattttattgtctctgtttaa

SEQ ID NO: 100111 - DNA, 273 bp, Glycine max
  Peptide Sequence Number=SeqID_216889
atgtataactattatgagaaaggaagagatcttgatattgaaagtgcattggcagacttcacgacgtaccaagctagctataaagatatagataaaggtcgattggaactcagtgtggaggatcagaaaatctcttttgacctctttgaagccatgaaacacttagatatggatgatgcctgttttgaagaaggagaggtggagcaggaaatagcatcatcagtttcaaccatgatactacagtttcctttggaaaaagaacttggtcatgtg

SEQ ID NO: 100112 - DNA, 735 bp, Glycine max
  Peptide Sequence Number=SeqID_216890
atggtagccacggcttaccaaacctcccatgaatgttcagaagaaaccattatagatatcttagtggcaggattttctggccaactaaaaggatgcgcagttaagacggatctcaatggaaaagtcattactaatgacgatgataaagagattcctgacgctgttaatacattaatttttacaatagcccaacatttcattggaaacccatccttgtggaaagacaggtccgcagaattattatccaatcttaagtgtagaaccttagcagattttaggtggtatagagatcctttcctaactagggtttacacaagagaagatagtcaacaacctttttggaaagaaaaattcctagccggtcttcccagatcattaggagacaaagttagagataaaatccgtagtcaatctgccaatggagacattccatatgaaaacttaagttatggtcaattaatttcctatgtccaaaaggtagccttaaaaatctgccaggacgacaagattcagaggcaattagccaaagaaaaggctcaaacaaagagagatttaggttccttctgtgaacaatttggcttaccagcctgtccaaaacaaaagaaaaaacaaacctctaggaaagaagcccacgatcataagccagccaataacagaagattttcaagacgaagatattctcaaaaaccctcaaccagtagagaaatagaaaatcctaaacaaaaaataaaataa

SEQ ID NO: 100113 - DNA, 495 bp, Glycine max
  Peptide Sequence Number=SeqID_216891
atgtcctcgcctgagagggctacattgccctcaccttgggtactagtaccctcaccgttgagaggactacacgtcctcgcttttagaggactacacgtcctcgccaacagagggctgcacgccctcaccttcagaggacgacatgtcctcgccttgagagggctacacgccctcaccttggagggctacgcgccctcaccttgggtactagttaccctcaccgtgagaggactacacgtcctcgccttgagaggactacacgtcctcaccatcagagggctgcacgccctcacctccagaggactacatgtcctcgccttgagagggctacacgccctcaccttgggtactagttaccctcaccgtcagaggactacacgtcctcgccttgagaggactacacgtcctcaccatcagagggctgcacgcccttacctccagaggactacatgtcctcgccttgagagggctacacgccctcaccttgggtactag

SEQ ID NO: 100114 - DNA, 195 bp, Glycine max
  Peptide Sequence Number=SeqID_216892
atgggttgcgcaattaccttatatatcacagtgattttcgagactgactgcaaaaccttagttgaaaacttaaagggtggaagaaacaacattactgaatgtggtgtcgttattgaccatatcaagcaaattctaaatgcacatccaggcaaagataattatatgtcactatgggtaaaagtgatacccacatag

SEQ ID NO: 100115 - DNA, 159 bp, Glycine max
  Peptide Sequence Number=SeqID_216893
atgcaagaaaatagtcgattgtgtggtgggtccggaggagcaagaaaggatgaaatgaagcagggcagcgcacgaatgggtgggaccactcctctcgtctggattgccttcggacccatcaaacgtgttcctgtacttacgttcattgtcttcttttaa

SEQ ID NO: 100116 - DNA, 342 bp, Glycine max
  Peptide Sequence Number=SeqID_216894
atggctacaaggataatgcttttaagaggtagcttaggagagtgtagtagtgaaagcagatgcaaatgcaccaatggtggaggatttactctcgcgaagcaagcgaaaatttttgccaaggaaaacatatgtagaaagccccatcataggggcattgatggcagagaagtggggtccaatatgatgaaggacagaatagaaaaaaaacattttctaataatgggaataaaggatcttgatttcaagatcttgataagggatgtatttgtgggaagctcatgggcactctggaggtatttagtgcctatgggatttggctatgtgaaaggtgaaagttcttga

SEQ ID NO: 100117 - DNA, 549 bp, Glycine max
  Peptide Sequence Number=SeqID_216895
atgttcacaacttggatgcattctaacaaaatatgttcttatggacgggatcttacatatcatcaatatatctcaagatttgtttatgtcgcccgcaaaagatgctggcaaccaagaaaacaagggaatacaataggcagactcatatgggtcccaccttcagctggtgaactattttaccttagaatgatgctatccactgccaaaggtgcacagtcttacagtgacattagaacagtcaacggtctggtatatcctacatttagggaagcatgttttgcaaaaggctttctaggtagtgatcaagaatttatcagtgctttacaggaagctaataattggggtattgcacactacctaagaaaattatttgtcaagcttttatttatgaacaccatggacagaccagaatatgtttggcaacagacatggcaatggatggcagatgatatcatattcaatcatagaaaacaaggtattcaccttactaaaaaggaaacaattcatttatgcttaactgagattgagaatatgctacaagcgaactga

SEQ ID NO: 100118 - DNA, 297 bp, Glycine max
  Peptide Sequence Number=SeqID_216896
atggagaatggggagaacattctcgatgccatcttccaagacgaaaacttggaggacgatgttgagatgattgacgttgaagaaggggaattggttgagctgaacgattcccaaaacggcgtcgtagaggcggataacaaaaaaccgcacagtaagaagcgcaggcgcagaggtaacaagagaaataagaagaagaattcaggaacaaccggtgccattgacattgacaggcctagggagacagaaaataaaaaccaagagttgcgttacgttcacgagactacttcagttacctga

SEQ ID NO: 100119 - DNA, 618 bp, Glycine max
  Peptide Sequence Number=SeqID_216897
atggtgtatacagctgttgcttgccttggagtttgtgcattgagtgatctcatcaatgaggtggaggctatacaggcttgtggaggccagatgactgttgatggtaggcgatttcgaacagggggtggtgtattgtggagtatcattaaggttcgcgaaccaaatgcttacaaagagataataaagaaagcaaaggagtttgagaacttgagcaaggggcaagaaattgttatttatgatcctatgatgaaggtggatattggagaagggatgggtaaaatagatagtgaagtgaatctagtcatgtacaaggaaagggatattcaaaactgcattaaactctatttggtgggaggagagagaaggcagccaaatgtgaagcagccacctgtgcaaaagaaagaggattcttttcaaggggatgacacctctacatttgctagcggtcatcagggcactgtttctgacaaatccttttctgcattgcaaatgcaagatcgacaacataaaccatcaggttctgaagagaaacgtaactctgttcatgacagattaaggatacatgtttcttatgatgatgatctgcttggattaagtgcagataatgacacagcctga

SEQ ID NO: 100120 - DNA, 495 bp, Glycine max
  Peptide Sequence Number=SeqID_216898
atggttgtcgtctccactgatactaccacttttcacactgatggtgaaccaaccgttcatactaagcacttctttgacattgatgagttggagaaagttggccttaaattccacaagaccatggacaccattgccaaggctaatgggtgccttcatgaaggaagcacctactatgaaggatgggagaaggcttataactctcaaatccacagagccctctatgcaaaaaaagtgggtgaccagaaagccatcacatacaatctcttgtctgaaagggctaagatttgggcaaacaagcttaacaaaagtgtcctccacaaggttggttcaaaaactacactctctgatttacataagtttgtactattccatcttatggaaaaccttccatttgatctaccaaataccatttacatcaacattctttgcaattcaaggaacttgggaggaatggacaacatctactatgctactctcatgaataagctcttatga

SEQ ID NO: 100121 - DNA, 717 bp, Glycine max
  Peptide Sequence Number=SeqID_216899
atgggtatatgcatatccgttgcagaaggagttaacgatgataatgtgacaatatttcaagcaagaaaggtcccgaatgagagtcagagactttgctctgtttactcccaacagggtagcaaaggactcaaccaagatgctgcctctgttcacgagggttatgggatggaagatggaacattttttggagtttatgatgagcatggagggaatggacacaaagtgagcaaaatagtaagcagtcgtttatcttccctcatactggaccaaaagaatgttcttgaaaagattgatgcaatagagaatggaatcggctgcaagaaatggaaagaagcaattttaagtgctttcaaggtgatggacaaggaggtgaagcttcaaaagaatttagattgctctagcagtggaaccactgctggtgaaggtcttgtcattgctaatctgggtgactcaagagcagtattgggaacaatctgtgatgaaaaaactcatggccattcaattgaccacagatttgaagccggaattacctccaaggttcttaaattacttgcgacagaagccacagtaatgagctatatggtgtgggatgtactaagcaacaatgaggttgcatcaattgtgtggggtgtagacagtgaagaggcagtagtggaagcagccactgctgcatggaacgagaagtatccttcctatatggcagatgactgcactgtg

SEQ ID NO: 100122 - DNA, 195 bp, Glycine max
  Peptide Sequence Number=SeqID_216900
atggaatctacttccatcaaaccaaacacccaggagatgaaaacacccacacacccaacaatgtatattggactggacaaggaaccaaagaaggtggacaacactcaatacagagcaatgattggttcaatactgtacttgaccacgtccagacctgacataatgttcagcgtatgcttatgtgttagattctag

SEQ ID NO: 100123 - DNA, 453 bp, Glycine max
  Peptide Sequence Number=SeqID_216901
atgggcaaaattgcccttgcattaaaaaaaataatttcttcttccggaagaaggttcttctggaaatcttccggaagaaggttcttccggaaattttccggaagaaccttcttccggaagaacaatttgtgttctaccggaagaacctttttccggaagaaccttcttccggaagctttccgaaagaaggttcttccaaaagaacaaattgttgttctttcggaagaaggttcttccggaaagtttccagaagaaggttcttccggtagaacaatttattcttccgaaagaaggttcttccgaatgaacaatttgttttaccggaagaaccttcttccgaataagttaccggaagaacttcttccggtaacttctccagaagaaggttcttctgatagaataaattgttctaccagaagaaccttcttccgaaagaaggaattatttttttaa

SEQ ID NO: 100124 - DNA, 204 bp, Glycine max
  Peptide Sequence Number=SeqID_216902
atggaacataatgtgcaaaattggaaacacgaggtgagctttggtgaaggtgaaggggccggtgttcattgttgcggtggttggttcaacgtcggtggcaaactagttgatatcgatgatcaaaatgaacaagaatgtggtgtgaatgaaccacaagtttattgctcggatgcgttcaatacttctcaggtgtttgacagctga

SEQ ID NO: 100125 - DNA, 222 bp, Glycine max
  Peptide Sequence Number=SeqID_216903
atgttgctaagtagcaatgtcatacatatctgtgtaagagtggtcatgttggtgcgcatgatccgcactcgtcactttgcagcagcacgggtgaaatcatgccctggtatgcatagtagttgggcgatagcctccctctctggttgtgcttgcacagttggtcgccttccaatatcagggggtggcccaggaactgataaaaggaaattactggccccttaa

SEQ ID NO: 100126 - DNA, 264 bp, Glycine max
  Peptide Sequence Number=SeqID_216904
atggactccagtggagatataagcattctaaaatatgccgcatatttctcagaagcaatctctgtgggcgtattgcgtgaggatgttgatcatgttattgcactctctgagctgatcaagttaggcttcctggtgaagtttaatgaggaagcagttgatttcttgatggaatcaaaggatttgcagattttcttggaagacgaggagttgtctaggtggggatgtagctactcagaaagaaagtataatatgatgaggttttga

SEQ ID NO: 100127 - DNA, 819 bp, Glycine max
  Peptide Sequence Number=SeqID_216905
atggggattgggaattcaaagtcaaatgcagttgaaggagaggggttaccagccaaaatccgccctatgctcgttagccgatatgaggagttcagaaaacgtaggaatagagaaaccaccctctccaagaagaacctgttgaatgaaaaggatgacaattctcaatcttcacacagaactgaaacagaagataaggtttcttcttcaaaggagattgaaccacctaaagaggaaacggttgagcgagtaataaccgcagaaaaaatgtccagagtggttccgattcccaactctgaatgtgaaaatgtggaggagactcaccccaacaaagttaagatagagcaggttaacaaaaacatggatcccaaccaagatatattgaatcatgctgttgagatggccgaggcagaactagtggaagagacaaaggaagaaaaggagcaagaagtgggtgcaaaaggtgatgatcatcacgaggatagtgacgatgaagatgaaagtgaagaagttggcaggtttctatgtcctggatcgcctagtttcagaatttattgcaatgaggctgagaaaagaaacgaggaagaatgtaatagtccagccattgtcgtgctccataagtcacgcagtgcagacagtgttcaaacagctgaatcaacaaattcaaacgaggaactagaaccaacttcgaagagaaaaggacataagaagaaatttggggctatgaggactctactcaaagttaagtcgctctatcacccaatgtgtacctgtactggagatgaccgaagtcttattgttactacaaaagcaacgaaatga

SEQ ID NO: 100128 - DNA, 1056 bp, Glycine max
  Peptide Sequence Number=SeqID_216906
atggctgtgcttatggctctcacactcttcgttctgatcacccttgtagtgacctctgcaagagatcctggcatagtacctcgtaatgcccagcctccgcagccagatgaccatcatgggactgataatagcaacaataggcaaatttcattgtcacgatttccacgaacaaaggatgtaattctcaatggtataacattgaaagtcaaatattgtgatacttgcatgctctacagacccctccgcgcttctcattgttcagtctgtgataactgcgtggagcgatttgatcaccactgcccatgggttggtcagtgtattggactgcgaaattacaggttctactacatgtttgttttctctgccactctgctttgcttatatgtacatgccttttgctgggtctacatcgtgaagatcaaggactccgaggcaatatcaatttggaaagcaatgtccaaaactatagcatccatcgtattaatagtttacacctttctttgttcctggtttgttggtggtctcactattttccacacgtacctcatcagcacaaaccagtctacttatgaaaattttaaaaaccggtatgacccacaaaccaacccatataacagagggatggttaacaacttcaaagaagtattctgcaccagaattcctccatccaagaataatttcaggtctaaggttccaagggagcccttagaatcatatcaaagaacgggtattaggcccttaagcccaatgatgaaaagaagaaccagaaccagaagtatggaattagtagggaatgcagtttataatgagcaagacgaggaggaaagtaattatagagatggattcgacaatgaagcacgtagcaaagatagtggattgaccgataagtccctggatttaagcaggatccttcacacggaaggagtggagggagaagaaagttcaattagacaccatcaatgggaaggaactacagaagttcaggacagcataacagaagttggggaatcaaattcggctactgcgcctaattgctcaactagagaagttgtatag

SEQ ID NO: 100129 - DNA, 594 bp, Glycine max
  Peptide Sequence Number=SeqID_216907
tcggtaccgtcgatttcgccgtcagcggtgtcgtactcgcaccaggtcggcggtgcgagcaagaagattgatatccccaatgggagggttggtgttatcattggaaaaggtggtgagaccatcaagtaccttcagctgcagtctggtgccaaaattcaagttactcgtgatatggatgctgatccgaattcggctactaggactgttgagcttatgggttctcctgatgctattgccactgctgagaagcttatcaacgaagttcttgccgaggctgaaactggaggttctggcattattgctcgacgagtggctggacaagctgggtctgatgagtatgtgtcaaagatccctaataacaaggttggtcttgtaattggtaaaggaggagaaacaataaagaacatgcaagcttcaactggagcaagaattcaggtgattcctcttcatcttccaccaggtgacacatctactgaaagaacattaaaaattgaagggacccctgaacaaattgagtctgcaaaacaaatggttaaccaagtcataagtggcgaggtttatgactactgtcttaaacttccagggcctgtctag

SEQ ID NO: 100130 - DNA, 566 bp, Glycine max
  Peptide Sequence Number=SeqID_216908
aaaccctgaccgatggagtcgaaggaagagccgttgttgtcgtgcttggggcgtttggtggggtcgaggggaggggcgcctctgaggaggcgagcagcgacttcttgggcgcgctgtttggcgagctcgaagtcggaggcggcggaggaggggggagggacgctgttgtaggaggggggtggcggcgccaccgagtcggggccgtcggagaaaccggtggggcggtcgtcgttgtacttccgcttgagggagggtggggtggggatgctgtcggggttcgccgaatattgagattcgtcagccatggggattgggttgaggaagaaaccctaatgggagagagcaatttttttaaggcaacacaaggtgtgttccaacaaccaaagagagagtacaagaaagttcccataatacaaagcctctcaaagagagaaaaccattccaaaacaccaacaagcctcccacaacaaaagggtcagcaacatgatgatcccacaactatctcagatcaagcctcccaaaactgctgcaaaaacaaaagatctagacctcacacgacttggtaa

SEQ ID NO: 100131 - DNA, 306 bp, Glycine max
  Peptide Sequence Number=SeqID_216909
atgcctgagccaaggtgggtgatctcaatgggaagctgtgctaatggaggtggatattaccactattcatacgctgttgttagaggatgtgacagaatagttcctgttgacatatacgttccaggttgtcctccaactgcagaggctttgctatatggcctcctccagctgcagaagaagatcaataggcgcaaggacttcctctggtggtggaccagatgtgaggctaagcttgtgtgggttctggagaagaaaaatgcagttttggaggctaaagctgctttggacgttcctttcactttttga

SEQ ID NO: 100132 - DNA, 237 bp, Glycine max
  Peptide Sequence Number=SeqID_216910
atggctctcgtcacccgaatcggactcacgtggcgcctccctcagcggctagtttccgcgtctctccacagcaattccactggcaccaccgctcccactagttactccggcggaattcgtgatctcgaaggtggactccctcttgaactgggcccgcacagggtccatctggcccatgacgtttgggctggcctgttgcgctgtggagatgatgcacacgggcggggcccgttatga

SEQ ID NO: 100133 - DNA, 234 bp, Glycine max
  Peptide Sequence Number=SeqID_216911
atgttgtttggcggtggtgggagtttggtcatggtggatgaagggtggagaagatggttttggaaggagcacggcggtggtggtgcagcaatgttgtttggcggtggtgggagtttggtcatggtggatgaagggtggagaagatggttttggaaggagggtggagaagatgatctggtcgaagatgatgcagcgcgacgatgctggtgcaatagtgctatttgtgtgagatga

SEQ ID NO: 100134 - DNA, 564 bp, Glycine max
  Peptide Sequence Number=SeqID_216912
atgattatgaggcaggttctagctgaaggtcctttaattcagtttcaaaactttgttgtgatgatgggattttcagtctatgaagatgagaaaacacaatttattcagcaaaatattggtatcaatttgaagtccgacgatgacagcttaagagttctctacttttgcttaggtatggaagaagttgtggaagtttggattaatttttttggcagccccacaataggtagagcaagatatgaaggcataacaattagagaaactaacaaaactggaagattggtatatatggactacatttttggaaatgagactgaagcaagaacattttctaaagctcaaggttgggagatttctcacttgccaaaagcatcacaaaagcataaaaggattactgttatcacccaaggtgcagatcctgtttctgttgctgaggatgagaaaataaaattgtaccctatgatactattacctaaagacaaattagttgatacaaatggagcaggagatgcttttgtgggaggacttctttcacaattggttaagcagaagcccattaaataa

SEQ ID NO: 100135 - DNA, 387 bp, Glycine max
  Peptide Sequence Number=SeqID_216913
atggctcttgtcacccgaaccagacccacgtggtgcctccctcgacgactacttttcgcgtccctccgcagcaattccaccggcgccaccgctccccctagttactgtgcgccgccgtcgatgatagcaaattcttcccctgtgggccactcaaagccggtagagttcgtgatctcgaaggtggactcactcttgaattgggcccactcaaggtccatctggcctatgatgtttgggttggcctactgcgacatggagatgatgcacacaggcgcgacctactacgatctggaccgctttagaatcatctttaggcctagcccgcatcagtccaattgcatgatcgttgctggaacactcaccaacaagatggcccatttttattaa

SEQ ID NO: 100136 - DNA, 528 bp, Glycine max
  Peptide Sequence Number=SeqID_216914
atggcctcggaaacccaccatcatgtgcaaggcctaacacccgaggaactaaccaaactcgaacccatcataaaaaaataccacttattcgaacaatctcccaacacatgtttttccataataacatacaggatcgaagcgccggcgaaagccgtgtggcccttcgtccggagctttgacaaccctcagaagtacaaacacttcatcaaagggtgcaacatgagaggggacggtggcgttggaagcataagggaagtaaccgtggtttcgggcctcccggcgtcgaccagcaccgagaggctcgagattttggacgatgacaaacacgtcctaagctttagggtcgttgggggcgagcaccgactcaaaaactatcgttcagtcacatccgttaacgagtttaacaaagaggatatacctgaagggaatacggaggaagataccaagatgtttgttgacaccgtagtgaaactcaatcttcaaaaacttggggtcgtggccatggcttcatcaatgcatggacaataa

SEQ ID NO: 100137 - DNA, 210 bp, Glycine max
  Peptide Sequence Number=SeqID_216915
atgtggtggtatcgtggtcacatgcgcactcaaagggaggaaggaggtggcaatatgatgatagtgagcaatggtggtgtttatggaagaacgaaggaaatgtggtggctaaaaatcgtcattattcgtaaaagaaaatcatcaaaattcacaattctaatggcgtctgtaacacctcgaacaaataacactggaatgggagggatctag

SEQ ID NO: 100138 - DNA, 768 bp, Glycine max
  Peptide Sequence Number=SeqID_216916
atggaggctggtcatgtcttgacgtcactgtcatctatagaggttactcagggttctgaaaatgaagttcttttaaaagaagtcctgtacaattctgtgatgatgatagactattcattcattaatcctcaagcagaatttttactatatgccaacagcttgaaagatgttgctataatttggttgtttgttgctgagttagcagtacagtctgctagggaaaaaggtgatcatgggaaagctatgtcttatataaatgccttctgtagatcctgcatacccattcaattgatcaactgggttactaatcaaaattgcgtaggcagaaagatcaccagaccaaatgtttccactcccatagctctcataaagtggcttattgttgttgaggaacaaggaattgcagtttttgctggtgaaactgccaagcagataaacatcatgttcaaagctaactttttcacttcaagaactgagtgcttgcttccagttatcaaacatttctttaacaatctggataagaatctctatttgaattctgtgaatggagaagccggggcagataaacttgatggtgatgtggagatgcttgatactgcagacactgtaagtttgcctgctgctgatagtgtgaacagagttattgatggaacaagaaaacgcaaagaagggattgaggatgatactaaaacacagctaaagtatatgagatgtcaatttcatgagaattcagtcagagaaaactcgtttatattcaggcaacagtga

SEQ ID NO: 100139 - DNA, 798 bp, Glycine max
  Peptide Sequence Number=SeqID_216917
atgttcttatctcaacaatactacattcaggatatcttgcaaaaaggtaacattattgatgcaaagccagttggaactccgatgtctactacctgctcgcttagctcacacgatgatacacctagttgtgattcatctttgttccgtagcatcatcgaatccttacactatttatccatcaccaggccagatgtcgcattcaccgcactcaagtgtatcctacactacctcaagcataccatctcacatggtctacaactcattgcaaccaaaaactttgatctcactgccttttgtgatgcagattggggtggtcatacaaatgacaaaaagtctacacatgcctatattgtctatcttggtccaaatgctatatcttggtcttgcaagaaacaatccacagttgcaagatcctcaactgaggttgaatattgcaccattggattaacgtttttggaacttctatggctacaacaactactattggaacttggcatcaaattaaccaagcaaccaattatcttttcagacaatattggtgccacatatctttgtgcaaatccagtttttcactcaaggatgaagcacttaggtattgattaccattttgttcatgacattgttgtcaagggtgaactcaaagtgtctcatgttccttcaagtcatcaattagcagacttgctaactaagccactctcctggccacaccatgagtttctcatcatcaagattggtatcgttgactcctcctccatcttgcaggcacatattagtgataaatgcaaatataggatttaa

SEQ ID NO: 100140 - DNA, 963 bp, Glycine max
  Peptide Sequence Number=SeqID_216918
atggccgattcaacctcaagcgattcactctctttagacatcgattccttatctccttcacctcaggaacatatcatcagaacacgtcatggttccgtatctgttgctgtatatggagaccaggataagccagctcttatcacatacccagatttggctttaaattatgtctcctgctttcaggggttattattttgtcccgaggcatattaccttctgctccataatttctgcatttatcatattagtccacctggacatgagttgggagctgctgaaatcgatccagattaccctattctttctgtagatgacttagctgatcaaatagctgaggttctcaacttttttggtcttagtgcagtcatgtgtatgggagtaactgctggggcttatattcttaccttatttgcagtcgtgtcaaatttactatacttttatggcatgtgtggggtggtaaaggaaatattgctgaagcggtactttagcaaggaaattcgaggtggtactcaattgccggagtcagatatagttaaatcatgccgaaggttgttggatgagaggcagagtttgaatgtgtggcggttcctggaagctattaacgggagacctgacataagtgaagggttgagaaaactacattgccgttcacttatttttgttggggatatgtcaccatttcactcggaggctgttcacatgacttcaaagttagacagacgattcagtgccttagttgaggttcaagcatgtggatcaatggtaacagaggagcagcctcatgccatgttaataccaatggagtactttctcatgggatatggcttgtacaagccatccaagctgagtgtcagcccaagaagccccttgagcccatcttgcatttctcccgagctttactcgccagagagtatgggtttgaaattgaaacccataaagacacgaatttctctggaaatctag

SEQ ID NO: 100141 - DNA, 465 bp, Glycine max
  Peptide Sequence Number=SeqID_216919
atgcgtgcatgtatggttgatgttgttgaatttcagaaagtggttattcgtaccaaaagtgtagagttcatgcctattactctgtcactcctcctcacagtaagtgcaatgatgtggatggcatacggtattctcctgagggacatctatgttacacttccgaactttgtgggtatcacatttggaacaattcagatagtgctctacttaatatacagaaagaacaagcccgttaaggatcaaaagctgccagaacacaaagacgatgttgccaatgatgaaaacgtcaacacagctgtgagcggtgagaatcggggagcaaacgccactggattcgttgatattgagattggagagaagaagcaagttcaggaacaagcagacaaaaaacaggaccagcaagctgttaatgctcgtgaccaaacagaacacaacaacaatagcaacaaaacaagggaaggttga

SEQ ID NO: 100142 - DNA, 339 bp, Glycine max
  Peptide Sequence Number=SeqID_216920
atgccggaagaggatttggtggacatcaaatttaggttgtacgatggttctgatatcggacccttcagaaaagttgaggcaaggaaatctggagtggtcaccggtgaagccgtgaaggtggattgggatgcactaccatctagacatgagactgaggcagctgtagataggtactatgtgtggttggtgctcaatcaaacagaagttgataatcactggataaagttcatatgggagaggaggaccaaacaaaaggagttccaggttttttggaactcagcaacagagattatgatggaattggtcatgaaggatgataccgatgcaataccatgttga

SEQ ID NO: 100143 - DNA, 255 bp, Glycine max
  Peptide Sequence Number=SeqID_216921
atgggagaggaggaccaaacaaaaggagttccaggtaaaaccgtcgtgccaaagtcagctaatgaagtgaaattgattagttctggtaaaatcttggaaaacaataagactgttggtcaatgtaaagtaccatttggtgagactccagggggtgttataataatgcttgttgttgtacagccatctctagcaaaaactaaagctggtacgttccatggacttcttgctatagggaatatatataattttagttag

SEQ ID NO: 100144 - DNA, 1893 bp, Glycine max
  Peptide Sequence Number=SeqID_216922
atgggatggggtcggggatacccgatactcgacgggtacggggatgggataataaattttaacctgtcggttatcgggtacgggtatgaggacatgttcaggagttggggtaggggattggggagacaatacccgtccttgccccgccccattgccatgtctagtcccgagccacgatgctggctggcccatttagcccccgggttatgcaggcggacgtgggccttctcaaacaaagtccgcataagcaggcttaatgggcagactatgcaggctgtgggctatgttggtgcgggctttaatgagcggctctacacagagcatagggttgctgtcttacacatttttgaggagtactgggaaggaagacattgtagtacccatgtacaatggtcaccattttccaatgaggctgatctacttcttcagttcaacttggtgaaagatcatggtacacgagtaattatatacaatctttgggaagatgaccaaggtcagctggaacttgatttcgatgaagacccacatgatatccaaataagaggcgtaaatcgagatgagaaaaacatacagatgtctaaagagtttcccaattctagacatttcttgacctatcgacattcactaaggagttatacttctattttatatctgagacttccttctggcttccgaattattcttcgtgggaaagatattttgcatcacaacatagtgaatgatatgatgatgtctcaggaggtgacctacaggcctcaagcaggagtcgatggacttcttccaaaggattcaaatatggttgctgttgttactattggatttgtcaaggatgcagtacaccatgttgatgtttcagcttaccctctttctccctttaaaaatttctgtggcccaagtgcttttgagattatgaagaatatcttttctgttaacctggccattctggaggatctggaatccagctggaagtggagggcgtggggtgtgttggaagccaattttgttgaacctgctcatgataagcagggctttgagcgtacattagttttatcaagactggagtctaaattgatacaaatgcagaaaaaatactggagcactaactgccataaaatcggttatgcttccaatcgaagtaaaatacaaataagagattatgctgataaagaggcatctcctgattattttccagaatcatcacaatcaaaaaggaaatattctaccatggatgacaaggctacaccgttgacatccgacaaattgcgttcacactcggatcagaaacggatacaaaaacaaacagataaatatattgcctataaaaatggtcaatcttcggtctctcctagacgcagaatgcaaagtttatctgaacaatcatcatctgatgacgaagtcagtgaagtcttgcctaagaaaaaaactcaaaagatatctactgctgaaaaatcatttgaaaaggagaatggatgttctcaagataccacatcaaggggaaaatcctcacagtacacacgaggatccaagctagagggaaaaagtgttaatgatggtgagcaaccaccatctgacaacgatttactaactctcgagcaattgaaaaaagagaatcgtgagttgaaggagagattacaaaggaaagaggaggatattttagggcaagtgttgcaggatctgcagcatgagaaagacaggtgtaaatctcttgaaactcagctcattgatgcagaaaaaaagcttgaagagttgaacaatgagcaggaaactctcattgatgtattcgctgaagagagggatagacgtgatgctgaagagaaaaaattgagaaataagctcgaggttttactcttgcctagtgcatttcagaatgagtacaagcaacacacgttgtaa

SEQ ID NO: 100145 - DNA, 900 bp, Glycine max
  Peptide Sequence Number=SeqID_216923
atgaggatgggaagaaaatgttcctattgtggaaactttggtcacaattcaaggacttgcaacactcacaaaaggggactaaagctttttggagtgcaacttgacctttgttcttcttcttcttcatcatcattgcctttaacatctccatgcacctcttcttcttcatcaacaccctttgatatcatgaaaagaagtttgagcatggattaccttgtatcttcacgaatcatctcaccctcttataattttctgcttggtggtggtgcggatgaaaattcatcagataaaacaataactgatgggtacatagccagtgtcggcggtggtggactcacttcaacaactcatcatcaagaaaggaaaaaaggttctctccaaactttacttgcgtttgttatgatgtatggttctaataataaattttgcattacttctaagcaaggagagaaatacaagaaaagaggtgtgccatggagtgaagaggagcaccggaaatttcttgaaggactggagaagctggggaagggtgattggagaggcatttctaaaaaatttgttataacaagaacaccatctcaagtggctagtcatgcacaaaaattttttttgcgtcaaactagcttcaatcaaagaaagcgccgtcgtagcctctttgatatggaaagagatgaaaccactacacttgaacagtttaatacttgtttcaaggcaagtggtcaatttgggtccccatcagggactataattacttgtcctcagtgggtttcttgcaatcattcagtgctgaattgggcaaccacttcaacaaactacactcatcaaagtgcttccccagacctagaactcaaactagctgttcccattctaacagagccatgcggcagaacagaattataa

SEQ ID NO: 100146 - DNA, 210 bp, Glycine max
  Peptide Sequence Number=SeqID_216924
atggctccacctaaagaaattgcgatcgtcatttatcacaatggtcacatagcaaccaagttcaaggatcgatgcacacatggtctgacacgttatatttcaacacaactactcgataatgacgatctcagaggcgcgatggaaacaattctccagaattcacaattgaattctgctaaattctatgctattactgaccttattccttaa

SEQ ID NO: 100147 - DNA, 3882 bp, Glycine max
  Peptide Sequence Number=SeqID_216925
atggcagacgcaactcattctaaggtttcctcagatcgcctggaagacgcaattgcgaaactcacaacctctcagctcgccatgaattcgaaaattgatgatcttcttcatcgtatgttgcaactcgaagtgaaccagcaaccgccgcaaatgccaccgtcttcgtcggcaggacagacgccatcgtcatatagtccagtgcatcgtatgaagctcgacgtatcgaggttcgacgacttcaatccaactggttggaccttcaagatcacacaatttttcgagtatcactccacgcctgatcaagaatgcttgacaattgcttcgttctatatggaagggtcagctctcgcgtggttccaatggatgcactgcaatgcgcagctttctttgtggtcaacatttcttcatgctttgcactctcattttgcttcgtctacatatgaggatcctacaggtttgttgtgtaaacttcagcagcgttcttcggtaagcgcttatttgtccgaatttgagtctctgacgaattgtataatgggactaccaacaccatttgtgttgagttgctttatttcggggttgagtcccgccattcgccaggaggtgcaagtcctacaacccgtctccttggctcaagcatttgcctatgctcgcttacaggaggagaaactcctcgatgcacgcaggccacctgcacatcgttttcaaccggccacccgtctcacaccagaagagctcgcgatctgccgcgagaaagggttatgcttccactgtgatgagaagttttctcgaggtcacaagtgctcaccctcgttgtttctattggtgatggaggatgaagagctcgcatcggagctcagtttgcatgccttgtcaggccactcagcacctgaaactttacgtatgaaggggcttattgacgagcttcacgtcagtatcctgattgatggaggcattacggtggataacggagacgagattcgttgtcatcaactttgtacagccgttacaatacaaattcaaaggcactctttcactgttgactttcatatcctacctttgtgtggcgctgacatcgtgctaggggtacaatggcttaaaaccttgggaccggtgctcacagattacacttcattgaacatgaagttcattacaggcggtaagctagtcgaattgcatagtgaccgcgagaaagacatggaacctgtttcccattcccagttacgtcatttccttcatacgaacccttctagcaccttctttcatattcgcgtggaagcatgccctcaatcgccttcctcgacacaaaccttactagaaatcacctctttaaccaccaaatactcttcattattccagtcactcacaaccctaccaccctcacggccaacagatcactccattacccttctacccaactcgactctagatggagcatggcagttctgtgtagactatcgggctcttaatgcaatcacagtgcgagatcgttttccgattcccacggtggatgagttgatggacaaacttggaggggcacgttggttctttaagttagatttgatgcagggataccatcatatctggatgcgcgaggctgatatcagtaagactgcatttcgtactcatcacgagcattatgagtttagagtaatgcctttcgggctttgcaatgcgccttcttccttccaagctacgatgaatcaattgtttcaaccatatttacacaaatatatcatcgttttctttgatgatattctgatatatagcaaaacgatagctgatcatctctttcatttggaaagcgcttttcagattctggtagcaggtcagttctcgttaaagctttctaaatgtatgtttttgcaacaacagttggaatatttaggtcatatcgtggcgggtgaaggagtacgacccgtgccggaaaaggtgcagactatacagacttggccaactctgcattcaccttgggctttaaggggtgttctcggcctcgtctggttttatcggcggttcattagagggtatgcagctttggcaacacctctcaccaagctcttgtgccatgctcagtttcattggtcctccgaagctaacgtggcttttcagaacctcaaggacgctatcacaacagcccctgttcttgccttacctgacttcaaggttccctttgtcgtggagacggacgcgtcgggtgccggcatgggggcagtgttgacgcaaggagaccaccccatcgccttcttcagcaaacagctttgtcccaagttaataaactcttcaacatatgtttgcgaattagcagccatcaccgccgccgtcaagaagtggcggcagtatttgctagggcatcacttcatcattctgacagatcaccggagcttgagagaactcatgaaccaggcaatgcataccccgaaacagcaccgttacttagctcatttgttgggtttcaattatacaatccagtatcgctcagacctccataaggaactggcgtccttaccagcattcgttgaattgcgcgatcaaattcaagttgatcccacgacttacccaaaatataccttgacctcgaaactcatcttgcacaagggacttatatggctcccctttaactcgtcctttatcaagctgttactcgaagaatttcaccaatcacctataggcggccatatgggggtacagaagaccttacatcgcttacaggagaatttcacttggagttcaattcgagaggatacccgcgcttttatcataagttgtttaacttgccaacacaccaaatatgaaaaccggaaactaacaggtctactttgtcctcttccggtgtcggcacaaccctgggaagacttgtcagtggacttcatcgtagggttgccagcctatcagggaaacacctgcattcttgtagtggttgatcgtttttctaaagggttgcatttgggcatgttacccactcatcatactgctcacgcagtggctatcctgttcatggacatggtgggacgacttcatgacatgctgcgaaacattgtttcagaccgtgatccgttgttcatcagtaagttttggagggaacttttctccttaagtggtacgaagctccgcctgagttcagcgtaccacccacaatctgatgggcaaaccgaagtcgctaaccgcatcattgaacaatatttgagggcgttcgttcaccaaaaaccttcagcatggggccgctatttgcttcaacaggaggcagtgttcgagttgcttcgccataagctaagtaaagctcaaactcgaatgaagacaatagcagataggcatcgccgtgatcaagagttcaaggtaggggattgggtcttggtgaaacttagaccacacaggcagacctcagccatgggctcagcttattctaaactagccaaacgatactatgggcctttccaaatcacgacacgtatgggcaaagtcgcttaccagctgcaacttcctgaccattctcgcattcatcccatttttcattattctctccttaaaccctatgtggccactgcatgtccgaggggcaccgctgatcttccacccatggctcgggacaaccaccctgtcatctctcctttagccatagtggcatccaaaccaattccctccgagttaggaccaaaacgtatggtgttggtgcagtggaaaggcctgcccccagaagaaacatcgtgggaagagtggtcagatttcaaaacgcttcaccaccttgaggacaaggtgttgtttgatgggcacgggagtgttacgagtaatactagggcggtgttgggtggttgcgtggaggtggggaacggtggtgttgggtggttagatggaggggtattgttgttgtttgggttttctttagag

SEQ ID NO: 100148 - DNA, 210 bp, Glycine max
  Peptide Sequence Number=SeqID_216926
atgaatgttcatttatccaagaaaagaaaaaatgaagtgacaactcctttacttttcaagctaattcctgctgtagtgcatcttggtgtgctactgaggtggttctctactgacagttcaatggagattggatataagctagataacctccgctcagatagtggtaagcagcggataattttaatggaccaagaatctcatgattcttaa

SEQ ID NO: 100149 - DNA, 444 bp, Glycine max
  Peptide Sequence Number=SeqID_216927
atggagatgcatgatgccaaaggtaaactggattcttgtgtctcatcagaaacttccgtagtcattgtgtttttgacggattgtagcgataagctgggactaagtctagaactaggttcctttgctgctggagtgatgattgcaaccactgatctggctcaacatacactagagcaaattgaacctattcgcaatctttttgctgctctttttctagccagcattggaatgctgattcatgttcattttctctggaaccatgttgatattttggtagcatctgtaatattggtgattgttataaaaacaatcataattgcatctgttgtgaaaggatttggttacaataacaagacttcaatacatgttggaatgtcgatggcacagataggagaatttgcttttgttcttctcagtcgtgcttcaaaccttcatctagttgag

SEQ ID NO: 100150 - DNA, 243 bp, Glycine max
  Peptide Sequence Number=SeqID_216928
atggaaggcaagtgcgagacaatattgacagaacagagaggaatgcaatcaatgtcaccaacctggattcagaaaggataccacatatttccctctgtccttctcgagaacatcaacttgtgttctttctggtttgagcgcaccttgacatcttggtcattgataacactccttgaaaaacacccgaggtgccacccagaactggaagcaatgcaaagagcaatccaacagcacagcctttaa

SEQ ID NO: 100151 - DNA, 543 bp, Glycine max
  Peptide Sequence Number=SeqID_216929
atggatcaggctgttctggaaactgtggccagagtcacaccaaacaagaatgacacgaaagatgaaaaatcatttcaactacatcatgtattcaatagagctgaggaaaccccgatgttgatagatcgaaaggacaatgtcttcatcatttctaactttaaatccaagtacccggtgctccagctagatttacgattgatttcagacctggtagttgctattgtttcagcaacttgtggtggcgttgcatttgcttttgctggacaaccggtcattaccggatatcttttagctggctccatagttggacctggtggctttaacttcatcagcgaaatggtgcaggatccccaaattttttggaatattactacccttcagccccggagatccaccctatgtggtctccgcctttccaacgaggaagttcaaccattacatgctagtaagcttagttgtaatctccttcttgtccaagaattgccttcgtcgtgtagagttcgagtcacccttttgttatttgtggcttatagaatcacttga

SEQ ID NO: 100152 - DNA, 354 bp, Glycine max
  Peptide Sequence Number=SeqID_216930
atgtcgcgagcaagatcacgctcacgctcaccctcaccgtcaccgtgctgcggtgacagtcacttagtgctgctgctgcctgtgatgctcgctgttttcttcaactcactccttctgcttcctcgttcctcgctcgctattcgacctaccgagtcggatcggatcgaactcgccaatgcgaccgagtccagcagcaacgtctccctctcgcgccctcgcgaaggaaccttcgccgacatgattgatcgcgcgctcgagcacgagttcaccgagaacgaccagaacgaagcaacggctgatccgggaagcttcaacaacagtgtagcagaacaacaggttggtcttgtaccttga

SEQ ID NO: 100153 - DNA, 255 bp, Glycine max
  Peptide Sequence Number=SeqID_216931
atgaatgcaaagaaaaaagatgatatggtttatgtgcttccaaagagaagaatattgatgcaacctgggaagttacaggggaatcggaatacggcggtgtacaccactacacttgatcacgacattcagtcaacgacgcaagacatggctcaggcccttcgcgccggcaagcaccttcgtcgcgtgatggacaatgacagctgctcccctaactggcgggtgcagttttacatgtccccctatgttcgtatttga

SEQ ID NO: 100154 - DNA, 836 bp, Glycine max
  Peptide Sequence Number=SeqID_216932
gtgacaaagttcaaatgtggaggatttgttttgggcgtaaacgtgaaccattgcatgtctgatggtatatgtgctatgcaattcgtgaacgcatggggtgagacagccagaggcttggacttgagcatctcaccagttctggaccgaactatcctaagagcacgaaaccctcctaaaatagagtttccacaccacgaattcgacgaaattgaagatgtatcaaatgccacaaaactctacgaggaggaagagatcctctacaagtccttctgtttcgacccagataagcttgagctgcttaagaaagtagccacagaagacggtgttgtaaaaaagtgctctacttttgaagcactcacagcttttgtctggagagctagaagtgaagccttagggacgcactctaatcaacaaacaaagctactttttgctgttgatggaaggtctaaatttgtgcctccaatacccaagggatactttggcaatgccattgtgttttcaaatgctctatgcaaggtagaggaattagtgaataatcccctttcatttagtgtgggattggttgggaaggcaattgatatggtcaaagatagttacatgagatctgctattgattactttgaagtgaaaagatcaaggccttccttaacagcaacacttttgatcacaacatggactaggatacctttccgaagtgcagatttcggatgggggaagcccttcttttttgggcctgtaactttgcctggaaaggaagtcattttgttcttgtctcataatgaagaaagtaaaagcataaacgtgctcctaggtttgcctgcttctgccatgaaaag

SEQ ID NO: 100155 - DNA, 180 bp, Glycine max
  Peptide Sequence Number=SeqID_216933
gctgaagaagcaaactgtgtgataaaggacttgggagatttggcaaaacaacccgaccttcaaactcttggaaaactggtttatgatatccctggtgcaaccaacttgcttcagatacctcctttgctaactcagattattctatttgaacttgagggcgagccctggtacagcgtgtaa

SEQ ID NO: 100156 - DNA, 204 bp, Glycine max
  Peptide Sequence Number=SeqID_216934
atgacaaactggaagaaattctgtaccaaaaacagactaccaaaaaagaagcagaaattgatacacactagagatgcaaagagaatcaatattgcaaaaataaaccaagtcaacaaagagaaacagcaacccaagattcatttgctgaatctcaataggcgactcccaaagtttgcaaaccaaacttctcatcaagataaataa

SEQ ID NO: 100157 - DNA, 960 bp, Glycine max
  Peptide Sequence Number=SeqID_216935
tggctttcacgttatcaaagagaaaagctgatgacaacttgcgtgcacttcatagtatattgtttgggaaaaaagcaaaggcacaccatctaaagagaaatataggattgttttctggctatgtgtggactgaaaatgaggaaaaacagagggcaaagataagggagaagattgacaaatgtgtgaaagaaaagttggtggacttctgtaatgtgcttaatattccgataactaagaccagtatgaagaaggaggaactgtctgcaaagttgttagaatttttggagtccccacatgctacaactgatgttctgcttgctgataaggaaaagattggttctatgttacagaaaggcaaaaagcgagccagaaagcaaaccccaagcaaatcccctgctaagaagcaaaagcaaaattcacaagttgggaaaaagcaaaagcaatcttctgacatcgaggacagtgatgcagctgaaccttcagatgcaaaagttgattcccgggaagatgatgattcaagtcaaaaaagtgaaggtggtaataaggaaagcatatcagagaaagaggaagataaagaaaaggttcacaaacgttcttcaaaaaagattctgaaggaggatcaaaccacacctgtaaagaagaccactggtgtaaagactgccaagagcaatgaaaacacttctaaaaaatctacttcaaaaagggctgttactgacagtacttctaagtccaagaaacagaaatcagtgaaggaaaacctgaactcgaaaaggaaggatgcaaacaaaaaacaaactgacaagtctttgaaggctttattgaaggatcaaggcaaagataaaagtagtgagaaggccaaagcagaacctagtaaggaggagttgcatcgagtggctgttgatattttgaaggaagtagatttcaataaggcaactttatctgacatcctcaggcaacttg

SEQ ID NO: 100158 - DNA, 582 bp, Glycine max
  Peptide Sequence Number=SeqID_216936
atgccgcctatacgcatacgccgtctcaggctcgactccgattccgacggagaagaacaagacccactccaaccccaatccgagccacaaacccattttccggttgaaatctccgacgacgaggacttcctcgacgtcctcgacagcctccctccgccctctcccgcctgtcctgtcaccgacttcctccgccgccttggactgtcacccaagagtgactggctcacttcctgcctccgcgaattccagtcctccgttccggcctttgaacacctcgacgtcgccgcaaaagccaaacgctgtttcgagcagtttctctacgccgacatgaatttctgcggaagtggcatactccctcccaacgtagacgccatgcaccttaacgttctccccggtccctatgtattgcaggttgatgaaataattaatatgacttgtcctctacgaggcagatatgaaaaggcaaatcctggaattaaaagatgtttgaagttatcaatgactgatggcattcaaagagtatttggaatggagtataggcccatcgaagctcttgaagtttgtgcctcttctggtttaaag

SEQ ID NO: 100159 - DNA, 318 bp, Glycine max
  Peptide Sequence Number=SeqID_216937
atgacgttagtctctgcgtgctatcaggcttttcgtattacagatagcaaaaaggtttatacggataaccactcgggaatctccgcccgtcagcgtgactcaaaagtcagtatgacagatcttgtgagcgcggaagatgacgtaaatctccgcgtgtcaacgggcttgtcggccgcgattgacgaagggcgcaggagacgacatagcaaaaaggtttatacggataaccactcgggtatctccgcctgtcagcgtgactcaaaagtcagtatgacagatcttgtgagcgcggaagatgacgtaaatctccgcgtgtga

SEQ ID NO: 100160 - DNA, 492 bp, Glycine max
  Peptide Sequence Number=SeqID_216938
atggcttctcaaatcttgcatgacacaaagaaatcccaagctaggcgagcattacgttctctagcaataggcattgcagttcccttcactctcacattggccataatcatcatctttggttccggacgcaagtataaccaaattatatccaaaccattttggttttcaccactttggttcattcacttggccacattgggttcatctttcttcatgggtctcgcgatgtggctagtatgggctgatggaggatttcaaggagaaactgatgcaatgtctctctacatagtccatgtctctctaagtatcgtgtggcatcctcttgtgcttgttatgggtgtttattggcttgctttaatttcttgccttgtgaattttggaaccctctttttatgctacttgaggtttagaaaggtgaatccttttgccagagatctagccaaaccatgcttgacatggactgcgtacctttgtctgttttgtagttattaa

SEQ ID NO: 100161 - DNA, 603 bp, Glycine max
  Peptide Sequence Number=SeqID_216939
atgacccgcaccaagaaaattgggcaaatgatgtctaaggcatcaaaggaaattgctgagaagaatgatgtactgactgttgctattgggcgaccagaacaccctggtcttgtgcgtgctgctagagctggtgtcacgatcaagcaatactttagaccgactccaaggacctctcacacgtcttccttcattgctcccgaagagctggagcagctgacgcaaaaaatcagagaccaactagaggagtcgatcacagaaaaaatgcaatcacagggacttgcattgcctcctgagcctgaggttggtccttcatctgctcgtgtcagtacaaaggagagttatgttgatccctcagggaacgatccagagacgggtgactcagaaaaatatgggttgttatatgagggatccacaatcgttcacaaaattcatttgttgcatgatcaagtcaaggttggtgttgaggaggttagagatgcagattttcccattcctgtacccactgaagaggttaagttagtggggcaggcacttaacaccttccttgcttggccgacacatcttatcaagcgtttatcagaacatgtatttcagtgtcattaa

SEQ ID NO: 100162 - DNA, 1044 bp, Glycine max
  Peptide Sequence Number=SeqID_216940
atggttttcattcatgaaatgttgaacattctagttccccctcttggcctggttttgctgctcctcatgttaccgccctatctgttattcaagattctccgcttcatcgtaagatcaatttttagtgagaacgtagcaggaaaagtgatactaatcactggagcctcctctggcataggcgagcatctagcatatgagtatggtagaagaggagcgcgtctagcacttgttgccagaagagaaaatagactcaaggaggttgctagcattgccaaattgtttggatcccctgaggtcatcatcatccctgcagatgtttcaagttcccaagattgcaaacgattcgttgactcaacaatcaaccactttggacaactggatcatctggtgaacaatgcaggagtaagtgctcccggcttgtttgaaagcaccactgatatccgcaattttgcacccgcaatggacattaacttctggggttctgcatatggcacttactttgcaatcccccacctcagaaaaagcaaaggcaagatcatagcaatagcttcctgtacaggatggttgcctgttccaaggatgagcatctacaatgcgagcaaagcagcagtgatcagcttatatgagactctaagaattgaattgggaagagacatagggataactatagtcactccagggctgattgaatcagaaatgtcgcaagggaaggtcttattcaaggaaggcaagatggtttctgatcaactaataagagatgtgcaagctagtttgatacccataagatcagtcacagaagctgccaaatcaattgttaatagcgcttgtcgcggagactcatacttgacagagccagcatggtttacgacaacgttctattggaagatatttttccctgatgtgcttgagttttgtaaccgtaggaccctaatctcagggtcttcggagagggatacagttagcaagaagctccttgatttatcaggcttgaagaaatatctgtgtcccaagtcagtgagaaatcccaatctcaaacccagctaa

SEQ ID NO: 100163 - DNA, 198 bp, Glycine max
  Peptide Sequence Number=SeqID_216941
atggctccacggatcttacaaagttcagaaaatggtaaatataaattggagatcgccctttcgggttttcgacctatcaggatgattattttctgttttatgtctctaatttttgcttggaccgcccttttcgggttttcgatctaccgagatgctcatttttgcctaagccgccctttcgggttttcgacttactga

SEQ ID NO: 100164 - DNA, 183 bp, Glycine max
  Peptide Sequence Number=SeqID_216942
atggaatttatgatcgaaaggaagaacttgaaggtccaatacggtggtaagaaaaggcaaaggaaaaagaaggtaaggtggcaccactgcatgctaagtaaaggacacgtaggtatcttagagacgcagagaaacaatatcggcgactattttctgcagacgatactagttgcattccaatga

SEQ ID NO: 100165 - DNA, 432 bp, Glycine max
  Peptide Sequence Number=SeqID_216943
atgaccacggaagcactagttcttctaccaggttttggattggcacgttcttcccaagaagtgtttactccccatcagttgcggcgtattggcatcatccccattgaggattgccgagtgttcatgatgctacgtcgggtcacttctcatcttatccgtccaatcttgtctcatcaagcaacatcattcatacatggttgcattaaccaccctgagtctcttttcgccaagtggcagttccttaacgaacagcttgagcattttcttatccagtcttttgtcgtcagtagcaagttcggcaacaacccgagcagctggcatttacctttgtttcatgtcgtcagtggcaagttcggcaacaacccgagcagctggcatttacctttgtttcctctcgtcggtggcaagttcggcaacaacccgagcagctga

SEQ ID NO: 100166 - DNA, 1392 bp, Glycine max
  Peptide Sequence Number=SeqID_216944
atgctggtacctgaaaccattgaaatattggggggattggttgaggagctggatgctgcccgaaatcgcctggttggagaattaaagaagccacctagacctagggggagaagaactagaaacggagtgtttattcctttagcgactagagcaactcttgctgcgtggcctccaggtggagttgatgatcttgcacgcagtggctccacgctgcacagtactgatcctgtacaggaaaacaatcaaggttctggcccgagcatgtctggcactggtaacagtaattcaataccccacatggcgtcaaatgctgatgctatgaacatggatatgtctagagataccaattctgtttcccgtggtagctctatggctaaccagctctcttctgtcatgtcaaaggctgaggagatgcacatagatgcttctaatgtcaccagggaatattctgttgaccatcagtcttctaatatggtttcaaatgtttcagcagcatataatgatactgttcatataacaagagaaagttctgtggctactgagtgccctcccgttgttgaaagtgttgagacatacagggatagaactccagtagccacagatagttctcatccacgaagaacctcttccactgttagggaatattctgttgacaatcggttttctaacatggtttcaaatgtttcagtggtgcataatgacactgttcatataacaagggaaagttctgcaactactgagtgccctcctgttgttgaaaatgttgagacatacagagatagaactccagcagccactgatagttctcatccacgaagagcctcttcctctgttttaaacaccagcgatgtcgagatgggtgatgccagtgaccatccactcatactgtctggagaccaagaggtcccgttcacatacatggctagtttgtcagccaagtgggctaaaatgaaagaggaagctcctgcaattcggggtaaaatcaagtgctttttgactggtgtaaaaggattccggtacaagaagaggacatcatatgagcttcaggcatatgtagacgatggtagccttatttctgaaatcctcattgatcatgatgttgtacagaaaggaattggtttttctcctgaggaggtaactgcggccatttcttctcctgacacgaaaactgtccaacaaatgagggatacaatgcataaatttcaagcatttttagcaaactttgagggaataattcttgtggaattaaataaaaaatcttcccttccacttgccctagagatgagtcaaggctgtcctcaatctgatgcacggttacttctgagaaggctgaagtctcttaaccctccacaagttcaaaaacctacggatccaattgaattatccccgtaa

SEQ ID NO: 100167 - DNA, 177 bp, Glycine max
  Peptide Sequence Number=SeqID_216945
atgtcagaattaacaattgaagagttcgaagaatggagtgaaatggcaaagatgatgcagaatgtcgcagttccaccagttactattttaaacaccgttcacgccaaggaccagatttacggtgaagttagtaagttatatgttgtcagatggaaggacgtacttgacagcgtatga

SEQ ID NO: 100168 - DNA, 3474 bp, Glycine max
  Peptide Sequence Number=SeqID_216946
atggcggacgggactcactccaaagcttcctccgaaaggttggaagaagctattgtcaaactcacagcctctcatctttccatgtcatccaaaatcaatgatctccttcatcgtatgtcgcagcttgaaacctcccacaacaaccctcacacaccttcatcgtcctcgtttggtccttcggcttcgtcaccgcttaagatcaaccaccgtgtcaagctggacgtgccacggttcgacggctctgatcccactggctggatctttaagattactcaattttttgagtatcatgcgacccctgatcaggaacgcttgaccatcgccttgttttacatggagggccaggcgctggcatggtttcaatggatgcaccgcaacactcaactttcttcgtggtttgcatttcttcatgctcttcattcgcattttgcttcgtccacttatgaagaccccatgggtttgctctacaaactcagtcaacgttcctcgggaggttcaggtcctccaacctatatctttagctcaggctgtggcatgtgcccgccttcaggaggaaaagctcctcaatgcttgacgcctttcatcctatcgcctttcttcatccacttcgggaacactgaccttcgccaaacccaggatgctttatcgagccacttagctccagaaactttacgagtgaagggcctcattgatgatcaccctgttagcattccgattgacggaggaagtacccataacttcctccacaaccaagttgtgttgacacttgggctctccctaacggagatcgttcctctccgggtcacggtgggcaacggcgacgagcttcattgtcatcaactgtgtaccgcagttaaggttcacattcagaatcactcattcactattgactttcacatattacctctttatggtgcagatgttgtccttggggtacaatggctcaagacgctgggtccggttctcacagattacacttcgctcaccatgaagttcatcacagatggccaattaattgagttacagggtgaccgtgagaaggacgtggaactcatttctccgtcacaactacgctgtatcatccataccaacccttccagtaccctcttccatattcgccttgacccaccttcctctcaacatgaccctctttcccactcattacccgccatcaccaccctaaccatgaaatactcctccctctttcaacccctcaccactttacctccctcccggccgatagaccataaaatcaccctcattccgaactcagctccgatgagcgtgcgtccttaccggaatccttattatcaaaagcaagaaatagaagaacaggtggcctcaatgctcgccagtggcctcattcagccaagtttcagtcccttctcccccccagtactgctagtaaaaaagaaagattgttcgtggcgcttttgcgtcgactatcgagctctcaacgccataaccgtgcgtgactgcttctcaattcccaccattgatgaactcggaggagcgcgatggttctccaagcttgatctcatgcaaggttaccatcaaaccttgacgaatgaaatcaatattaacaagactgtgtttcgcacacaccatggacactatgagttccggagatggagtccaaccagttccggcaaaagtgtaggccatccaacaatggcctccccctcgttccacacgtgccctacggggtttccttggccttaccggattttaccggcgatttatcaaggggcccttaaggatgccatcatgaaatctccagttcttgcattacccgacttcagcgtgccatttgtagtcgaggcaaatgcttttggctctggtatgggagcaattctatcacaagggggccatcccattgctttttttagcaagcaattttgtccgaaggagttaatgaatcaagcaattcagacacccaaacaacaccattacttggctaggctcctgggtttcgactactcgatccactatcgcaagggcaaaacaaatgtcgttgttgatgccctctctcgttcgctgaaagaccaaactgcagccctctatgccctctctacacctcaattccttttccttgaggacctccgtaaggagctattgtcacttccagaattcactgcgttgcgtgacgacatccaggcaaaccccatagcctacccggagcacacgttaaacccaggcttcattctccacaaaggtcgcatatggctgtcatctaactcttccttcatcaaacctttgctcaaagaatttcatcaatcccccactggaggtcatatgggaattcagaagactctccattgtttacaagacaatttcacttggaacatcatccgcgatgacacccgagcctttgttgctagttgtttgacctgccaacttaccaagtatgataaccagaagcctgcaggtcttctctgccctcttccagtgctggcacaaccttgggaagatctatcgatggactttatcatcggtcccccagcttatcacggtaatgcatgcatttttgtggttgttgatcgattctccaaagatggtaggcaagctgcatggaatgccaaggagtatcgtatcagaccgcgacccactgttcatcaacaagttttggagggagctgttttctttgagtggcacgaggctccgcctgagctcggcgtaccacccgcaatccgatggccaaacggagggttgacaccattcgaaatcactttcggaaggaaacctcccaccttccctcagtatgtcacgggcacctccaaaatagacgcagttgatgatatcctcagtcagcgagaagctgtatttgctttattgcaccacaaattattgaaagctcagtcttgcatgaaggcggttgcagacacccactgtcgtgatcaggagtaccaggtgggtgactgggttttggtgaaactccgccaacatcgtcaatcctcggccaccggtacaacctattccaaattgaccaaatgttactatggtcccttccaagttacagagcgcatgggcaaggttgcttacaagctacagctaccagaacactcacgcatccacccggtttttcactgttccctccttaaaccatatgttgcatcaaacactccgacggatgcagctgaccttccaccaatggcagttgacaatcaccatgtcatcaccccattagctattgtggcatccaagttgattccttcggagttcagtcccaagaagatggtgttaattcagtggaagggcatgcccctggaagaaacttcatgggaagagtggtcaaccttcaagacaatccatcaccttgaggacaaggtgttgcttgatgggcaagggagtgatacgaatggaaatgatgggcgtctacagaaagcaaaaggagtgcatgaggaaaataatgcaagacccacaaggaagaaaactgcaccaacgtatttggaagactacgtacggagcgcgtag

SEQ ID NO: 100169 - DNA, 1224 bp, Glycine max
  Peptide Sequence Number=SeqID_216947
atggacgaagaggttcatctatgtgatggcgaggtttatgttgagaaatggatgatttacatggggaaactcacatgtctcactttgctactcatgacgggcttcaagacgatagcttttggagttaagagcttgggattagcatacgtcgtacccgactcacccttacaaccaacaacttttagggtcaggagatgccgagggagctacgctccttgcgagcttggcatagtaggcagacagaaagattgtggccatgttgggagacacacattgtctcacaatgctcaagaattcaaagtgaccccagtgaggtttgatgccagagggttgggcatccgtgctcctacaccagggctaacagaaagggttgatgcaaaaaaggttgtccagtgtcagaggagattgtttgatgtcgggggtaatagccttgacaagtctgtcaagcttgtcaagcccccccatcctagacaagtgttgtctgggacgtgtgcaacgcatgcacaacacttttgcatacgtgtcactcgtggaatgggcatgtgttggagacatgatgcgtggccaccgtcactttgcaatttctatcttctttctcctgaaatctctttgccttcatgcttgcttcttgtgagtccctttgttcttccttcaccttcttcaatccttcaaggtattccttctctgatcatgtcttcatttctatctgactccgccaccgacatgggtgacatgattctggggaacactcgttgtggtgcctccgacaatgaatatttttctttggagaagttgaaggttatgcggcttattggtgaaggcacctctcgcctttgcgggagggcgcgaccttcctccgtttccccaactaaggagcctgtctcggtcaccgtgattctctccccttttgcttttgggggagcaaggaggagcggtagggacattagggcatctcctcgcgtgcaacgtagctatagtgcttggtcgctattgtccacacctgccattgctggctgtgagtgggtgagggatgatgttctgaagtataagtcctccctcacctctacggcgagtgtcgctagcaaccttgaggactcttacaagatagccgtccagacttgccggagtgatgacttccctttctatagggcgacattgggtagtccacctttcttctttatgtacagatgtctggttgagatcctgggtcttgttcctccctag

SEQ ID NO: 100170 - DNA, 1485 bp, Glycine max
  Peptide Sequence Number=SeqID_216948
atgaagctaactgacaagattggatgggtctccttgaacaacgtgtccaacaagttgtttgagttcgactcaaacgtcttttgccgcttcaaggaccgtttcttcaaggtcctggctattgatgccatggttgatggcttgccacttatgtttaatagggacaaggaatatcgcttcccgttctactggcagtctaaccccaccaaattcaagtcgtttgatgagaatctgttgacccttgttgaaagggtcgacaaagctattttggagcagttgccatcctcgctagacatgcgggtcattttgtcttttccctcgacaagcgatcctctccttgccttggacggaattatggatgacttcgcttggaggccccttgtgaaggatgccagacttgctggtgggattgtgccaccgttcactattgcccttgttgctggagaaaggggtcaacctactggtgaggttggccatgttgttggtactgtcgaggttgcccccggtcgcaagaagttaggggtccatttgagccttcgtgctctaaggcaagccgcagggttaacgcctggttcgagtcacccttcaagtttgcaagatgtgcctccagctctagtgattgtcgagacttttgcttccactgttgttgttacggttactcttgcaagatgttcaggagcgaccactagtgctcatgtgatgccgccttctgctgcttcagctccatctattccaccctttgtcgtgttagcggcgacatgtctccctcgtcttatcgtccctatgtctctttggatcacctacacacctccagcgatgttgattcactgtgggaaccttattcggttagctggggtacaaaacgctatagactctgccaaagtcttcctcaagagaagtttgatgattctggaggagaataggcaacaacaccaagaggctttgcgcaaggtgtcgtccatggagacaaaagttgccaaatggagggctactgcttgcacggtttggagacaagagcgccctaaggttggcagtgttttccccaagttgttacgcacaaggtcggatggtgatgaactgtccacacactgcaagagcttgcaagaagagaaaaaggacttgggtggcaaggtgagagacattgtgacgaagagggacgagcttcctaaggtggttgttgagttaaaggcccgactaaaagaatctaagtcctggctggaggagtctgagctgcaagtggctaaggagaaggaggctagcaaggaggttgaagaggagttgataatgtgcaaaaaggatgctatggagcagcacgaaaaaggctttcaaaaggtcgtcaggcaaactgggttatacgccaaggaccttgacttgagttttttttacccttttaaggatgtgactgacaattttctgcttgacgagaaagatattgttgttgaggaggaggttggcgaggagcagggtgctgatgatgctgatgtttaa

SEQ ID NO: 100171 - DNA, 447 bp, Glycine max
  Peptide Sequence Number=SeqID_216949
atgaatgtagatggtagcttctttccatcaaacaaaagaataggatctagaggtgttgttagagatctaaactacacaaggatggttggcttatcttctttggatgaggttgacgatattgatatgtctgagatcctagcttggaatcatgacttgaatttggcttgggatagaggctttaggaaagttctatgtgagatggataatttgaacttggttcatattctaaattcaaaagaaggctttgaaactcatttgcatgtgactcttctgctggaggctcgtgagaagatacaaagagattggaaaatagaagttaatcacgtagataaggaggcgaatggagtagctcactttctagcgggacgtgggactgatgagttggaagctaattcaattcccttaaggaggtccttcacgcctatggcaaagcttcaagccaaatga

SEQ ID NO: 100172 - DNA, 1797 bp, Glycine max
  Peptide Sequence Number=SeqID_216950
atggagcctaataatgcatgtactatgcattctcattgcatagagatgtccatggaagtgcaccaagttgttccaccaccccacaagagcacccttcagaagctccagggtagactcaaggaaactttcttccctgatgatcctctgcgccaattcaagggacaacctcttaagagaaaactgatccttggagcacaatatgtgttccctattcttcaatggggtcctaagtacaacctcaaactcttcaaatctgaccttgtttctggcctcactattgctagcttggccatcccacagggaataagttatgccaagcttgcaagtcttcctccaattgtgggactttattctagttttgttccaccactagtttatgctgttcttggaagctcaaaggaccttgcagttggacctgtttctattgcttctcttgtgatgggatccatgctgaggcaggaagtgtctcccacagcagaccctatcctgtttcttcagctagctttcacttcaacattatttgctggcctctttcaagcttctcttggaatcctaaggctaggcttcataattgattttctatctaaggccattcttattgggttcatggctggtgctgctattattgtgtcactgcaacagctcaagagcctgcttggaatcacacatttcactaatcagatgggtctgattcctgttatgacttctgttttccacaatatacatgaggaaggtattgcagtaggaaggacatttgcagctctcaaaaactacaaagtggatggaaataaggaaatgatggcaattgggtttatgaatgtggttggctccttcacttcctgctatgttacaacaggtgctttctctcgatcagctgttaacaataacgcaggagcaaaaacagctgtgtcgaatgtagtgatgtctgtgacagtcatggtaacactcctttttctcatgccattgtttcaatacacacctaatgtcgtgttgggcgcaatcatagtcacagcagtaattggcctcattgatctccctgctgcttgtaacatttggaagatagacaaattcgatttcgttgtgatgctgactgctttcttaggtgttcttttcatctctgtccagggaggccttgctcttgctgttttaattcccttgacacttgtagctactcataatcattttgcagtccttgcccaacaagatcaagtcgggttatcaactttcaagatactcttgcaaattacgaggccgaaaacagtaatgttggggaagattccaggaacagacatatatagaaatcttgatcaatacaaggaagctgtgagaatacctggatttcttattttaagcattgaggctcccatcaattttgctaacatcacatatctcaacgagagaacgttgcgatggattgaagaagaagaagaagacaacataaaggaacaattaagccttcgattcttagtattggaaatgtcagctgtgagtgctgttgacacaagtggaatctcacttttcaaggagttgaaagcaacactggaaaagaagggtgttgaggcaagaatcctaaactctggcatacttttactttacacacctttgtatcttgtgttggtcaatcctcttgctgaggtcatagaaaagcttaaaaaagcagatgaagctaatgatttcatacgagcagataaccttttcttaacagttggagaggctgtagcttcactttcatcagcaatgaaaggccaatcatcaaccattacagaagggacacacacaattgtgtcacataattga

SEQ ID NO: 100173 - DNA, 150 bp, Glycine max
  Peptide Sequence Number=SeqID_216951
atgggactggttggattctatgaagggtctaaaataggcagcgaagtgttattggcacccaaattgggacttgaaacatttcggggcaccattgagttgcccaagaaagctctaaatagggaattgaaattaaaatgggaggtgagttga

SEQ ID NO: 100174 - DNA, 1076 bp, Glycine max
  Peptide Sequence Number=SeqID_216952
ccagcatctgctgctgctgggcggcacgctgctgcccaccttactgattggtctgccgctgggactcgtcatcgcgcgtcgcgcccgctggcaacatgccgccttcagcgtgctgaatctgatccagaccgtgccgtctgtggcgctgtttggcctgctgattgcaccgctggccgggctggcggcgcattttccgcagctggcgcgcctcggtatcagcgggattggcgtcgcgccggcgctgattgcgctggtgctgtatgcactgctgccgctggtgcgcagcgtggtcgcggggctgcagcaggtgccgcaggagttctggcacgccgagctgccgctggcgctgccggtgtggctctccggactgcgcgtggtggtggtgcaaaccgtcgggctggcggtggtcgccgcactgattggggccggcggcttcggcgccattgtgtttcagggattgctgagcagcgcgctggatctggtgctgctgggcgtgattccggtggtggcgctggcggtgatattcgatgcgctgctgcgattgctgtgagcaaagcgttcgccggtaaagaggcgattcgcaacctgtcgctgaagattgagaagggcagttttaccgtgctgatcggcacgtccggctcgggtaaatccaccacgctgaagatgattaaccggctggttgagcatgacagcggcgaaatccgttttgccggtgagccgatcgagcagatggatgcgcgcgcgctgcggcggcgcattggctatgccattcagtccatcggcctgtttccacactggaatgtggccaaaaatatcgccaccgtgccgtcgctgctcggctggccgcgggaaaaaattgccgcacgggttgaggagctgctggcgctgctcaatctcgacagtcagctggcgtcgcgctatccgcaccagctctccggcggtcagcagcagcgtgttggcgtggcgcgcgcgctggcggccgatccggaactgctgctgatggatgaacccttcggcgcgctcgatccggtcaaccggcaggcgctgcagcaggagatgctgcgcattcagcagct

SEQ ID NO: 100175 - DNA, 264 bp, Glycine max
  Peptide Sequence Number=SeqID_216953
atggtgcagcccaaaccaagcgctggccttaaggggaaacctcaccaacatgctctcactcatcatgccttcttgtatttcaacaaacaaaagcttgggccccctaggcctaagtcatgttttggaatttatcctaattctcgcaagctgtccgcatccaaaaaatggcatttcatcgagcacttggtgggcgcacttttgggtaccaacaacaagggaatgggggcaatgtggcttgccccatcatctcagaacacaacctag

SEQ ID NO: 100176 - DNA, 104 bp, Glycine max
  Peptide Sequence Number=SeqID_216954
atgtctgagatcagtgcactaagcgcagcagttgtcttcagccaggctctgtgcgagggggtcgataagctcaaatccgtgtactctcgaaaagcgcctgggtg

SEQ ID NO: 100177 - DNA, 414 bp, Glycine max
  Peptide Sequence Number=SeqID_216955
atgtggttcttgagagtctctgttaattttgaccagattatatttgaaggcgtctatgccctgcatcctgatattcgaatatcacttgacttgtggattgctgttgttggaggtgttcattcacatttgatctcacgtgttcaaagggataagagtagagtggggtgttttatttcccaaaatgagatcatgatgacagtgtttcctatgttccagcagctcattgaacctcatcttgttcatgcacatcttaaaattcgaaatgactttgaccctgtgctttctcctgagagttcattatttgtattaaagagtaacaaaaaacctatcaaagaagggaactttatcattcagcctaaagtggattttgatattggcattagtacggttgctggtcttcttaatcttgggtaa

SEQ ID NO: 100178 - DNA, 1515 bp, Glycine max
  Peptide Sequence Number=SeqID_216956
atggaccaagtacccaatgaagtgcaccaagttgttgcaccaccctacaagagctccctacagaagttcatcaccaaggttaaggaaacttttttccctgatgatcctctgcgccaatttaagggacaaccactcaagagaaaactaatccttggagctcaatatgtgttccctgtgcttcaatgggctcctagttacagcttcaaactttttaaatctgaccttatttctggtctcaccattgctagtttggccatcccccagggaatcagttatgctaaccttgcaaatcttcctgcaattctgggactctgtgagtatgttgattttgccagcaattctagttttgttcccccccttgtgtatgttgttcttggaagctcaatggatcttgcagtaggacctgtttctattgcttccctagtgctgggatccatgctcacagaggaagtgtctcccagtgaacaacctgatctttttcttcaattagctttaacttcaacattctttgctgggatctttcaagccgctcttggaattctaaggctaggatttatcattgattttctatcaaaggcaatccttattgggttcatggctggatctgctgtaattgtagctttgcaacagctcaagggccttctcggaatcaaacatttcaccaaaaagatggccctgagcataaggaaaccaaagctattctgggtctcagctggagctcctcttgtgtctgtcatcatctctactgtcctctcttctgtaatcaaggctcaacttcatggcatcagtgtgattggaaaattgccacaaggagtaaatcctccttcagtggataagctactttttcaaggaagtcatctcggtctagccatcaaaactggccttgtcactggcttattatccctcacggaaggaattgcagtggcaaggacatttgcttctatccgaaactacaaagtggatggaaacaaggaaatgatggcaatcgggttcatgaatgtggttggctccaccacatcctgctatgttacaacaggatctttctctcgctcggctatcaaccataatgcaggtgctaaaacagcaatgtcaaacttagtaatgtctgtgacagtcttggtgacactactgtttcttatgccattatttcaatacacaccaaatgttatattgggtactatcataataacagcagtgattggcctcattgatctcccttctgcctatctcatttggaagctagacaaattcgattttgttgtgatgttgactgcattctttggtgtgatttttatctctgtccagcttggccttgctattgcacttgtgttggtgaatcctctagctgatgttatagaaaagctgcaaaaagcagatgaagttgatgatttcgttcgagaagattaccttttcatgacagttggagaggctgtaacttcactttcatcactaatgaagggccaatcaccaaccatggaagaagaggaggcacagaaaattgtgactgagtactaa

SEQ ID NO: 100179 - DNA, 558 bp, Glycine max
  Peptide Sequence Number=SeqID_216957
atgggcattaatggaccttggattactaaatcatatctggaaatgattcttgaaagaaaaggtgtacctcgtcttagtacaccaccacttgtgtctaatacaactgtgcctggtagtcaagaaaccgtgatcgctgcgccaaagccaattcgtgttacccctaaccttgttaccgggcttgatgatttacctcagccgtggactcgatctccaacaaaatctaaaatggaacctgttgtggctgaatggcatttcatatcttcagattcttccctgcctgacaactcagtcctaggtattttccttgaattggaggatgtagctaattttggagatgatttcttgcatgcttacttaagatttccattgtgtcaagacttctctcatgaagcaaccacagatccttcatctttcagggatagtgttaggcttgctccaatgcctgattcatttgacttggataggggattgcttttggcagttcaagcaatacaagcattgttggagaataaaggtgtcccagtcatagttggaatcggtaatatggatgtttcttga

SEQ ID NO: 100180 - DNA, 1044 bp, Glycine max
  Peptide Sequence Number=SeqID_216958
atggatgatgaagttgttcagcgagtgttccatgaaggaggacgcgattacttccagcaacagccttcgacttcttcgtcttcctcttccatcctccaatctctccctctccatgtgtcttttgatcatggatactatttgttggtaaaatctatccaagaactccgagagaaaaaagatggccttgttacagttggcattggtggaccaagtggatctggtaaaactagcttaacagaaaaggtggcatctgttattggttgtactgttatatcaatggagaattatcgtgatggagttgatgaagggaatgatgtggattctatagattttgataccctgatcaagaatcttgaggatttgactaaaggcaatgatacatcaatcccagagtttgactatcagcaaaagaggcgtgttggctataaagcaataaagagcccttcatctgtggtggtaatagttgatggcacatatgcattgcatgcaaaactgcggtctttactggatattcgagttgctgtggttggtggtgttcattttagcctgctttctaaagttcgctatgacattggagattcttgttcactggattaccttattgatagcatttttccattatttaggaaacacattgagccagatcttcatcatgcacagatcagaattaataacagctttgtctcatcattcagagaggcagtctacaaggttaaatgcagaagtaagtcttcagatggacattcaggttctgcttttcaaggaaatgaagcccaaacagacaattttatcgaaatgtaccttagaccaccttcagctagtgaagaagcaaggataaatgattggatcaaagtgcggcagtctggaattagatattatttatcacttggtgaccagaggattgttgacaagaatttcattatcaggcctaaagctgaatttgagggagtctgcaagaggcgtgactggtattgcagaatagggattagaactgacctttgtcaacatgtcaacgtttatattttgagaatgacttcactttga

SEQ ID NO: 100181 - DNA, 285 bp, Glycine max
  Peptide Sequence Number=SeqID_216959
atgcaatatatccctgaattttatggacttagtgatagaggttgcctaacaatgatgtacaaggacaaaacaacttttcttgtaggtctcaaggatcgaatgagacatgaagtaacttaccctttaggaataactaatttccctttgaggattagcgagactctaagtttggcaacaattgatcaaattgtcaataatgatccaagtgttcgtaacctagatgagcatttttaccatattcttatcaagattttgactgccactaatgtgtcttcatctattttg

SEQ ID NO: 100182 - DNA, 2034 bp, Glycine max
  Peptide Sequence Number=SeqID_216960
atgacgacgacgaccaccaccacgcagcaaaatccaaacgacgacgaccaagattccagaaacgcgcgcgccatgactctcctccatgactctgtcgtttctaaactcaaaaccctcaacccttccctctccatcgaacctcatcactcttctctcattcagcgtcgccttcaaaatcttttccctgcgtcgtttcgcacccctacacaccctccttatgcattgatgatatgcaatgcgataatagggttggatgaggcgaccgggtcgacggagaaggcgatttcagagttcatcgagagggagtatgatgatttgccgttggcgcatgggaggattctgagtctgcagttggagaagctttgtgagattggggagattgagagtgtttctggtgggaggtatgttgtgatggttgatgattcagagagaaaacaatgtagtaagagtagcgagaagaagaagagggggaaaaggagaagtaaacgtggtgagggaaagagtgttgaagaaaaatctgaagagggacggcttcaagtgtttggaaaacaaagtcatcaacatgctgaagcggaagcggaagcagaagcggaagcagaagcgcaatgtggattaggagagtcacaaattcaggattcgaggctgcatttgaaaacaacttgttcctcccagccaacagcgttgaagtgcataccagcagctgcaaaccccttattgcctgcaccattgcaactgcaaatgccatgtaatgaaccttcagaaagtggtgtggatgcagcttccaaaatgtcaggttcattatctttgaacgttgaagaatgcaagcaagatgagaacccgatgaccgggcattctgatcatccatccagagagaggacgcctcataagtgtaagcaaattgcagaccatcaagaggagacattgctgccctcaggtgatgctactgccattcagcaagagccaaatgaaaagaaaattcatggaaggggtcttgagctacatagaactgcacgccacatcaataagaagatgcatccacatgatcaagctgatgatccggagtgctcttctcatttaaacaagaaagaaacaggttcttcatcccagccagcagcacctaattctactgttaatccaacacatgatattgggaagcaactggtggttcctacttcagaaggctctccaaagtgcgtagtatctacaggattagaatttccttcaacacagttgcaacagcaagtttcttcagatattgatttgggtacagtgtccaaaagaaaagcttcatcaactttggagaatgatcatgatggccagccccagcattacaatcaaggaagtcctaaaggggacctagatgaggaccctatgtccgggggttcggagcagaagcctccaaaacgtcccagaggaaggcctcctaagttagagactggagcaaacaacccaggaaagtcattgttgccttcagatgatgacattcatgatgagcagcggccaaacaaaatggagaagcagcagcttctgtacggcagaggtagaggtagaggtcgtggtcgtggtcgtggtcggggtaggcctcctaaaataaaagaaactccaatccaatatgaggagcagttgcaacaacaagatcaacctcagcagcatagtcaaggtagaggtcgggggaggccccgtaaactgattcaagatacaaacatatgtgagacacaattactacaagaagttcaagctaaacagcagcatgttcgagttcaaggtagaggccgtgggaggcctcctaagccaaaggaaaatacaaaccaatgtgaggagcaagcacaagaccaagctcaaggtttggtgaactctccgagttcagggtggaattataaccagaatttggagcaaagaggggggaggcatcatatatcagagtcaggagaagcaaagtcaccagcagggtcaaggttggaaccagaatcaaagtatgggtcaggagaggtctcccaatctaatgttgaagcaaaccagagccttggcagctag

SEQ ID NO: 100183 - DNA, 564 bp, Glycine max
  Peptide Sequence Number=SeqID_216961
atgtcacgtcgcccccacgcgccgccgccgcccccgccgccgaggccactctacaagcagcagtcgtggtcgccggacacgcttcgcgacgaggcctggcagcggcggaaggacaacagccaccacatcagcggcgacaaccaccgctgcagccaccggctgagcaagagcctctcggaggacgacttggacgaactgaaggcgtgcttcgagctcgggttcgggttcgattcgcccgaaatcgacccgaaactatcgaacacaatccccgctttggagttgtaccatgccgttaacaaacagtacaatcaccacagcttgtctaggtcatcctcttcgtcttcccttgtctctgacagcgacattgctagccccaccactatattcaatcctggggatgatttggctgcgaagaagactcgtttgaagcaatgggcgcaggtggttgcttgttcagtgcgggaatcttcttcatcttcttgttcaaacccttccgaccaaatgttcacgcaagtcactaacatattagttggttgcgttaaaaaacaagagaaaggaagataa

SEQ ID NO: 100184 - DNA, 2013 bp, Glycine max
  Peptide Sequence Number=SeqID_216962
atgaaactctttaaaacccgcgacgccgcgttcgcgttcttcaagctagcgttcggggattgttctgattccgaagagatccttcgtttgagttgcgtctccgcccatgttctggcggcgcagaaacttcagctgctagcacaagacgtggtttcgtggctcattgcgagggttgggactgggcctcgcccttccaatctcacgtttaatgcgatgatttgtgggttttgtagacagcatagggtcgtggttggggagagtttgttgcatttgatgcctaagtttatgtgtagtcctgatgttgttacatttaacattcttattaacgcgtgctgcattggggggaggacttgggttgcgattgattggctgcatttgatggtcaggagcggtgttgagccgagtgttgccacatttactaccattttgcatgccctttgcagggaagggaatgtggtggaggcgcggaagctctttgatgggattcaggatatggggattgctccgaatgctgcgatttataatacgctgatggatggatatttcaaggcgagggaggttgctcaagctagcttgctttatgaagagatgaggactacgggtgtttctcctgattgtgtgacttttaatattttggtttgggggcattataagtatgggaggatagaggattcggacaggttgttgaaagatttgatagtatcgggattgtttctggattcttcactgtatgatgtaatggtatcgtcgctatgttgggctggcagactcgatgaggccatgaaattattgcaagaactgcttgaaaagggactaactcttagtgttgttgcctttaactcgctaataggagcctatagcagggcaggtttagaagacaaagcttttgaagcatatcgtattatggtcagatgcggtttcactccttcatcgtccacgtgtaattctttgcttatgggtttgtgtaggaaagggtggttgcaagaagccaggatacttttgtataggatgttagagaaggggtttcccatcaacaaagtggcttacactgtgcttttggatggatatttcaagatgaataatttggaaggggctcagtttctctggaaggaaatgaaagaaagaggtatatatccagatgctgttgcttttacagccttaatagatggactttcaaaagcaggtaatgttgaggaggcatatgaagttttcttagaaatgtcagctataggtttcgttcctaataattttgcttacaattctttgattagagggctctgtgattgtgggagggtgactgaagcgttaaagttggagaaagagatgaggcaaaaaggtcttctttctgacaccttcaccttcaatatcatcattgatgggttttgtagacggggacaaatgaagtttgcaattgagacatttcttgacatgcagcggattggtttgctgccagatattttcacatttaacatcttaattggaggatactgtaaggcatttgacatggttggcgctggtgagattgttaataaaatgtactcatgtgggcttgacccagatatcacaacgtataatacatacatgcatggttactgcagaatgcgaaaaatgaatcaagcagttatcattttggatcagctcatctctgctggtattgttccagacacagtgacatacaacactatgttgagtggtatttgtagtgatatattagatcgtgctatgattcttactgcaaaattacttaagatgggttttattccaaatgtgattacaaccaatatgttgttgtctcatttttgcaagcaggggatgccagagaaggcattaatatggggtcaaaagttaagggagatttcatttggttttgatgaaatctcctatcgaatactggaccaagcttactgtttgatgcaagatgatgttgaacttgcaatggagattgaagaatgttttgtgccttttaagaggaagggaagccttggtgcaacagttagaggtgttgccatctaa

SEQ ID NO: 100185 - DNA, 144 bp, Glycine max
  Peptide Sequence Number=SeqID_216963
atgggtggaaggtttctatactatccgcaagcctgcaccttcaagaacacatggagcattgaatatactgtaactgttccagctcaatgccacccttggcattctctttgccaaccaagtcaattatgctgccaacaaccttag

SEQ ID NO: 100186 - DNA, 360 bp, Glycine max
  Peptide Sequence Number=SeqID_216964
atggtctctaatgtcatctactatttgcagggatcgcgcccacaagacagccagtggacccgaagaagtccaacagggccctggggttctagctctaattatgggactctgtcagttctacagagtgaccaccactccgatctccccctgccaaagtgtcagcaggatcgcgcccgcaagacacccagtggacccgaagaagttcaacaaggtcctggggttctagctttgattatgggcctctgtcggttttacagagtgcctgccgcccccaacaaggtcatcaggccccctattaaccgggctttcatcaagaagtattgcgcccccaggcaggcgcagggcgaggcaccacggtag

SEQ ID NO: 100187 - DNA, 711 bp, Glycine max
  Peptide Sequence Number=SeqID_216965
agactcgcactgcctcctgagcctgacattggtccttcagctactcgtgtcagcacaaaggagagttgtgttgatcccttagggaatgatctagacacgggtgactcagacaaatgcgagttgtacgtcgaagaaaatcctccccgtctagtttccctaggtagacattgtgaggggtccacaaccattcacaatattcctttgctccatgatcaagtcaaggttggtgttaaggaggttagagatgcagatgctcccattcctgtacccactgaacaggttaagttagtggggcagacacttaacaccttccttgcttggccgacacatcttgtcaagcgtttattagaacatggagctgtgggaccggcgaaacctgcaaataggctggataatgatatcgatgatcccttatatctaatgacattgaccatcccacagctttttttgaagccattgtttttgatgatgccaaagtataatcaaacaagattgcttcaacaaacatttaaggttaagcaaatagagattggttcaagattaattcaaggtcaagcaaacaagaccaagaaaaaggcattggtaattaccaggcattataatcgattaccagagacaagattgcaaataggcttttcaaaagggttttggaatttgaattttaaatcttgtaatcgattacctgtaacgaaacttcagaaaacactttga

SEQ ID NO: 100188 - DNA, 300 bp, Glycine max
  Peptide Sequence Number=SeqID_216966
atggaccttgaacgcaacggtaccagcaagagcgtcgaaatcctcgacgagcttgcccatcctgataaaatgcaagtcctgctccgggagggtgttttgagaacggaggggccattggagagaacggggttttcgaaaacggaagatctggcttcccagagagcgtatatggcaggggaatggaacatccctggccatagactaatgggtttgcggttagaagaaccagcatcgatggaaacagaggttgtcgttttagttgttgtcgggtatgttgtggaagaatcagttgagaagtga

SEQ ID NO: 100189 - DNA, 1100 bp, Glycine max
  Peptide Sequence Number=SeqID_216967
ctcgtggcgctggcctacggccgcctgttgaagcgctggtcgcggcgtggcgccacgctcgcggcggcgctgttgcaggccgtgggcattggcggcctggcgctgcccgccatggcctggggctcgcacaccgccgcgggcgtggcggtggtgctgtactacatgctgtacacgccggccgccacggtgctgtgcacgctcatcatggatcagtcgtcgccgcacagtcccgccaccgactacacgctgcaaatgagcgtgagtcacttcttcgcgatgctgctgacctcggccggcaccatgctggccggccgcatcggctacggcggcgtggtcggcgcggcggtcgtgctggcggtatgcggcctattggccgccgcgcgctgggttccccgggaggcaacatgaacaagtcctgggaaatcatgcggccgcctgtcgagcctggcctgcctggcgctggccatgcgcgagttgctgctgtccccggacatctatccctggcccgcgttcctgggcgcgctggcgtgcaccctgctggcctgcttcctgcggctgcaggccttcaaccagtcgcactacgccgccttccgcctggaagtgatcctgcgcaacgacctggtgcggcacctggcgcggctttccttcggcgaattgcaggcgctgggcagcggcccgctggccaaggtggtgcagaacgacgtgcaggcgctgcacgttttcgtggccgacagcacgccgctgttcgcccgcgcctacgccatgccgctgttcagcgcggcgctgctgttcgcgctggactggcgcatggcactggccgccgtgggcgtgctggcggtaggcgtggcggtcctgtcgctggcgatgcgcggccgaggagccatgacgcggcgctaccaccaggcgcgcgaacaggccatgcccgtggtgcgcaccttcgataccggccagagcaccttaggacgataccaccgcgccctggagcgctaccaggcgatgctgaccgactggtatcgcggcgccagtttcagttcccgcttcgcgattgccgcgctcgggccgctgccgacccttgcggtgctgctgtggctgggcacctg

SEQ ID NO: 100190 - DNA, 266 bp, Glycine max
  Peptide Sequence Number=SeqID_216968
acaaccttgatctgaagcatgtcaagaaccatgtccttgatgtagggtttcagaagccgcggctcgtgagaaaccaaacttatcaactctgcaaacgtgcttctgaagtagcttccttcgaagacatgcaggagcatgaagatgccgaccatgaccatgcagaggagcttgtggaacatcgagggcctgaagaacaagaggatcatgccgatgacggcgtcgaacgccacaatctggacataagggcaggacgacaacgacagtga

SEQ ID NO: 100191 - DNA, 252 bp, Glycine max
  Peptide Sequence Number=SeqID_216969
atgggagcgtttgtggagggaaactaccctttgaggggaaaccagccgaaggaagagtacgctcacaataccgacaatcgaggaggtgggaagggatggcggatctgcaactttggatgccagatctacaccttctttggtcattgtgattgtgtgagagcaagagagccacacaagagaatgaaagagcaagggaaaataagcgtaaatggggagggatttcaaagacaatttttccaaaaccatccttga

SEQ ID NO: 100192 - DNA, 444 bp, Glycine max
  Peptide Sequence Number=SeqID_216970
atgccgatctccccctgcggaagtattagttggtctgtgccatcccgacataggggtcgtgcccacaagacacctggtggacccggagaagtccaacagggccctggggtctccagctttggttacgggcctctgtcagtcctacagggtgcccgttccccccagcaagggatcacgcccgtaagacactcagtggacccgaagaagtccaacagggtcttggggtttccaactctgattacaggcctctgtcagttccacaatagtgcctgtcgcccccagcaaggcgcagggcaagacaccacagtagcctggggatggccggcagcggacaacagacgcaccgccgccacctccaaagcccctcagttcatccacaaaaaggttagtgcgttgcctacgacccatggccgaccagcaggcgaccaaagtccaaagccaaag

SEQ ID NO: 100193 - DNA, 483 bp, Glycine max
  Peptide Sequence Number=SeqID_216971
atgagtctttcatcatggcagaacaagttaaataggtgttttatgttgaagatccttgtgatgaaaggtggtcaatggcacatggctacactacccagctcccctcctcttcctcctgagtcagcatcttcctcatctttgccgaagaagactagaaaagtaacacggctcagatcattggctaccaaacccggtgggatggagagaccaatggttcatgtgaatccagccattgggaaagatgatggtccccacaaaaagaaattaaggatgtattttgggatcgtcgctcgagacaaggatgttagaaagaaggctctgaccatccaacaactaaacactgcccctcatgtgttgtctcgtgggggttatgatttactagaagaaaagttaatgaaggaaaaacaaaagaaacgattggagcaagtatcccaattcgaaagcacaaaaacaattgttgatcctccatcacccattagatga

SEQ ID NO: 100194 - DNA, 372 bp, Glycine max
  Peptide Sequence Number=SeqID_216972
atggatgtagaccctttcaccttcatcaatctttggtcttcaggtttaatgccttcaaaagcttccaaattgattaagaacaagccttttactcatttcgatgaggttgtggcctatttcagaaaacttgctttcgatcaacaccttaaagacactctttcaaatccaaactacaaaggacaacttcaacaaacaatcaatgaggtttttaaattcgatgatctagtagctgatgagtttcatgaggaaattgagtctttcctcaatgtttgcaacaatgattttaaggccaaccaactctatgaccaacatgttgctgacattattgaaattgagtcctccatagaattggatcaaagcaagcttatttaa

SEQ ID NO: 100195 - DNA, 1428 bp, Glycine max
  Peptide Sequence Number=SeqID_216973
atgattcaaatttcttactatggtgacagcaaattgaacctgtcatcaagtcacacaaacttaaaagcaagtcatcttcctttcaacaggaatggattcaaatttttcacaaatgctggtgggcttgggaaggctgacatcaaagatatcttagagcgagctgcggacatatacaatcgatttacagaagaaagtttgacaaattcagagagaaaagcttcactatctattaagaaagttgattacatgattgtttatacatctgatctagtaaaagcagttcgcaaagcagctggaaacataggcatgactttgttgaagtatttttataataagaaaccattggggggtttccatatagttgttgatgcaggcaatggagcaggaggcttttttgctgcaaaggttctggaacctctgggggcaataacttctggtagtcaatttttggagcctgatggtaattactatgcttggaggaatgatttcaactgggtatggcaaatggactttaattctttgagtaacaaatggcttttctattcaggcttgtttccaaatcatatcccaaatcctgaggacaagacagcaatgaaagctataacccaagcagtccttgataacaaagttgatcttggaattatttttgatactgatgtggacagatctgctgctgtggatttcactggccgtgaattcaacaggaatcgtttaattgccttaatggcagctattgttcttgaggaacatcctggaacaactattgtcacagacagtgtgacttctgatgggcttaccacgtttattgagaagaaacttggtggcagacaccatcggttcaaaagaggctacaaaaatgtgattgatgaagctattcgtttgaattctattggtgaggagtcacatttggcaattgaaactagtggacatggagctctcaaggaaaatcattggcttgatgatggcgcatacctaatggtcaagatcttaaataaacttgcttctgcaagagcttctggaaagggtggtggaagtaaggttttgactgatctaatagacggacttcaggaaccagattttgctgtagaactgagattaaagataaaccaaaaccatccagatcttaaaggaggagctttcagatcttttcgggaatatggagaagctgtgctgaaacatttggagaactcaattggctctgatccaagtctgcacaaggctcctgtgaactatgaaggggtccgagtttctggctatggtggatggtttcttcttagattatcactccatgatcctgtacttccccttaacattgaggcacctagtaatgatgatgctgtgaagcttggacttgctgtgcttgcagctgtgaaggactttgcaggtttagacacatcagccttgaacaagtttgtaggagcatcataa

SEQ ID NO: 100196 - DNA, 426 bp, Glycine max
  Peptide Sequence Number=SeqID_216974
atgatatttttgcacccggaatgggtcgcagcggttgtgcatggcgttcttgcactcggagtgagtcatttacaaaatatcaccactttacttgagggatttcgagcggcacatgctccgattggtgtcgaccaaggaatgggtagttcacatggatttcagatgagtgcagttgcgcccggagtgggtttttcgtgtggttttcagattattgcagatgggtgggaaagtaaaaaggtgccgctggtggtggcgcacggcggcgacgacgtggtgtgcgtggaggagttgcacgcacacgcccttagtaaggatatatcccgggatgtggcaccagatggttggggaatccgaagacaacgtggagttggtgttcggggacatgttggagtgtgctctgataagatatttattgtttcttcctaa

SEQ ID NO: 100197 - DNA, 474 bp, Glycine max
  Peptide Sequence Number=SeqID_216975
atgacgccccccgaatacccgtcagccgtgagtggccaacccgaaaattatcattttaccgagcaagtcgggcacctgctgcgcaaggtttatcagcgccacctggcgatttttcagcaaaacgtcggcgattcgcagctgacggcggtgcagttcatcaccctgtgcgcggtgcgcgatatgggaccgagctcgctgaccgagctggtgcaggtgacggcggtggatcaggccaccatacgcggcatcgtcgagcggctaaagccgcgcgatctgatcacggtgacgccggatccggtggatcggcgcaaggtggtggtcggcctgactgacgcgggcgccgtgctgttgacggaaacggttccgcaggcggcgaaaatcacagagctgacgttcggcacgctcaacccggccgaacggatagcgatgatattcctgttgaataaaatgctggaagatccgcccaccggctga

SEQ ID NO: 100198 - DNA, 865 bp, Glycine max
  Peptide Sequence Number=SeqID_216976
atggcgatatctgaagtgcagtcgcccagggaaggcgcgaaaaccacgctgacggagcatccgctgatgctgtcggtgaacggcgaacagcttcatgcgcaggtgatggcggatacgccgctcttgctggtactgcgcaacgatctggcgctcaacggcccgaaatacggctgcggcctgggcgaatgcggcgcctgtaccgtgttgatcgacggcgtggcggcgcgctcctgcgtgatcccggcgctcggcgtgtccggccgggcgatcgtgaccctggaaggccttggcgatcgccagcgcctgcatccggtgcagcgtgcctttatcgaagagcaggcggcgcaatgcggctactgcctcaacggcatgatcatgaccaccaaagccctgttggatcgcaatcccgccccgagcgaggcggagatccgtcaggcgctcgcgccatcattctctgccgcgatgagggcgcccacgcttatgactgattcccgtccctcatcgccgagccaggccgaattgctgcagcgcgacggcgtgctgctgatcgtcgacagcgtgcaaccgccttcggggccggtgcccaaagggcaaacgccggtgctgaagcccagggagcaagggctgtttatcgccctgtgcgacagcggcgaaatctatgcctttaacggccatgtcgatctcggcaccggcgtgcgcaccgcgctcggccagatcgtcgccgaagagctgtacctgcgcatggatcaggtgcgcatggtgttgggcgataccgagcgcgcgccgaatcagggcgccaccatcgccagcgccacgctgcagatctccgccgtgccgctgcgcaacgccgccgccgaagcgcgcc

SEQ ID NO: 100199 - DNA, 447 bp, Glycine max
  Peptide Sequence Number=SeqID_216977
atgatcttccttccacatctgcaactcctactccagcatccacttcagcagctccttcagtcccagagcttacaggtggtgggacctccaggatccattcctaccgttgagaagtttctagcaagtgtagcctggcctggggcccaaccttctcttcacagggaagatgaagaggaggaggcaggtgagagacaggttagacaggaagctgctgctactccagagagatctcttgagggcacttcagagcctcctgcaccagtggtggacctatccttgcctcaacatgcagtagacccctccactcctatactcgagatactagaggatccgaccacaccaatcctgactctgaacacttctcctccagctactccagtactttatttgacagatgaggaggatgttcagacacgggacacacaggaccagtcacgggaattctaa

SEQ ID NO: 100200 - DNA, 768 bp, Glycine max
  Peptide Sequence Number=SeqID_216978
atgttggtgtgtaatttttatgagcaggaaataagggctttcaacaaggaactacttggaaaatggaggtgggatatgcttcagcaaagtaacaagttatggtccaagatactgcattccaagtatggtggatggagatcattggtggaaggtagtagaaggaataatgagtcaggttggtggaaagacttaatggaggttacacatgaccaacagatgaattctatcctccaagatggcactacttggagggtgggatgcggggataaaataaaattctgggaggactcatgggctggacacggaaaggctcaaaagatgaaatacccaaggttgtataggatatcacttcagcagcataaactcattcagcaggtgggaagtttcaatgactcctcatgggaatggaacctctcatggagaagaattcagcaggaggatgcagcccatctctttttcaattgtaccaaatctctagccttatggtgggaatccttagcgtggactggaatagttggggcattccccataatccctaggtaccattttctgcaacaccaaaatgggatgaatggagggaaaagaaacaataggtggaaggatgttgacgaagagaaggacaaggaagaacaaaataaaaagaagattaaggaagtgtcacatgaatgctccttggtgaacaagcacaaggccatttggatgacaaagcctgaggagatcacaaaggaggagtattctgctttctacaagagtctcaccaatgactag

SEQ ID NO: 100201 - DNA, 426 bp, Glycine max
  Peptide Sequence Number=SeqID_216979
atgatgaaggtctatgggaaaacattcctacaggctgagtgcgaaagtaatgctttgtttaatgtgatcatggccacagatccgacgtctcccccgcagtccgatggtcaatcagaggcgacttccaagaggagtagaacaacgacacggttgagaacattgacattaagaaccgtggatcagcccagaccggcagtttatgtggatcccgctaccgggagagcatcgggaccgatgcgtgaaaagttccacagctacctaggcgtagtggcgcgagaaaaggttcccattatccacaataattggaaagacgtacctgaaacgctaaaagacatagtgtggaatgacattctatggtccaaacatccactactagcggtggaacatgttgagataagtctgggaaggaagaatagcaccttctaa

SEQ ID NO: 100202 - DNA, 2010 bp, Glycine max
  Peptide Sequence Number=SeqID_216980
atggtgtatgacttgaatgatatttttgtttcgctgcctaataagcggacttgttttaaaaagcacgatcttcaaatgggaaagttagatatgaatgcaaagtttgatatcggagaagctacgaaggtgaagacgaaggttatgtcaacagtagcgacgagatggcggcaatttaagtccacattgactagcaaatttgtgtttgctaagagtgaaggtcaacaaacacaggatgttgtgacaaaatatggactagatcctgaagcatggaaacaatttgaagaaacccggctcacacctaactgggagggtattaggaaacgagcacaatcaattcaaaaacacaatgactgcccccacgtactttcacgtgggggatatgatttgctggagaagaaattgttagaccagaaacgaaaaaggatacaagaggaagcattgttgagtgaaaatgcagcaagccttgatgaacccccatctccaataaaaagacatgttaagtggaaggttgctcggaccagggctgttggcaatatgacatctgagtccgcacaggaaattgcagataaaatagactccttagaagagcaggtaacgcagggctcgtttgtaccccatggtcggcaagacattctgaacactgcgattggccgacctgagcatgggggtcgcgttcgggcagcaggcttaggtgtcactattactcagtactacggaagggcatcaaggacatgcagcagctcatccacatccatcagccaacaacaactagatgaagttgttgcaaggcttagggaagacatgactgggcagattagggaagaattgaggactcaaattaaggaagaattgaggactcagctagaagaggaaaataagaggagcttggaaataatgaccaatgcattgaaagaggctattaaaaaagagttgtcaaataaaggatccccagagctactccaaattcagccggacatacaacaagtagctgcgcgtgtcagcacacagggaagtaatgttgttaccaatgtccaggcttcacaagaacatcatgctgatgccataccattgatgggactgtatgtgcagcttaaggatggtacaacaaggttggtggccatggggaaaataatggagggggattcagtcatacacacagtggcatatgcagatgatgttgtcagggtaagtgtagaaacagttattgatcctgaggctgaggtcccctatgccacctcagaaatacaatatgtgaagcaggccgtcgatacatttgtagcttggcccacacaccttgtgaaagctgtattagatgaggttccacaaagtattccacacaacgaggatgcacatgtgccgaagccgactaatgtggacgcagatgatccgttgcgtggattgataaagtatagtttcgatatttacgacaacccacttgaaatcaactttgatgggagctttcttggaattgtagatgcatctgcatcgatattcattacatattcagatgttagtgaaataatagcaggagacaaaagtctgaacatatctatcatacaattatggttaatgtatattcatgagtggagtcagatattcagtcaaggtttcatgtatgcattccttgagccacagtcgttggtttgttcaaaggaaagacgcagcgaatgcgaacaatatcttctaagatggcttaaggaatctgaccgagaggtgtacattggaccttacttccatcatgtaatgacgaaattgaagacgaccttgtctcctgaaactaaggcagttgcacctaagtggattgaagtaaagagtcacgttcaaaccggctgttatgaatgtggatattatgtaatgcattggatctggaacatcatagccagcgacataaagagtgactggtccatgtggtttgctaatgacacaccgttggacatcgacatgatcaccacaattcgaaaaaaatgggcaacattttttttaaagatggcaataagtaaaaacggctaa

SEQ ID NO: 100203 - DNA, 271 bp, Glycine max
  Peptide Sequence Number=SeqID_216981
cagtgtaatgatgaaattgaagatgaccttgtctcctgaaactaaggcagttgcacctaagtggattgaagtaaagagtcacgttcaaaccggctgttatgaatgtggatattatgtaatgcattggatctggaacatcatagccagcgacataaagagtgactggtccatgcaacaattaagtgcagctatagtaccaccaagcttggcactgcagcagttaactgaacaaatgaagtgtccacagtcattggatggttgcctggtagag

SEQ ID NO: 100204 - DNA, 633 bp, Glycine max
  Peptide Sequence Number=SeqID_216982
atgacgccggacgaagagcgcgccgacatcctgcgcaagctggaagagtcgcgcgcgcgcaatctcgccgaacagcaggcgctggccgaaaaggatcgtctgcgcgacgaagccatcgtccgcgcccgtgaggaagagattgcggccaaggaacgcgcagaggccgagaagaaggcggccgaggaagctgcggccgccgccaaggctgccgaggcgctggctgccaccaagcccaagcgcgctccgatcgatgaaaccgcgccgcgcccgccgcgtgctccggccgccgcgccggctgcgccacgcagtgcgccgccgccgccgcgcagcgacgaccgcaacaaccgcagcgcgccgcgcaacgagcgtggtccgggcgaccgtttcgccggccagatgcacctgtcggcggccgaccgcgcgcgtcgtggcaacagcaacaacagcaacacccggggtcgtccgggcgggcgtaaccaggtcggtggccgtcgcgacatgtcgcgcgttatcaacaatgtcggtccgcacgccttcgagcgtccgaccgcgccggtggtgcgtgaagtggcgatcggcgacacgatcaccgtggccgacctggcgcagaagctcgcgctgaagggcggctag

SEQ ID NO: 100205 - DNA, 824 bp, Glycine max
  misc_feature (770)..(770): n is a, c, g, or t
  Peptide Sequence Number=SeqID_216983
atgggccatgtcgcgggtgatttccacgtcggacacgctcaccgagggcaacccatgctcgcgcacggcgttgtgcaccagggtgccgagttcacggcgcagctgggcggagacacggtcggttcgatggaaagtcttgggcacgaggagctcttggttcagttgtcgcccgaccaacggtcgggcgctacctttgattcgattgtcgcccgaccaacggtcgggcgctacaggtacatggtagggcccgaccgttggtcgggccaccttgcagcattacagggtgcgcggcacttcgatacgctcgaagcactcgatctggtcacccggcttgacgtcgttgtaggccttcaccgcgataccgcattcggtaccgttgcggacttcctcgacgttttccttgaagcggcgcagcgattccagttcgccttcgaagatcaccacgctgtcgcgcagcacgcggatcggcttgttgcgcttgaccacgccctcgatgaccatcgagccggcaacggcgcccagcttggagctgcggaacacgtcgcggacctcggcgataccgatgatctcttcgcggatctccacgcccagcagaccggaggccacctgcttcacctgatcgatcacgtcatagatgatcgagaagtaacgcaagtcgacgccgttggattcgatgatgcgacgggccgaagcatccgcacgcacgttgaagccgatgacggtggccttcgaagcagccgccgagttggcgtccgattcggtgatgccgnccacgccggagtggatcacgttgatgcggatgtcgtcgttggacagcgcgacca

SEQ ID NO: 100206 - DNA, 504 bp, Glycine max
  Peptide Sequence Number=SeqID_216984
atgcttcaaagagttcgaaaatcatggaatgcggtgcaaaggaaagataaggagcttagaggaagcaactatggaattattggcggataccatcaatggttgaaggctcggacacaagggataacttggctcccaaagctaaagagttcaagtggggaagaggctgaagtccctgaggagagtgaagaagtgcaagcgttgaaagcggaacttgaaagaatgccagtggtcaaggaaaatttcaagatgacaaccattagggtcaaaaaagagtgtgacaagccaagggatgtcaatgtggccacagccgaagcattagaacgagaaacgaagagggcccaaaaaaaagaatggggccgaaacaagttccgaggggcagcaacaacaaactcaagcttcaaagggttgcttagcgcagtattggcgccaagcccaaatccacttactcgcgctaagagcaacagtggcgctaagcgcgacggtgcgatttcagagcctatttaa

SEQ ID NO: 100207 - DNA, 940 bp, Glycine max
  Peptide Sequence Number=SeqID_216985
agggctacacgtcctcaccttcagaggactacacatcctcgccttgaggactacatgtcctcaccttcagagggctacatgcccttgcctttagagggctacacgtcctcgcctttgagggactacatgtccacgccatcagagggctacatgtccttcagaggactacacgtcctcgccttaagaggactacaccccctcgccttccgagggctacacgccctcgcctttagaggactactcgtcctcaccttcagaggactaccagtcctcaccttcagaggactacacgccttctccttcagaggactacatgtgctcgccttcaaaggactacatgtgctcgccttcaaaggactacacgtctttgccttcaaaaggctacacgccctcgccttcaaaggaggtctggacgccctcgccttcagaggtctaaacaccctcgccttcagaggactacacgtccttgccttcacagggctgcacgtcctcactttcagagggctccacatttgcgcctttagaggacttaagcaccaccagagggaggctatcgtgcagccaccatgcatactggggcaagatttcacccatgccactacaaagagacgagtgcagatcatgcgcaccaacatgaccactcttacacagatatggatgacgttgctacttagcaacattttgcccagtcaccacaatgctgatctccccctacggaagtatcagttgggatcgcgcccacaagacacccagtggacccggaggagcccaacagggccctggggtttccagctctggttacaggcctttgttagtcctacaggggatcgcgtccgtgagacacccagtggacccggagaagttcaacagggtcttggggtttctagctctgattacgggcctttgttagttctacggagtgcccgtcgcccccaacaag

SEQ ID NO: 100208 - DNA, 354 bp, Glycine max
  Peptide Sequence Number=SeqID_216986
atggaaggaacatcagtcacccgtgcggttatcagcggcattacatggaaggaatatctgcacgatacgttgcgccatcatgattcattgcgaatgcgatatctgcattatcccgtcgcacaaaccgtagcggcgcgattcatcgcgcatttcatttcccgcaccgtggcggaatgcgcaataaattgcgccgctaccacccgttcggttatcagcggcatcacatggaaggaatatcagtcacccgtgcggttatcagcggcatcctatgaaaggaatatctgcgcgatacgttgcgccaccatgattcattgcggatgggatatctgcattatcccgtcgcacaaaccgtag

SEQ ID NO: 100209 - DNA, 810 bp, Glycine max
  Peptide Sequence Number=SeqID_216987
atgccggagttcacgaaacccgcaggaatgaaatcaccgctgatgggaatggtgaatattcgcgatcaggtgatcccggtgattgacctggccgccgtggcgggctgtaagcccactaccgggctgaacattctgctgatcaccgaatatgcacgtagcgtgcaggcgttcgccgtggaatcggttgagaacatcatgcgtctggactggaagcaggtgcacgccgcggaaaccgccgtcagcgggcgctacatcaccagtattgcgtgtcttgacgagaagacggataccaacgaactggcgatggtgctggacgttgagcagatcctgtatgacatcacgccggccaaccacgatcttcatgccaccaatctgaagaccaccaaattccatattaagcctggcgctgtcgcgattgtcgcggaagattccaaagtggcgcgctccatgctggagaagggcctgcaggcaatggaaattccggcgcagttgcatatcaccggtaaagacgcatgggagaaaattggcgtgctggcggcacaggcgcaggcggaaggggtgccgattaccgataagattgccctggtgctgaccgacctcgaaatgccggagatggacggctttaccctgacgcgcaacatcaagcgcgacgacgcgctgcggcagattccggtggtgattcattcctcgctgtcaggtagcgccaacgaagatcacgtgcgcaaagtgggcgctgacggttacgtcgctaagtttgaaatcaacgagctttccagcgtgatttatcgcgtgctggagaagaagcgctaa

SEQ ID NO: 100210 - DNA, 375 bp, Glycine max
  Peptide Sequence Number=SeqID_216988
atgaaggaacaaggactgcatttggacacccgtgcttacaacatagttattcatgtgttctgcaagtttggtaaggtcaacaaagcttaccaactgatggaggaaatgaagacaaagggaataaacaaaatcaattggggagaagatcacctaccccatggtccatctttcttcatatttatgacagaaacttcagtggatgactgtgtcctgtatcagttcctattatataagccgaacatttttatctataattggtggagttgttgctggtattttgggatttgcagacttgaaaggatttgtgttttacttacttctcatgtcatttacttcacttgggctcatggccaaagcaaagttttacaggcttga

SEQ ID NO: 100211 - DNA, 114 bp, Glycine max
  Peptide Sequence Number=SeqID_216989
atggagtttaaacattctaagagacaactaataggtgatggagatcagtttcagaaggctttggacattttaattcaaatgagaaaacattcaataaagaagtggaacctttag

SEQ ID NO: 100212 - DNA, 210 bp, Glycine max
  Peptide Sequence Number=SeqID_216990
atgtcggtctcttcgcgtcaacgggctcgtttgcccccttggttgacaaaaggtgcagatagcaaaagaatgtttgcgggttaccgtcgagtgtctctgcatgctactggactcttgggtcacggtaacaaaaggtggggtggtcgacaaaagcagggcttttgctcctacctatcctcaatttgtgatgaggaactcagacatacgtag

SEQ ID NO: 100213 - DNA, 537 bp, Glycine max
  Peptide Sequence Number=SeqID_216991
atgagggatagaaattgtgctgaccctgtatttgttttttcagttgcatttgctgtggatccactctatcgtcagatgtcagcacaatttgatgaaggtggagccaaaggccttttgatgaataatcttggcatatatggtaaatgtaggttgctcttcgattcactagaagtgccagggaagtgcataaccagtcaaaatgaaagtgatatttcagatacaattgatctttctttcgccagagattgtgttgaacaaatgatattggacatacatacgaagggtgaaatctctccaactctgagggtgatagtaaatcaatttgatgaaaataataaaaggccttctgattttcaatcttctactgagaaatcaggtgaagagtttgatgcagctattgatagtgaacttgccactgaaaaagaatatgagaacttcccctcctggagtaatgatcatgatagtgaagcatttcctgctgaatggggctctgatgatgcagacccaacttttccaagttaccatcaggtttgctaa

SEQ ID NO: 100214 - DNA, 534 bp, Glycine max
  Peptide Sequence Number=SeqID_216992
atgacggggatcaagggagccccgtatcggagacgtctggataccctgactgtgactgacgtgtgctggatgccctatgctgagcatcggggagtcaagggatttgacttgatatcgtcgtacaccggtcaactcaaatggggtcagattgtggtgtacgttcgacctgagcgggttcttcgacagtttggctaccttcaaacggtccctccgccgccggtttatgattctttgacgggtgatgatatagatgaccggtggctgcatttttcagagcatttagtgccttcaggggagctttgtgtagttcctggacaggtagcatcagactacatggagtggttttttcggatatcgcacccatttgtcacgcggactgaggagactgctgagccgagacatccgcctccccctcatgatgaggagttcgtcgagccacccatccccgaggttgactgccaaggatgtccagggatggctgaggatttaggagcgattgctgaggatttggagcgggtcatcaacctcaggatg

SEQ ID NO: 100215 - DNA, 204 bp, Glycine max
  Peptide Sequence Number=SeqID_216993
atgacccctactcatgatgccttgctatattacaatgggaggtggaacgtgtcacgtcaaaatgagttttttggttactcgttcacaggaaaaaatcctaaaaagtttgacattccttccgcatgtaccatggatgaactgaaggatttgatcaagcaagttgcgtctcatgagattctcccttatggtgttagtgcattctaa

SEQ ID NO: 100216 - DNA, 291 bp, Glycine max
  Peptide Sequence Number=SeqID_216994
atgggactggatgttgaaggggcctctagtaatcgattaccagtgctgtgtaatcgattacacagaggaacaggccactgctgtgaaattcgagtttggcctctgatcgtgatggcagcgcagttcatccatgatcgagtgcctagagggagcttgggagaccctcgaaggcaatgcgaggtgttgattccggggcacgattcgattcacggctacttcattggtgcatccagaggaacccgcgcgatcgcttcagtgcactgtggagtggatattacccacgcctactga

SEQ ID NO: 100217 - DNA, 2217 bp, Glycine max
  Peptide Sequence Number=SeqID_216995
atggttggaattgttgcagctaaagacttgccagcagagccatctgaggaagagtttaggcttgttcaacctggtgctgtacccagggttgtggagagtcctattgattctgcactagtccccgatggagcacccttatccgcatttcagtattttgaaaatgtgaggaactttctgctgactgtgcaggaaattggagttcctacctttgaggcatctgatctgggaggaaaatcagccaggattgtgaacagcgtcttagctcttaagtcctatagtgaatggaaacagactgggggtaatggtgtgtggaaaattggaggaactatcaaacccactgtctcttcaaaatcttttgtgagaaaaaactctgagccatttactaattccctgtcaaggaactcgtccatcaatgaaaaatccatgactgctcttacctctgatgtcgagtctaataaaatgtctgggtctcactctttgagtatgcttgttcgtgcagtactattagataagaagcctgaagaagttccattgttagttgaatcagtcttgaataaggtcgtagaggagtttgagcatcgcattgccagccagggtgaacagacaaaaatttcaagaggtgctgtgttgctaggcaatggatctgtatcaaagtttgttatggcagataaaaagatggataacaagattcctatggtaacaaagaaagaaagattgctccataaaaactttgtcgatgatgaggaatcgaaaagacaacttctgaagaagcaaatgctctttgatcaacagcaaagagatattcaagaactaaagcatacaattcacaccaccaaagctggtatgcagttcctgcaaatgaagtttcatgaggagttctccaatctaggcaggcatgttcatggcttagctcatgctgcttctggatataatagagttcttgaagaaaatcgcaaactatacaatcaagttcaggatcttaagggaagtataagggtgtattgtcgagtaagacccttcttatctgcacaagcaaattattcaagcacagtgaataatatagaagatggaactatcacaattaatattccttcaaagaacgggaaaggtcacagatcctttaacttcaacaaagtctttggaccatcagcatcccaagcggaggtcttctctgatatgcagccactcattaggtctgttcttgatggtttcaatgtttgcatatttgcttatggccaaacaggatcaggaaaaactcacactatgactggaccaaaagagatcaccgagaaaagcagagaaattcgtagtaattctcagagagggctcagcgtaccagatgcatgcctagtcccagtttcatcaacaaaagatgttattgaactaatgaacctgggccaaaggaatcgtgcagtcggagcaacggcacttaatgatcgtagtagtcgatcacacagttgcttgactgttcatgttcaaggaagagacttgacatctggaactattctacgtggatgcatgcatttggttgacttggcaggaagtgagagagttgacaaatctgaggccacaggagataggctgaaagaagcacagcacattaacaaatctctttcagctttgggtgatgtcattgcttcccttgctcagaaaaaccaacatgtcccttacagaaatagcaaactcacacagttactccaggattcactcggaggacaggccaagacactaatgtttgttcacataagtccagaggttgatgctgttggagaaacaattagcaccttaaaatttgcagaaagagttgccacagttgaacttggtgctgctcgagtgaacaaggatggggcagatgtcaaagagctcaaagaacagatagcctgcctcaaggcagcattggcaagaaaggaaggtgaatcagaacattctttatcaggcagctctgaaaaatataggacaatggctagtgagctatcaccttatcatgcaaaccaacagggtgctgatattgtgagcccagggtgccggcaaccaatgcttgatgtaggcaatatagagcttcacagtagtaccacattgagacaaaaaactcagagctatgattttgatgagatgtcaacgaattcaccgccctggcccccggtgaataatcctagacaactctatggggatgatgacagagaaactggctcaggagagtgggtagataaagtcatg

SEQ ID NO: 100218 - DNA, 297 bp, Glycine max
  Peptide Sequence Number=SeqID_216996
atggatgatcttgatgatacaaccactgattcctcggaacctgacttgcggtggcaatttaatcattccaaacttaccagcatagccaatggcaacggatcaaaggctaggagacctgtctcaaagcccacaaatagcccagtattgagcaagaataatgttcattcttctcttggtccttcaccttcaaggaaacaatcaaacagtgtctcacatcgaacagcaagacatccagctccagttgacatgaaacataatggagcaataatgcccgttgcttgtaccatgggtccatga

SEQ ID NO: 100219 - DNA, 447 bp, Glycine max
  Peptide Sequence Number=SeqID_216997
cttgttactggcctatgtgtaccagcagtggtgtttgttgtgtatgtcattgttggtattcgtgtaagtattattgttggtggagcagcctatggatttcttccacccatattggctacctttgaagatgtacaccaaggaaaagtgacaaatttatccacaggagagtcattggttgcgatttcaactttaagcattccccagaatgatattcagccttttgaagggatttcagaagttgagcaagacctcggcatcaatgagaatatcatgcatcaaagctcctcatcctcctcctctttctcctcctacttctctcaagaaagtaatagtggagcattcaaccaatatggagagggtcttgagcagctacaccggttcctatttgttcttgggatgactcatgttctgtatagttgtgtggttgttggtttagcaatgagcaag

SEQ ID NO: 100220 - DNA, 228 bp, Glycine max
  Peptide Sequence Number=SeqID_216998
atgaagaccaaagtggatcctggtgatttgtttaggcactatgttgctggagccattggggtggttgctataaatttgctatgggtagatgcaacaattacatcggctaaggaggagattacaaatacagaatgtgaattgatccatgtgaatgacctcttaagcagggtaatgaaggagacagatgatgcacaagcaaaatgcaataagctaatgctgctaaattaa

SEQ ID NO: 100221 - DNA, 1906 bp, Glycine max
  Peptide Sequence Number=SeqID_216999
atggatcgaagttggatgaaagcatcacgtataactgaagattatgagaatggtgttgaagattttttgcagttttctcaatctaatgcaccatctctatgggggaaatatttatggccatgtgtcaactgtgcaaatgggagaggccaaatagtaaatgacataagatctcatcttatctgtgatgggatagttctgaattacacaaaatggatatggcatggggaattgtcggacatggcaacagtctcacaggctaagccagcacgatttgggtggagtgacaagagtttcactaagttgcttgtgttattgaaaaacattcttcctcaagataacaggttgatgaagaatcactacgaggcaaagaagatttcatgtccaatgggaatggatgttgatgcaattgcaaacaatcggcatccagcaaaggtgtgttggcatcttccaataataccaaggtttaagcaattgtttcctaatggcgatgatgcaaaaaaacttacacggcatgcacacaacagaaaatctgatggattcctccgacatccggctcatagtccacaatggaaggcaatcgactgtctgtatcctgattttggggatgagccaagaaatctaaggcttggtccaaggcagccatggaatgatattgatgtgtatctcagtccgttaactaaaaacctaagaaaattgtgggaagatggggttgatgtgtgggatgggaatctacataagacgttcaggttgcatgcaatggaaaatgaaagtgcgcctagtccattagctggcaaagaagtttatgatcagaaaaggttagtattctttgatcttccatactggtccgatcttgatgttagacattgtatagatgtcatgaatgtgaagaaaaatgtttgtgattctttaattggcaccctccttaacattaaaggaaagacaaaggatggtttgaagtgtcatcaagacttggttgacatggtcccacaaggatactcttcaaatatcaagagccttgtttccctaaatgatctcaaattggttgtcttgaaatctcataattgtcatgtgttaatgcaacaactattgcctgtggcgattcgcggtagcttgcctgacaaggttaaggttgcaataactcgtttgtgcttccctcttaatgttatctgtaggaaagtcattgaccctcaaaaattggatgaattggagattgaggctgccgttgtcctttgtcaaatggagacatattttcctccatcattttttgacataatggtacactcagttgttcatctcgtgagggaaatcctagtatgtggtcttgtgtttttacgatggatgtatccagttgagtggtacatgaaggtgttaaagggttataccaagaaccaacaccggcctaaagtttcaatttttgaaagtgcatcagacaacaacctgattcgagtatccatgacttactttggtatcattgaaaaaatatgggaggttgattatagtgaacttagagtgtctatttttaagtgtaagtgggttaataggaataacgctatgcatgaagatccattgggatttactttagtagaccttaacaaggaagaccaagtggtatcagttaccataatgatgattcaacctttgatatttgtgagacgcctgattttcacaatgaatgaagctcatgacattgatgatgtcatgggcacatctccaaggtctcctccgtattctgatggtcagtcagaggccacttccaagaggagtagacaatcgacacggctaagaagcttgactttaagaatcgtcaatcaaccaagaccaacggttaatattgatcctggtactgtgagctggtactatgagaggatcaagccctcacaaggaaaatttccacagctatctgggg

SEQ ID NO: 100222 - DNA, 633 bp, Glycine max
  Peptide Sequence Number=SeqID_217000
atggaagacaacattgagcagatgccattctatgactcactcaacttgcaagttacagagaaatccttctacaacactctcactggaaacatacctcttttccccaatcaacatcccgttgttctcagtccccaagctgaaaccactcccaccaccagcaacaacaacaaccacaactttttagatgaaaattctcttactgttaatcatggcctctcaaatttggattcttccactgccaaactcttggcacaaaatattttcaatgatgttgattccctttccaagtttaggagaggcttggaggaagctaccaggtttcttccacctggccctaagcttgtagctggtctagattcaaagggaaaggaaccaatcaatacattgggaaagaattcctatgggttgaagggtaggaagaatcacgatttgcagagtgaaacagtgaaagctgtagagccaggtggagtgaagggtcatcctaagaatcaagcgataaacaaggaaacaataaatttgaggaatcttcttatgatgtgttcacaatctgtgtatgccaatgacaaaagagctgccaacaaattgctaaagcagattaggcagcacttttctccctccggggatgcattatag

SEQ ID NO: 100223 - DNA, 168 bp, Glycine max
  Peptide Sequence Number=SeqID_217001
atggtggctttgaagttaactgtttttatcaaacttggtatcgggggcttcaatatgggtgctgctgcaactacgttatactcagctacatgccatgttttggggcactatggtaatggaaacatttaccctatcaacttaagtgctattgtcatagtgaatatgtaa

SEQ ID NO: 100224 - DNA, 867 bp, Glycine max
  Peptide Sequence Number=SeqID_217002
atgccaaattcggaacttcaaggttcgagggcatgcatgaccaaagctacaagggagagatggagacaagtaagacaaaggagtaaaaattctactcctgtcgcttctaattcagttcaagaagggacaacaagggaacaatttgttcctaatggagggtcaaatgtgaggatcacagtcaaacaacacaatgcaaccaagttttttaacaccccaaacgggaagaagctagaagaaattttgacaaagaagttgaataagagtgatgttggcgtcctaggccgcattgtgctcccaaagagagaggctaaggataagcttccgacactgtggaagcaggaaggaatcaatattgtactaaaggatgtatattctgagattgaatggagcatcaaatacaagtactggactaataacaaaagcagaatgtatattcttgataatacaggagatttcataaccctttacaaggacgagttgaaaaatctgtatgtgtcggctagaaaggatcaagaaaatctagaagaatctaagtcctcgtcaaacacaggaatgccacatgaaccagatgcatatttagcttacttgacgaaggaacttggccataaggggaaagcagaagctgccaacaaccttttgaacaatgttgaggaagaggcaccaaatcaagcaaatcaattacatcaattcatgccgatgaacaatattgttggggagggggcatcaaaccaagcaattgaagaagccgcaccagcagcacccatcaatgttgatcaagaaaacaaagttgttgacaacgacgatgatgttatctatggtggccttgacaatatttttgaaattggaaatacttatcaaatttggtag

SEQ ID NO: 100225 - DNA, 1134 bp, Glycine max
  Peptide Sequence Number=SeqID_217003
atggaaaacttttttgtgccatttttaaaaaaaaaccccaacccatcaatcaccactactggtggcaatggctcatcttcatcaaaccaaacaagccttgtacaaccaagcacatatcctcaaaatttcccttacaatactagtgtaaaacttaactttccagaacaaccttatttcattcctttgtatccctttccaacaggacaagttagcttttctaatcaaccctatggaatgccaaattcggaacttcaaggttcgagggcatgcatgaccaaagctacaagggagagatggagacaagtaagacaaaggagtaaaaattctactcttgtcgctcctaattcagttctagaaaggacaacaagagaacaatttgttcctaatggagggtcaaatgtgaggatcacagtcaaacaacacaatgcaaccaagttttttaacaccccaaacgggaagaagctagaagaaattttgacaaagaagttgaataatagtgatgttggcgtcctaggccgcattgtgctcccaaagagagaggctgaggataagcttccgacactgtggaagaaggaaggaatcaatattgtactaaaggatgtatattctgagattgaatggagcatcaaatacaagtactggactaataacaaaagcagaatgtatattcttgataatacaggggattttgttaaccattataaacttcaaacaggagatttcataaccctttacaaggacgagttgaaaaatctgtatgtgtcggctcgaaaggatcaagaaaatctagaagaatctaagtcctcgtcaaacacaggaatgtcacatgaaccagatgcatatttagcttacttgacgaaggaacttagccataaggggaaagcagaagctgccaacaaccttttgaacaatgttgaggaagaggcaccaaatcaagcaaatcaattacatcaattcatgccgatgaacaatattgttggggagggggcatcaaaccaagcaattcaagaagccgcaccagccgcacccgtcaatgttaatcaagaaaacaaagttgttgacgacgatgatgatgatatctatggtggccttgacaatattttcgaaattggaaatacttatcaaatttggtag

SEQ ID NO: 100226 - DNA, 1134 bp, Glycine max
  Peptide Sequence Number=SeqID_217004
atggaaaacttttttgtgccattttttaaaaaaaaccccaacccatcaatcaccactactggtggcagtggctcatcttcatcaaaccaaacaagccttgtacaaccaagcacatatcctcaaaatttcccttacaatactagtgaaaaacttaactttccagaacaaccttatttcattcctttgtatccctttccaacaggacaagttagcttttctaatcaaccctatggaatgccaaattcggaacttcaaggttcgagggcatgcatgaccaaagctacaagggagagatggagacaagtaagacaaaggagtaaaaattctactcctgtcgctcctaattcaattctagaagggacaacaagggaacaatttgttcctaatggagggtcaaatgtgaggatcacagtcaaacaacacaatgcaaccaagttttttaacaccccaaacgggaagaagctagaagaaattttgacaaagaagttgaataagagtgatgttggcgtcctaggccgcattgtgctcccaaagagagaggctgaggataagcttccgacactgtggaagaaggaaggaatcaatattgtactaaaggatgtatattctgagattgaatggagcatcaaatacaagtactggactaataacaaaagcagaatgtatattcttgataatataggggattttgttaaccattataaacttcaagcaggagatttcataaccctttacaaggacgagttgaaaaatctgtatgtgtcggctagaaaggatcacgaaaatctagaagaatctaagtcctcgtcaaacacaggaatgtcacatgaaccagatgcatatttagcttacttgacgaaggaacttggccataaggggaaagcagaagctgccaacaaccttttgaacaatgttgaggaagaggcaccatatcaagcaaatcaattacatcaattcatgccgatgaacaatattgtgggggagggggcatcaaaccaagcaattcaagaagccgcaccagcagcacccgtcaatgttgatcaagaaaacaaagttgttgacgacgatgatgatgatatctatggtggccttgacaatattttcgaaattggaaatacttatcaaatttggtag

SEQ ID NO: 100227 - DNA, 297 bp, Glycine max
  Peptide Sequence Number=SeqID_217005
atggttgggtcaagagggaagtttgctaatatatgtgaggagatcaacttgagtcaactaatggtgggaaccgtctttgaagggcattggtacgaagacgggcatggtaccaaacccgtcttagaattgtggacattctacatcggttctaaaggtacaaacgatgtagaaaatggatattctacatcggttctacagaaccaatgtagaatgtccatattctacatcgttcattccttcagaactgatgtagaatatccacattctacatcatttatacctccaaaaccgatgtag

SEQ ID NO: 100228 - DNA, 306 bp, Glycine max
  Peptide Sequence Number=SeqID_217006
atgagtggattggagttaagtgtgaatgtgatgatgagtaccgaattaggggcattatggtcaacaaaagcttggaagaaaacaagcagctgtatgattaaattgatttgcccaactgctcctacacggcctgtagccttatttggtgtatttcttgcactgcttgcatgtctacaagggtttgatgctggggatatttcagaagaagctcctagtgatttggaggggttagatgcttctgcagcacacgttgccaatcttttgtcaatagagcctccaaatagtaggctttccatgatcacttga

SEQ ID NO: 100229 - DNA, 417 bp, Glycine max
  Peptide Sequence Number=SeqID_217007
atgtttgcacattcgattaaaggctgccgtcccttgagacgggcgtgtggggtgctaataccttccccatcgcgtcttttccggtttttccgacattttcctcaaataaacgttggtggcgactccgcgcgtattcctttcgtggaacacgcatcccgcgagtcacgcgtcgccctcccgccgaagggtaggttgcgacagtcatgtattaaggttgcattggattttgtctctccggaaaatgttggggagtgctttcgtttgacagaggaattttgcacacttccaattagccatgcgtctagtgaggacaaagtggagctacagtgttatatgcatagtttgatagatctgaaggaggaaattaggtcttggtgtattgttattggtgttttgaagaaggaaactccttgctag

SEQ ID NO: 100230 - DNA, 453 bp, Glycine max
  Peptide Sequence Number=SeqID_217008
atgatattaatcttgcaatgcggtgcatttaaggcattaaagacaactgatgactgcaagcttcctcaaagtacaccccagtggattgaagttaagagtcacgttgaaagaggaggctatgagtgtgggtattatgtgatgcattggatgtggaacataatcggcgcagagttgaagactgattggagtctgtggttcggtgatgccacaccactagagacgaagatgatgacaacattacgtcaaaaatgggcagaatatttttttaaacttagaaactcccaatctggtcccaactcttggaaactcttcctcttccgaatattaaatggattttccccaactgctcctacacggcctgtagccttatttggtgtatttccttgcactgcttggtatgatttactacaggaaaggatcctctcattgttggatcaagtggcctcggaataa

SEQ ID NO: 100231 - DNA, 1362 bp, Glycine max
  Peptide Sequence Number=SeqID_217009
atgtcggtaactgtgcttttactcataatattaagcactgctctggaaggcaatggagaagatgatcatgaaccgtgtaaagaaaaagtgttggatcctaggcctcacagcgtgtcaatcttagagtttggggcagttggagatggaaaaacactgaacacagttgcattccaaaatgcagttttttatgccaagtcatttgctgacaaaggtggggctaaactatatgttccatctggcaagtggctcactggaagttttaaccttaccagccacctcactctctttcttgaaagaggcgcaaccatcatcgcatcacaggattatgcacactggactgcaatggatcccctaccctcctatggtcgaggtgataatggaattattgatgggcagggttctgtttggtgggacctaatcagtactcattccttaaattatagccgaccacatattatagaacttgttggttctgataatatcataatctcaaatttgacatttttaaactctcctgcttggagcatccatcccgtatattgcagtaacattcaaatccagaagataacagttcaggcaccaaccaagttcccttacacaagcggtatagttccagtaagagttctcaatatgattgaagaaagggtattgttcccagttctcatatttggtgtattccctttcacagattcttctgagcatgtttgcattgacaactgcaatattagcactggtcatgatgcaattgtgctgaagagtggttgggatgaatatggagttgcctatggcaaaccaacctcaaacgtccacatcaggggtgtttatctacaatcgtcatctggtgctggcctagcgtttggaagtgagatgtctggaggcatatctgatataattgcagagcagctccatattaccaactcaacttttggcattgaactgaagacaactaggggtagaggtggctacatgaaaaacattttcatttctgacgcaaaattggaaaatatttacttgggtatcagcatgacgggaagttctggctcccatccagatgacaagtatgatcctaatgcagttccggatgttggtaatgttacttttgagaatgtgattggtgcaaatattgctattgctgggaatttttcaggaatagttgattcgcctttcactcctatctgtctttcaaacgtgactttttctaccagttccgagtcatctccttcatggttttgttctaacgtaatgggaatctccaaggaggtgtttcctgagccatgtcctgatctgcagaacacgtattcaaacttttcctcttgcttttcttccctacatccgtcatctagttttgtctcaagcgcatga

SEQ ID NO: 100232 - DNA, 261 bp, Glycine max
  Peptide Sequence Number=SeqID_217010
atgggtgccaaataccttgaagtggtcaaacgagggtcacatcccaacaacggatggtccccagacgaaattaggacgcagaatggccataatttgtctttgcgttttgttggacatgatcgagcctgggcggcaagacacagattgaccataatttgtctctgcgtgccaccggacacgatcgcctctggatggcgaaaaggtgcgcggaatgaccataatttgtctccgcccacctctcgacttattgtccccgaatga

SEQ ID NO: 100233 - DNA, 1445 bp, Glycine max
  Peptide Sequence Number=SeqID_217011
atgacattctgctgttgcacggccagccgctgcagtggtgctgggcgtgtggctgctggcgcgccacaacggcgtaccggcatttctgctgccggcaccgcaggcggtgctggaggctctgtggcaaaagcggcagctgctcgcgcatcacgcaatgtttacgctggcggaaattgtgctggcgctgctgctgggtgtcggcggtggcgtggtgctggcggtgctgatggcctccagcccgctactgcgtcgggtgctgtttccgctggtgacagccagccagaccatcccggtatttgcgctggccccgctgctggtgctgtggctgggttttggcatcgcgtcaaaagtcgtggtggcggcgctgattttgtttttcccgctgtgcctgtcgctgttcgacggtttatgccgtacgcctgccggctggctggagctggcgcaaacgctgtatccctcgcgctggcgaattttctggcgcgtacgctggccggctgcgctgccgcagtttttcgccggcctgcagatggcggtggtgctggcaccgattggggtggtgatcggcgagtgggtcggtgccagcgaagggttaggctacctgatgatgcaatccaacgcgcggctggaaacggccaccagttttgccgcactgctgctgttaatgagcctggcgctgctgctctcagcggcagtggcgctgtgaatagacttcttcgtgccatcgcttcgttactgctgctggccaccatcaacgcgcaggcagccgaaaaggtgcggctgctgctcgactggttcattaaccctaaccacgcggcgatctttgccgctcagtacagcggggcgtttaaacagcaggggctggatgtcgagatgatcgcaccggcggattccgcgtcggtaccgctgttgctggcggcaggcaaagcggatctggcgattagctatcagcctcagctctatacgctggtggacaagcaggtgccggtgatccgggttggcacgctgattaaccagccgctgaacaccctgacagccgtatcgggcgatatccacagtattaaagactttgccggcaaatcgattggctatgcgatccccggcgcggaagatgtggctatccgcaacatgctgaaatcgcagggtgtcgacgttaacagcgtgaagctggttaatctgaatatggatgcggtctctgcgctgctgacgcacaaaattgacggcgcgttgaccattttccgtaactacgagctgctggatttgcagggcaaaggcgcaaagccggtgtcgtttaaaccggaagattacggcgtgccggcctacgatgagttgattattctggccaacagcaacacggcggcaaacgatcctcgcatcccggcatttctgcgtgggctggatgcgggcatcgcctggctgcgcgctcacccgcaacaggcgtggcaggc

SEQ ID NO: 100234 - DNA, 399 bp, Glycine max
  Peptide Sequence Number=SeqID_217012
atggcgaaaaaaggtaaattggatcatataaaggaaaggatcaaggccattgaaggagatggagattatgctttcactgacatggcagaattgtgcctagtgtctggcatcgtcatccctctgaagttcaaggtgcccaacttcgataagtacaaggggactacctgccccaagaatcacctaaaggagtactgcaggaaaatgggagcatatgcgaaagatgaaaaattattgatgcatttcttccaagaaagtcttactggggcagccgtcacctggcagtatcagtacaattctgatatggcttcggatagaatgcaactacagaacatgtgcaaaaagagcatgaatccttcaaaggatacgcccaaaggtggagggatatggcaactcaagtag

SEQ ID NO: 100235 - DNA, 645 bp, Glycine max
  Peptide Sequence Number=SeqID_217013
atgacaaccaaaagtaatagcaattgcagaataagagattttactagcatgtctcttgcaactctttttggaaagcttcaggaacatgaaatggaacttatgagactccatcaacatgaagagaatgacaaaaagaataaaggaattgcactcagaacctcatcatcttctattcaagaagaaagtgacaaagaggacttgaatgaaatagaagaagatgatgatttcagattttttataaagagattcagtaaattttttagaaacaaaggaaatcaaaggagatcaaatatcaatccaaagaaggaaggagaaaattcctccttagccccaaaatgctatgaatgcaatcaacctgggcacttgagatttaatgaggttctgagtgcaattttatacaaagctcgattggttgccaaagggtatactcaacaagctggaatcgatttctcttatactttttctctagttgtcaagcttaccactgtgagagttttgctctgtgttgctactgctagaaactggtgccttctcctattagatgttaataatgcttttttgaatggagatttgtttgaagaagtttatatggaacttcccaacttccttggtatgcaaattgaacaaatcattgtatggacttag

SEQ ID NO: 100236 - DNA, 1302 bp, Glycine max
  Peptide Sequence Number=SeqID_217014
caggtgacgggctgcttggtcggctattctggccatgagcgtggcatttcagtgccgatcgccgtgaccgcgctgggcgcaagagtgatcgaaaaacacttcaccatcgacaaatccatggaaggcaacgaccacaaggtgtcgttgttaccccctgagttcaaagagatggtcgtacgtatccgcgaagttgaagagtccatgggcaacgccggcgaacgtactatcacccaaggggaaatgatcaaccgcgaaactctggcaaaaagtttgattatcaatcgcgatctgaaaaaaggtgaaatcatcactcgcgagatggttgaagtgaagagtccggggcagggtctgcagcctctttatctggagcaattggtcggtaagaaagccaatcgtgaccacgaaaaaggcgggtatttctatgagtcggatctaaatgatgtggcgatagaagccaaggactatgatttcaatcgtccgttcggcattccagtgcgctaccacgattacggcaagttgaagaataaatccaatcttgacttcgtcgagttccatctgagctatcaggatatggaactcgatttaacagaattcttctccggcgctgaaaatatcggttttgcggtacatagccccgagctgttcgccaacgatcatattttggatctggcgacggatgatcccgtttatcttgctcattcgatcaaacagctgcagcgtgtctgcgatgtgactcgcgcgttgaagcaatatttcccgaaaactgagcgtccggtcatcgtggtgaatgcaggcggtttcaataccaccggtttcttgccaaaagaatcacgtcaggcgatgtacgaacgcattggcgccgctctgggtgaaatcaatcaagaaggcgttgaaatcatcatccagacgatgcctccgttcccatggcactttggtggtcaaagctaccataacctgtttgtcgatccggacgagattaaagcgttctgtgagaaatacggctaccgcatctgctatgacacgtcgcattccatgatggcttgtaattactaccaatgggatcttcatgagtttacccagaaggtcggcccttacaccgcacatatgcatattgttgatgctttgggagtggatggtgaaggggtacagatcggtaaaggcgatgtgaactttgacgagctggctgatgatctgcggcgtcatgcgccgggagcgcagtttattcctgaagtgtggcaggggcacaaaaaccaaggggaagggttctggcatgcgcttaacttcctggaaaagtatctgtaa

SEQ ID NO: 100237 - DNA, 315 bp, Glycine max
  Peptide Sequence Number=SeqID_217015
atgggtgtagagaaacgcgaggaactggaaccagagaggcggcatgcaaaccgaggcaggattttagcatccaaaaaggttcaatttttcctccttgtggctgagtatgaagtcacatcaagggaaaaagctccaaaatccctcctcatttctactccaaattgcaaggagaagccattttcggagtcttggagcacacatctacattgtgggacttcgaatttcaagtatgggtggacttattctcacatgaaatttgtgggtgttgggtttttgggagctatgatgggtagttctactaggttaatgccttag

SEQ ID NO: 100238 - DNA, 369 bp, Glycine max
  Peptide Sequence Number=SeqID_217016
atgccaatctccccctgtggaagtatcagttggtctatgtcgttcccacatagtcctataggatgcccgttccccccagcaaggtcacgccatcatgacatagggatcgcacccgcaagacacccagtggacccgaagaagtccaacagggtcctggggtttccagctctagttacgagcctctatcagttttacggagtgcctatcacccccaacaaggtcatcaagacccctattaaccaggctttcatcaagaagtactgcgcccctgaggcaggcgcagggcgagacaccacagcagcctggggatggacggcagtgggcaataaacgcaccgccgccacctccaaagcccctcagctcatctaa

SEQ ID NO: 100239 - DNA, 216 bp, Glycine max
  Peptide Sequence Number=SeqID_217017
atgtgggtaaggatttcatccattttcaagttcatggcttggatggtgtcgcccaaacgggcgagaaccttggttagttggggtggaggcttagccgtggaggcaatgagagcaccaaatgatagggatgagcgtgtactggtatatgatcctcacttccagcctgagtcaaatgccacctcagatatgatcctggaccttatgtctctcatctaa

SEQ ID NO: 100240 - DNA, 744 bp, Glycine max
  Peptide Sequence Number=SeqID_217018
atggaagggcttcaacttggagcaatggaatacaagatggattttcactccctctgtcgtctgtcagcgagggcaaagcttaaggagaacccaatctcctatctggtagttcacgtcgcgtcgttttccgttagcttgggctttcatggcagcttaggccttgaggagtttatttcggatggtttggaaggtgttatccctgtcaatcagcacttcattcacaacatcaactatgccaaggtggattcccttggaaaagcgatcaacaacaaccaaaatggtggtgttacccttgtatggaaggagctcgacaatgaagcaaccaaatacgacccgagtgcagcaccaagttctgagagagagaaaactggggatgtttgtgggggttatcgcgaatggattgccggagttcagtatactcaggttgagcttccaattgtcgacagagttcctcaaggaaagtcaaccatgggactgacagaatcaaggacagagatgttgttgtctccggcttatatggttcgtgaggataatgaagtggcgaccaagaagatattgtctccatttcttcaccgtgctggttatggcacacaattccctgacataagtcgaagctcggagaagctttgggctaaacggatcgcacccatgcctaccctcgacgcgtcggtctcgactatgaaaggcatatcaaaattaggcaagaccagaactggagctgaggacatggcttgcttgagttga

SEQ ID NO: 100241 - DNA, 843 bp, Glycine max
  Peptide Sequence Number=SeqID_217019
atggaggtagcacgcataacttcgtccaacctcaggtggtcaccaccctgggtttgcctcgccggacgacctcgacaccctttcgggtcatggtggggaatggccaacacttggaatgacaacaccttcatccttgatctttacattttacccatttccggtgccaatgtagtatttggggttcaatggctcaagactttgggccccgtgctgaccaacgatacactagttctgccagctttatcgccatcaaccagagacttactacttccatattacgctgattcccgagacatcaacgtctcccaacccaggtaccatttcctcggagattcatggcttgctttccaagttcgcacttctcttccaacagccacagactctgctaagcatgaaattgagcttcaagatgattcaatgctccaacagggcctcatccaatccaacacgagtccattctcgttgccagtactgctcgtacgcaaaccagatgggtcgtggcatttttgcgtggattatcgcgctctaaatcccgtcaccgtccgggataggttccctattttgacgattgacgaattgctagatgaattgggcgatgctcaatacttctcgaagctcgatttactccaaggacacatggtatctggcagaggcatggaaccggtggcctcgaaggttgccgcaattcagcagtggcccacaccacgttccataaaagccgtgagaagcttcttgggtcttgccggcttctaccgcaggttcatttgtggctatgccaccattgcagcaccaatggtcaaggtgacaacaggggatcaattccagtggacgacacaagcttag

SEQ ID NO: 100242 - DNA, 291 bp, Glycine max
  Peptide Sequence Number=SeqID_217020
atggcgataaagctggcagaactagtgctgtgtgagggcccccaaattagtgtcatgttctccgtgaagcactaccaaacggtcttgatagaagaactgcatggacagagtactatcgttgacactcgtacattccaagtgttggccattccccaccatgacccgaaagggtgtcgaggtcgtccggcgaggcaaacccagggtggtgaccacctgaggttggacgaagttatgcgtgctacctccatcaacaaggatggtaacacagtggtcggcgataaggcccgctag

SEQ ID NO: 100243 - DNA, 234 bp, Glycine max
  Peptide Sequence Number=SeqID_217021
atgggtgaagtagatgaggtgcaagggcggatgaaggttgacatagaggccatgatgagcatgaagaagctaatggaggtcaatgcggctgtagttgtcactaccaatgccgtttctgaggtggacccgactcccccatctgacctcaaccaaataattgggaagtatgggcggcccccattttgtgcaagttcagaacaagcatgccttcccatcatatggcttacctcctaa

SEQ ID NO: 100244 - DNA, 213 bp, Glycine max
  Peptide Sequence Number=SeqID_217022
atggagaagaagcccacgaggatgaggagatggctgatttgcttgacttcttgggagggagtggagacacgtgactgggagatccccagattcatggtgaatgctgtgaaatttcccggacgcccgaaatggactcggatgaatgcacaaattgataaaggaacatattttggaaacattgggttgattaaaaatagaggaaatgaatcctga

SEQ ID NO: 100245 - DNA, 396 bp, Glycine max
  Peptide Sequence Number=SeqID_217023
atggaagtacttgacagacaactgcaaattaagtgttacccagatgtagttacatacactgaattgattgatgcagcttgtaaagatagtagagttggtcaggcaatgaagctgttgattgagatggtgagcaaagaatgcaaacctaatgtggttacatataatgctcttataaaagggatttgcaatgaaggtgtaggttggatgaacttgtctagtggtggaagatggacggatgctatgaaactattggctagcatgctttgtaaggggtgttccctgaatgttgttactttcaataccttgatcaatttcttgtgccagaaaggcttactaggtaaagcctttaatgtcttggagatgatacaaagcatgtctgtactcctaattccataa

SEQ ID NO: 100246 - DNA, 1557 bp, Glycine max
  Peptide Sequence Number=SeqID_217024
atgaccgcagacgatgcgcgcgaatggtaccgcacctggtatgcgcctaataatgcaacagtggtggtagtgggcgacgtcaaggcacaggaggtatttgccctggccgaaaagacatttggtcaattgaaagccaagcctttgcccatacgtaaaccacaggtggaaccagcacaaattggcgaacgccgcgccattgtcaaggcgcctgccaagttgccttattttgtgatgggctttcatacgccagcattgaaaaatggcgtggcatatagcgagcaggattgggagccttatgcgctggaagtgttatccagcatcctcagtggcaatgacgcctcccgcctgaaccagaaactggtgcgtgagcaggcaattgcgcttgaaattgataccggctatgacagcactaaccgcggccagacttcaacttttgaggtcgcggcttctccgagtgagggtgtgtcacaagaggatttgatcaaggcgatctgggcacagattgaggaggtcaagaatcacggggtaaccgcagcagagttgcaccgtatcaaggcggcagtgattgccgccgatgtctataaacgtgattctatgttttaccaggcgatgcagatcggacaattggaaaccatgcattacccgctgtcgctgttgcagaataatgccgccagggtgcaagccgtcacctcggagcaggcgtatgccatgaacgtgtttgcagccctgaatatccagcattggactacatctgaaggcagtgaagtgtatttcgtagaaaatcactcattgcccatgatggatgtcagtattaatttccgtgctggcagcgcgtatgacacgcttgaaaccagcggtgcggcggcggtgacgcatcacttgatgtcgcttggcgcaggtgggctggacgaagaaacattgacgaaccagtttgctgatattggcgcggtgttaggcggcagttttgatgccgatcgcgccagcttcaaagtgcgcacactgaccagtgaacaacaggccgcgctggatacctttatgctggtgttacacaagccggattttccacaaaatgtgctggtacgcgagcaggcaaggatcgtggccgcgttgcaggaagctgaaaccgagccggacagcattgcgcagaaagcctttatgcagtcggtatatggcatgcatccctacagcatggaccaaaatggtgaaatctctacagtgcagtcgctgacggttgcccaactgcgcgagttttaccaaacgtattacacggccaagtctgctgtcattgccatgatgggggatttgacgacagaccaagccaaacagattgccgaacgtttaagtgccgggttgccacaagggcctgcagtagccgctattccaccggtcaaagaactcaatgtgcccagtatcaaaaagttcccgcatcccgccgtgcaagcccatatcctgattggccagcccggcaatatgcgtggcgacccggatttctttcctttgtacgtgggtaattatattttgggtggtggtggatttgtctcgcgcctgactgaagag

SEQ ID NO: 100247 - DNA, 240 bp, Glycine max
  Peptide Sequence Number=SeqID_217025
atgaagcagaacatgatggctcttttgattggattaattggtgcagccctcactttatttgcttactcacaaaccttcgtatcaccaggtcaatgcatcacacttggtcttattgtcctcatgttgggcttgcttgtaggagaaggtatgtatattgagaattatattatatggccatttgttaatagtgctgaagctggtcaaacacctctgatagccattagaattcagaaaagataa

SEQ ID NO: 100248 - DNA, 1758 bp, Glycine max
  Peptide Sequence Number=SeqID_217026
atgggtggccaaaggagtggttatggtaagcgtccccactctcaatctgaccatgataatgggccaaataaaaggaggaatcatggtgatgatagagagcagtttgtgattgattcggaggataccgtgtatcgttatgtgtgcccgggtcgaaagattggcagtgttattggtaggggaggtgagattgttaagcaactgagggtggagactaaggctaagattaggattggtgagactgtgccggggtgcgaagagcgcgttgttactatttatggtcccagtgatgagactaatgctgttgagggtggaggcaattatgtgtctccggctcaggatgctctgtttaaggtgcatgacagagtggttgctgaggactttcacggtgatcaggatgacgatggaggccaacaagtgactgctaagcttctagtgccatctgatcagataggttgtgttattggaaaaggcgggtcaatagttcagaacatacgtggtgaaacgggggcccagattcggatactgaaggatgatcatttacctatgtgcgctttgagctctgatgaacttgtgcagattactggggatgctgcagttgtgaaaaaggctctttatcaaattgcatctcgacttcatgacaatccttcacgatctcagcatcttcttacttctgctgtttctggtgtatatcctgccggtggttcgctcattggtccaggtgctggagctccaattgtggggatagctcctcttgttggttcttatgggggatataaaggtgacactggtgactggccaccgcggtccatgtactcagctccaagggacgaggcatcttcaaaggaattttcagttcgattggtttgtccaacaggaaacattggaggtgtgataggaaaaggtggtatgataataaatcaaattaggcaagattctggggcaacaatcaaagttgatagttcaacaatagaaggggatgaatgcttaatagccatttcgaccaaagagttctttgaagagactttctctccaacaatagaagcagctgtgcgtttgcaacctcgatgcagtgagaaggttgaaagagattcaggaatcatctctttcactacccgtctgctggtaccaaccacacgtattggttgccttattggtaaaggggggtctatcataactgacatgaggaggcttacaaaagctaacattcgcatcatttcaaaggaaaatcttcctaagattgcaaatgaagatgatgaaatggtgcagatttcaggagaccttgatgtcgccaaggatgctctagtgcatgtacttacacggttgagagcaaatctttttgatagggagggtgctctctctgcattccttccagttctgccatatctccctgtttcagcagatggatcagatggcctaaactatgatggtagagatggtaaaagacatggacgtggacattcatattcaagtgggtatggaggctcaagtgatttagcagctggtgacgtctatggaagctatggtggttctcagcttggaagcaacagtgcttatggggcttatggaagttattctttgggacggtctagtactgctgggaaatacatatttttgtcgtctgaaaacggagttagagtgttaagcaatgagagccaaagtggtgttactattggcataccaacctttcatttttgcatgggctgtgggctgaccccctttaagtcctgtcccaacttccttactaagtgggctgtgtaa

SEQ ID NO: 100249 - DNA, 544 bp, Glycine max
  Peptide Sequence Number=SeqID_217027
atgtttcccttacgcatcgtcgagaccctctcggctgattctttcaacccgccactgttcgctgccctgtgcagcgctaatctggtacaggccatgcagcgcctcgccaaatacaagcaacttgtggctcccatgagcctggaagtaaacacgggcgacgcaggcgagctggtagtaacgcctcgctggttgttgatgcaaaccgatgtgccctattcgctgcaagtggccgagattgcgtttttcgtccgactggccagactcgctacccgtgagcccattaaggcgcatcgcgtcattcttccgccgcttccgtccgctcattatccccgacgttacgagagtttcttcggtgtgcccgtgcaaaacggggagtgtccaggtatcgctttcgccgctgtggatgctttgcgtccatttctgacggtcaacgaaagcatgtttcgcgcgttcgaacctgatcttcgccgtcggctcagtgaactcgatgcgacggcgtctacagcggatcgcgtgcgtgctgtcttactggaactgttgcctg

SEQ ID NO: 100250 - DNA, 573 bp, Glycine max
  Peptide Sequence Number=SeqID_217028
atggccagccagccgatatccattggaaacgttttgtttttgcaccctcagaactccgtcattattgctcattcaaccgacgctcagagtcggacacgctccatctgtcctgaactgtccaatctgaacaatggagatattccaatgaatgctaccaacgctatcgaccaactggccccccaaaaatggaccgaaacatctcccgcagaacgtttgcgccttctggaggaaatccgtgcaaacatgaagaagtacggtgatgaccttgccctcgctgacagcaagatgaagaatggcatcctcggtgcgcctcttttttcacaccccctgtctaaggttgcgaccgtcgttcctatggcgagtacagtctcggccgccattctcctttacgaatccattctcgacggcaagatgcctcagccgctgagcgtggaaaaagttagcgaggatctctacgacatttatgtctttccgcaggagcggaaggacaagttgatgtacgcggatcagaagagtcgcatccgtgtgaaaggtgaaccgaaacaaatcaatccgatggaaaagccctgcccg

SEQ ID NO: 100251 - DNA, 743 bp, Glycine max
  Peptide Sequence Number=SeqID_217029
atggcggcggagtcgcacgtttgtcattctcaagcctatgattatgcagaggttagcaagcttaggttgtcggatgataccctgttcacctgccgcgacgtggggcgcctgacgatccctgaattagcgcgaaaaggatggaaggtgattcatttggcgcagcaaaccgaatataccgactccgtcgacagcgacggtgaagttattaagctttaccaggaaatcgtggtggcaatcaaggccgccgagccggatgtgtcggcggtgctgcaaatcgccattcgctcgggtcttgccgcgctggcggtttacctgctggcgcgcggctgcggcgagcgcttcacctgggatcgcgccacgctgtgcgccggtttgagcgtgggggcattgttcgcgctggagttcttttttgtctccgcagggctgcgttacaccagcgcctcgcatatggcggtgtttttgtacaccgcgccgctgttttccgcccttggcctgcattttctccttcctcaggagcgcctgtcgccggtgcagtggctgggcatgctcatcgcctttggcggcgtggtgctggccatatcgggcatggctgagggaagcggcggagccgaacggctgaaaggcgatctctacggcctgctggcggggatcgcctggggagcttctaccctggtgatccgcaccacgcgcctggcggagtgcccgggccaaacagacgctgttgtttcagttgacgggcgcct

SEQ ID NO: 100252 - DNA, 512 bp, Glycine max
  Peptide Sequence Number=SeqID_217030
gtgcaccttttgagggcaccattgttgatgactggaagtttgactattctagtcatgatgctcgccgtatggctcacttggttaggtaccgaatgcataaggcattattggccaatgcacctcttccgtatcctcaattggtcaccccttttctctgtcattttcaaattcctcttgatgatgaaccttttgttcaagttaagagatcctttgccataggtgttggtgcagtaacttcatttggttaccgtaaggatcgtgatggacaatggctgaagaaggacgtgctacctccacaagacgagtatactccctctcatccttctcagcgagatgattcctcaacccttatgaatgaagttctttcagaattacgggacctccacacctatgttggcgaacgctttgattccttggatggtcgctttgaaggcatggatacccgcatcacccaacttgaagaggatgtgacttatctttgtcggtgctttgaccttccaccaccttcctag

SEQ ID NO: 100253 - DNA, 2301 bp, Glycine max
  Peptide Sequence Number=SeqID_217031
atgtctgttacttatgttgttcaacatgcagaggttgtagtgtcgccgaaacacacaactaaagccacttcttcttcagtttcaccgacacaatgcctttcatctccaaaattcagcgccaaaccgattacaccctctttggttccgccactcccatcgtcatcgacaatggcgcctcctatttccgcattgggagaaactgtcactattgttggtgaccatgatccagcattactgaaatactttgactgtactcgctctggaccccgctcagcatttgacagcaatgttgtttaccagtttgaaataatggaatatagtatagacctcgtcatttcttcaaggtcctacagaatgataatttcctgggactatctcacagacagtgccatagtgtggtgccttgcaccaagcaatgccaagattctggactttggatttgacaggttgggtgctacaggatcagagattgatcatcctgtcctgatcacagaatgtgtaagcaacccagttcagtctcgtagtaagatgggagaacttctttttgagacttatggagttccatctatagcctttggtgttgatgcggcatttagctataaatataatcaacaacaaggtgtttgtgataaagatggtcttgctatgtgtcctggattcaatacaactcatgtgattccgtttgtagatggggagcctatttataaaggatgctgtcgtactaatattggtggattccatgtgactgattatttaaagcaacttctttcactcaaatatcctcatcatatgactagatttacatgggaaaaggttgaagacctgaagatggaacattgttatattgcaccagactatgcttctgaagctcggttgtttctgaaaggagctagggaggctgaagaaaaaaccagatgttggcagctcccttgggttccacccccaactgaggagcctccttctgaggaagagattgcaagaaaggcagcaataaaagagagacaaggtcaaagattacgagaaatggctgaggcaaagaggtcatctaaaataaacgaattggaaaatgaattgcatggtttggaatttcttttaaaacagcttgagcaagttcaagacagtaatgttccgtctttcctagcagagaccggttatgtctctaggcaggagatagaatctgcccgtactaaagttacacaatccttacggaaagcaaaaggtgaaccaaagaatgaacaagctgaaactgataaagccagccctaatgctaatgaaaagtattctcttataaacatccctgatgacatgctcaccccagaccagctcattgaaaagaagaaacagttatcactgaaatccatgtctgaagggcggcaacgattaaaacagaagcgttatgaagaggaattggagcgacaaaggaaacaactgctagaggaggagacacgcttagagaacccagagctttacttggaacaattgcgtgctagatacaaagacctttcagtgaaagttgaccaacgaaaacggctcaagacaaatggaggtcattctaacggaaataacttggccggtgccattggtcgtggtgagagactcaatgctgttcaaagggagagaatgcgcctcttgacaactgctgcctttgatcgcggcaagggtgaggatacatttggtgccaaagatgaagattggcaactttacaaattgatgagcaaagatattgatgatggtgatgagggaccagatgaggatgatgcagagctagcccgcatctcttcaaggctacaggacttggatccaacatttgtgcccaacaagtcagaagcaggtagctctcaacctgctgctgaggcccaacgcgcccgtcctctcaccaaagaagattttcagattgtttttggtgttgaaaggttcaggtgccccgaaattttgttcaatccaaactggattgcggttgatcaagcagggttacacgagatggctggggtctcaataagaaggttatcatgtaaggatgaaggcctggaagagagactcactagctccatacttgtgactggtggaagttctcttttccccggcatcactgaacgcctcgaagccggaatccggatgattcgaccatgtggagcaccaataaaagttgttagagcactggatcctgttatggatgcatggcgtggggctgcagcgtttgcatctgccccacaattccatacacaaactttcagtaggatggattatttcgaaaagggtgaagattggctccgcaattatcagattaaatattcatcgtaa

SEQ ID NO: 100254 - DNA, 225 bp, Glycine max
  Peptide Sequence Number=SeqID_217032
atggttttgaccacacaaccggaccagccggttaaagagtatatgttaccggctatagcaggtcaccttccaccaccaaaaacctctttagacccattcttaaccctcaactcaacccaaccccttttgcttgtgttccctggtgccacgtgtaagcctcactcttccttgacaggattagaaaacatgagggatttggctttccctaagaaggatttagagtga

SEQ ID NO: 100255 - DNA, 564 bp, Glycine max
  Peptide Sequence Number=SeqID_217033
atgttgctgctcaagggtctagatgatctaggtcatgagctctttgagactctaatcataagtaaggatcacaaagtggtgacccaagaggaccccgcccatcacgacgccaaaagcatttgtttccagcgagaaagggatagagaagtcaggggagcccaactcgtcgatgagctcatcaatggttggcatgggaaatatgtctttgatggtaatgacgttaagactgtggcttatgcggataagtctggtatcgagcatggtgaatgtgatgggttgtcaggaatgagtgagggagataaagtatggttagtgacgggaattggggtgatttggaaaaaggtcgatatggcttgggtatgtaacaggcgtttaagttggtgggctgaagtaaagggtgggctgaaggaaatattcactaacagctggatggggtggcccaaatgggtgaaggtcatagaaagtgaggtggggtgtatgcactacatgacttcaccatttcccaccattacttgtaaagggtcaatggatttggacggtagattaaggaactttgcgacacag

SEQ ID NO: 100256 - DNA, 273 bp, Glycine max
  Peptide Sequence Number=SeqID_217034
atggcgtgtccgacgatcgtgtacttcgaggttaaggcgctgaagatcggaaaggtcacgacgctggaatgtgtcatgtgcctcaacgagttccgcaacgacgaaaacgaaggagatcgagttcgtcagacttcaacaagaactcaagaaggtttgggagaagaaatcgctcaattagagaattggggatttagggattcatctgagtttgagagaaccggtggatgcttagaccaggtgaacaaattgaaagctgccatgtgtccaatgtag

SEQ ID NO: 100257 - DNA, 168 bp, Glycine max
  Peptide Sequence Number=SeqID_217035
atggcggttgttggaggtgcgtgtaaagcttggcaagtggtcatgatcgaatatgctacttcgaccgaagaagaaccttgtaggtattgtggtatcaaaggtggaggcttgccatatgtaatctcgaaaggaaataactcggtgctggagtgtatgaatgtgttataa

SEQ ID NO: 100258 - DNA, 216 bp, Glycine max
  Peptide Sequence Number=SeqID_217036
atgtcattgcctagcgctgttcatgtgttctcccttatcaagtgcgaagcttctggtgactgggaagcacgttattctgttgttttccagatcggttccttcgccaaaagaaaaaaaagaagaagtagagatgagagtcgtcattgcgaaaagggcaggacggacgaaatcagtcctatctttgctttcctcttatctccgatgagaggtaagtaa

SEQ ID NO: 100259 - DNA, 264 bp, Glycine max
  Peptide Sequence Number=SeqID_217037
atgacttggatgcagccaaacttaacaaatgttgttggattttcgtcggaagggaatatggctaatgataaaggtctaaaagatactagtttgaaattcaacaaggtcaaaaaatacaagaacttgacaaaggatcccactacattcactactaatgtgttcaaaggcaagggaaaggaaagatttgagctagagtttgcaatcatgtccaaggttctcaaacagatgagctacattgaagtagatgaagaaggaggaggctag

SEQ ID NO: 100260 - DNA, 261 bp, Glycine max
  Peptide Sequence Number=SeqID_217038
atgcaagaacagtgccctagcaaggctgactcacgtccaccttggtctcacaggagccaatggcgggactgtgcatggggtgtatcgcaagagccaatggcggcatgggcttacgtggaagccttctcgccagtgggagtagcgagacagcgtccacgtcagctgtctcgccaagcagaatggcggcaccctctgagctctctcgccactgctaatggcggtactcctttcttgcctgtgttgctggcgggatcctcgtag

SEQ ID NO: 100261 - DNA, 222 bp, Glycine max
  Peptide Sequence Number=SeqID_217039
atggaggattgggggaattttctccatcgaatccttcaggaggattctgaggattccgctctgattaaagtgttcctcttggtgtgggggtttggcggcaagcaacggcggctcacggcagccactggtggtggagaaggaggtattaagatctcgcttagcgagctcgtttcactaagctggagtccacttttcgctcttagtgcgacaattcaggcttag

SEQ ID NO: 100262 - DNA, 309 bp, Glycine max
  Peptide Sequence Number=SeqID_217040
atgcctgcgagagcagagcgcatggctcggaggagtgattttgatcaatacaccccttgttgcagcggggaaacctacgatgttgttatatattgtgggattattgacattttgcaagattacgatatcagcaagaaactggagcatgcttacaagtctttacaggttgacccttcatcaatctcaattgttgatccaaagctttactcaaaaaggttccgggattttgtgggtagaatattcattgaagactgggggcagggtttgtggtcacaaataggatatgaatatgatgtgaaaaatgattga

SEQ ID NO: 100263 - DNA, 465 bp, Glycine max
  Peptide Sequence Number=SeqID_217041
atgggaagagggaagttgccaaaaatcactccggtagctaagcacggtggagcatcgctgtttatgatagggatgcttgcttgtggagcttctatggaagctggatctttgagcttcaatgaggagcttcaccaccaagaatgtgccttggataagaagcttgaagaggatgctttaatggaggaaaagaaagagagaagaggggagcatgaaattgaaggaataaaagagggagagaagtggaactttgaacatgaggttcatgagaatcctaaggtcttctttagcaactctagcccaattttcttggagtcttctatcaaatacccttggggggtaggattgcatcatcccctccaccttggaaaggatttgacctcaaatcctgagagtagggtaaggtctgaaaacccctttcatggacatcttcctataagggaacatggttcctcaccaactcaatga

SEQ ID NO: 100264 - DNA, 129 bp, Glycine max
  Peptide Sequence Number=SeqID_217042
atgttgagagaaaaggatgagaagtttgcaaatcaaaatacactagctagagaagttatttgctcttctgcgcaagttttgaagttgtctctaagcctaaataatcccttgaaccccatcaacaaataa

SEQ ID NO: 100265 - DNA, 678 bp, Glycine max
  Peptide Sequence Number=SeqID_217043
atgcttgttctgaaactgccacgtgtcacccctgcattttctatgtatctgccacatccttgttccctcaaagaagttgttaacctcttgaaattctctgccactgcaaagagcttgagatttggcaaaaccatccatgcccagttggttgttcgcaaccaaacttcaaaggacagtgacatcactcaaataaattcactgatcaatctatattccaaatgtggtcaatcgaaatgtgccagaaagctgtttgacagaatgcttcagagaaacgtagtttcttggagtgccttgatgatggggtatttgcacaaggacagtgggagagtcaaagaggggaagcagtgtcatgggtatttgttgaagtccgggttgttgttgcatcaatatgtgaagaatgctcttattcacatgtactcaaggtgctttcatgtggattcagcaatgcagattttggatactgtgcccggggatgatgtattttcttataattccatcttgagtgcacttgtggaatctgggtgtcgaggagaagctgcacaagttttgaagaggatggtggatgaatgtgtaatctgggatagtgttacatatgtcagtgttttaggcctttgtgctcagattagagatttgcaattgggtttgcagatccatgcccagttgttgaaaactggtttg

SEQ ID NO: 100266 - DNA, 294 bp, Glycine max
  Peptide Sequence Number=SeqID_217044
atggcgttcggtgtgggggagggatttggaggaagagagagtggtgtagctgttcaaggagttgccggcgcacaaggacaattgtccaaggatgtttcattcaccatcgtgcctttggttgcttcggtcaatgaatccgtcgaaccggagatgtggccttttgatctttccaatacaacgtcgttgaaggtcgccaatggtgtgatgccctatgaagcaccgacaccgacaccgacaccgacaccgacaccggacacgacacggacacggacacgtggacacctgaaatgttga

SEQ ID NO: 100267 - DNA, 1119 bp, Glycine max
  Peptide Sequence Number=SeqID_217045
atggagcttgaggatacacgtccaaatgagttcacttttgcagttctgctaaatgcttgtgcgagtttggtggcactggcatatggatttaagaatcatctcattgttggaaatgctttgataaatatgtattccaaaagtggcaatattgattcttcatacaatgtgttctcaaacatgatgaatagagatgtgattacttggaatgctatgatatgtggctattcccatcatggacttggtaaacaagctttactagtgttccaagacatgatgtctgctggagaatgtccaaactatgtaaccttcattggggtactttctgcttgtgttcatttagctcttgtacaagaaggattctactattttgatcagataatgaagaaatttgacgttgagcctggactggagcactacacatgtatggttgcacttttgggtagggctggtttacttgatgaggctgaaaactttatgaagacaacaacacaggtcaaatgggatgttgttgcgtggcgtactttgcttaacgcgtgccacattcatcgaaattacaatttagggaaacaaattacagaaactgtgatacagatggaccctcatgatgtgggaacatatacattgctatcaaacatgcatgccaaggcaaggaagtgggatggagtggtgaagattagaaaactgatgaaggaaaggaacattaagaaggaacctggtgcgagttggctagatataagaaacaatacgcatgtctttgtttcagaaggaagcaatcatccagagtctactcaaatttttgagaaagttcaacagttgttggcaatgattaagccactagggtatgcgcctgatgttggtgttgtgctgcatgatgtggaagatgaacaaaaagaaggttatcttagccatcatagtgagaagctagccttagcatatggcctcatgaaaatacctccaccggggccaatccgcataattaaaaaccttaggatgtgtgatgattgccacattgctgtaaaattgatttcaaaggccacaaataggttgataattgtaagagatgctaaccgttttcatcattttagagaaggattgtgtacgtgcaatgaccactggtag

SEQ ID NO: 100268 - DNA, 406 bp, Glycine max
  Peptide Sequence Number=SeqID_217046
atggctcacatagacccgggtattgatgtagctccatgtggagcttgtaggccttggatcttcttcatcaatggattcctttgcttcttgaggtcttattatagtggaatggagaaggagaaagatgaatggagacgccacttcaaaaaacttgatgccttggtcaacctagtaactcagctggccataaatcagaaatctgcagttgcacctgttactgttgcaagagtctgtggtctatgttcttctgtcgatcactatacagatctttgtccttctttgcaacaatctggagtcaataagcaacctgcagcctatgctgcaaacatttataatagaccccctcagcagcaaaaccaacaacagcagaataattacgatctttcaagcaacagatacaatccag

SEQ ID NO: 100269 - DNA, 662 bp, Glycine max
  Peptide Sequence Number=SeqID_217047
atgttggaggcaaaagactcaacgatgatgaagctcttcgggaatacgatcccggcaccggagatccccgccggagctccggcattttcttctggtgatgtttttggtgacagtgttggtcagaaccgtggttcttcaagtgtcaatggggatggtgaagaacacgagattcagcaggacataatgggagaggaaacaactgagagtaagaaggaagatgaagtgaccaatcttgatactgtctcaagatcaggggaagggtctattaacccctctaccgagaaggaggatcttacattgaaaacttcaaaaaagactgagcaagaacaaggtgaaaattcacaaaataaaacactgagaaagccggacaaaatactgccttgcccccgctgcaatagcatggacaccaagttctgctactacaataattacaatgtcaaccaaccccgtcatttctgcaagaattgccagagatactggactgctggtggagtgatgaggaatgttcctgtgggtgctggtcgcagaaagaacaagaattttgcttcgcagtatcgtcatataactgttcctgaagcagcactctcgagttcccagccggacttgtcaaatggagtcagtaatccttccttgaactgtaatgccacactccttgcatatgg

SEQ ID NO: 100270 - DNA, 294 bp, Glycine max
  Peptide Sequence Number=SeqID_217048
atgtcggatgcacaacggagagggctttccaaccaaaaacttctagagggagacatcaacacgattaagggatttgaagatctgattggcggcctattcttgagcaaaggaatcaaagttgcatttgtgtctcccctaaggttgagccaagtcaatcactttcatcatcgtataggaatagaggatgcttgtgcagtaggatcaatgcaccacagtgtaaaaccagaagtgggagctgagcaaaacgaatggggacaagcttttgagacagaggatttccattcgaatatatga

SEQ ID NO: 100271 - DNA, 264 bp, Glycine max
  Peptide Sequence Number=SeqID_217049
aatgtttatacggataaccactcgggtatttccgcccgtcagcgtgactcaaatgtcagtatgacagatcttgtgagcgcggaagatgacacagcaaaaaggaatgtttatacggataaccactcgggtatttccgcccgtcagcgtgactcaaatgtcagtatgacagatcttgtgagcgcggaagatgacgcttttcgtcttacagatagcaaaaaaggttttgaaagagcggacaaccacttgggtatctctgcatgtcac

SEQ ID NO: 100272 - DNA, 126 bp, Glycine max
  Peptide Sequence Number=SeqID_217050
atgaccacaatagatgaaggggatgatagtgatgaaagactcatgaaagacctttccatggtttcaactctcaccactctggctggtttgagactagcaaaggtggtagggctagtgccgaagtga

SEQ ID NO: 100273 - DNA, 402 bp, Glycine max
  Peptide Sequence Number=SeqID_217051
atggtcacctttcgtctgtcgccgttgtcacctatgcgaccctttttcgcgaactccatcatcgtcgcctacgtccaaaatggtgacctccacgacacgttccaccacttcgccatagtgccggggaagaacatcgcatcgtacaatgtcatgatctcagggctcgcgaggtgcaagcacatggaggatgtgcaaaggctctttgaagcgatgccatgtccgaacattgtgtcgtacaccgtgatggtggatgggtatgcgagggtggagggagggattgggcgcaaaaggatgttgttcaaagggatgcctcgaaggaatgcgatcaataacactgaaaagttgtgcaacaatggagattggaatttaaaaccatatcaggtatttgaccctggaagttga

SEQ ID NO: 100274 - DNA, 609 bp, Glycine max
  Peptide Sequence Number=SeqID_217052
atggcgaattcaatatgttctgctgatttcggttcgaaatcgaggcaaatcaatcaccttcagaagaatcggagaacccctagttcttcatcgtcatcgaattctcttcagataccaccctgtgatcgatctcgatcggctatggttgatgttgtgatgttcattgctgttgtttgtgcctgtggctttttgttcttcccttatgtagagtttttggtgacaaagtgttacgaggttattaaggttgttgtgtttttgattaaggaggaggtttctgtggcaccttggatctatgtttccatagggttgagtgttgtgtttgctgcattggccacgtggggtgtggtggcttgcaccactaggaagtgtgggaatcccaattgcaagggtctgaggaaggctgctgagtttgacattcagttggagactgaggattgtgtgaagaattcggcttcttcgtcaggttccgggaccaaggaagcatcttcgaaagatcaacaagaagtagcagctatagtgaccgagacgagtaggacaagggacaggagaggacacccttttgatttattggatggaattaaggaaagggatgataattggatcaaatag

SEQ ID NO: 100275 - DNA, 498 bp, Glycine max
  Peptide Sequence Number=SeqID_217053
atgacattgctacttagcaacattctgcccaacgaccgcaacgccaatctcccccggcaaaaagtatcagttggtctgtgtcgtcccgacatggggatcgcgcctgcaagacacccagtggacccgaagaagtccaacagggtcttggagttgtcaagctctaattacgggtctctgtcagttctacggagtacctgtcacctccagcaagggcatcaggccccctaccaatcgagctttcatcaagaagttctgcgtctccaggcaggcgtagggcgaaacaccacagcagcctggcaatggccggcagcgggcaacagacgcaccgccacctctagagttcacctcagctcatccgcaaaaaggttagagcgttgcctacgacacatggccgaccagcaggcgaccaagtccaaagccaaaggtaagcaaaatactaggtccgtgacctacaagccatcatgcgtccagctaaagacgttaaagaagcgctgctag

SEQ ID NO: 100276 - DNA, 459 bp, Glycine max
  Peptide Sequence Number=SeqID_217054
atgtatcattatcccacgcaccaatataattactcggccaatatcggatctcccccctgcccgacgcctctccgaccgagaatgcccaatcaaccacaaagacctccccaacatcacccacaaaatccattccctacactgcctagaccgagtgcaaatcccaaccccaatacaaacaccaacccaaagaggaacttcccagagagaaaacctgtggagttcaccccaatcccaatgtcatacgccaacctgctaccatccttactctataaccaaatggccatagtgagcctaggaaagaaaatggaatggataaggagagagaaagtggcaagtttatggagggctgaatggaagggatttggttcaaagtttgaatgtgtttggatggagaatgatgatgataacgatggtgttcaagtgggattaaaaggatggtttaagtttggcaatttttag

SEQ ID NO: 100277 - DNA, 141 bp, Glycine max
  Peptide Sequence Number=SeqID_217055
atgatgcgtgcacctgactcaacactcagatgcaatgtgggaactgtgctgagtttgtcgagaccacccggttgtgcatgtaacagcccccctcccataggtgatcagcctgggagcccaaaggtgttccctaccaagtga

SEQ ID NO: 100278 - DNA, 201 bp, Glycine max
  Peptide Sequence Number=SeqID_217056
atggttcatgatagcaccaaggcagcgaaccatacccaacccatcactctgaccccagctagcccattggttggttcaaatttgcgtcagcttctcacgcgcgaagtatttgatataatgtctcaatcaaaagttacatcttctttaagtgttaacaacaatgaagagtcaaattttaaaggaaaaacgctattgtcttaa

SEQ ID NO: 100279 - DNA, 405 bp, Glycine max
  Peptide Sequence Number=SeqID_217057
atgaaacaagaactcaaaaacttcgacatgcttaccttcacacaagcaaggtcacgacaccactccaaagggcacgagatcggatatgtggtggtggtcagaacaatggctagggtttttgttcttggtggtcgaaaaggcaatgtgacggttcttgaagagcaatggaataagaactacttctcactctggtgtgtgatacccatggcatacaacgcgattttagaaataataaggagtttcattattgcccgccaaaatggagcttactacagagaaggatggtttctatttgctttcaggacaatagggttaataattcctggggtacctgctcatggtccacaagattactttaattctacccttttaggaaagattgaaaaacacttcaaagtagagtga

SEQ ID NO: 100280 - DNA, 324 bp, Glycine max
  Peptide Sequence Number=SeqID_217058
atggcttccacaaacagtggtgcaacttcggccaacaatggtggcctgactccggtaaacaactccggtgcgactccgctcaatgcgtttctgatgaatcaagatgttccttccttgtttcctatgacaaattttctgattcaaatcacaaagaagttagatgataagaacttcttgttatggcaacagcaaatcaagccagcaatcactgcacttggactcaatcgcttcgttgcgagtcctcaaatccctccacgatatctttctgatgaagatcacgatcctgatcgcattaatcctctcttctcgatctggcagaaataa

SEQ ID NO: 100281 - DNA, 609 bp, Glycine max
  Peptide Sequence Number=SeqID_217059
atgaaggataggccaaacaaaatgtggaaacttgatacaagcttaggaagcaatggtagagaacacgcacagtcaagcttccttcgtgaaatgaaagaatgtctcaacagcaaaatggaatcaagatttgtcaagctcactacttccatgcaacaaacaatacacggaatgtttcaacagaggcaacaagactctccaacatcaagcaatcaacctagaggtgagagatctagcccttattcttgtggcactcgattggctaggttggactttccaagattcaatggtgaaggaataaaacaatggttgatccaatgtgaaacttttttttctgttgataatacacctgatgaattcaaagtacgtttagcagtagttcattttgaagggaaagcattccagtggcataatgcttacataaaatccgtaggattggagaatttaccctcttggaatgaatatcacatcttgttacttgatcattttggagatgtttgtgaagatcctatggcggatttaatgaaacttaggcagacaggatccatcatagagtatcataaggagtttgactcaattatatcaagagtagatcttttttatgagcattaa

SEQ ID NO: 100282 - DNA, 267 bp, Glycine max
  Peptide Sequence Number=SeqID_217060
atgcgttcctatggagtggtgaaggcgctagagaaagagacaacaacggtaaaggagaacgcgatgtgtgtgttggttcacttattgcaaaacagggaggaagagaaggcgatgatagggagggggagagtgattatgcatctggtgaagcttctagatggaagggaattgcgcgggaagaagaatgtggcgactgtgcagtacgtgctgtgttcgacgacgaaggagaataaggtgaaggcggtgagcgcgggtgtcatactctaa

SEQ ID NO: 100283 - DNA, 1923 bp, Glycine max
  Peptide Sequence Number=SeqID_217061
gagaagcaagttgatcttcttccgaagttgaaaaagaatgtaagcactccagagggggttccacgcctttttgatttagtgaaagttcaagatgaaagaatgaagcttgctttctttgcggcacttagaaacactgtggttgctaaagatcttgaccaggcaacacgtatagcatatggtggaaacactgagtttcgtcgagttgttacccttgacggtgcactctttgaaaattcgggaacaatgagtggtgggggtggtaagccccgtggtggcaagatggggacatcaattcgagctacaagcgtgtctgtagaaagtgttgcaaatgctgaaaaagagttgtctaggttgactgataaactgaatgacatccgccaaagaattatggctgctgtgcaacgttatcaggcctcagaaaaagctgttgctgctttagaaatggagttagctaaaagtcagaaggaggttgacagtttaaattcacaatataattatattgaaaaacaacttgattcccttgaggcagcatcaacgccacaggaggatgagctcgacagattgaaagagctgaagaagattgtttctgcagaagaaagggagattaatagactaaataatggatctaaacaactgaaggaaaaggctttggagctccagagaaatttagaaaatgttgggggtgaaaagttaaaatctcagaagtcaaaggtccagaaaattcaatctgatattgataggaatagttcagaaacaaaccgtcataaggtccaaatagagacaggacaaaaaatggtgaaaaaattgactaaaggaattgaggattcaaagaaggagaaagaccggcttactgagcaaaaggagaaactaacgcaagccttcaaagaaatagagcagaaagcatttgtagttcaagagaattataaaaaaacccaaaaggtgattgacgaacatatgattgtcttggagaaagcaaaatccgagtacaataagatgaaaaaagtgatggatgaattgcgtgcatctgaggttgatgctgaatttaaattaaaagacatgaagaaagcatataaagaattggaaatgaaggggaaaggttacaagaaaagactagatgatttgcaaactgctcttcataggcatattgaacaaattcaggcagatttagtggatcaagaaaagctacaggctacattggctgatgaacatcttaatgctgcttgtgacctgaaaaaggcctgtgaaatggttgctctgcttgaagcacaactaaaggagatgaatccaaatcttgattcaatttcagataatacagattcaaaacttatgattatcagataccgaaagaaggtatcttcgtacaatgagcgagttgaagaacttaacgcagtcacgcaggagcgggatgacataaaaaagcagtatgatgaatggagaaagaagagattggacgagtttatggaaggatttaatgcaatatctttaaagttaaaggaaatgtatcagatgattactcttggaggtgatgcagaacttgagcttgtggattctttggatcctttctctgaaggtgttgtgttcagtgtcagaccaccaaagaaaagctggaaaaatattgcaaatttatcgggtggtgaaaagactcttagctcgctggctcttgtatttgctcttcatcattacaagcctaccccactctatgtaatggatgaaattgatgctgccctggacttcaagaatgtatctatcgtcgggcattatgtgaaagacaggaccaaggatgctcaattcataatcattagtcttaggaacaatatgtttgaattggctgatcgacttgttgggatatataaaactgataattgcacaaagagcattactatcaatccggggagttttgtggtatgcgaaaaggctgtttga

SEQ ID NO: 100284 - DNA, 436 bp, Glycine max
  Peptide Sequence Number=SeqID_217062
ggtaggttgcgacacgggggttatgaaggcgttggtggagctgatggtggacttggggttgagtatggtgtacttggtgagcatggtggtggcagtggcagaggggatggcggcactgcttcaatgatgtcctttaatggtgattttcaaccatggagatgcagcagaagacaaaggagaagaggtgagaggaggcgccatccactagggaataagccatggaagaaggagcttcaccaccaagatgagccttggataagaagcttggaaggatgcttcaatgaaggaaaagaaagagggagagaaagagagaggggggagcacgaaattgaaggaataaaagagggagagaagtggaactttgaagtatgtctcacaagactctcattcatcaaagttacaacaagtgttacacatgcttctatttatagactag

SEQ ID NO: 100285 - DNA, 1800 bp, Glycine max
  Peptide Sequence Number=SeqID_217063
atggccccgcacgccgagtccgcacccgactcagccactcgccgccgctcctccgctcggccaaggctcttcataaaggagatggtcatgcgcaacttcaaatcctacgccggcgaacagcgcgtcggtcccttccacaagagtttctccgccgtggtgggacctaacgggagcgggaagagcaacgtcatagatgcgatgctgtttgtgttcgggaagcgagccaagcagatgcggctgaacaaagtttcggagctaatacacaattccaccaatcaccagaatttggatagtgcaggggtttcagttcattttcaagagattgtggattcggatgatggaacatatgaggcggttgcaggaagtgattttgtgattaccagggtggctttccgggacaactcctctaagtattacattaatgaccgcacaagtaactttacagaagttacgaagaaactgaaagggaaaggtgttgaccttgacaataacaggtttcttattcttcagggtgaagttgagcagatttcacttatgaaaccaaaagctcaagggcctcatgatgaaggttttctagaatatctggaggatatcattggaaccaacaaatatgtggaaaagattgatgaatcacacaaactgttagaatccttgaatgagaaaagatctggggtggtacaaatggttaagctatctgagaaagaaagagacagcttggaggcatgtaaatttgggattgtttgtagccatttgatgtttatccaacacctgatgaaagctacaaagttggcccttgatgatacaggtggaaaaatggatgagttacaagggaatgttgctactctagaagaaagtctcaaggcagaaagggataaaatccaagatagtaaacaaactctcaaagagcttgaaactacgcacaacaactatatgaaaagacaagaggagttagataatgatatgaggaagtgcaaggaagagttcaaagagtttgagaggcaggatgtgaagtatcgagaggattttaagcacgtgaatcagaagatcaaaaagcttgaggataaagtagaaaaggtagagggaagtcatagtttatggcaactgaaagtaaaagattcatcaaaaattgaagcccttataaaagagggtgaggaatcaactgttctgataccaaaacttgaggacaatatcccaaaattgcaaaagttgttgcttgatgaggagaaggtcttagaagaaatcacagagagttccaaagttgaaactgagaaataccgctctgagcttgctaaagttcgtgctgagcttgaaccttgggaaaaagatttgattgagcacaatggaaaacttgaagttgcatgtacagaggctaagcttctaaatgataagcatgaaggtgcttctcaagcctttgaagatgctcaaaagcagatgaaaagcatatcagaaacaattaaatcaaaaactgccagcatttctcaaatcaacagtgatatagaaaagaggaagcatgaagcttcagaagctcaccaaattgaagaagaatgtatcaaagagcaagatgaactgattcctcttgaacaaagtgctagacagaaagttgcagaactgaagtctgttctagattctgagaagagtcagggatcagttcttaaagcaatcctgaaagccaaggaaacaaaacaaatagaaggaatatatggtcgcatgggtgatttaggtgctattgatggtgaggttttccaattgcaatttttctggcttcatgaagttcttttccttccaagttataccacttga

SEQ ID NO: 100286 - DNA, 321 bp, Glycine max
  Peptide Sequence Number=SeqID_217064
atgacccaaaatccggtagcatgcggagacaccttacggttatccgcaactcgtcatacggagaccccaagttcgattgacaagcagagaccaatttggtcatctgcaccctttccagagatgtcagcatgtttcggagcaaaagcctcgcttttgtcgaccaccccaccttttgctatcatgacccaaaatccggtagcatgcggagacaccttacggttatccatacctcgtcatacggagaccccaagtccgattgacaagcagagaccaatgtggtcatctgcacccttttctggagatgacaacatcttctggtag

SEQ ID NO: 100287 - DNA, 399 bp, Glycine max
  Peptide Sequence Number=SeqID_217065
atgcatttacctgaattacatcaaattcaaaccctgatcctttgtaaaaaccgtaaccccttagataagatttatgctggttccttctttgcaattcctcttgttcggtggttttttattcggaaaaagaatgctgatattgaaaagagaaacaaagctaggcagcagtgtgcacaagttcttgaattacctgacacttcactaaggcagaagatagctggaatcatcatcaaggagagaaagcatagcaaggttaacaaaggaaaatacccacaaacaagctcagatggggatgaaacttcagggttaggagtggctggtagggacgaccctcactttggtagcccaactagagcacaggctggatgtgccttcgtgcgctgcaaaagcttccaatga

SEQ ID NO: 100288 - DNA, 267 bp, Glycine max
  Peptide Sequence Number=SeqID_217066
atggcccaaaagacagtcataggacaggatcaaattgtgtatagtactgacaaggacttacttgagcaagagtatgaagctcgcgaatgggataaaaagtttcgggagctagagagggcgttgagctctcattttgccatcattgacaactttagcacagcatctaggctgccttctgtgaaagcattgggtagccctggtttattgcaggcatttactggtccatgtatcaatcttaattcgtttctcttaggtccagcaatttaa

SEQ ID NO: 100289 - DNA, 249 bp, Glycine max
  Peptide Sequence Number=SeqID_217067
atggagggcgagcagagagcgaacgggacaagtgacaatggccggcaacagttggaaaatctgcttggaaacatgtcggaaaacatgccagaaagagacagtcctttggatccctctcattcggatgtgtattcgattcattcatttatccctcctgctggaagcctgctgggagccactccttgtccatgccacatctcttgtgcactagcgatcactccccgcgctcgtcagcgtccgggatgttag

SEQ ID NO: 100290 - DNA, 723 bp, Glycine max
  Peptide Sequence Number=SeqID_217068
atgtcttcaccttcagagggttacaggccctcaccttttgaggactacacgtcctcgccttcaaagggctgcacaccctcacctccaaagggctacatgccgtcacctttagaggactacacgtcctcgccttcgaaggactacaggtcctcgccttcagaggactgcacgtcctcacctacagagggctacatgccctcacctttagaggactacacgccctcaccttcagagggctacatgccctcaccttcagaggactacaagtcctcgccttcgaaggactacaggtcctcgcctttagaggactgcagaggactgcacgtcctgaccttcagagggctacacgccctcaccttcagaggactatacgtcctcgccatcggaggactagacgccgtcgcctttagagggctacgcgtcctcccctttagagggctacatgtcttcaccttcagagggctgcacgccctcgccttcaaaggactacaggtcctcgcctttagagggctacacgtcctcgccttcagagggatatacgccctcgccttcagaggactacacgctctcggcttcagaggactacaggtcctcgccttcagagggctgcatgccctcgccttaagaggactacacgtcttcgccttcagagggctgcacgtcctcgctttcagagggctccacatctgcgccttcagaggacttaaagtcctctacccttaa

SEQ ID NO: 100291 - DNA, 276 bp, Glycine max
  Peptide Sequence Number=SeqID_217069
atgtgtcttttgagaagttgtcgcaagaatacaaagcttatgtcacctccttggacagcaccaatatacctcaaaacttccatgaagcaatccaagtggcaggctgctgttaaagaacaaatcaaggctttggagatgaatgagacttggaagctctcaaaattgacagaaggaaataagccagatgaatgtacatggcctccttggtggctaaggggttcacccaatcttatggggtggactgtgaagaaacgcctacactcatggcaaaactga

SEQ ID NO: 100292 - DNA, 111 bp, Glycine max
  Peptide Sequence Number=SeqID_217070
atgaagggttcttatcagttgatactagaggtttccaccgtgtctctcaactgcaagcgagtgatgcaggtggtgacatcgacatttcagtgttctccttggtctagttaa

SEQ ID NO: 100293 - DNA, 336 bp, Glycine max
  Peptide Sequence Number=SeqID_217071
atgtggtatgggagagatattaacagaccatataacactgttgaatactatactccctccgactggagggagtataggcctaacatttttctgagtctatgcggattgatgtggaagtgtaggggaactgggaggcgaaggctacaagctgatgatgacaagatgaacttcattgaatcggtcttctcctttgtatttggagatggtgatcccaatcaaggaattgaagaagagagatggaagttgattgggcaatacatagcatctaatggtggcgttgttgcagctgaagaacttgctccatatcttgatatagattccacagagggaattaag

SEQ ID NO: 100294 - DNA, 177 bp, Glycine max
  Peptide Sequence Number=SeqID_217072
atgggcacttggggcaatggcagctcgcccaggcgagctggttccttcaggctgaagtcttctgagggcccaggcgagccaaaagacccttttgcccctcctttttggtatctttcattaactggcgtcgaacaatgcagttcggctagcgagaatcaaaacattagtgaacgatag

SEQ ID NO: 100295 - DNA, 351 bp, Glycine max
  Peptide Sequence Number=SeqID_217073
atgttacatatcacatccctttcgagcatacttctcaaagcgacattaaccatgttatttcctattatgcttactttggattcaagcggtcgagcaagccattgtgattctagcagcgattcttcgggcatgatactaatgggtggaccactagatttgccttctgtcaggatacgaccgtcaaagtctacgaggatgtgggagattttagcgactatgaggatctcacgccatctgagatcgctttctactggggtgtttacaatgaagagatattcgagggaaaggtggttttgtctgatgaggaatgaaattcctcaggacatgagagtgaaccttctgaagatatga

SEQ ID NO: 100296 - DNA, 1064 bp, Glycine max
  Peptide Sequence Number=SeqID_217074
atgagcactattttggccgcagctggcgttcaacctgctgccgcagcaggcggacagtgccggcagcgtggcgagcgagcgccggctggattaccgattgcggtgagcagcgtgcaggcgccggtattctacggcaacgcgcagatcgtctatatcgagaacctgcggccgctgtcggcggaggaagcgcgtgacgaactggcgcgcgccgacgatatcagcctgagcgacgacggtgattacccgacgccggtcagcgacgcctccggcaatgaagccctgagcatcggcagcgtgcgcaacgactacggcatcccggagctgctgcagttctggtcggtggccgacaacatccgcttcggcggcgcgctgatggcggtgaaaactgcagagaagctgctggcgctcggcattgagtatgacggcagccgttactacggctggcagcgccagaatgaagtacgcagcgtgcaggaaaagctggaaaaagcgctggccaaagtggccaatcacccggtgaacgtgttctgcgccggacgcaccgacgcgggcgtgcacggcaccggccaggtggtgcattttgagaccacctcctcgcgtgccgacagcgcctggacgctgggcgtgaacgccaacctgccggacgatattgcggtgcgctgggtgaaagcggtgccggaaagctttcacgcgcgcttcagcgctaccgcgcgccgttatcgctacgtgatctacaaccagcggctgcgcccggcaattctcggtaaaggcattacccatttttaccatccgctggatgcggaaaaaatgcaccgagccgcccaggctttactgggtgagaacgattttacctcgttccgtgcagtgcagtgccagtcgcgcacgccgtggcgcaacgtgatgcatctcaacgtcacgcgcctggggccgtacgtgattgtggatatcaaagccaacgccttcgtgcatcacatggtgcgcaatatcgtcggcagtctgctggagattggctgcggcaatcagccggaaacgtggatggccacgctgctaggcggcaaaagatc

SEQ ID NO: 100297 - DNA, 417 bp, Glycine max
  Peptide Sequence Number=SeqID_217075
atgggaaagttggatcatctagaggaaaggctcagggccattaaaggaggtgaagattatgcctttgctaacctagaagagttgttcctagtacccaacatcatcacccctcccgagttcaaggtgctggactttgacaagtacaaggggactacttgccccgagaaccatctaaagatgtattgtcggaagatgggggcatacgcaaaagatgagaaattgctgatacattccttccaagaaagtcttactgggggtagctgttacctgccaagtttcccaccaacccaacaatgtcattactcagccaataacaaaccttctccttacccaccacccagtcatccacaaaggccatccctaaaatcaaccacaaagcctacctaccgcacttccaatgacaaacaccacctttag

SEQ ID NO: 100298 - DNA, 3020 bp, Glycine max
  Peptide Sequence Number=SeqID_217076
gttttgacgacgaactggttcgcaacggcatcgccatcgcggtgttattcgttgccaccctgattgtgggtgccatcgtgaactatgtgatcggctcgctggttgagaaaaccggcttgtcgggaaccgacagggtgttgggggtctgtttcggggcgttgcgtggcgtgctgattgtatccgccattctcttcttccttgatacattcaccggcttttcaaaaagtccggactggcaacagtctcaactcattccccagttcagaaatgacaacatgtgcggtattgttggtatcaccggttttatgccagtaaaccagtcgatctatgacgcgttaacggtgctgcagcaccgcgggcaggatgccgccggcatttgtaccatcgatgcgctgaactgcttccgtctgcgtaaggccaatggcctggtcagcgacgtgtttgaagcgcgccacatgcagcgtttgcagggaaatatgggtatcggccacgtgcgttatccgactgccggcagctccagcgcctctgaagcgcagcccttctacgtgaactcgccgtacggcatcacgctggctcacaacggtaacctgaccaacgcccatgaactgcgcaagcagctgttcgaagtcggtcgccgtcatgtgaataccacctcagattccgaaatcctgctcaacatctttgctcaggagctggatcgttttcagcactatccgctggaagctgacaacatttttgctgccgtggcggcagtgcatcagcaggtgcgcggcgcttacgccgtggtggcgatgattatcggtcacggcatggttgcgttccgcgatcctaacggtatccgtccgctggtactgggcaagcgtgagctggccgatggccgcaccgaatacatggtggcctcagagagcgtggcgctggatacgctcggcttcgaatttattcgtgacgttgcgccaggcgaagcggtgtacatcaccgagcagggtcagctctcgacgcgccagtgcgcagagaacccgaaaagcaatccgtgcctgttcgagtacgtttattttgcgcgtccggactcgttcctcgacaagatctccgtctacagcgcacgcgtgcgcatgggcaccaagctgggcgagaaaattgcccgcgagtgggaagatctcgatattgacgtggtgatcccgattccggaaacctcgaccgataccgcgctggagatcgcccgtattcttgataagccgtaccgccagggttttgtgaaaaaccgctacgtgggccgtacctttatcatgccgggccagcagctgcgccgcagtgcggtacgccgtaagctcaacgccaaccgtgctgagttccgcgataaaaacgtgctgctggtggatgactcgattgtgcgcggcaccacctctgagcagattatcgagatggcgcgtgaagcgggcgcgaagcgcgtctatctggcgtcggcggcaccggaaattcgcttccctaacgtctacggcatcgatatgccgagtgctaccgagctgattgcgcacggccgtgaagtggaagagattcgtcagctgattaaagccgatgcgctgattttccaggatctgcaggatctgatcgacgcggtgcgtgaagagaacccggatattgcccagttcgaatgctcggtgttcaacggcatctacgtcaccaaagacgttgacctgcagtatctggaatatctgcagtcgctgcgtaacgacgatgccaaagcgattgcgcgtcagaacgaagtggaaaacctggaactgcataacgaagcaaggctgaattatgaaacgactcatcattggtatttccggcgccagcggcgcgatctacggcgtgcgtatgctgcaggtgctgcaaccgttagccgaagtggaaacccatctggcactggccgatgtggtgcacgatgtgcgcgatatcgccgccagcatctcgtccggctcgttcaaaacgctgggtatggcaattctgccatgttccatgaagaccctgtcgggcattgtgcacagctacagcgacagtctgctgacgcgcgccgccgacgtggtgctgaaagagcagcgccggctggtgctgtgcgtgcgggaaaccccgctgcatctcggtcatctgcgcatgatgaccaccgccgccgagcttggggcgctgattatgccgcccgacggtcaaccgcgtgctggatcagtttgatatcgagctgccggaagatctgtttacccgctggcaggcgagttctggctctttctctgatgctggctatgtccggcgctgcgagcgtgttcgcagcggtaccgcagtcgctgcgcatcgggaccgatccaacttacccgccgtttgagtccaagaacgcgcagggccagctggttggctttgatatcgacctggccaacgagatctgtaagcgtatcaagaccaaatgtacttatgtggaaagtgatttcgatgcgctgatcccgtcgctgaaagcgaagaagatcgacgccatcatctcttcactctcaatcaccgagaaacgtcaggaagagatcgccttctcggaaaaactgtatgcagcgaacgcgcgtttagtggcgccgaaggggtctaaactgcagccgaccattgagtcgctgaagggcaagaacattggtctgctgcagggcaccacgcaggaaacctacgccaatgaatactggcgtccaaaaggggtgaccgtcacgccgtatgccaaccaggatctggtgtatcaggacctgaatgctggccgtattgacgcggcgttccaggatgaagtgcaggcgagcgaaggcttccttaagcagccggtcggaaaaaactacgccttcgccggtccggcggtgaaagatgacaaaatctttggcgtcggcaccggtatgggcctgcgtaaagatgacgctgatttgaaagctgccatcgacaaagcctttaacgacatgcgcaaagacggtacctacgacaagattgcgaagaagtactttgatttcaacgtttacggcgattaa

SEQ ID NO: 100299 - DNA, 273 bp, Glycine max
  misc_feature (167)..(167): n is a, c, g, or t
  Peptide Sequence Number=SeqID_217077
atgttggtgcgcacgatccgcacttgtctctttgcagcggcacgggtgaaatcttgccccggtatgcatagtagctgcgtgatagcctccctctctggttgtattcgcatagttggtgccctccaatatcaggggatgtggagccctctgaaagcgaggacgcgtangcctctaaaggcgagggcgtgtagccctccgaaggcgatgatgtgtagtcctctcaaggggaggacgtatagtcctctgaagattagggtgtgtagccctctgaag

SEQ ID NO: 100300 - DNA, 477 bp, Glycine max
  Peptide Sequence Number=SeqID_217078
atgccgatctccccttgcggaagtatcaattggtctgtgttgtcccgacataggggtcgtgcccacaagacacccagtggacccggagaagtccaacagggccctggggtttccagctctggttacgggcctctatcagtcctacagggtgctcgtaccccccggcaagggatcgcgcccgcaggacacccagtggacctaaagaagtccaacagggtcctagggtttccagctctgattatgggcctctgtcagttctacggagtgcccgttacccccagcaaggtcatcaggcctcctactaaccgagctttcatcaagaagtattgtgcccccaggcaggcaaagggcgagacaccacaacagcctggggatggccagcaacaggcaacaaatgcaccgccaccacctccagagcccctcagctcatccactaaagggttggagtattgcctacgacacatggcggaccaatag

SEQ ID NO: 100301 - DNA, 864 bp, Glycine max
  Peptide Sequence Number=SeqID_217079
atggcgtcaattaaacaaggtgataagtctataactgattattttacaagattttgtgtgatttgggacgagtttgagagttatggacttgatcctatatgtgtctgtgatccaaaatgttcatgtgatgcacttagtagtgttttagaaaggaagaaacaagaccatgtgatgcaattccttagaggattgaatgatcagtttagtattgtcaaatctaatgtcttgatgatggatccactacctgtcatatctaaggttttcttatatgcaatgcaacaacaaaggcaaattagcaacaatgatgtgttaggaagcactagcatgattaatgcagcaaacactaactcatcaagttcacctttttcatgtacatattgtggtaatttaggtggactaggtaataagatttgtactcactgtggttttactaactacattgttgatgaatgttatagaaaacatgaatacccttctgatgtcaaattaactgctcaacaatacaatgccttgatgacattgctacaacaacaaggatcttcaactcacaacaattcacaagtgaatcagattggcacaatggctagttttggtcatgcacctataggtaatatgccatcaataacttgtagtgtaagcaaggttatgtcactcttgatctcaaaacaagggccattagtgtatccaggaattcctttcattgctcaagattcttctggtctcattactgttttgcctataccaacttcttcttttcatgatgacattgaattccctgtctatgcttcttctgtatcaccatctgttccacctgattcttctcttatagcctctacgcccacagaagcaccacaaagctcttag

SEQ ID NO: 100302 - DNA, 1524 bp, Glycine max
  Peptide Sequence Number=SeqID_217080
atggaaatctccggcactgttccgagctcggggtcctctttccgactcagcagcgatgatggcgaccctttgttaggttctcgtatcggagctggaacagatgatggtgatgctttaacaacggaaacagatccagaggtttcgtcctctagtagaattgctgccagaaagaacaaatatcgtacgagcagcatcaaattgtttggggtagaattatcccctgataatgttgctgttgcgatggtgtattttgttcaaggtgttttagggcttgcaagactggctgtgaacttttacttaaaagatgatttgcatttggaccctgctgaggcagctgtgctttctggtttttctgcattgccgtggcttgtcaaacctctttacgggtttattagtgattctgtcccgctctttggttatcgaagaagatcgtacctagttttgtcagggctgcttggtgcgctctcatggagtttgatggctacttttgttgacaacaagtatagtgctggtttttgcatacttcttggatctctctctgttgccttttcggatgttgttgtagattcaatggttgtggagagggcacgtggtgagtcacaaagcacctcaggatctcttcagtctttatgttggggttcttcggcctttggtggaattgtgagctcctacttcagtggatctttgttggatgcatatggagtaaggtttgtttttggtgtcacatcattgcttccgttgataacatctgtagttgccgttcttgtaaaagaacaacctatgattggtacagcaagagggctaaatcttcttttttccgggccagagtttttggaaagttcaaaacagcgcattattcagctgtggggttctgtacgacagcgtagtgtttttcttcctactttgtttattttcttgtggcaagcaaccccgcagtctgactctgctatgttctactttaccacaaattctcttggttttactcctgagtttttgggacgtgtcaagcttgttacctcaattgcgtctctgcttggtgttggtctttataatggatttctgaagaatgtgcctttacgaaaagtattttttgcaactacacttttaggttcaacgcttgggatgactcaggttttcctcgttactggactaaaccggaagtttggcattagtgatgagtggtttgcaattggtgattcattaattctcactgttttgagtcaggcttctttcatgcctgttcttgtgctagcagcaagattatgtcctgaaggaatggaggcaactctttttgcaactctcatgtctgtatctaatggagggagtgttgttgggggattgttaggggcgggcttgactcaactatttggaattaccaaggacagatttgataacttagcagctttgataatcctttgcaatcttagctcattattgcctctgcctcttcttggccttctccctggggacaatcctgatatgaatgaggaggacaattccgatattgagatgaaatgtaattga

SEQ ID NO: 100303 - DNA, 636 bp, Glycine max
  Peptide Sequence Number=SeqID_217081
atgagaaccgtttttctgcaatcgaaaacaaaatccagcacatcatcatcggatgaagataacaacagctgctacttccccggttgcaagaaagatgcaaactgcaactgcgaaatgtgtttggccagcatcaatgccaccctcgatctcatgcccaacagcgtccacaaaggcaccctcaccaagctttctgcttccaaacccaacgttgcgtgcaccccaatttcttttgatgcttctattctgtccacacccagatccagcgagtttcagctatcttcgtccactcctctctccaaatcaagagccagatcggacttgagcaagaaaatggagaagcataagaagggacaacaagcctctggtttcagtttcttgaggttgatgctcttttttggattcttcttgtctgcggaccttgtttttccattggtggtttctggggtttttcagccttccttgtcaccggatgtggtgaaaagggttggtgagaaatgtagccttgtgcgtgatttgaatggaaagttgaggcttttgcagaaagagttggctagtgttgttgttggagaagtttcaaattgcagctttactgataccttatgggaaatcagccaggtaggtcaaaattggttttag

SEQ ID NO: 100304 - DNA, 441 bp, Glycine max
  Peptide Sequence Number=SeqID_217082
gatggattgctattgaattcaaggtgcacactgtacaaatcagcaatagaagaggtaacgatctggggatggcctttgcaaacagcaggattgctcacaaatgggttctcttctcggacattcactctcttatcaggaagagtcactcagtggaatggtggacaaattggctattcaattcggacggctaatgcttcatgggtgcaaccaaagtgggatgcttcagcagtgcaattagaccccaacacttgggttcttgaatatcagatgagttatatttttgatggtacgaggttgcattctgcagcattggagttcctcaaatataggatttcaagaattgttgccaggctgaagaaagatttctggctttttatcgcatttgaagataaacagtacaatggattcacagcaaaaaatggacctcaaatcccaacttga

SEQ ID NO: 100305 - DNA, 471 bp, Glycine max
  Peptide Sequence Number=SeqID_217083
atggataaagaagaaacttgcagagaaagctggtgtaacgcttggccacgtattctcacttcccacctcttgaactggaatacaaaaccaatactaaacacaattcggcaacaggatacgaagatgagtcaggaacagccaaggtgtcccaaagaccaagaccccatcaagtatggcgatgttttccacgtttccggcaaccttgcaaaaaagcccgtcgcgcctgaagatgctgccatgatgcaaagagtgctcgcccaggtcactcactgccaccgacgattccgactcataatattttttcattcatctcttccccatcatcataatatatgggtaacaaggcggtggatcagagtgacgcaggcggcggagatgagagcgatggggagggtgggttggctgctatggctcaagagtgagcaggacaaggtcaagcttgccgacgttctgaccgctgcaagatgctga

SEQ ID NO: 100306 - DNA, 471 bp, Glycine max
  Peptide Sequence Number=SeqID_217084
atggtggtagtagtagaattggtggtggcagtcagcggtggcgatggtggtggtgacaatgataaaggtggtattagtggtggtagtgacaacaatgacaatgatggtaacaatgtcgatggtggtggtagtaacggtaatggggtggtggtggtggtggtgatagcaatgtcaataatgatgatgatgtcgatgacggtgatggtggcagtgacaatggtggtggtggttatggtggcaatgatcaaggtggtggtgataataatgatgatgctagtggcaattgcattgatggtggtggtggtagcaatatcgatggtagtggtggtggtggtaacaatattgatgatggtgatggtggtgttggcaatcggttatgacaatgacaaatgtggtattggtagtggtagtagtggtgatggtgatggtagtgacaatgatgttggtgatgaggtcaaaacaaaaagataa

SEQ ID NO: 100307 - DNA, 915 bp, Glycine max
  Peptide Sequence Number=SeqID_217085
atgagttggtttaaaaatattttcaaaaaagaagaaaaggaaactttagataaaggattggaaaaatccagccagggtttctttgaaaaaataacaaaagccgtagtcggtaaaagcaccgtagatgatgaagtattagatgacctcgaagaaatactaattgcttcggatgttggtgcatccacaacgatcaagatcattcagagaattgaagaacgtgttgccagagacaaatatgtgaatgtaggtgaactcgataaaattcttcgtgaagaaatatcaaacttacttctcgaaaatccgcatgcaggaaccggaaatattgatacatcaaaaaagccgtatgttattatggttgtcggtgtaaacggagtcggaaaaacaacaactatcggaaaactggctcatcagtttaagtcggaaggcaaaaaggtagttttgggagccggagacacttttagagctgcagctgtggatcagctgaccatttggagtgaaagagtcggcgtacctattgtaaagcaggaaatgggttccgatcctgcctccgtagcttttgataccgttcaaagtgcagttgcccagggtgccgatgttgtgatcattgatacggcaggaaggctccataataaagtgaacttaatgaacgaactttcaaagatcaaaagagtaatgcaaaaggtaattcctgatgctcctcatgagattcttttagttcttgacggttctaccggtcaaaacgcatttgagcaggcaaaacagtttacagcagccacagaagtaaacgctttagccgttacaaaattagatggaacagccaaaggaggagtggttataggcatttctgatcagtttcagattccagtgaaatacataggggttggggagaaaatgcaggatttgcaattgttttaa

SEQ ID NO: 100308 - DNA, 1239 bp, Glycine max
  Peptide Sequence Number=SeqID_217086
gatatgcagaacttgcagaggattggtacagttgatatggtggaaggtctttatagactcaagatgcttccttccaagcctcctaaggagtataattctagttctattacagcttttgtttctgctagtgtttcagctctttcatgttgcttccctttcactgcacaagataaacctgatcccattactgtcttgcatgtgccaacctcttcttttgatggtaccattgatcagtttgatgactttccttcagaaccaccaattgatcataccattgttgaacccaatgacactgatcttaatccttctatctcacaaaaagccactcaggcacctagacaatccatgagacagatacacaggccaagcaaatataaagactctcacatcacatatccatcatcaactattgccaatctctctacaattgaacctcaatcatacaatggagcctctaaagatcccagctacactcaaatagaaggccaagactatctagacactttttctctagtggccaagttaaccatagtaagacttttattggctttagctgctatcaatcaatggcatctaaagaaattagatgtaaacaatgccttattacatggtcatttgaatgaagaagtgcatatggcttttcctcaaggctttgaagtggctagaacaaccactagcatcaatctctgccaaagaaagtatgctctgaacattctcagtgacactggcatgctttgttctaagccagtgtttactccttctaactataccacaaggtctattactggttttgccatatattttggtaattcattgatttcatggaaatctaagaaacgagccactgtatccaaaagctcctcagaggttgagtatagagcattggctaatgctacttgtgagctgcaatggcttattttcttgctaaaaaagttcaaaatcgattttcagcaccatgttgctttgtattgtgataatagatctgctctccacatagctatcactcttgtttttcatgagagaacaaaacacattgagattgattgtcgcatagttcgagagaagatgttgaatggccttgtgaaattactccttgtttcctctacaaatcaacttgcagacatctacattaaggctctaatgcatggtgcctttccatttctgcattccaagctaggaatgtcaacatttattcctagcttgaggggggctcttagcatagatatagtcttgatcatg

SEQ ID NO: 100309 - DNA, 465 bp, Glycine max
  Peptide Sequence Number=SeqID_217087
atgtgttggaaaagtttctacttggaggtggatgatatggacctaccagtttttgacttgtcaacaatagttacggccactagcaactttagtgtcaagaacaaaattggagaaggtgattttggacttgtatatagggaaattgctgtgaagaggctctcatcaagctcaacacaaggattgaccaaatttaagaacgaagctaaacaattgtgcttgggtataacaagtacacttattctagagtataggcctgtgcgtgtggttgccaaggctggaaataagagagagattggggatgtgcctacggcatcgatgaaggaggcgatgccaggagggcacaacttaggacaacgaagagggaggcttaggaggatggggacttctataacaacaacgacaacaaaggtgaaaacactggtgatgagaggcagcgacaccaatgacgagaggctagggctctag

SEQ ID NO: 100310 - DNA, 759 bp, Glycine max
  Peptide Sequence Number=SeqID_217088
atgagggttcatatcaacagtttccgaaaacccaagtggcggtggttgtttcttcgcctctgcaagctgaacctgatgctgaccactctcccgctgctaagacaaccaatcctcttatactctggcaggacttttgtggggacaaatttaagtcctatgtgggaaaggttcctgtttccattagaagatgattctgttctttgtcagcacacctccagcccactaggaaatggtgcagtgcctcaagaaattggtataacatctcatcaatatgacaaggagttaacagaatctattaacgttaaggtttcacaggagattttttacagcattgttcatgaagtagttgaagaaattggagtgccagcttcatcccttagttgggatgaggtggagaaatacctcattgtgcacaatggcaattgggatgaggtggagaaatacctctctggtttcacaaaggtggatgataataggtattctatgaagatattttttgagataaggaagcagaagtatctggaggctttagataagcatgactggtccaaggctgtagaaatattagtgaaggatttgaaagtgtttgttacatttaacgaagaattgttcaacgaaatcacacagcttctgacattggaaaattttaggaagctgccaactgttttgcagatgcgtgcagctgtatgtgaagttgtcaattgttttcccactgccgttgttagtggaaggagcaaggataagatagtaaggttttga

SEQ ID NO: 100311 - DNA, 150 bp, Glycine max
  Peptide Sequence Number=SeqID_217089
atgtctgtttggcggttgtcggtttgggagaatcctgagtggatgactcagagccaatttgaaacctttgcctgtactccgacctcctctctaggaggttcctgttgccttaggaggcatcgccatttttctgtaagaattcacgggtaa

SEQ ID NO: 100312 - DNA, 264 bp, Glycine max
  Peptide Sequence Number=SeqID_217090
atgattgatcttgattcacttaagtgtggtcgtgtgattcttctaacatcttttgagatgtttattttggagtcctcctcttttgattctttgaaacaccaactcttattccttcttgtcttgagaaatgcaaacaatgttccctggattacatggttgccctacgtaaaggagaggataagcatgatgttactagcaaaggagttgagactggcggtgtggcttgcaatgttgtcgatgaatgatgaagaagttgttgagtag

SEQ ID NO: 100313 - DNA, 678 bp, Glycine max
  Peptide Sequence Number=SeqID_217091
atggaacctgaattttgggacaaaaacccattcaaggcgacagccaaggcttttccgtcaggattttatttcaaaccaaccgcaatcaataagacaagaaccttttatgaacttatactggtagactcaaattcagtgtctatcaaacacttcaaggactcaaaggaccaatcgttgaatactcactcaacgatccaaatctttaaagttcttcaaccaaggcattttggcccagacctaaacaaaggcaaaaaaaattcagtaccatttgatcctgtaggatatacctactgggattatgttgatgcttggaccaaggtattttggcaccagaataatcgctacaagcacttatggctgatatacttcatgactaacgtagtctacaacttcccaaactggttttttcaatggagggatttctttggcccaataccagagatcttcccagagcagaggcatacctttgtgaaatggtggacacagtttgattcatccaaggctgacccaaaacaagtcaagctttggttccaatctcatccgaaacttctcaaggcagccgatccagaaacttctgtatttctcaaccagaagtctcaacttgctacgttcctaactggctcaaggtctaaagaaagcttggccaagaaccttaaagaagttctccaaatgttatag

SEQ ID NO: 100314 - DNA, 413 bp, Glycine max
  Peptide Sequence Number=SeqID_217092
aagcgttaggtgtggcaaagccttcagtagctagttaccttagccaggagatactagcagagcaagaagttgatagagcgcatggattacctgcacagcctccggtgaagttcaacaatatggtggttatatcactgtcaatgaaactcaaggaagagcattgttctattggtttttcaaggccactcacaaaccagaacaaaaacccgttctcttttggctcaatggaagtacctttttttactaacccagctcttcatgtttatgattatttggttgacactgctgcctttgttcaaacaagagaaagcatcaatgagttcttgacaagtgttaaacaacatgacctggcaaaagctaaggttctgagcatattaaacattgggccagctgctgattttgaactataccca

SEQ ID NO: 100315 - DNA, 372 bp, Glycine max
  Peptide Sequence Number=SeqID_217093
atggatgtgaatctagataggatactgatacctgtaattttgtgcatagttggaatctcggttcacaattcaaagtcatcaacctctttgctagtgttttttgcgataaacacaataattttctctattcttgtgggaagtcgcaaatcatctttagcagaaattggcatggcttcgcctttacttccatctttttttgaagtagggggtaatattgaagatgaaagtgtagacaaagttgatgaaattacaacgcaagagcaagaagaatccgatgataatctgaagtcaagaattgaaagcttcatcacgaaggtctacaaaggatggattgaggagagctattgggataaatatggcatagacatgtga

SEQ ID NO: 100316 - DNA, 1139 bp, Glycine max
  Peptide Sequence Number=SeqID_217094
tggtactacttcacaagtgtttgaacatggaggccagtggcggtgttagcagcggcgttacggtggtgggatcggatgctccgtcggactaccatgtagctccgaggaccgacaacccggctcccgcaagcggatccacgacgcagattcctgcgacggcggggagtgctctgtcgccgtcacatccgcctcacacggcggcgatggaggcgtatccggcgacgatgccagcgaagaagaagaggggccggccgagaaagtacgcaccggacgggtcggtgaccatggcgctgtctccgaagccgatatcttcctccgctccgttgccgccggtgatcgatttctcgtcggagaagcgcggaaaaataaaaccagctagctccgtgagcaaagccaaattcgagttggagaatttagtacttgtgtttgtgtttgttgttagtgttggaaaatggaaaattgggatgagaaaatggcttatagggaagtggaatgagaagagagggattcgttcattcaaacttgatccaaaccatatctttctaggtgaatgggttgcatgctcagttggtgctaattttactccccatatcatcactgttaattctggagaggatgttactatgaaggtaatatcattttctcagcaaggacctcgagctatatgcattctttcagctaatggtgtcatatcaagtgtcacacttcgtcagcccgattcttctgggggcacattgacatatgagggacggtttgagattctgtcattgtctggctcattcatgcccaatgaaagtggaggaacacgaagcagatccggtggcatgagtgtatctttggctagccctgatggacgtgttgtaggtggcggagtagctggtctgttggtggctgcaagtcctgtgcaggtagtggtaggaagttttctggcaggaaaccaacatgagcagaagccaagaaaacagaaacacgaggttatatcaagtgtgacaccagctgcagttgttccaatctctacacttgatccagtatcaattctatcagcagcgtcttccatccgcaacgataattggtctgctatgccggcagaggccaaggataagccagctgacattaacgtgtcgcttcctgcagggtaa

SEQ ID NO: 100317 - DNA, 774 bp, Glycine max
  Peptide Sequence Number=SeqID_217095
atggcagccttggttgcagggtttgaaaagctgaggcctgcgccttgtaacataccaaaattgacggaaaggaaaagcaagggtttgtgcttcaggtatgctaaccacaatacatcaatggcacgtattcgaatgatgccaatagggactcctaaagtcccctataggacacctggtgaaggaacttggcaatgggttgatgtatggaacgccctttatcgagaacgtgttatcttcattggacaagagatagatgaagaatttagtaaccaaatattggctactatgctttatcttgacagtatagaaaactccaagaagctttatatgtacatcaatggccctggtggtgatcttacaccaagcatggctatctatgacaccatgcagagcttgcaaagtcctgtagccacccactgtgttggctatgcttatagtcttgcagcatttctccttgcagctggagaaaagggtaatcgttctgcaatgcctctatcaagagttgcccttacatcaccagctggagccgcccgtggacaggctgatgacattcagaatgaagcaaatgaacttcttagaatcagagattaccttttcaatgagttggcacagaaaacgggtcaacctgttgagaagattactaaagacttgagtaggatgaaacgcttcaacgcacaggaagcccttgaatatggactcattgatcgaattgtcaggccaccccgcattaaggctgatgcaccacgcaaggaagcaggcacaggtcttggttaa

SEQ ID NO: 100318 - DNA, 1002 bp, Glycine max
  Peptide Sequence Number=SeqID_217096
atgggaaggccaccatgttgtgataaagaaggtgtaaagaaaggaccttggactcctgaagaagacatcattttggtgtcttatattcaggaacatggtcctagcaattggaaagctgttcctgccaatactgggttgtcaaggtgcagtaagagttgtagacttagatggactaattacctgagaccaggaatcaaaaggggtaacttcacagaccaagaggagaagatgataatccatcttcaagcacttttagggaacagatgggctgcaatagctgcttacctaccacaaagaacagataatgacataaaaaactattggaacacctatttgaaaaagaagctgaacaaattggaagcaggttctgatcagggacataatattggggtttcagtttctcagccaatgtcaagaggccagtgggaaagaaggcttcaaacagatatccgcatggctaaaagagcacttattgaagcactctcatcaaacaaggcatcatcatcatctaccttgttattagctgaatcaaattcaaacctctccagtgaaaatagcatcttctataatagtaacactaataaacccacaacacaatctatgtgctatgcttcaagtgctgacaacatagctcgtttgttgaaagggtggatgaaaaatacaccaaaattagcctcatgtgctgcctcagctgtgactcaaaattcctttaacaacttggctggtgctgacactgcttttagtgaaggaattacaacaacaaagggaagcacaagcactagtactgttgagttgtctgagacttttgactccttgtttggttatgagtctttggattattcttcaaattctgagttctcaccatctctttctcccgaggctactcctttccaagatgagagcaagccagatataactgcagatggaatagacatgcctttctctttgcttgagaaatggcttctagatgatgctgcttgtcaagagaaacttggcttctag

SEQ ID NO: 100319 - DNA, 516 bp, Glycine max
  Peptide Sequence Number=SeqID_217097
atggctctcaaactacagctaccgagaaaaccatcaccactaccaacagtaacatcaaaaccacaaacatatggttcatttggctatggttttggtgctctttctctttctcccctaccgcgcgtgaatttggccggggttcggtgctatgatgttttggtggtgtggtgtgttggagatatgggtttcggtgatggcgtttggggtttcggaagagatggtgttgggcaagtcgatctccgtgatgagccgacgacggtgagggcgaagacgatgacgtcaaccatggcatcaaagggaccaaagtgcgttggtgtcactgcgaagttgttcttcagtggtgtttttgtttgggagagtgcagtcgcgactatgacaatgcatgtgagtttgactagaggtgaaagaaggggatttagggtttggagcactaatgctttcaagataagcatatttggccatggacagattgtcggagaaccaaaacagatatgtagtttttcttataatttttaa

SEQ ID NO: 100320 - DNA, 144 bp, Glycine max
  Peptide Sequence Number=SeqID_217098
atggagaaaggtacaagtcttcctatggagaaaggtttcaagatcctgttgtttcctatcattgatagtctaggaaatcccttaagaatttttacatgtggtatcagagcatgtgttatgaaatttatgattctccaagaatga

SEQ ID NO: 100321 - DNA, 147 bp, Glycine max
  Peptide Sequence Number=SeqID_217099
atgcgtctaccggggaaggagaggaaacaccatttagaggaaacaccgggttcaacaaaaatagaagaaaatcactcagagtgtatcaatctcgcacagtgcggggcgaaaaagtcgccgacgcaaaggattttggttggtaattaa

SEQ ID NO: 100322 - DNA, 268 bp, Glycine max
  Peptide Sequence Number=SeqID_217100
gggttcttccggaagttccggaagaaggttttccggaaagtttccgcaagttgcggtagtgcgagtcttcccgaattcttccggaagaaccacttcttccggaagacttccggaaaacgtcttccgggaactttccggaagaagtggttcatccggaagaattccggaagactcgcacttccggaagaagtttcaaacttccggaagacctttccggaagaacccttcttccggagtgtttccggaagaaccacttcttccggaagtg

SEQ ID NO: 100323 - DNA, 294 bp, Glycine max
  Peptide Sequence Number=SeqID_217101
atggaatattccaatgttggtcaatttcatccatgcatccaagattctattgaaaacattattgatgccaaagtggatagtaactgtggttatcgtgcaatagttgccttattgggtatgggtgaagaatcatggtcattggtgcgtaaccatctgcatgtagaacttacaagctggtcagaaaagtatatcaacctgcttgggcgtatcgagaaatttgaggatgtcgcaacctacccttcggcgggagggcgacgcgagactcgcgggatgcgtgttccacgaaaggaatac

SEQ ID NO: 100324 - DNA, 536 bp, Glycine max
  Peptide Sequence Number=SeqID_217102
atggattcaggtttctgcttggtgtcatcgccgaaccaccaagaagtagtccaaagccgtttcttcgacccctcatggctacaaatgcagccccacgtgcccatgagctttgtttggcccaaagagtgcttagtgaacgcgaatgaggagttccacgcgccaatggtggaccttggagggttcctaaggggtgatgatgatgacgccacaaaccgtgccgttaggctcgtacgcaaggcgtgctcgagccacgggttcttccaagtgatcaaccacggcgttgatcctctcctcattggggaagcgtatgatcaaatggacgctttctttaagcttcccattcgtaggaaagtgagtgttaaaaagactctgggttccgtgtggggatattctggtgcccatgctgataggttctcctccaaattgccctggaaagagaccctctctttcccctttcatgacaacaatgagttagagccgccggttgtcactagtttctttaacgacaccttagggggagactttgaacaagctgg

SEQ ID NO: 100325 - DNA, 344 bp, Glycine max
  Peptide Sequence Number=SeqID_217103
tccacgattgacgatgggtgcagaagacgaggatgactcaaatgtctgtatgacagatcttgtgagcgcggaagatgacacagcaaaaaagaatgtttatacggataaccactcgggtatttccgcccgtcagcgtgactcaaatgtcagtatgacagatcttgtgagcgcggaagatgatatagcaaaaaagaatgtttatacggataaccactcgggtatttccgcccgtcaacgtgactcaaatgtcagtatgacagatcttgtgagcgtggaagatgacgtaaatctccgcgtgtcaacgggcttgtcggccgcgattgacgaagggcgtagaagacgac

SEQ ID NO: 100326 - DNA, 658 bp, Glycine max
  Peptide Sequence Number=SeqID_217104
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgaaagcaggggccatgctccttggtctggccccaagtgggactccattgagggattgccagaggtcacccagagagacccagtggctctctgaagggcacacagcaatgcctttagggagactcatggatgagaactatatgcaattgttcttgaacaatattagcaccagcagtgccccgcccagctccattggcacagagagcagctgcagcaggagctggctgaggagggaggctggcaccccagcagctccctggagtgtggggcatcaagcttatcgataccgtcgacctcgagggggggcccggtaccagcttttgttccctttagtgagggttaatttcgagcttggcgtaatcatggtcatagctgtttcct

SEQ ID NO: 100327 - DNA, 651 bp, Glycine max
  Peptide Sequence Number=SeqID_217105
atggaaaagttggaccatttagaggaaaggctcagggccattgaagaaggtgaagattatgcctttgctaacctagaagagttgttcatagtacccaatatcatcacccctcccaagttcaaggtgttggactttgacaagtacaaggggactacttgccccaagaaccatctaaagatgtattgtcggaggatgggggcatacgcaaaagataaggaattactgatctttgattcgataggaaatcgtgcagttatgcgttgttcatgcgtcctccaccatcgagtctggagccccacgaattcattgcctagcattgttcatgtgtcctcccacatcgagtctggaaccccacgaattgattgcttagcactgttcgccaattctccattctccaattttattcggagacccatgaattcattgcctagcgctgttcatatgtcctccaccatcgagtctagagcctcgcgaattgattgcctagcgctgttcaccaattctccattctccaatcttattcggagacccatgaattcattgcctagtgctgttcatgtgtcctccaccatcgagtctggagccccgcgaattcattgcctagcgctgttcgccaattctccattctcaatcttattcggagacccatga

SEQ ID NO: 100328 - DNA, 309 bp, Glycine max
  Peptide Sequence Number=SeqID_217106
atgaaggaaggaatttgctcaatccaacactttttcaacacttggaaagcaatacccttccaagccaggaccaatgtgaggcggtcagttttggtaaggataggagaaaaggagagacaaccatgcaaatcgccactgccattggcgatacaaccctgggtgcaacacgtggcttttcgccactgccactggcgaaatagccagtggtttcgccactggagttggcgacatagccatgcagtggttttcgccactttgactagcgaattacgtgcaggcgtacgtaggtgcagaaggcagcaggattag

SEQ ID NO: 100329 - DNA, 753 bp, Glycine max
  Peptide Sequence Number=SeqID_217107
atggtgtcaatgcaaattgcaacaaattggggtaccaaaatgcaaagagaagtgttactatcagcattggttagggttttcgcttctcggaaaattcgaaatggaagaagattttgggtacagaaggaaggccaagatagcactcgtcgcaatcatggtactcgcctccgtcgccgtgtttgcgctgctcgttgccttcgcctactactgccacatcctcaacaaggtctcgaatcgtcgcaaaagcctcaaaaaaggttcgggtctctttctgaaaatgtagtgaaattcaaggttcggtttattttgcttgattttataatagttgaagatgccaaccttaacgagaaaagtgactttgcaaatctgcaagttgttgctgagaaaggacttcaggtgttcactttcaagcagctgcattctgcaacagggggcttcagcaagtcaaatgtcattggtcatggtggatttggacttgtttaccggggagtgctcaacgatggcaggaaagttgcaatcaaattcatggatcaggcaggaaagcaaggagaagaagaatttaaagtagaggtggaactgctaagtcggttgcattctccatatctgctggcattgcttgggtactgctctgatagtaatcataaattgttggtgtatgaatttatggcaaatggtggactgcaggaacatctctatcctgtcagcatccagcctgcatgtgctcagtttgactggttgcattggcacttttag

SEQ ID NO: 100330 - DNA, 4422 bp, Glycine max
  Peptide Sequence Number=SeqID_217108
atgtcctcttcacccaagatggacagaatcgaagaggcaattgccaagcttgcttcaagccatttaatcctcaccgagaagcttgacgaattgattaatagagttacgaaccttgagaacataaccaacccttccccttcaccgtcatcttcctcagctatgcccataccacagatccaattggccaatccacatagactgaaacttgatgtccctcgatttgacggctctgatccctcagggtgggtattcaaaattacccagttcttcgaataccacgcaacccctgaggctgagaggctcaccgtcgcgtccttttacatggacggaccggcccttgcgtggtttcaatggatggctcgaaaccaccagctcaccacgtggtcggggttcctgcaagcaatcgaagcacgatttgctcaatctccatatgaggatccaacaggactcctcttcaaactaacccaaaaaggcacagtgagggaatacctggctcagttcgaagccctcgcgaatcgtatcacggggttatcgccggcctcgctcctgagttgcttcatttcaggacttgaaccagacgtccgccgtgaagtccaggctcttcagccttcaacattggttcacgccgccggcttagctcgacttcaggaggagaagattcttgagcaccgtcgagctttccgccaaagacctcaccccagccctccacaacactcacccacccctctttcaatagtcacccccacgcccagccctccgttacttccctctccgcccaaaccaccacccctacccatcagacggctgacaccggaagagatagcaagccgccgggagcgcgggctctgcttccattgtgacgagaaattcacgagaggccaccgctgcccctcacgattcttgcttctcttggcagatgaagacccaccagataaccctaatatagacaaccctgacccactaatggacccgaaccgacccgaaaccccaattattaacccaatgacccaggacccaactgaacccacccaagcccaaatcagcctccatgctttatccggctatggaaccccggaaacattacgtgtcaccggccggattaatctccaccatgtcacgatcttggtcgacggaggcagcacacataactttgtgcaagaacgcctcgtcaagaccttaggcttgaacccccaacccacacctacccttcgcgtgcttgtcggcaatggcaacaccgttgaatgttcgcaagtctgctcagaggtcaccgttcacattcagggagtcagtttctctgtgaatttacatgttcttcccctatatggtgctgatgtagtatttggagttccttggctcaaagccctgggccccgtgttaacagattataataatcttgtgatgaagttcatgcatgatgacaggataatcgaattaaagggctcatcggaaactccattaacggccataagcccacctcagctccgacgattagtgcaaacacaaggtgctagtgaattttttcacattcgtgtctgcccctcacctgaacataccccaaacaactccccaaacactcaatccgccatccttgatgtcatcaatcaatttccaagcctctttcaaccacccacaaagcttcccccgtcacgagccaccaaccaccacatacacctcctacctaactccaccccagtcaacgtccgcccttatcgatatcctcacttccagaaggaggaaatcgagtctcaagtcaataccatgctccaaaacggcattattcgtcccagtaatagcccttattcttccccagttcttcttgttaaaaagagagacgacacgtggcgtttctgtgtcgattacagggcactaaacgcactcaccgtcaaagatcgattttcgataccaacaattgatgaattgttggacgaattgggtggtgcctactggtactcaaagctggatcttctccaaggttaccatcaaattctaatggctccggaggatgttaataaaacagtgtttcgtacccatcacggccattacgaatttctggtaatgccgtttgggctttgcagcgctccatcatcctttcaagcgacgatgaacgccatttttggaccttgtctgcgaaaattcctcattgtcttctttgacgacatactggtctacagtaagaccttccatgatcatctagaacatctacgcaacacctttcagatcatatccgacaacggcttcgtccttaagaagtcaaagtgttcctttgcaattcaacaagttgaatacttaggacacgtggtttccgcacgcggggttgaaccagttcccgagaaggtccttgcggtgcaacaatggcctccaccgcggtcagtaaggcacttacgtggattccttggattatcgggattctataggcgcttcatcaagggctatacaacgctggcggcacccctcaccgctctattggctaaggaccaatttgggtggacaccggaagctgaggatgcatttaatagactcaaggaagctctatgtaaagcccctgttctagctctaccggattttgccgcgccgttcataattgaaactgatgcttcaggtgccggaatgggagcaattctttcacagcaccaccatcctttggctttttttagcaaacccttttgttcaaaactcctcagagcctccgcgtatgtccgaaagctcgctgcgatcactgctgcggtcaaaaaatggagacaatatttgttgggtcaccattttagcatcatcacagatcataggagcctaaaagaactcatggcacaagcggttcaaacaccagaacagcaagtgtatctggcacgattgatgggatacgactataccatccattatcgtgccggcaaacacaattcagcagcagatgctctctcacgtctccctgagccccctccaaacccattagacacaacccaaagccagatttttatgctaacaattcctaattgcgttttcttgcaggaactcaaaagggagctgttcaccaatgaggaatttcaggccaaaaagaagcaaatccaagaagagaaggaaaccccttctgaattcatcattaaggatgaattcattctccatcaaggacgcatttggttaccacggaaccttcctttactacctacaatcattgcagagtttcatgcaactcccacaggcgtccatatgggaatcatgaagacaatggcgcgtgttcgtgaaaatttcacctgggcctcgatgaaggaagacattcagaggcacataaccaactgcatcacttgtcaacagattaaaacagatcatcgtcacccaccggggcttctctgcccacttccggttccggcaaggccatgggaggacctctcccttgattttatttcaggactgcccccttatcgtgggaattcggtcatactggtgattgttgaccgcttctcgaaaggaatccatctgggatctctaccctcacatcacaccgcttttagtgtcgcacagctattcatggagctttccggcaaactccatggtatgcctcgcagcctagtatcggatagagaccccttattcttaagtcgtttttggcaggagctgtttaagatgagtggaaccaagctccgtatgagctcagcgtatcacccacaatccgatggccaaacagaggccatgaacaagattgtcgaacagtatcttcgagctttcgtacaccagaacccagcctcatgggggcgctttctagtctgggcagaatggtcttataacacttcagtccattctgtcacagggaagacaccatatgaagtaacgtacggaaaaccacccccaagcttaccccaatatatcacaggaagttcgaatgttcaagcagtggacgaattgttgaccaatcgagagacattgaatgcatgcttaattaaaaagttgaccaaggcccaacagagaatgaaggagatagcagacaagcaacgtcgagatgtcagctatgaggaaggagattttgtgttagttaaattaagaccccgtcggcaaacatcagccacaggggagacatattcgaaacttgcaaagagatattatggaccattccaaattaccaagaaaattggaagtgcagcttatcagctgaatttatcaacaagctcaagaattcacccggtgtttcactgttctttactcaagccttttaattcatccaccacggaaggctcccttgaattaccagccatcgcagaagacaatgaacccttgatacatcccctcgtgattatcgacacaaggtgggacatcacaccaattggaagacatctgcttgttctcgttcagtgggctgggcttccacctgaagatgcttcatgggagaaatgggaagtcctcaagaaagactacaaccttgaaaacaaccaatag

SEQ ID NO: 100331 - DNA, 198 bp, Glycine max
  Peptide Sequence Number=SeqID_217109
atggctaagaataacaaaagtggaagtcaaagtaagcacatcaacattaaatacttagccactaaagaaagagtaaaagataagaaagtgttcattgagcgtataaacattgagttgatgatggttgatcctttgactaagggcatgccaccgtttaagttcaaggatcatgttagagttgaaactcttatattgtga

SEQ ID NO: 100332 - DNA, 1134 bp, Glycine max
  Peptide Sequence Number=SeqID_217110
atggagaggaatgagatggaaaggattgatgatgtgatgccaggatttcgttttcaccccactgatgaagagcttgttgatttttatctcaagagaaaaattcagcagaagtctcttcctattgaactcattaagcaagtggatatttacaaatatgatccatgggatcttccaagtactggggagaaagagtggtatttctactgtccaagggacagaaaatacaggaacagtgcacgtccaaatagagtcacaagagctgggttttggaaggccactggaactgacaggcctatatattcctctgaaggaaagtgcattggtctgaaaaagtctcttgtgttctatagaggcagagctgccaaggggatgaaaactgactggatgatgcatgagtttaggcttccatgcatctcagactcatcccctcccaaaaaactctcagacagaagcctccctccaaatgattcatgggcaatttgtaggatattcaagaaaaccaactccctctccctggcacagaaagccttatctctccctttgatctctcagttacctggaggcatagtatctgacatgttcacacaaggtttaaaatgccataacataggatcaccagccattcaattttgtggtgacaagcaagatgagttacaccaagtctccaacaatgccatcaacaacaacttctcagcctctgatattcccacttacaagctcataaacaacagcacagtttcaaagccatcaccacaaagtcctgtttcagatggagaccttgctgacaacttcatattctactcatcatggcccaccaagtgctgcacacttgatcccacttccatgctttctcccaaccctgactatatagaatttgaagacccaaaccaacaacactatagtggcttctcaatcaatctacctcaagatatgaaacaaaacatgagcacagaaacaggaacaaaagaacaagatcatcagtgggaaacaacaattgggatgagaaccactggatatcccttcagtttgagtcctccttatgatgcttggaaggcttcttctgtggcatgggagtcacgtccttgccctagtgatatgtccactacctattccaccaacaaatgctacacttaa

SEQ ID NO: 100333 - DNA, 249 bp, Glycine max
  Peptide Sequence Number=SeqID_217111
atggcctctatgccgttggggccgcagcaacagcttccaccgccgccgccgcaacaaccgccgccagcggagaatgacgcgatgaaagtggactctcgcggcggctccgacgccggcaccgaaaagttgatccgccagagaggtcttggtatgagcgtagcctacggcgatctgctcatttccggcattgtttttgcctgctcggaggtcgccggaattatgctccgcctacggtcggagtggttctga

SEQ ID NO: 100334 - DNA, 2197 bp, Glycine max
  Peptide Sequence Number=SeqID_217112
cacgcagaagaagcgaccgtaccacatagaagcgttcaagcaccgcgccgtgggggatcccaagtacgccgagaagacatggaaggttctggaacacgctattcatgagatatacaatcacaacgctagtggccttagctttgaagagctttacaggaatgcttataacatggtgttacaaaaatttggggagaaactttacacaggacttgtgacgaccatgacttctcatctaaaagaaatttctcaatcaattgaatctgctcaaggagaaattttcttggaagagatcaacaggaagtgggtagatcataataaggccttacaaatgatccgagatatactgatgtacatggatcgaacttttataccgagcaaccataaaactcctgttcacgagcttggattgaatctttggagagatgttgtgatccattccagcaaaactcaggctaggcttctagatactcttcttgagcttgtacttagagaaaggaatggtgaagtaataaacagaggattgatgagaaatataataaagatgcttatggatttgggtttgcctgtttaccaacaggactttgagaagcattttcttgatgtttcagcaaatttttactgtcgtgagtcccagaaattcattgaatcctgtgattgtggtgattatttgaagaaagccgagagacggttaaatgaagaaatggagagagtatctcactacttggatcctagaagtgagtcaaagataactaatgtggtggagaaggagatgattgagagtcatatgcacactctagttcacatggagaactcaggcctggttagtatgcttgtggatgacaaatatgaagacttgcaaagaatgcataacttgtttcgccgggtgcctgatgggctcacaattgttaaagatgtcatgacctcttttgtacgggatacaggtaagcagctagttatggatcctgaaaggttgagagatcctgtggattttgttcaacgtctcttggatttgaaggataaatatgacagggttattactatgtcatttaacaatgacaagacatttcagaatgccttgaattcctcttttgaatatttcatcaatttgaatgcccggtctccagagttcatttctttgtttgtggatgacaaacttcgcagagggttgaaaggggtcggcgaagaggatgtggagattctactagacaaagtcatgatgcttttcaggtacctacaagagaaggatgtgtttgagaagtattacaagcaacacttagcaaaaaggcttctttcagggaagactatatctgatgatgcagagaggagtttgattgttaagctcaaaacagaatgtggatatcaattcacttctaagttagagggtatgtttactgacatgaagacttctcatgatacgatgcagggtttctatgcaatccttggcactgagatgggggatagcccttcgctatctgtccaggtacttacaacaggatcatggcctactcaacctagcccaccatgtaatcttccagcagaaatactgggtgtatgtgataagtttcggacatattatcttggcacccataatggtaggagattgtcctggcaaactaatatggggactgctgatttgaaagcaacatttggtaagggccaaaagcatgagttgaatgtttccacataccaaatgtgtgtacttatgcttttcaacagcgctgagcggttgacttgtaaggagatagagcaagctacagcaatacccatgtcagatttgaggaggtgccttcagtctctggcctgtgtcaaaggaaaaaatgttcttcgaaaagagccaatgagcaaggacatagctgaggatgatgcattcttctttaatgacaaattcaccagcaagttcttcaaggtaaagatagggactgttgttgctcagagggagtctgaaccagaaaacctagaaactaggcaaagagtggaagaagacagaaagccacagatcgaagcagccattgtgaggataatgaagtctaggcggactctagatcataataatattgttgctgaggtcacaaagcagctgcagtcacggtttttgcctaatcctgttgttattaagaaaaggattgaatcccttattgagcgtgagtttttggagagggataaagtggacagaaaactgtaccgctatcttgcttga

SEQ ID NO: 100335 - DNA, 666 bp, Glycine max
  Peptide Sequence Number=SeqID_217113
atggcagagtccacaagatccaaagccaactccgatcttctagaggacgctatcacaaagctcaccatctccctcaatgatacccttcacagtcttactcacaaaatcgatgagctcatcaaccacctgcagaaaccagaaccaaacagtcactcacctttgtcttcatccgctattccctcctccgcgactcctccttcttctcaccgcatgaagttggatgtcccaaggtttgatggcgctgacctgcttggttggatctttaagatcaaccagttcttggaatatcatgcgacaccggagcatgaacgcctgacgattgtctccttctacatggacggtcgtgctctgtcattgttccagtggatgactagcaatggccagttcacctcttggccagcttttctccaggccctgcaattccagttcgccccttcacaatatgaggatcccaccagggcattattcaaattaacacagaagggaacagtcaactcttacctctttgagtttgaggacctcgcgaatcgcattgttggcatgccatctccctttctcttgagttgcttcgtttcgggattgtcctcggagatacgtcgggaagtccaagctctccaacccttgacgatggaagttataggagatcttaaactgactaaactatga

SEQ ID NO: 100336 - DNA, 2514 bp, Glycine max
  Peptide Sequence Number=SeqID_217114
atggctagaggtctcttccacttgtgcacacgcaagagaatcctctcaaagcttcaagctcttctcttcatcaaccactcccaattccacacttttcagaacccggtttccccaatttcgacccgtttctcgaacccgctccttcgccccagattctcccaaagttcgaaacttcccggcgaaagattccgccccaccaggccgttttccgccgctggcaacgagggtggcgccaccgagacgccggaaggtgagttcaaaactgattttgagcttggagatgaggttattaatagtgttcatggtttttctgaacatggggtcgttgcaaatgatgagagtaatgactgcaatttagagatcgttgattctgcagaatgtagtagtagtagtaataatggtggtggtggtggtggtggtggaagtgatactaacaatgagttagggaagaagagtgaggaatttatgcatgtggcatcacgtgacccggtcgaattgtaccgcgaaatgtgtagtgtggaaaggggtccaaggctggatagtacagaggtggaggtgctgctggaagtgtgccattggtttgccaaatcaggttgggcatccaatcaggcccttgccatttacattggtttgtcatttttccccactgctgcacacaagttccgcaactttctcaagaagtgtcctgccgatgttgccaagtacttggtatatcttgggccaagcgatgaggccgtgaggtttttgtttcctatatttgttgaattttgtttggagaattttcctgacgagatcaagaggttcaggggcatggttgaggcggctgacctcacaaagcctcacacttggtttccatttgcgcgggtgatgaaaaggaagataatttatcactgtgggccgacgaatagtgggaagacttataatgctttgcagaggtttatggaggcaaagacggggatttattgtagtccgcttaggttgttggcgatggaagtttttgacaaggttaatgcgaaggggatttattgcagtctgctaaccggacaagaaaagaagcgcgtgccgttttcaaatcatgttgcttgcactgtggaaatggcatcaacgcaggaattgtatgaagtggctgttattgatgagattcagatgatggcagattcgaatagggggtatgcatggacaagggccctccttgggttgacggctgatgagatacatttgtgcggtgatcctagtgttttggatattgtcaggaagatctgtcaagacatgggagatgagttgtgtgagcagcattatgagaggttcaaaccattggtggttgaagcaaagaccctgcttggaaatcttgaaaatattcgatctggggattgtgtagttgcattttctaggagagagatatttgaggttaaattagccattgagaaacagactaaacaccgctgttgtgtgatatatggtgctctgccacccgaaactcgcagacagcaggctagtttgttcaacgatcaaagtaatgaatatgatgttctggtagctagtgatgcagtgggaatgggcctgaaccttaacattagaagggtgatttttaatagccttacaaagtacaatggtgacaaaatggttcctgttccagcatcacaggttaaacaaattgcaggaagagctggtcggagaggatgcctttaccctgatggactcgccacaaccttgcatttagatgatttggactacttgattgagtgtttgaaacaaccttttgatgatgtaaaaaaggtaggcctttttccatcttatgagcaggttgaattgttttctgggcaacttccagatttgacattcacccagattttagaaaaatttggtgaaaattgccgtttggatgggtcatacttcttgtgtcaacataatcacatcaagaagattgctaatatgttagagaaggtccagggattatctctagaagatcgttttaacttctgttttgctcctgttaatgttagagatccaaaagctatgtaccatttgcttagatatgccacatcatttggtcagaagctccctgtaaatgtagctatggggatgccgagaagttctgctcgaaatgatgcagaactcctggaccttgagactaggcatcaggtattatccatgtatttgtggttgtcaaaccactttgatgaggagacgtttccatatgtgaagaaagttgaggcaatggcttcatgcattgctgacttactgggtcaatctcttgtcaaagctaattggaaacctgaatcaaggattaaagggagaccaaaaaccgaaaaaagtgaagggcaactagaaacaaggagtgcagttgaattacaaactgaaaaaacggaaatgggctattcaaggacacgatctcttttaaaattatatgagaagatttttgggtggggtgcttgtttggtagagggggtcaatattgtggagggagaaatgctagcaagtagcaacacactctatcatcagtttattttgtaa

SEQ ID NO: 100337 - DNA, 1194 bp, Glycine max
  Peptide Sequence Number=SeqID_217115
atgaatatctcaaactcaaaccaaaccaccataagctgcgtagagagccacccttccttaaccccttatccctatctctcccataaattcaacttccaatgccaacccacagtcacagaggaagaagaagcagtgtcctcagccgccgtgagatctgctttgatggaatgtcctctgtctgctcaaacgacgccgtttcgcccatctccatttcaagctctagctttgggagatccatcagtgaaacttgaagaagtaacccctcctgtgttttcttctggtccactctttccaatagaggatcgaattgtccaactatttgaaagaaacacatactctgttgttaacatctttgatgtgacattacgtcctcagcttaatgtaactggtgtggttgagattcctgaaggaaatggttctggagtagtttgggatgaggagggccacattgtgacaaattatcatgtaattggcaatgccctttcaagaaacccaaattctggtgaggttgttgcccgagttaatattctagcatcagaagggttacagaagaattttgaaggtagactcattggagctgaccgtttaaaggatcttgctgtagaagcccctaaagatattttaaggcctatcaaggtgggtcaatcgtcatctctaaaagttgggcagcaatgtttggctattggaaatccatttggctttgatcacaccctcacagttggggttattagtggacttaaccgagacatctctagtcaaactggggtaacaattggtggtggtgttcaaactgatgcagccataaatcctgggaacagtttactttgtaaaaatgttgctcttttcatgattggtgttaagtggacatcagctggtgtaggatttgcaatcccatcttcaactgtattgcgaattgttccacagctgatccaattcggaaaagttgttagagctggtttaaatgtggatattgcgccagacttaattgcaaaccaacttaatgttcgaaatggagctcttgttcttctggttcctgcaaatagtcttgctgccaaagctgggctaaatcccactacaaggggttttgctgggaatatagtccttggagatatcattgttgcagttgacaataagcctgtcaagagcaaagctgacttgttgaaagcattggatgactataatgttggagataag

SEQ ID NO: 100338 - DNA, 234 bp, Glycine max
  Peptide Sequence Number=SeqID_217116
atggggcaccttagtgatcaaagggttcccacagaccctaagagaataaaggtcattcctaagtggcctactccaccaagtgtcaaggaaagaaacccagagtatcaagaacctctgaatttgaggtcaaatcctttccaaggtggcaaggatgatgcaattggggggtattggatagaagactccaagaggattgggctagagtggctaaagaaggccctagggttctcatga

SEQ ID NO: 100339 - DNA, 366 bp, Glycine max
  Peptide Sequence Number=SeqID_217117
atggaaaaagttcctcggcaacggcgccaaaattacttgttcgaccataatacttgtttactccctcttctaaattggtattacttgtttttatatgggagtagtcttaccagcaagcacaccgggtcggcaaatatgaaaaagagtttacatcaactagtcaataagaatctccaactgagggttttagcctttcatggcaaggaagctccttttacactgaaaaagaggaatcaagagaaattgcatgcttacaaaggaatggggatgtctcttccacctctaggaatctcacaatcactcaaaaactcactaatctccctaaaagatgaaacttggccccttgctctgttctacgctctctga

SEQ ID NO: 100340 - DNA, 243 bp, Glycine max
  Peptide Sequence Number=SeqID_217118
atggttggtgttgaggaggttagagatgcatatgctctcattcatgtacctactgaagaggttaagttagtggggcagacacttaacaccttccttgcatggccaacacatcttgtcaagagtttattagaacatggagttgtgggaccgatgaaacctgcagataggccggatcatgatgtcgatgatcccctatatctgatgacattgaccatcccacaacattttttgaagccgttgtag

SEQ ID NO: 100341 - DNA, 186 bp, Glycine max
  Peptide Sequence Number=SeqID_217119
atggctcacaaattctgttttgaggcacttgatcacagccttagagatattatcaaacacatctcaaggcacaataaaatctttggaggtcttgaggctgacaaaaaacatgcgcttacaaaacaacatgcaagcaacagaccaagaagaaactgcaaattttgcacaatggattatagatattag

SEQ ID NO: 100342 - DNA, 802 bp, Glycine max
  Peptide Sequence Number=SeqID_217120
atgaagaaatcattaggttcatacttgagagccaacaacaactacatggcaacaccactagccgtagccaaagaagaagagtggtacatcgtaatcgtgaagaagattcaattccggagaaggttttgtatgctaagacatgtgttaatccgaattgtaaacgcactcagcaatcatgatgaatactttcaaatgagggtcgatgcactacgtcaaaaaggcttatctccattgcaaaagtgcacaactgttattcgtatattggcttatggatcacctgctgacagtgtcgatgaatacgttcgaattggtgaaaccactacagtggaatgcttggagcgatttgtattaggcatctgcaccatatttgggaatgaatacttgaggagaccaaataatgaagacatcaaacgcctactacaaatgggagcggcacgtggatttccagttttgtcaggacatgcgcccgcaatgcaattcatggtgaatagaacccaatataatatgggatactatttagcagatgacatttatccagactttgtcacgtttgtgaagaccatctcaatgccacaaggagaaaaaagaaaattatttgcacaacgacaagaatcggtaagaaaggatgtagaacgagcgtttggagtgctccaatctcgattcgcaattatacgtggtccgtcacgtttttgggatgctggtaaaatgaagaatatcatctatgcatgcatcatattgcataacatgattgttgaggacgaacgtgacacatatcaaaataatattgattacgatactgcag

SEQ ID NO: 100343 - DNA, 339 bp, Glycine max
  Peptide Sequence Number=SeqID_217121
atgactaaagcacgtcaaaagggggtacggaaagaaaataggggagaagcttgccacccagcttgcccagggattgtgctacaatgccttcttttgacttccggcatgtcacggaacttcacgaattgcctaatgatgggtgccaagtacctcgaagtggtcaaacaagggtcgcatcccaacaacggatggtccccggacgaaattaggcggatgcatgcaagcggtgtgcttagcaggatgagtgctcacttagcgcgtgcgtccaactcatccttcttccagattcctcctcgcgctcagccgtatgagtggtgcgctcagcggatggcttgctaa

SEQ ID NO: 100344 - DNA, 246 bp, Glycine max
  Peptide Sequence Number=SeqID_217122
atgggggcagcccttgctcctacgtatcctcaggcaaagggtcactttggggcagttgcagctcacccaggcgagctaagccttagtgctgaagcaataagctcgcccaagcgagctggtttcttcaccatgaagctatttggtagcccacgcgagccagaggctggcctgggcgagctagggtctaaaaataccaaggaaaagacccttttatcccctttgttttggtattttttgcattcttga

SEQ ID NO: 100345 - DNA, 261 bp, Glycine max
  Peptide Sequence Number=SeqID_217123
atggccccgaggaagcttgcctcaaagaggtccaggaaggataagtcggccgaaggaactagttccgctcctgagtatgatagtcaccgctttaggagcgccgtacaccagcagctcttcgaggccatcaagggatgggtgaatgctgtgaaattttcccggacgctgaaatggacttggatgaatgcacaaatggataaaagaacatattttggaaacgttgggttgactaaaatagaggaaatgaatcctgagccctag

SEQ ID NO: 100346 - DNA, 1085 bp, Glycine max
  Peptide Sequence Number=SeqID_217124
gcgggcgaagttggcggagagaatggacggggcgatgaggcagttggacatggccggggccttcggaacggggaaaggattctcccgcccgcaggcgggactgtcgggtcagcgcttgcgcagggtcttgatgcggtcgtaggcggcgttgatccgccgcgacttctgctcggcctgctgctgcagctcgggggcggcaccgcccagcttgtcggggtggtactgcgagatcagcttgcgataggcgcgctctacctcggcatcggtggcctcggaggtcagccccagctcccggtacgggttctccttgttcaggcggaaccagtccgagtcgaaggcatggccgatcaacaggccgaccaccgcgccaaacagcggattgggccggaacagcagggcgccggcgatgaatccgagcagttttccgtaccagcgcatggcgctccgggccgtatcgacaacgccccaggagtgcccgtgccaaccacgctgttgcaatccgatctccccggcctgcccttgcgccatcgcggcaaggtgcgtgatgtgttcgatatcccgcgcgagcggctgcccgcagggaccccaccgggcgactacctgctgatggtggccaccgatcgcctgtcggcgttcgacgtggtcctgcccgacccgattccgggcaagggcgagatgctctgccaggtgtccaacttctggttaaccaagtccgcgcacctgatgcccaaccacctgaccggcatcgacgtggccagcgtgctgcccgagggcgtggacccggccctgtatgcaaagcgcgcggtggtcacccgcaagctgaagccggtgccggtggaagcgatcgcccgcggctacctgatcggcagcggctggaaggactaccagcgcaccggcaaggtcagcggcatcgacctgcccgacggcctgcgccagaccgagcagctgcccgagccgatctttaccccctcgaccaaggccgccgtcggcatccatgacgagaacatcgattttgatgcgatggtgaagcaggtcggtgcggacctgaccgagaacatgcgcgatgccaccctgcgtatctacaa

SEQ ID NO: 100347 - DNA, 1464 bp, Glycine max
  Peptide Sequence Number=SeqID_217125
gcggtgctcgataccgaagcggccgtgtacaccggccaggaatcgatagacgcaggtctgtctgatgaactggttatcaacaccgatgcgttagcggtcatgcgtgaggctatcagtaactcaaaagtaacccggtctataggaggccaaatgtcagtaaatcaaacccaaaccgtagcggatacgccaaccgggtcggaagtagccacagcacaaatggcagcggatccgacagcggctcagcccgcaggaagtgtaacagcggccgttaatgatgccattcaggccgaaaatgcccgcatcatggggattttagattgtgatgaggccaaaggccgtggcgcctccgcgcgcgccctcgcagccacgccaggtatgacggtagaaaatgcccagcgcattcttgccagcatgccggaaagtgcccaggtgcggactgaaaccggacttgatcgcctgatggtcgattctcccgaagccctgggacaaggggcagcggctaaggccgaagaaaacgacttaatgaacaccccgccccttggtggcagcgatgcggcccatactgcgatcggcattagtggtcttgctgcggcaacgccggcacttaccccgctaatgctgaaagaagacactaacacgctggtggcatgggatggggcaaaagccgggacggccgttgctattttggcgctggccatcgatggccctcaaccgaaaatcacgtactacaaatccggtacatttcgggttgaggatgtgcgatggccagaagcggctgccactgatgaactgaaatttaacgcctttgccggaaaactcatgtcgcaatccatgtactcgacgagcaaattgatcgccgtcacagagacaaaattcaagtttgacccgctgtttctgcgtgttttctaccgtgaaagctacgaatttgatactgaaaccgtagacctggccaagatccctggagaggtcgcaatggcggtttatatctctccaacggttgaaggtaaagtgctgcgttcgcgtggcggcctgaccacgcaatttaagccgggttacgttaagccaaagcacgaagttaacccgcaaatggtgctgcgtcgtctgccagatgaagatccggagcaattgaaagaccccgcttatcgtcgtaatcgcatcatcctgcagaacctgaaagatgaagaattggctatcgcccaggttgaagaaaaacaggctgtcgatgctgtgatcagtggcaaatacatcatgaccggcgaagcgttcgaagaggtcgaagtagacctgcagcgcgacccggccaacaacatcacgcaggctggcgccggtcgctggtctacccaggacaaggaaacctacgacccgaccggagatcttgaggagtacgcgctcaatgcgtccgggattgtcaatctggttgtgatggatcctaaagcctggtccctcttccagtctttcaaagcg

SEQ ID NO: 100348 - DNA, 357 bp, Glycine max
  Peptide Sequence Number=SeqID_217126
atgtggctgaaatgggtgaagacccctgtggttttgtttggaaatcacgatgaacgcactaaatggcatcagaaaaggaaggctccttctacaccttcccaagttagatttgatcggtctaggttcacatctcaagaagcttgggagaggtttgcactcctaaggcctgatcctcaggagttggcggctaagctctgtatcccaaggagtggattcaagctaaatgctgatggtcagccgttgaagatattaaggaagaacatgaccactttagctcaaacatggagtgttctttccttctctaacctgattcctacctcccatacatctgacgtcacattggcagagccaagttaa

SEQ ID NO: 100349 - DNA, 282 bp, Glycine max
  Peptide Sequence Number=SeqID_217127
atggtgaagaaaccaacttgcctgggcaagctcattgcttcaacactaagtttcaggtcgcctgggcaagctgcctttgccctaagtgcccattttcctataaataggcgtgctagggaggctgtggagagacaaaaaggttcaagaggtgagggaaattggagaagagagaaagaagaagaagaaagaagaggaaacgaagttgaggcattacaaatcgtgaccgcgatcattccctacgtcattttcttgttctatgttctttgtgcgaccatcggttag

SEQ ID NO: 100350 - DNA, 261 bp, Glycine max
  Peptide Sequence Number=SeqID_217128
atgacagatcttgtaagtgcggaagatgatgtaaatctccgcgtgtcaacgggcttgccggccgcgattgacgaggggtgcagaatgaccataatttgtctctgcgtgccatcggacacgactgtgtctgaatggaaaatggtgtgcggaatgaccataatttgtctccgcatgtcatcgggcccgccgcctctggatgacaaaagggtgcaaaatgaccataatttgtctctgcgtgccatcggacacgactgtgtctaa

SEQ ID NO: 100351 - DNA, 177 bp, Glycine max
  Peptide Sequence Number=SeqID_217129
atgttcctggcgggagaaaaaggaatcgcacaaagacagtacaaatggaggcttcaatctcttctcattctctctaacgtttgggaaccctatcagagcaaccagaggaagaaattgaggaatcctaggaacttgctagagatgtctctatcgctttcggaagacacagtgttatag

SEQ ID NO: 100352 - DNA, 738 bp, Glycine max
  Peptide Sequence Number=SeqID_217130
atgccttacctcaggaagcaacggaagctagaaagcgaggaccaaacaatgtatgtcttagacggggtgcataaaggaatttgtggaatgcacattgtagggaggagcatggcaacaaggattatacgagttggtcactattggccaacattgagggaagattgtactagatacgttaagaaatgtaaagaatgccaagaattcaacaactttcaccacacaccaccaaaagagctttacaacatcacatctccttggattttgccttatgaggaatggataattaatctcaggccatttcccacagccaaaagccaaatcaagttcttcctcgccattgggtatgaagagtttctcaagaaactcaaaattagacatctggcattctcagtaaaccatccccaaaccaatgggcaagtagaagccataaacaaagtcatccttgttgagttacacatgacattgtcaaaggtccctaaggggttgtgggtagatgagctcccaagcgtgctttgtgggatgttcaatacaagcaaaaacttaggatcactagcagtagagttggacttagtcgaggaagtcagaagcgaggcaagagtccacgaaaaggcttataaaagaacaatgactagaaaatacaactccaagcttaagaaacaaagctttaaggccaacaatatggtttggagaatggtgcttataggcttgaagacatggggcaagaaaggtcatctctag

SEQ ID NO: 100353 - DNA, 237 bp, Glycine max
  Peptide Sequence Number=SeqID_217131
atgtcaccatttgggttggggaacttcattgtgatatgcagcattgagacgatcgcgcctagagcatttatccatgttcttctgaataggacgttgtgggaagtgtcggcatctatgaggacatattggacaagtagtgttcttgacaaatctctgattccaaaggtggtttcatgctctacaacaccatgggcgtggacttatccccttgtaaaactaatcaagggttatggatga

SEQ ID NO: 100354 - DNA, 387 bp, Glycine max
  Peptide Sequence Number=SeqID_217132
atggaggctcaagaatgttatgccaaaaccctgcctgccaaaccttacatctttacctctgagaaacacaccaaagcgatagacatcaataatgttgggggagtcacaccgatcagcttggtcgaatttgacccaaggaaagataaagaagacgaaaggccaacaccaattgaagagttattgttggaggagtcacaccgagcagctaggtcgactttgacccgaggaaagataaagaagatggaaggccagcaccgatcgaagagttatgtttattccaactcgaaaaaatcctcaccaactcaccgaatagggcagaaacttgacaaacatcttctgaaggagatcgaggaagtgttgaaacagaacactgatttttttgcttag

SEQ ID NO: 100355 - DNA, 306 bp, Glycine max
  Peptide Sequence Number=SeqID_217133
atggtcgagaaatccaatgaaaaagggagaatgtgcatcgattacacagtccttaacaaagcctgcccgaaggatgcatacttgcttccaaacatcgacagactagtcgatggcgccatgtggaacccacaaaacttgaaagaagttcaaaagctgacatgcagactctgcaataagctcgactctcttacaagaagaaggtcgaaagcaaatgccaatttactacaccatctaattacttcaatgagcagaaaagacatattaaacaatagaaaagctcaccctaacactgataaactccgctag

SEQ ID NO: 100356 - DNA, 834 bp, Glycine max
  Peptide Sequence Number=SeqID_217134
atggaggatgggtctcccattcgcggtaggtctcttatgggtagggagaaaacagaggattttctagtgggtagcagcgatgaggtggagatttttaaggaaaaggggaagaaaggtaagagggtattagagggaaactatggggaagttaagaggcaaaagagggacaatgctacagcatatggcaaaaaagttaggaaaagtagggaaaagaagtttacccctatcactattcctggtcaatcttggaaaaatttcaagtctaattttttccaagttcatcctaaccttgcttctcgagacttgaaaaagttatttttcaagaaggatgaaagaactcctaaatttcccttttattggcaatgtttccccttcaaattcaaatctcattctcaccaaacattgtcagcccaagagatcaaagatattgatattataagagaatggtcgtgtgagatgtcttgtaaattcattatggttattcccaactcatgtttccctaattgcgttctaagtaaagtcatgaagggttacgactacaaaaatctaaagtgtttggttgctaatgaccaaatggatctcaggaagacaaaaaagaggaaacgggttaaggactcctccaaatctgaccttgggaaaagttctatagattttgtggaagagaaagttgaaggcaacaatgccaatgtagaggtcctccacgtgggtggaacaaaggagacgatgtcaaaaacgggtgagaagactaaagcgatggctgcacaactaaaagtcatgaaggttgaggttaacaaaagtaaacaacttaattggctaagagtagggaagcagtga

SEQ ID NO: 100357 - DNA, 360 bp, Glycine max
  Peptide Sequence Number=SeqID_217135
atggagaaaactaagaaattgaagttcggagaatgggataaatatcaacatcatcgagaggaaatcttacaacattcgacaaaggaaggcacatttacacaggattcccctaacactgctacttttgttaatgataatgaaatatatttgaatgttgttggaggtccaaattataagggaaacatttatagactaggtactttgagcaaaaggtttagttgctcaaaatcaggttcatctacttttgttgctcctgtggaaggccaaatagaggaaatgcgtgagacaattaataaattgaatgctgagcttttggcaaaggcaaataaggagaagacacttgaggaaaagatgttgtag

SEQ ID NO: 100358 - DNA, 312 bp, Glycine max
  Peptide Sequence Number=SeqID_217136
atggaaagagctgtgcttgttatacttgtctctactatggcctctgagtcttcctttagcaccgaaggaagagttctagatctgtatcattgctttcttactccccaaatggttgaagcacttgttttagtttgccacattttgatgcaatcctaccccccaagggcattggatagaagactccaagaagattgggccaaagatgcaagagaaggccctagggttctcatgagccttagggactcacatagccttttccttgatcactcaggaatgacctttattctcttaggatccatgggaagcccttga

SEQ ID NO: 100359 - DNA, 621 bp, Glycine max
  Peptide Sequence Number=SeqID_217137
atggctctaattgcttctactaccttgtcccttaagtggaatattggagtaccagaaggtttttgccttactaaaggtctgcgacaggggatccccctgtctccttatctatttttactctacatggagaagctagctactatgattcaagagatagtagctaataaaaagtggctccttgtcaagattgccaaagcctctggcctgaaagccaatattcagaagtccaaatttttggcttctaggaacatttccaagactaagaagaagaagtttattagtattattggcttcaatcaatcgcaaaaccttggcagggcgaggagaacaactttggcaaaattggtgcttaatgcaatcatggtgtaccctatgaaaaatttgcgggttcctaatggggtgtgtgaggaaattggcaagattatgagaacatttatctggcattcacatcataatcattgggttaattggagtatagtgatgtgtcctccatctagggttggccttgatgttcgaacaatgagagaaatcaacgtggccttactagggaaacatgtttggttgttacaacatgatcctcatatgttgtgggttcaattgctctcaaataaatacctttag

SEQ ID NO: 100360 - DNA, 615 bp, Glycine max
  Peptide Sequence Number=SeqID_217138
atggatacctcagagccctacactggggcaatgaaaggcaccatgcataaacctcaagcgaacctagggggtggacccttgggaactagtaccctcatcttcaaaggactacacgttctcgcctacagaggactacacgtcctcgaatttagaggactgcatgtcctcgccttcagagggctacacgtcctcgccttcagagggttacacgcccttgccttcagaggactacacgtccttgccttcagaggactacacgtcctcgccttcaaagggctacatgccctcgccttcagaggactacacgtcctcacctttagaggactacacgttctcgccattagaagactacatgccctcaccttcagagggctacacgccctcgccttaagaggactacacgtcctcgccttcagaggactacaagccctctctttcagaggactacacgccctcgccttcagagggttacacaccctcgcttcagaggactacacgccctcatcttcagaggactacacgtcctcacctttagaggactacacatcctccccttcagaggactacacgtcctcacctttagagtgctacacgccttcacgtcctcgtctttag

SEQ ID NO: 100361 - DNA, 249 bp, Glycine max
  Peptide Sequence Number=SeqID_217139
atgccttgcaaatatgtgatggctccgagaaagctccccgccaagaggtccaggaaagacaccgctagagagggctccaataaggccccgcaaacggatgtggactttgatagtcatcggtttcggagtgttgagcaccagcaacgctttgaggccatcaagggatggtcgttccacagggaaaggcgtgtccagctcagggaggacgagtaccctgacttccagggtgagatagctcgcaggcattag

SEQ ID NO: 100362 - DNA, 570 bp, Glycine max
  Peptide Sequence Number=SeqID_217140
atgaaggctgacatggaggccatgaaagagcaaatgaccataatgatggaagccatgatgagtatgagaaaaatgatagaggtcaacacggctacagtcgttgcagcaagtatcgctactaagggagctgaagcgttaggaagtacaggcggcccccattttatgcaagttcaaaacaagcattccttcccaccatatgggttgcctcccaactatacatcacccaatgttgcacacgctcccgatgagaatgtcaataactctactcccatactcattgagagccaacaacctcaatctggtcatgcacaggggcaagcatttggtagcatacccctgccaatgatggagagggagatgataataatgatagtagacatgttaccggtgttctactatgagaggatggtgggttacatgcctccaagctttgctgatttagttttccccggtgaaaggatcgaagtgggtctaagaagaggaaaatttgattatcctccattgatgaataggaagcctgaggcaaatggagagaataagaaggagggaggaacccatgctatgactgtc

SEQ ID NO: 100363 - DNA, 213 bp, Glycine max
  Peptide Sequence Number=SeqID_217141
atgggtgggagtggagctttatttggagaaggccattgttttgacaatgaaattgatacggctggtgtttttctcaatgaggttcaggatatggccattcatcaacatggacctgatgtgtgggaatggactgctgaccctacagggacagtgaggatgatgcaattttcattctttggacctggcttaggaactttgagaaaggcttcatag

SEQ ID NO: 100364 - DNA, 865 bp, Glycine max
  Peptide Sequence Number=SeqID_217142
tgccctcacctttagaggactacacgtcctcaccttcatagggctgcacgccctcgcctttaaaggactacacgtcctccccttcagaggactatgtgtattcaccttcagagaactgcacgtcctcgccatgagagggctacacatcctcgccattagagggctgcacgccctcacctttagaagactacacgtcctgaccttcagaaggttgcatgccttcgccttcatagggctacatgccctcacctttagaggactacacgtccctgccatcagagggctgcacgccctcaccatcagaggactacacgtcctcaccatcagagggctgcacgccctcaccttcagaggattgcacgtcctcaccttcaaaggacggcacgtcctcaccttcagagggctgcacgccctcgccttcagagggctacatgccctcgcttgtagaggactacacgtccttgccttcatagggctacatgccctcaccttcagaggactacacgtcctcgctttcatagggctacatgccctcacctttagaggactacacgtcctcaccttcattgggctgcacgccctcgccttcagaggactacacgtcctccccttcagaggactacgtgtcctcaccttcagcagactgcacgtcctcgccattagagggctgcacgccttcaccttcagaggactgcacgtcttcacctttagaggactacacgtcctcaccttcagaggactacacgtcctcacctttagaggactagacttcctcgccttcagaggacttcacatcctcaccttcagaggactactcgtccttaccttcagggggctacacgtccccgccttcagaggactacac

SEQ ID NO: 100365 - DNA, 678 bp, Glycine max
  Peptide Sequence Number=SeqID_217143
atgttagtgaaaaacctcatcgggtgcccaggagtacataataggacagaccacacattgggagaccaattagggtcactatgtgtttgtgagaatgctccaaccatatgggatcaacataggcttcaaggaacattcaaaccgagtgtatttatcaccaaggcatacacctcaaagagtacattagggcctctccctcttgatttaggcattagttcccaaatcccaacagtagggatgtgcgaggatgcgttttgcacttggtgttcaaatttgacgatgatccaacaaaatgctaaagttgatgtctcgctaagcgagctcaatgcgcttagcgagtgtcatccgctaagcgaggcatcaacgcacttagcggataggaggaatctagaagggaatctatcacgcaggcatgcactcagcgcgttatcagctagctcaacgagtcgtttgtcaccttccaggcttagcatgagtttggcgcttagagaaaattcacttactcgcgttaagcgcgagaatggtgctgagcacgacgtagaggtcagagagacctttttaaagcctagaatagtagaagagaaggaggggggcatgagagaagcgctgaatagccgtaagagcttgatgagtgaaatacacagaggcaaagaacagagcaaagaagccaagttttga

SEQ ID NO: 100366 - DNA, 234 bp, Glycine max
  Peptide Sequence Number=SeqID_217144
gacctgaaagagatcagtaaaccaacgcttctccctctccagactcaagccatgatccagttccagacaacatgcctgaggactttactggctattgctgcatcaaagaagtggtccctataccagttagatgttcaaaatgccttcctacacggagaaaacattgcattagagcgaaaagcgcagcatggcaatcggagacaagtcaagttcagtaagaaattggatagatag

SEQ ID NO: 100367 - DNA, 651 bp, Glycine max
  Peptide Sequence Number=SeqID_217145
atgtttgaaacctggcgaattctagggtgcgtaagtgaaactccttacgcaccgtggattttttttctcctccgagcatgttaccccgctggcaatgatgacactggtgacgacggggacgagggtgagataggtgagccaggcctcacgcttgaaggtcatgatataagcgaagacgacggtgaagaagggggtggtggtgccgacggcttggttgaaagacaccggaaggtagcggagggagacattgtcgaaaacgatgaaaatgcagaagacgaggctgagggtggcgatcttgaggaactggaggcaggagcgaatggtctgcatggggaccatcttgagccaggcgatgacaacatagctaaaaagggagcagcatgttaccccgctggcaatgaagacaccgaggactttgacgaccatgaaggcgctggtggagtcgaggccggaggttggttcgtcaaggaagagcacgatagggtcgtggatgatgttggtgtcaatggagatgcggcaacgttcgtcgccggagacgtcgtggtggcccttgtagccaatgaccaaaggagggaaaagcttggaggagagagaggggtgattggagaccaaaggagggagaagcttggaggagagagaaaaaagatctag

SEQ ID NO: 100368 - DNA, 735 bp, Glycine max
  Peptide Sequence Number=SeqID_217146
atggccccgaggaaacttgcctcaaagagatccaggaaggataaagcagctgaaggaaccagttccgctcccgaatatgacaaccatcgttttaggagcgctgagcaccagcaacgcttcgaggccatcaaaggatggtcatttctccggaagcgacgcttcgaggccatcaagggatggtcatttctccgggagcgacgcgtccagctcagggatgacgagtataccgacttccaggaggagatagttcgccggcgatgggcatcactggttacccccatggccaagttcgacccagacatagtcctcgagttttatgccaatgcttggcctacagaggagggcgtgcgagatatgcgatcctgggtgaggggtcagtggatcccgttcgatgcggatgctctcagtcagttcctgggatatcctttagtgttggaggagggccaggagtgcgagtatggccagaagaggaatcgggccgatggttttgatgaggaggccatcgcccaattgctgtgtataccggggcaggattttgcccgaactgctgctgggagacgggtgcggatcatgcgcaccaaaatgaccaccctgaccataatatggatgagcattcacgtggctcagttgatcgctgatgtcatctatctatttgcagagacaggcccagggggatgctccgcaggccgcagacgcaccgccacctcatcaggctggcccagctggatcatttga

SEQ ID NO: 100369 - DNA, 893 bp, Glycine max
  Peptide Sequence Number=SeqID_217147
atgtggaagcttgaatatctttatctgagtaatgcaaacctatccaaagcatttcattggctacacactctccaatctcttccttctttgacccacctatatttttcagaatgcacactccctcactataatgaaccatccttgctcaacttctcatctctgcaaactctccatctttacaataccagttattcccctgccatttcttttgtccccaagtggatattcaaattgaagaaacttgtttctcttcaattacagggtaatgaaatccaaggtccgattcctggtggtattcgaaacctctcacttcttcaaaatcttgacttgtctgaaaattcattttcatcttctatacctaattgcttatacggtcttcatcgactcaagttcctggacctaaggctcaacaacttgcatgggactatttctgatgccctgggaaatttgacttctcttgtcgaacttcatttgtcatctaatcaacttgaaggaaccattccaacttctttgggaaatttgacttctcttgttgaacttgatttatcacgtaatcaacttgaaggaacaattccgacttttttgggtaatctccgcaacttaagggagatagatttaaaatatctctatctctctattaataaattcagcggaaatccatttgaaagtcttggatcactctctaaattgtcaacgcttcttattgatggcaataattttcaaggagttgtcaacgaagatgatcttgcaaatcttacaagtttgaaggagtttgatgcatcagggaacaatttcactttaaaagtgggtcctaattggattcctaattttcaacttatctatttggatgtgacatcatggcagataggtcccaactttccatcgtggattct

SEQ ID NO: 100370 - DNA, 213 bp, Glycine max
  Peptide Sequence Number=SeqID_217148
aagtcgcaactggcagcattcttagcaagctcaaaatctaaagagagtcttgctcagaatctcaaagaagttctccaactacttcaacaggaagtggaagaagaaccttccaagaaggaagctgaatcatctgagactaatgatgaccaagaagatgatccattctaccagaatgaagaatactgttttggtatatcattagacgacgattaa

SEQ ID NO: 100371 - DNA, 355 bp, Glycine max
  Peptide Sequence Number=SeqID_217149
atgagttctgaatgtttgctagtagatcccaacggtcacaatgtaggcttatgcactatagactcccaagttttctgcctttgctctgttttgcttggctgtgatagcttgtgctgtttgaatgttattttgcttggatgttgtggaagcttgggaggattgatggggacccggggatggtgggtttatgcgcgcattgtggatgtggaaaacttgttgtgcaccatcgcccgaccgccacctaagtggtacctggagatatgtcgcgggggtcaggagaccttggggacgtcaggtggggtgctattgtccaaaaccaagcttgaccaatcccgacccaacccgggcatagtcg

SEQ ID NO: 100372 - DNA, 1668 bp, Glycine max
  Peptide Sequence Number=SeqID_217150
atggccacgaaccaaggtgtcctctcaacacttgacaatgccaagacacaaagctaccacttcaaggcaattgtgatagccgggatggggttcttcaccgatgcatatgatctcttctgcatcactgcagttatcaagctcataggtcgcttgtactactatgatcccaatagtcatagtccaggaaagcttccaaagaatgtaaacaatgcaataacaggagttgcattgtgcggcaccctcgcggggcaactcttctttggctggctgggtgacaaactcggccgaaaaagggtttatggcataacacttgtgaccatggtgggttgtgccttggcatcagggctttcttttggctccacagccaagagtgtggttgctagtctttgcttcttcaggttctggctaggatttggcattggaggagattaccctctctcagctgttattatgtctgaatatgccaatcaaaagaccaggggagcttttgttgctgctgtttttgctatgcaaggtgtgggaatattggttgctggaggtgtggccatgttggtctccaaactcttcctatttgcctatcctgccagaatttttgcagaagatgctgtgcaatccactcagccagaagcagactttgtttggagaatagtgcttatgtttggtgcatttcctgcagccttaacttattactggcgaatgaaaatgccagaaactgcaaggtacactgccttagtggaaggagatcacaagaaagctgttgaagatatggccaaagttcttgataatgatatacctttagaagaatcaaatgccagggttgctgccacacctggcccctcttatggattcttctcttcaaagtttcttgaaaagcatggacttcacctgctaggaacaaccagcacctggtttttgttggacattgccttctacagtcttcagctaacacaaaaagacttttaccctgcaagtggacttgtacccaaggactcccgaatgaatgctatagaggaggtttttctactctccaaagcaatgtttaccgtggctctgtttgccactgtccctggatactggtgcacagtgtacttcattgacaagattggaaggtacaaaatccaacttgttggattttttgtaatgtctgtttgcatgtggattttgggacgcaaatatggagaatataggggagttgactgcagctcagatgacagattagaatattgtgatggaaacctccctatgtttatcattctttttggactcacccttttctttgcaaactttggacccaatagcacaacatttatagtgccagcagagctgttccctgccaggttccgttcaacatgccatgggatatcagcagcagctgggaaagcaggagctatcattggtgcttttgtggttcaaagctatacagataatgcagaagacaaaatcaaagggatgaagaaggcacttatgacactttcagttgtcaattttcttggattcttctgcactttcttagtgccagaaacacgaggtcgatcacttgaagaaatctcaggagaagataaagaactcccaggcaatattactcaagacaatgcaaatgagacaacaactgataaacaaaagggaacaaaaaactctaatgttgagaaacttccagaaaccttgatg

SEQ ID NO: 100373 - DNA, 1317 bp, Glycine max
  Peptide Sequence Number=SeqID_217151
atggtgcggcacaagcgtgggaggccttcaccggaaaattctccgtccaaacggagaagaagacgttctccgttggaatgtcgtaggagatgggttgtctcttccaaagactcttctaattgcacggccgccgtcatctatcctggccagcagcatggcaggccacgattgtggaagtcctccactggaaaatttaagtacttgttacctgtcaaagcagagaacacctcagctggaagcccctgtttcagattgtggaataaggttctggttgtttcatacaatatacttggtgttgaaaatgcatcaaaccatccagatctgtattctaacattccacatagtttcttggagtgggacaggcggaaaaggctcatacttgaagagattaataactataatgccagcatactgtgcttccaggaggttgatcattttaatgatctggatgatcttttccagaacagtggctttaaaggtgtttacaaggctcgcacaggagaagcacaagatggatgtgctgtattttggaaagacaagttattcaaacttttgcatcaagaagatatagagtttcaaagatttggtatgcgtaacaatgttgctcagctttgtgtttttgaggcaaaccatgataagaaagaatctgatgcatgtaacctaacaacaatgacaccatccaccggaaaaagaagatttgtagtaggaaatatacacgtgttgttcaacccaaatcgtggtgacatcaaactgggccaggtcagacttttacttgataaagcttacaagttgtcacaagaatggggcaacattcctgttattattgctggggatttaaatagtgttccacagttagacatccaattacatgatcgcagaaatatgtcaggacagcttgaaatccagactaacagagtcttcagatcacagattggtgatgacgctagcatttcaatgtctgtttcaagacaattgtacagatggagtgtggaagaactaagactcgcgtctggggcagaaggagtcactcgtcttcagcaccagctcaaactctgcagtgcttatagtggtgttcctggaaaccatagaacaagagatgatattggggagcccttggcaacatcataccactccaagttcatgggaactgttgattatatctggcattctgaggatcttattccagttagagttcttgaaaccttgcccattgatactcttagaagatctagaggactccctagtgagaaatggggaagtgaccacctagctgttgtatgtgaatttgcttttgcaaacaatgccaatgtatcctga

SEQ ID NO: 100374 - DNA, 633 bp, Glycine max
  Peptide Sequence Number=SeqID_217152
atggacatgtgcgtgaacagaaggttgggtagggaaacacggaagcaggaaggaaaaagggggtgttgggtgagagatgcaaccgttttcaaatccttgctatacgaagcttgtggtcggatggtgaacccggttttcggctcgactaggttgctctcgaccgggaattggcatttatgtgaagccgcggtcaaagccgttctaaatggcacgccgtttcagcaggctcctttgggcggcgccgcaagcctgcagctcgaggcttgtgatattcgccacgtggcaaagagtgataaatcgtgcgactctaatacgcttcacaaggtgaagtctcgcaccaccaagttcaagcgccaagccgtgaagtccagagtagagtcagttgtggctgagttggctgaaagcgagttaggtggtcatggttcagtgagttgtgacacgggatctggggtgactcggatgagtgagaacaaattcgttgaaggggaagccgataacggctccgtgcagagtgtggagccggctctagacaatggtggagaaatagagcttcaattgacattggggtggggtccagtgaagagacaaacggctttgatgacgccacgtgtagggcttgatctctctggctag

SEQ ID NO: 100375 - DNA, 1467 bp, Glycine max
  Peptide Sequence Number=SeqID_217153
atgaaagaagcaagtgccttaggagctagaacagcacgagcatgcgagagctgcctaaaagtaagagcaaggtggtattgtgcagctgatgatgctttcctttgccatggctgtgacaacatggttcactcagcaaaccaattagcaagcagacacgaaagggtgaagcttcaaactgcatcctccaaggtcaactactcagtgacccctaaggtagcatggcacagtggattcacacgcaaggcaagaacccctcgcagcaacaacaagcactcatcgctgcaacaacaacaacaaaaaccattacatgaagaacaaggagaagaagaagaagtgtttttcaataacaccatcattagtgttcaaccccttgtgcctgagcttggaagtgaagagccattgcttaatgatgagaccgaggagcaactcctgtgtcgcgtgcccgtatttgatgctgagctttgtagcatatacaatgaagtgaaggacgaggttaatgtagctggtggtgaagtagcctttgacttggaaaacttttcttctgagtttctaccaacagatatggatcttgctgagttttctgctgatgtggaaagcttacttggaaacggggttgatgaggattcacctgtgaagaaaggatcagaactagtgcttcttgattgcaaagaagaaggagatgatgaaatggatgcatgtgttaatggaattggagccaacaaagatgcaatggttaaggtcaaagatgaagaagaacttgatgctgatgatgacacagcttgccatttggattcgattcttgacatgaatagcgaggcctttaattggaatattgctgagtcagagtcacctgcacaggcacaagaagatgaagtgagtaaagtgggaaccaataagaaggacatatttttgaggctaaactatgaagaagtcattactgcttgggcaagtcaaggttctccatggactacaggaaccccacctaagttcttcaactccgatgattgctggctagacttgttttcttatagtatcatagccgatctcatatatatctggctaaaggaggaaggttgtgttgcgtcttcagtaaccgatgtaaaattcgtcgatatacctgaaatcattcgtagggcggagatgtgttatgccttcgggttcgaatggtgggggtgttcaatgctattatggggaagtgagaagcttaagagtgcatgcagatgggggaagagaagcaagagtgtcaaggtaccgagagaagagaagaacgcgtttatttgcaaagaagataagtgtttaatatatcgggtacttatatctacaagttttacatctgctttgcatataggaattgaagaagaaggaaagcagcagcttgatgctatgtgcttttggagatttgttggttctcccaagtttgtcggttcagagattggttggttctttcaatttcgtgagcttgattag

SEQ ID NO: 100376 - DNA, 2559 bp, Glycine max
  Peptide Sequence Number=SeqID_217154
atgaatccaccatctaataaccacaccatcgaacccagagacttgggcaattcaagtgccaatttcaacggaattaactcactccagagtaaggtgtcatccgaggcaaagtttcaacatattttgcatagcccagttatgacagagccatcaactacattaataagccaagtaggtcataagttcccggaggtatttcgactgagacaaggaagttacggagatcttccttcagcaaaaatttcagaattgatgaaatcaactagtttggataatgctcctacccaatcacttttgagtgtagtgaatggcatcttggaagaaagtgttgaaagaagaaatggtgaaataccccatcgtgtggcttgcttattgagaaaagttgtacaagagattgaacgacgtatatcaactcaagcagcacatctaaaaactcaaaataacctttttaaggcgcgtgaagaaaaatatcactcaagaatcaaaatacttgaggcccttacatttggaaccaaggaagagagtgaggttggaaggactaaaaaagaagacaagaaggtagaagaattaaaacattttgacaagattaacatagaaaaagagatggtgaatgacttaaaaccgattgagggcaccaaaaagatggaaaatgataaagatgttattagatatactaaagatatagaggacaaaaatatggaaatttcaacattaaagcaagaactagaaacaatgagaaaaacctatgaagtacaactctcacagttggaagcaaaagctgaggcagaaaagaaagtagatgacaaagagattattaaatatgttaaagagttggaggacaaaaatatggaagttttgacgttaaagaaaaatttagaaacaatgaaaaaaacatatgaaatacaatgttcacagttggaagcaaaaactgagaaggaaaaaatggcagatgacaaaggggttattaaatatattaaagagttggaggacaaaaatgtagaaattttagcatttaagcaggaactagaaacattgaaaaaaacatatgaagtaaaatgctcacaattggaagcaaaagttaacgagaaagaaaatgtagatgacaaagagattattaaatatattaaagagttggaggacaaaaatgtagaaatttcaacatttaagcaggaactagaaacaacgaaaaaaacatatgaagtaaaatgctcacagttggaagcaaaagttgaggatgctaaagaggaattgaaacataaatcacaagaatatgaacatttgttggaaaaactaagaaatgaggttaaagagaatgaagtcatttctgagtcaaagtatcaaaagtggatcatgaaagagaacgagatacgaaaagctgtgaattttcaatttagttccatacagaaattgaaactgtcatgggaatccattaagcaagatgctatgaaagagcaaaagatttattctgaggaatgtaatctattaggtataaatcttaaatcactagtagatgcagctgagagttatcaaatagttcttgcagaaaatcgaaaattgttcaatgaagttcaagaattaaaaggaaatattagagtatattgtcgacttagaccatttcttcctggacaaaaggaaaaacaatctattgtggaacacattggtgaaacagacttggttgtggcaaatcccgccaaacaaggaaaagaagcacttagaacatttaagttcaacaaggtctttggcccaacctcaactcaagctgaggtgtatgctgacatacaagcctttatacgatcagtacttgatgggtttaatgtatgtatatttgcttatggccagactggttcagggaaaacttacacaatgagtggtccaaatggtgcaacaactgagagtcttggtgttaactatcgagctcttaatgacctctttagcatatccacaagtagaaaaggctccatagagtatgacattggggttcaaataattgagatatataatgaacaacatgacatgtttatgacctatgatttccttgatttgcacacacttgggatattaagtcactctcaaccaaatggattagcagtacctgatgctacaatgcaacctgtgaaatcaacttcagatgtcattaagctaatggacattggcctaaaaaatagagccaagggttccactgctatgaatgaaagaagtagtcgttctcacagtgtggtctcaattcatgttcatgggaaggataagaagtctggttcttctcttcaaggtggtcaggccaagacactcatgttagtccaaattaattcagatttaaagtctttttctgaatctctaagtactttaaagtttgctgagagggtttctggagttgagttaggtgctgctaaaagtaccaaagatggtagagacgtcagagaattaatggagcaggtgtcttcccttaaggacactattttggttaaagacaaggagattgagaagctacaattacttaaggatctgaaaaatgtttatcctagtgtcaattctgagaatcctgaaactacctctgaatga

SEQ ID NO: 100377 - DNA, 708 bp, Glycine max
  Peptide Sequence Number=SeqID_217155
atgtcatccaacttttcaatcttaaacactgaggtttctacttcaccagctgtcactagttcgacagttgtgagaacccctcaccataatggaagaagaaatagatcaaaagcttggaatcatttcaatcaactagagccaaagtcagataagagggctcaaagcaagtattatgatgtcatgattaactatgagaatggaacaagttcaatgcttggtcatgtctttagatatctgaataaccctaacaaagaagcaatcaagaggaaaaaaacaattgcatcctcaactaatgacaggattattagctcttcatcgtacgacaagtttgacaaagatttgtgtgaagtggaaatggtaaagttgtttgttgaaactgaacttccttttcaattggtagagcatccagtttttaggagtgggcttaaagatattgacaactttgttttaagaatctgtgttgcagtggaatatataagatcatctccttctagacttatgagcttcaaagaatgcgttgaacggaaaaacattgaatataagggtcacatttgcttggatgttgaaacaaggaagacatttcgggagtttgagtttcatgatagaaaatatgctaatgagttaggaaaagggataggtctgccttcctatgaagattgggaatatgttgaggctattctatccatccttcttgagcattttctatga

SEQ ID NO: 100378 - DNA, 435 bp, Glycine max
  Peptide Sequence Number=SeqID_217156
atgggaaaagcaagggacagaaccgaagatttcaaagacgccgtgcgccacaccgctcgctctttgggctacgatgaggctaaattggcgtccgtaatggcatctttcattattcataaaccgccgcaaaggtccccgttttccaaagccgcattgaagacgttggagagtattggagagctggatcagtttttgttgaagcatagaaaggactacacggatctgcatcgcacgactgaaaaagagagagatagcattgagcatgaagttagtacttttattaaaacttgccaggaacaaattgatattcttaagaatagtataaatcaagaggaggaaacttcgaaacattggcttggcattgcaaccacaaaatctaatgccgacaccattgcccacaaacatggggtggtaaggacttatggtgcttgttga

SEQ ID NO: 100379 - DNA, 1378 bp, Glycine max
  Peptide Sequence Number=SeqID_217157
tcatgaactagagccgttagatcaagatcagcggatgaaatttcggatgcatattttaagtctggattacgaggcaaaaaatgattcgtcaatcttcatccaacggttgcgtttggctaaaatgccggatgttcagacccttgttaacgattttctgaatcagcttaagaaacgtgatgctagtaaaattgaaggttctcaggccacagcgaagctcacagcagagttgctccggtctgtgatttcacagcagcgagtgccacacacaaaccaagccacagctctgattaatgcagtgagggctgtgggggagcagcttattgctgctaatcctgttgagctagctgtcggaaatatcgtgaggcgtgttttgcacattataagggaagaggatctttcccttgcaacagctgctatggatggtttgggggtatcagctgcaagtgatgatgaagatgatgcagagcgagatgaaaatcctgttttatctgctgctgctgttgcagctgctgctagaagcacattgcgtccaccgtcattgcaaactcttctagaggatacatctgattcagctgcccctccccacacatcttcctcagggggtgaatctgatgggagaagtagatctgtggaaaaaggttcaagagggaggaaattgaagcatgatgtcatcgaagcagtcaatgaacttattcaagacatatctacttgctatgaacaaatagccgagcaggcagtggagcacattcatcacaacgaggtaatattaacgttaggcagctcaaaaacagtgttggaatttctttatgctgctaaggaaaaacagagatcatttaaggtctttgttgctgaaggtgcccctagatatcaggggcatctccttgcaaaggaattagccgctagaggcttacagaccacagtaattactgattcggctgtttttgcaatgatttctcgagtgaacatggttatagttggagctcatgctgtcatggctaatggtggagttattgcaccagtggggttaaatatggttgcacttgcagctcaaaggcatgccgttccatttgttgtacttgctgggagtcacaagttgtgccctctgtatccacacaatcctgaagtcctactgaatgagctgagatccccatccgagctacttgactttggggaattctcagattgcatggattctgcaagtggtgccggttctcttcatgtcgttaatccaacatttgattacgtgccaccaaaacttgttagtctcttcattactgacacaggagggcataacccatcgtatatgtaccggctcatagctgattactactcagctgatgatttggtggtgaaacgaagacccactacagggagttga

SEQ ID NO: 100380 - DNA, 516 bp, Glycine max
  Peptide Sequence Number=SeqID_217158
cgattctacctcgcttacatgtttccctctcttgttagcattaacataagttatttctgtgacttgctcagccacacacaaggtcatataagttactatgttactggcaaagaggatgagcaaccggctgtttttactggagatacattgtttattgctagttgtgggaaattttttgaaggaactgcagaacagatgtatcagtcacttaatgtaacactcgcttcattaccaaagtcaactcgagtatactgtggccatgagtactcagtgaacaacttgcaatttgctctgacacttgagccagacaatttgaggatacaacaaaaattaacctgggctcggaatcaacgacaagctggccaagcaacaattccctcaaccattgaggatgagttggagaccaatccctttatgagggttgatctacctgagatccaggagagggtgggctgcaagtcacctgttgaagcattaggagagataaggaagcagaaagacaattggagaggctaa

SEQ ID NO: 100381 - DNA, 477 bp, Glycine max
  Peptide Sequence Number=SeqID_217159
atgcatatggacgtctcctcacactggcatgacagcagagctggggctattttggaaggacctaacgatgtggctatggcacaattgttacgcttcagcttcaaagccacctacaatcagatcgctatcgaactgataaacaatgtttttcagattcgagacctccaactcccaaattactaccacacatttgaaaatctcaagagagaatttgaggaagtgcaagtgactcatataagtcgagagttggaagaatcccccttagggtggaaaaaggatatactcgactacttgaggcatgagatactcccagccaacaagagtaaagctagaaagataaaaatgctaactgtgtcctctgagaattgcataagggtacttgcggtttacattacggagaaagaaccatggccacaagagttctgtgggtcggctactatttgccaaccctcaggacgaactgctcgaactttgtaa

SEQ ID NO: 100382 - DNA, 303 bp, Glycine max
  Peptide Sequence Number=SeqID_217160
atgtcacccataaccttcacaattgatgacttcaagatggaaatacccgagtccgagatcctcccacatgatgaccccctattaagttttgttggggaacaggtagagggattggagcttgaccccagaacgaattatgacaaacgggtgaccttggttgaagagatgactactttccagctcgggaatcaaaatggacagagaaagagaacgataggagaagaaaggtgtcgagcagtgcatcaagaaatggccaagttgacagccatcgatttcatcagggaaattgactactccacttag

SEQ ID NO: 100383 - DNA, 831 bp, Glycine max
  Peptide Sequence Number=SeqID_217161
atgagtttgtcacatcttgattaccaattgtataatactcctcctaatcatgctttggtacttctaatcagatacgtggccgaagggtatgttcggtttgggtgcgccatgtctctcctcggcccgaccaagtactttatccggtacttaataattgtgtcggtcgaaggttcgtcgtcgagggagtcagttgaaggcaagtctaagattcaaaggtacaacgacatagttttagaactaccgtccactacagttgaaaatataggtgagagcattgcagctccggtggtggccgctactgccgaggcaggaatatcccaaagggatacttctcggcctaagaaatgtctagtgctgaaaaagaggtgtccacctcccccgattacgcttcgggagtacacgtgggttgacgaagaggattacttctatgactcgacgggaaccctttgttccccttctactggcaacagtatcctcgacggaccagctgatgaaggtcaaggactccttgaactcggtgcttcaagacaatatgaagccttgggtaggtcttgggatactgaactcgccaggctccagtcgaccttggctgatgccaagaaggagacaaaggaggctaatgctaaaaaagaaagggttcagcagaaggccttcgatgatgacccgagtgtcttcgacatcaataaagatgtgcatgaaggagagctagtgttgattgatgacatctcagaggatgatgttgccactttacctcgagggcaagtgaccccaattaaggagccacatgctgaggagatcacggatagagagaatgtaaagcctatggattaa

SEQ ID NO: 100384 - DNA, 513 bp, Glycine max
  Peptide Sequence Number=SeqID_217162
atgggtgatgggggaggaatagtgctcttagattatggcaacaatagtactattcacttgaccactgggactggatttgggcaaccctatccacagcaaaaggctcaagcttctttccatgggccacagaaacaggcccaaacaaatgtcccccactcacatccagtgccatttcctgcagactatgctactaacccttatgtgggtggaccaagctatgcacctgctggaccaagttatcaaccacccagaacaacaactccatcaccctcaaatgttaattatgctcccaattttttcccaagtagtggtggcatggcacctagttatttcaacatgccatcatcatcatcatctggggcaggtcctaggccaaggggtcctccaggatttgcaattggggcaggtgccggagcattggccgctggggctgtaatttttggtgataacatcatgtcaggatttgatgttggagatcccactcttaccattgcaactgatcctcttttctga

SEQ ID NO: 100385 - DNA, 510 bp, Glycine max
  Peptide Sequence Number=SeqID_217163
atgccacctaagacaactcagttgatggagctatttggcatgcatcatcttattgacttgaaaaaagataactctggaggggatcaaacacaaacgaatgtgcaagatcggtatcaagaatcactagggcgcagagagaacttcttgcttcatgttgttgtagctgttttatcattcctgatatttggtgctttccctcttgttatctatggcctcttgatcaataagaattactacaccgaagttaagctcgccacagtagcagctacatctattgtatgcatcattctacttgctattgggaaagtttacaccagcaaagcacccaaatcctatattaaaactgtgttatactatgttacattggcaatttcggcctcgggagtctcatacatagcaggcaacctaatcaaggacttcctagagaaacttaaccagccagaatcaggttttgctattaccatgcccatatcagacacaagtgtggggtcagcatggatgtcttactga

SEQ ID NO: 100386 - DNA, 1587 bp, Glycine max
  Peptide Sequence Number=SeqID_217164
atggaacaggaaggacatcaatggatagtgcatcctcatgatgaagaagaaggagaagaaattatggaagatggtgctttgataagaaagcaaactgtgtcacataacaagggcaatcttattatggaggaagtaacatttacatcctcctcctcctcctcttcttctagtagcaatggcagtgagcatagtaatggaatttgttcagtagcccccccagatggatctcctgttcaaaaagaggaagaagttgcagagagaggagatgttggtgaaaattgcaaccatgttaatggtgatatagtagattatgcagctgctgggcttgcacaagtggcagaatttgcaggagcagaaacaaatggagaggccataactggtgttgttgtgtcacagaataagaacagtgtttactttgatgagcaacaaggaatgtggaaatgtcaccactgcacatggaccaagcgatttgacagtccttggactgtgccaaattggaatcttaagggttaccctgacttgatgactgtcaaaactatgattcaacatggaccattttttgtttgtgatactaaagatgatgaagttaatggagttcaaaatggtgatgctttttggtctgtccatccaacaaatctgggggggagagactttgatgtacaagcggatcagtcagttgttcagaatagtctatgcagtgaaatcaccaatcaatgtatgaaaactgtggacgacaagctcccttctgttacagaaatatctcatttacataattcatctgacatacaagctacagctgttacaaattttcctgaagaaactagtacaaaggaagctcctaacctgatagaagagattgatccacaactggaagaatttgatgttgaggcagtattagcaaaacaagagacgcatgacttgttctgtcctaactgcagttcttgcattactaaaagggttatcctcacaaaaagaaaaaggaacactaaaaaatcaggcagcaaacccaagcgtgataagccggagaatactcataatttagacaacgaagccaagtgtgatgagttacagactagaggcagctcagagctgccagatagttctgcacaacccgaagccaagcaaggtgttcatgcaaatataatgcctgaacctggtattcttagtccagagccatctgctgataataatcaacctcacgaagaaccagaagttttcagatgtttagcatgcctcagcttctttattcctagtggtgatgcaccccttgaatattctggaactggttctgccgagcagcctaactcaacattaacttctaatgatgaaccaagctccactgaaatcggtcattcaaaaggtccacttgctgatacatctgatattaagaatgtaaaacctacgtcaaatattaatcatggacatggagggatgaattctctgatgtcatcaacaaatgatttgtcatctatacaatctggtacaaaaggtgctggtgatttgatgaacggagtgcagagtgttgtgcaggattccatagattatgcttcagtggacataataaggacaggtatgcttgagaactaa

SEQ ID NO: 100387 - DNA, 180 bp, Glycine max
  Peptide Sequence Number=SeqID_217165
atggttgtgatggtggttggtgtgattgttaacggcggaggtaagtccatacggattctcaatccgtataaaccagtgctaaatgcaaaagaagaagagggacttacgacggagacgatggcgaagtcggtgtcaacggcaagggcactcactggcagcacaatgcggacggaggcatga

SEQ ID NO: 100388 - DNA, 201 bp, Glycine max
  Peptide Sequence Number=SeqID_217166
atggttgtggtggtgattggtgtggttgttaacggcggaagtaagaagaagaggggcgaagacgaaagacttacggcggagacgatggcgaagtcggtgtcgacggcaagggcattcactggcggcacaatgcagacggaggcacgaaaggtgacacgacgcagaaataaagaagaagaagaagaagaagaggaacagtag

SEQ ID NO: 100389 - DNA, 319 bp, Glycine max
  Peptide Sequence Number=SeqID_217167
atgctcgataatggggtgctgttggcagtgaagaggatcaaggattgggggatttccaagcaagattttgagagaaggatgaatttgatagcccaagtgaagcatccacgcgtattgccacccgttgcatactattgctctcagcaagagaagctcctagcatataaatatctgcagaatggtagtctcttcatgttgctctatggatctcaaagtggccactcttttgactggggaagcagactaaatgttgctgctaagatagctgaggctttggcatatgtgcatgaggagtttcttgagaatggaatagcacatg

SEQ ID NO: 100390 - DNA, 441 bp, Glycine max
  Peptide Sequence Number=SeqID_217168
atggaacattcagaactttacttcctacaccctcaaaagacaaaagggaacaaaaataccctcaccaggcaccccttcctccacaagaaaccctacatagggtataggggaagtgttggggttgatgtcccaaatgatgatgcaagtggtgtcaatgttggaggtggcaatgcacttggggtcaatgtcattccagtcaaaggagatcagagggatgcaggacttgttggttttgttgttgaagaggaatatggcctcaacagagttgtcatggacctcccaggtaagaatgacaatggtttgggagtggtcgaaggaaaggaaggagtggcggttagggagagggtgtcagggtggaaggagaggatgtcaacacgattgttgtattctttgatgaaggtttcaagggtgaggtattggggtggtgcaaccatattttga

SEQ ID NO: 100391 - DNA, 2298 bp, Glycine max
  Peptide Sequence Number=SeqID_217169
atggtgaaaaaaatgtctgtgattggctttaagacaaagtcctccttagtcaatcactcgaagtatgagggttcgagttccgattcgcgaggcaagatgagcacgcagaagaagcgagcgttacagatagaggcgtttaggcaccgcatcgtggtggatcccaagtacgccgagaagacgtggaaagttctggaacacgctattcatgagatatataatcacaacgctagtggccttagctttgaagagctttacaggaatgcttataatatggtgttatacaaatttggggagaaactttacacaggacttgtgacgaccatgacttctcatctaaaagaaatttctcaatcaattgaatctgctcaaggagaaattttcttggaagagctcaacaggaagtgggtagatcataacaaggcattacaaatgatccgagatatactgatgtacatggatcgaacgtttataccaagcaaccataaaactcctgttcacgagcttggattgaatctttggagagatgttgtgatccattccagcaaaactaaggctaggcttctagatactcttcttgaacttgtgcttagagaaaggaatggtgaagtaataaacagaggattgatgagaaatataataaagatgcttatggatttgggtttgcctgtttaccaacaggactttgagaagcattttcttgatgtttcagcaaatttttactgtcgtgagtcccagaaattcattgaatcatgtgattgtggtgattatttgaagaaagctgagagacggttaaatgaagaaatggagagagtatctcactacttggatcctagaagcgagtcaaagataactaatgtggtggagaaggaaatgattgagagtcatatgcacactctagttcacatggagaactcaggcctggttagtatgcttgtggatgacaaatatgaagacttgcaaagaatgtataacttatttcgccgggtgtctgatgggctcacaattgttaaagatgtcatgacctcttttgtacgggatacaggcaagcagctaattatggatcctgaaaggttgagagatcctgtggattttgttcaacgtctcttggatttgaaggataaatatgacagggttattactatgtcatttaacaacgacaagacatttcagaatgccttgaattcctcttttgaatatttcatcaatttgaatgcccggtctccagagttcatttctttgtttgtggatgacaaacttcgcagagggttgaaaggggttggtgaggaggatgtggagattgtactagacaaagtcatgatgcttttcagatacctacaagagaaggatgtgtttgagaagtattacaagcaacacttggcaaaaaggcttctttcagggaagactatatccgatgatgcagaaaggagtttgattgttaagctcaaaacagaatgtggatatcaattcacttctaagttagagggtatgtttactgacatgaaaacttctcatgatacgatgcagggcttctatgcaaaccttggcactgagttgggggatggccctatgctatctgtccaggtgcttacgacaggatcatggcctactcaacctagcccgccgtgtaatcttcctgtagaaatactgggtgtatgtgataagtttcggacatattatcttggcacccataatggtaggagattgtcctggcaaactaatatggggactgctgatttgaaagcaacatttggtaagggccaaaagcatgagttgaatgtttccacatatcaaatgtgtgtactcatgcttttcaacagcgctgagcggttgacttgtaaggagatagagcaggctacagcaatacccatgtcagatttgaggaggtgccttcagtctctggcctgtgtcaaaggaaaaaatgttcttcgaaaagagccgatgagcaaggacatagctgaggatgatgcattcttctttaatgacaaattcaccagcaagttctttaaggtaaagatagggactgttgttgcacagagggagtctgaaccagaaaacctagaaactcggcaaagagtggaagaagacagaaagccacagatcgaagcagccattgtgaggataatgaagtctaggcggactctagatcataataatattgttgctgaggtcacaaagcagctgcagtcacggtttttgcctaatcctgttgttattaagaagaggattgaatcccttattgagcgtgagtttttggagagggataaagtggacagaaaactgtaccgctatcttgcttga

SEQ ID NO: 100392 - DNA, 2400 bp, Glycine max
  Peptide Sequence Number=SeqID_217170
atggctagaggtctcttccacttgtacacacgcaagagaaccctctcaaaacttcaagctcttctcttcaacaaccaccactcccaattccacacttttcaaaacccggtttccccaatttcgacccgtttctcgaaccctctccttcgccccagattctcccaaagttcgagactttccggcgaaagatttcgccccaccaggccgttttccgccgccggcgacgatggcggcaccaccgaggcgccggaaggcgagttcgtcgcagattccggtaagggaattgattttgagcttggaaaggaggttgttaatagtgtccatggttttcctgaacatggggttgttgcaaatgatgatagtaatgagtgcaatttagagattgatgattctgtagaatgtagtactagtagtagtggtggtgagggtggtggtggaagtgataataacaatgagttagggaagaagaatgaggaatttatgcacgtggcatcgcgtggcccggtcgaattgtaccgcgaaatgtgtagagtggaatggggtccaaggctggacagaacagaggtggaggtgctgctggaagtgtgccattggtttgccaaatcaggttgggcatccaatcaggcccttgctatttacattggtatgtcatttttccccactgcagcacacaagttccacaaatttctcaaaaagaagtgccccaccgatgttgccaagtacctggtatatcttgggccgagtgatgaggccatgaggtttttgtttcctatatttgttgagttttgtttggagaattttcctgatgagatcaagaggttcaggagtatggttgagtcggctgacctcacgaagcctcacacttggtttccgtttgcgcgggcgatgaaaaggaagataatttatcattgtgggccgacgaatagtgggaagacttataatgctttgcagcggtttatggaggcgaagtcggggatttattgtagtccacttaggttgttggcgatggaagtttttgacaaggttaatgcgaaggggatttactgcagtctgttaactggacaagaaaagaagcgtgtgccgttttcaaatcatgttgcttgcactgtggaaatggcatcggcacaggagttgtatgaagtggccgttattgatgagattcagatgatggcagattcgaatagggggtatgcatggacaagggctctccttgggttgaaggctgacgagatacatttgtgcggtgatcctagtgttttggatattgtcaggaagatctgtcaggacactggagatgagttgtgtgagcaacattatgagaggttcaaaccgttggtggtcgaagcaaagaccctgcttggaaattttgaaaatattcggtctggggattgtgtagttgcattttctaggagagagatatttgaggttaaattggccattgagaaacagactaaacaccgctgttgtgttatatatggtgctctgccacctgaaactcgtagacagcaggctagtttgttcaatgatcaaagtaatgaatatgatgttctggtggctagtgatgcagtgggaatgggcctgaaccttaacattagaagggtgatttttaatagccttgcaaagtacaatggtgacaaaatggttcctattccagcatcacaggttaagcaaattgcaggaagagctggtcggagaggatgcctttatcctgatggactcgccacaaccatgcatttagatgatttggactacttgattgagtgtttgaaacaaccttttgatgatgtaaaaaaagtaggcctttttccattttacgagcaggttgaattgttttccgggcaacttccagatttaacatttccccagattttagaaaaatttggtgaaaattgccgtttggacgggtcatacttcttgtgtcaacataatcacatcaagaagattgctaatatgttagggaaggtccagggattatctctaaaagatcattttaacttctgttttgctcctgttaatgttagagacccaaaagctatgtaccatttgcttagatatgccacatcatttggtcagaagcttcctgtaaatgtagctatgggcatgcctagaagttctgctcgaaatgatgcagaactcctggaccttgagactaggcatcaggtattatctatgtatttgtggttgtcaaaccactttgacgaggagacatttccatatgtgaagaaagttgaggcaatggcttcatgcattgctgatttactgggtcaatctctttctatggcttctttatctaagtccctggctggttatggtgttgtgtctgtatatctgttggctcatctttgtggaataagatttgtggttgtagaaaacattaggggggtaaagttctactgttga

SEQ ID NO: 100393 - DNA, 255 bp, Glycine max
  Peptide Sequence Number=SeqID_217171
atggattctccttgcactgtcttccttgctttcctctgcttcttcgttacttcgttgtgccacacttgcaccgagcacgtttgtacaactggatcaagtggtcatgtgctaagcgtagaatgtgcgcttgctcgtgacaactgtcttccattgtggcttcttgcgttaagcggcttgcttaggggtcgtgctaaacgtgacacttcagttcatgaatcctctttcggtcctctgctacaactctacaaaatataa

SEQ ID NO: 100394 - DNA, 240 bp, Glycine max
  Peptide Sequence Number=SeqID_217172
atgtggattatttggagacaaagaaatgataaggtatcgaaagctaaagattgtcgtgatgttggggtcttgagtagagcaaactcctttttccaagactggttgagagcaaagaatctatttgttagcaatgagaaagctcctaatgaaaactttatggagtcatggagggcaccatatggtggaagggtgctatcggtttccattggatggatgaatctatggcttgaagtaatgtag

SEQ ID NO: 100395 - DNA, 723 bp, Glycine max
  Peptide Sequence Number=SeqID_217173
atgaaggatgagatgaattccatgcagagtaatggattttggaaccttgtagagttgcctaatggggcaaaggccattggttgtaaatgggtctttaagaccaaaagggattcattagacaacattgagagatacaaggcaagactcattgctaagggatttactcaaaaagaaggaatcgactacacagagactttttctcctgtatctaagaaagattctcttcatattatcttggcattagttgctcattttgaccttgagttgcaacaaatggatgtgaaaacagtctttcttaatggtgatttagagaaggaggaggtcccttcagcaccacaaccagctcttacccctcctatttccactccttcttcttttcagaccttcgccttggaagatctcaaactacaaagcatccatcaaggccaacaacccatcatgtctatagaggaattccaacctactgttgttgttgaggctactgctgaggcggagattactgctgctactgctgaggtggagtttgtaattgatattgctacagagactgtggtaggacctactactattgatcctcttgttgatgttgttgagcatggggaaaatcttgattatattgttgatgtctcaacgactcaaactccagccagggaatccattatctacataggattaggccatctaattgtgcacttttctttatttattgttttctttctatga

SEQ ID NO: 100396 - DNA, 600 bp, Glycine max
  Peptide Sequence Number=SeqID_217174
atgagtgaagagcataattgggaagattggccaggtttcgaagcttcaaatgatgtatggatggaggttggagcagaaattgaagaatctgcagaaactgaaaatgaacaacccttccatgacttggcagtgccacaatcaaaccaatctcctgagaatatctctaagcctcctaatcggtattcaccggatcatggaactactatgaaaaatcccaagtggatccaagcactagaggaagagatgaaagcgttacaagaaaataacacttggccacttgtgccattaccaaaggggaagaaaacagtgggatgtaaatgggtgtttactatcaagcacaaggcagatggatctgttgaaagatataaagtgaagcttgtcgcgaagggattcactcaaacgtatgaaattaattatcaagaaacttcctctccagtagcaaaattgaataccataagagtattaatatcacttgttgcaaacttggactggtcgttgcaccaatttgatgtaaaaaatatttttctccatggggattttgaagagaaagtgtacatggacattccgcctggtttcattccctctacacaaaggagtgtg

SEQ ID NO: 100397 - DNA, 120 bp, Glycine max
  Peptide Sequence Number=SeqID_217175
atggggaactattataggggaacagggtcacaaagggtacagcatgaggtaaaggagaatgtcatgaagggaaccacatgccaaagggaggaagtggatagtgttaggggtctgaattaa

SEQ ID NO: 100398 - DNA, 258 bp, Glycine max
  Peptide Sequence Number=SeqID_217176
atggggagtggaaaatggatgaaaagatctcttgcttgcttgagaattccgtttgaggaagttggatggggttgtgtttggcgtaacattcaaatacttagctcacacttactggcacaaagggcagaaccaagagaagctatgtatggtggttcagggtttgttcctgatatcccatcactccagaggtggcttgagattgcttgggaaaggggttttgatgcgcctggcgctgatcagtttaaccatgctatctag

SEQ ID NO: 100399 - DNA, 372 bp, Glycine max
  Peptide Sequence Number=SeqID_217177
atgtccgcgtactgttccttcttcgaaacaaagttctcgtcccccatccacgcgccgtgtagcaacgcgctgccaccgagcaccacccagaagaagcacagcgactccggcggcgttaaagaggtcgagaacgaacacgcgaatcccaacatcgtggaactcagcaacgcccacgacgcgaaagtcgacggagaagtaaacgacgtagatgaaggcggcgaagaggagcattggggtgtcgtttttggtgtaggcgaggtaggttatgatgccgctgctgattgtggtgctgagaaaactaaagatgtcataaagtggcagcacgcgcgggtttggcgcgtgggcgtcggaggaggtggcaacagggagtag

SEQ ID NO: 100400 - DNA, 2598 bp, Glycine max
  Peptide Sequence Number=SeqID_217178
ggaaaacctcctgattggcaagactttgttgggattatcacactccttattatcaattcaacaataagtttcattgaggagaacaatgctggtaatgctgcggcagctctgatggctcgtttagcacctaaagctaagttccttcgagatgggaaatggattgaggaggatgctagcattcttgttcctggtgatataattagtgttaagctaggggatattatccctgcggatgctcgtctacttgaaggtgatccactgaagattgatcagtctgcacttacaggcgagtctcttcctgtcacaaaaggccctggtgatagtgtttattcaggctccacatgcaagcagggagagatcaatgcagttgttattgccacaggagttcataccttctttggcaaagctgctcatcttgtggactccacaaatcaagttggtcatttccagaaggtcctgactgcaattgggaacttctgcatatgttccattgctgtgggaatgatagtagagataattgtcatgtacccaattcaacaccgggaatatcgtcctgggattgacaatctgcttgtgcttcttattggaggaattcctattgccatgcctactgttttgtcagtgacaatggcaattggatcccatcgcttagctcagcagggtgctattactaaaagaatgacagcaatagaagagatggcaggaatggatgtattatgtagtgacaaaactggaactttgactttgaataaactgacagttgacaagaatcttattgagatttttgctaaaggagttgacgtagatactgttgttctcatggccgctcgggctgcacgattggaaaaccaagatgctatagatgccgctattgtagggatgttgggtgatccaaaagaggcaagggctggtattcaagaggttcacttcctacccttcaatccaactgacaagcgaactgcaatcacttatatagacggtgaaagtaaaatgcatcgtgtcagcaaaggagcaccagagcagattttgaatcttgcacgcaataaatcagagatagaacgcagagttcattctgtcattgataagtttgcagagcgaggattacggtctcttgcagtagcttaccaggaagttcctgatggaaagaaagaaagccaaggtgggccttggcaatttattggactcttgcctctatttgacccacctagacatgatagcgctgagacaatacgaagggcattaaatcttggagtaaatgttaaaatgataacaggtgatcaactagcaataggaaaagaaacaggacgccgtctggggatgggaaccaacatgtacccttcatcggctttattgggccaaaacaaggatgaagcaattgctaccttgccagttgatgagttgattgaaaaagcagatggatttgctggtgtttttcctgaacacaaatatgagatcgtgaaacgtttacaagctaggaaacacatatgtggaatgactggtgatggggttaacgatgctcctgctcttaaaaaggcagatattggaatagctgtcgccgatgctactgatgcagctcgtagtgcttctgatattgttctgactgaacctggtctcagtgttatcatcagtgctgtactgaccagtcgagcaatattccaaaggatgaagaattacacaatctatgcagtttccatcacaatccgtattgtgcttggtttcatgttactggccctcatatggcattttgattttccaccattcatggtgctgattattgctattcttaatgacggtaccattatgacgatatcaaaggacagggtgaaaccatctccatatccagatagctggaagttggccgagatctttaccactggaataattcttggtggttatttggctatgatgacagttattttcttttgggcagcatataaaacagattttttccctcaaacatttggagtctcaagtcttcagaaaaaggatagggatgactttagaaagcttgcctcagcaatatacctacaagttagcacaattagtcaggccctcatattcattacacgggctcggagttggtcttatgttgaacgtccgggtttgttacttgttgcagcttttgttatcgcccagctgatagctaccttaattgcagtttatgcaaattggagtttcgctgctattgaagggattggatggggttgggctggtgttgtttggctttacaacctcatcttttatatcccacttgactttatcaagttcataattcgatatgccttgagtggaagggcttgggatcttgttattgaacaaaggattgcttttacaaggaaaaaagattttggaaaggaagaacgtgaacttaaatgggcacatgcacagaggacgcttcacggccttcacccaccagagactaagatgttcaatgaacgtacaagttacacagaacttaatcagatggctgaagaggctagaagacgagcagaaattgcaaggctgagagaactgcatacacttaagggtcgtgttgagtctgtggttagactgaagggtcttaacattgacacaatacagcaagcatacactgtctag

SEQ ID NO: 100401 - DNA, 267 bp, Glycine max
  Peptide Sequence Number=SeqID_217179
atgtcaaaagggcataaattactcaatttagagctcataactcaaatgacttggaaaaaatttgttcttccatttgatgagattgagtctaacgatgaatggataactgaagagggatataatgatgaggatgagcaacctcagagtgaagcggaatctaatgatgatgcacaatctgaggaagacctcgatgatgatggagatggtaatgaaagtgatgatattcatggagatgatcctattagagaatttgacatgattctttga

SEQ ID NO: 100402 - DNA, 460 bp, Glycine max
  Peptide Sequence Number=SeqID_217180
gtctattatggataacgttttaatggctttcgagatcatccattacctgagatgcaagagaagtggtaatcgagggttgaagcaaggagaccctttgtctccttacctattcctcatttgtgttgaagggttgagtgcccttattaaaagtgctcaacaagagggaaaggcaatggagctcaagaaaatgttggtgatgtatgagttggcctcgggacaagcaataaatttaagtaaatcagaggttttctttagtagaaattttgatgaagctagatgtgcaatgatatcaaatatcctaggggtgcatacaagaactggaataggagaacaaccttcagctttgtcaaaagcaagttatggaagaaaatccactctgttagtcaactacggaggagttacagcgcatgatgaactcatattggtgggggaacaaatgggaaagaagcgaagtgaatga

SEQ ID NO: 100403 - DNA, 120 bp, Glycine max
  Peptide Sequence Number=SeqID_217181
atggaggcagttggaagcaatggagggaatgggctagctgtgacgtgcagattgaagcagaatgaagggcatgacggagcttgcgacaaacttcggaggtcaccaccgagtcaagagtaa

SEQ ID NO: 100404 - DNA, 291 bp, Glycine max
  Peptide Sequence Number=SeqID_217182
atgttgggtgttataaggcacaagagtattcgccccgccttctccgcaatcagacacttctcttctgcagctaaagagttactatcaaatatcaaactttccgccgttgtttcgatgcagattactgtcagggatgctctcaactccgcactcgatgaggaaatgtcagctgatcctaaagtcttcttgatgggtgaagaggttggggaatatcagggtgcatacaagatatccaaggggctgctcgacaagtatggccccgagagggttctcgatactccaatcactgag

SEQ ID NO: 100405 - DNA, 483 bp, Glycine max
  Peptide Sequence Number=SeqID_217183
atggcaaacccaaagacacccattgtccttaatatgaaggatcttgtgatagttaaaccctctaagcctgcaccacctgaacttcttgcactgtccaccattgacaaagccctctctaaggcctttgtttactattatccacttgctggaaagatagtgacatttgatgatggaaaacttggaatcaactgcaatgttgatggaattccattcttggaggcaactgctaactatgaactctcttctcttcactaccttgaagggattgatgttccaacttcacagaaactagtgtttgatgatgataaccctaataattctcatgatcaccctttggttttcaaggtgaccaagtttctctgtgggggtttcacccttggaatgggcttgtcacacagtgtttgtgatgggtttggtgcatataaattctttagagccttggctaaacttgcaagtacagtggaaaaagtgagccatcagtga

SEQ ID NO: 100406 - DNA, 324 bp, Glycine max
  Peptide Sequence Number=SeqID_217184
atgatgatgaagaagcatgatgaaggaaagcatagtgagaatgaagaaggaattggaaatgacccaagtctcacatcaattatagatagtgccaagatagaatatataagtgagggggttatctatcatattatccatgtatcaaatccaaaagtgttaggcatgaacaagtgtattgggaataacccaaatctcacattggttagagacagtgccaagataaaatatataagtgggagacaaccctcatcttatgagctacctttcggagttgagttagacacaaactcacattctaagaagggtgttgatctaagtgaatag

SEQ ID NO: 100407 - DNA, 264 bp, Glycine max
  Peptide Sequence Number=SeqID_217185
atggttacaaccacccctcaaccacgcataaacctcgagttcttatttgattccaacggcaacaacaaccacgggttcaggttcagattctcacaacttcaggttcatgcgggcgccgacaatgagggtggggtggaaatgcagtatccattgcaaggccggggcctcccggaagagagggagcttcggggaaggacggctagcaacactaatttaacgatgttaaacaattttaacggtaggaacctatcaggaattaaatag

SEQ ID NO: 100408 - DNA, 3516 bp, Glycine max
  Peptide Sequence Number=SeqID_217186
atgtctggtgaatcggctcccaaacccaaaccacgattagtgttatgtcctaaatgctggcaacttcttccagagtctccagattatgatgtgtacaagtgtggtggatgtggcaccactcttcaagctaagaaacgaagaaatggggctgtgaactcagaatccaacacacatgaaactgatgcagctcctagaaatgcattgaacaaggaatccagtacacgtgaaactgatgcatctgctggaaatgcattgaactcagaatctagaatgcgtgaaactggtgcagctcctacaaatgcattggatcctaaaactgatgataaaaaatacagcaatggagagctgctagttagtgatcaggggaatggtgtgaggaaaaaatcaactagttcttcctcagaagaatgttctttggatggacaagataaaagggatcaaattgaaaatggtgaatgcaatggagagcaactagccgcttctcaggataaaggtttcaaggaaagagcaactagttcttcctcaggtgaatgctctttgaatggaagtggtggaagtgatcaaattgaagatggtgaatgcaatggggagcagctagtcacttctcaggagaatggttttgaggaaaaatcaactagttcttcctcaagagaaggttctttgaatggaaattatggaagggagcaaattgaagatggtgaatgcaatggagagcagccacttatttcttatgagaatggtttgaaggcaaaaacagctagttcatccccagaagaatgttctttgaatggaaatggtggaagggatcaaattgaagatggtgaattcactggagagctggcatgtttttctcaggagaatggtttgagggaaaaagcaactacttcttcctcaggagaatgttctttgagtggaaatggtggaagggatcaaattgaaaatggtgaatgcattggagagcagctagccacttctctgagggcaaaagaaactagttcttcctcaagagaatattctttggatggaaatggtggaagggatcaaattgaaaatggtgaatgcaatggagaacagataggacagttaaatttaccagaggaagaactggaaaatgagattgatagccttaaattatcagatatgagaagacatacagtgtcctacaatcgttgttcagatgaggtaactcactttgagattgaggcctcagcagaattgatggcagacagttcagtagaaaatgcaaagaacacaaaccttcaactagaaggagaagagctaagtaatggaaatgtgccattggaagaagcagtggagcacttaatttgtgcattcgataaagaagatggcaatgatgagaaattggctccagtacaggaaaagtctgaagtggacattgctggaaatgatatagatgtagtagaagagttaaataatggaaactcgttactagaaagagcggaaaaagatttattttctggattggatagagaagaagtcaataatgataactcagctctagttggtgcaaatcctaaagtggacattaatggaagcaatgaagcaggatcagagaaatttaataaccgaaacttgttattagaggtaacagaagaggagttgaatgagtgtgcattggatggtgaagatcgtaaacatgaccaatcaggtctagtgggtgcaaaatctgaaatggacaataccagaaatgcatctattgcccaaaggttaagtactgaagaaggaagaatatcacatgcttaccctcgtgaacttgaaaaaggtacatctggttatcatgcttcttttaaagccattcaccatcgctttgatcgtgtaagatctgttgatacatttgttaatgcagaagtaattaatcccggttttgagactagtggtacactgggaggattgtctaaatcctcaaccattcaaagctatcatgcttatgatggcagcatctcttcaaacgatggggtggacgagcagttccctaatcagtatgtagattctcttgagaacacttacactgttgctaatggtgtttctgagggagggtccagaaaaggaaaaggccttgttaatagcatgttatgtggtgatcttgaaacacaacaccaatcatattttcgtgagagaaggcctcgtgttccaagagacagcaggaggaatctaaatgaagtgccagagactacaagacatggtcgtgcacattggatgagaacaaagaaagatgagtttccagccagagtgcctaaccatcgaagtggttcactatctggctatgaaagtggcagcacgtcaaatcaaatgcatgatgagttatactgcagctctagctatcgttcaccagactcttttgatgaccctgaccaggagaagatgaaactgttgagaatggtttataaattgcaggaacaactcaacagaacttgctatctaaacggggaaacaaatggaagactgtccatgggaagtcatgtttctgcatatcaaagccatgatcttcatgaaagaagactttatcatggtttggattatcctaggtgtgatgagatatgtagccatggaaccgactggtgccaaaagcataattttccacatgtaccttgtttaactgagccaacgagcagcatacaccatgttgatcattccttttttccttgctgtccccaacaatgccaatgctccacagagttgcctccatgtgatctttatcagcatgaagagttatgcaggcctagtccaggtcacaattgttgttcacctcaccattcctatccctcaggtccacaatggctcaaaaacctcccagcacatggccatgaaacaaaatcttgtgatcagaagcttaggcctgaggtgaagaaatatttttgggagaaaccgagcttgactaggcaacattaccgaccggtagcaggtggagcaccatttgtcacttgtcataaatgcttaaagctgctgcaactgccttctgatttcctccttttcaaaagggtatatcaccagctcaaatgtggtgcatgtcaagaggtactcaagttttctctgcagaacagaagtcatatagtctcgtatgcaccaaatggtctaaagcccccatcatcaagtagccttgatgatcaaaatgaggtgattgatggaagcaatccacattcagagtctcatgcagaccacatttcatattctgatgattatggtcattctgttggtaaaagctactcctcagaaggtgatcctgtgtctgcggcaccattacatcccttgcatggcagtgcatatgataagcaaactgtctcttctggcaccttggagcctataacagagaaggacaaaactgcttcaagaagtcttagtacaagtaaagctccagtggaaacagacgaacaagctgtgaactcctccaataatgtgccatcagaattggaggcacattcacagccaaaaagctcaccacttcatcaactgatgggctatacctcgccgagtcaagtgataagagggattccgtaa

SEQ ID NO: 100409 - DNA, 399 bp, Glycine max
  Peptide Sequence Number=SeqID_217187
atgtcgtatctcgtgccatcaaaaccttcctctccatttctcgcctttgcatgtgtcgaaaaggtcgacggtgacgccgattttgcagctggcgtcggcggtgaggctgggcatgggaagcctgatgatgggcgtgggagtgttgatgtggcattagcagccgatgtgggacttggatattttccaagttgcactccaatgattgagacagccgatgtgagacttgggtatttcccaagtgttattgatggggagtcgtggacgttcgataaccatacattggtacttcgagatgcatatcatgtaaggcatttccgagactttgagctggagttggagttcaagaggcagcaatccgaatgcatcaagaaatttagtaactattgttcaagaatatga

SEQ ID NO: 100410 - DNA, 306 bp, Glycine max
  Peptide Sequence Number=SeqID_217188
atgtcaaagggtcctggtctctactctgacattggcaagaaagcccgagatctcctcttcaaggactaccacagtgaccagaagttcaccatcactacctactcacccactggagttgctataacatcctcagggaccaagaaaggtgatctttttgtggctgatgttaacacccagttgaagaacaagaacatcaccactgatatcaaattagacactaattccaattctgttcgagccctgctaaaagggcagtgcggtagatgtgaggtagaactgctattcaatttgctaacatcagattaa

SEQ ID NO: 100411 - DNA, 324 bp, Glycine max
  Peptide Sequence Number=SeqID_217189
atgggcccagttttgccagactcgcagagacccttcttgggaggatgtgcgcaaaaaggcacaggccatccagaagtagaacactgcccccacgttttgtctcatgggggttatgactatttggagcagaagctcctggctgagaagatgaagaagaagctggaggaagctgcacagtcaagaagcgttgatggcgtcatcgaccctccatcctcggtcagacgccacgtgaagtggaagatggcccgcacgaaaaaaacaggggagatgacgattgaggccgcaaaggaaatcgctgagaagatcgattcctttgaggagtag

SEQ ID NO: 100412 - DNA, 302 bp, Glycine max
  Peptide Sequence Number=SeqID_217190
accaacgtcttggggctaatgtaggatctgctcaaggacctacaggtttagaacctctaaggggtccgaatggtttagacttgagtagactgaaaaaagatatacaggcttggcaagaacgccgttctgcggaatatatgactcatgctcctttaggttccttaaattccgtgggtggcggcatttatggcacgcgggaagagctcgcgcagctgccgcaggatttgcaacacggaattgatcgcgattttgaaccagttctttccatgactcctcttaattgcgaccatgagatcctatga

SEQ ID NO: 100413 - DNA, 492 bp, Glycine max
  Peptide Sequence Number=SeqID_217191
atgcttacccaaggttttcacaaattttacggaagcattacggaatccatggaagccccgaaaaccatttttcaaaaacgtggaggagcttgccacccagttgcttcctccttaagcaacccaacttccaaaatgttccggaagggcctagacttgaattgctatttacacccctatcttgataagttcacccccccatttttgtatttttggctgttttctttccgaaatctcacgaaactttacggatttcgtaacgacatccattttctttccggattgttgcgaaactttacggattatgcaacaatgctcttgttgacttccggaatattgcggaactttacagattgcgcaacaatgtttcttttttacttccagaatgttgcggaactttacggattacctaacgatggggttaagtacctcgaggtggtcaagcgaaggttgcatgccatcaaacaatggtccccggatgaaattagggtatga

SEQ ID NO: 100414 - DNA, 207 bp, Glycine max
  Peptide Sequence Number=SeqID_217192
atgtgcaacaacaatcatggtagtggtagcgatgattgtagcatcaatcatggtagtaacaacgacaacagtcaagatggaaaggtgatggtggtcatggtggtggtggcgggggtaacaatgatcaaggcgacgacaacaacaatgacaatcatggtgatggatgtaatcgtggcagcgatgattatagtggtggtgatgagttaa

SEQ ID NO: 100415 - DNA, 552 bp, Glycine max
  Peptide Sequence Number=SeqID_217193
atggtggaaccatcaaagaagcgcaaaggttcttcaagtagaagccaacagtactctgaggctcaagatattccaattccttcctccatttcctcctcctcattgttctcatctgaagaacaacgtatacggtacacaaacctattctcctctcattctatcattgaccctagattcatagatatggatttcttttctgatgagagttttgaatgcattcaagcatttcaaaactcaaatcccattccctttatgtctctgaaattgcatgtgtattttgaattggtaaaagttttttattcaaaccttgaaattcaagaaagtaccttaatttcagaagtttatgggataaagatggtcattgaccaatccctcttctatgatttgacccaattatctagcgacggtgtaccatttgaaggtacattggacgatgattggaagtttgatttttcggtacatgatgcccaccgattttcaaaccttgcacaggtttctgaaaaagatcttattgtcatgtgggcttttcataccggtcggcaaattgattag

SEQ ID NO: 100416 - DNA, 198 bp, Glycine max
  Peptide Sequence Number=SeqID_217194
atgcgtctattggagaaggaaacacgttggcggcttaatagtgaatgggtcctatttcttggggagatcccattgttatttctaccgagggaaaggatggacattctcatcctgggtcaaggtttatggttgtttgaggttttggctcaaaaggtttgcagaatggctggacatgatgtatgtcagggtgttagttag

SEQ ID NO: 100417 - DNA, 426 bp, Glycine max
  Peptide Sequence Number=SeqID_217195
atgttaccttgtgagtctattaggaatcattctaaaaagagttttaacagagatccagcagaaggtggctatgagatcccaactgagagcaagatattggtgaatgcatggtggctggccaacaaccctgcacactggaagaagccagagaagttccggccagagaggttcttggaggaggagttgcatgtggaagccaatggcaatgactttaggtaccttccctttggggttggcagaaggagttgccccggaatcattcttgcattgcctattcttgccatcactttgggacgtttggtccaaaactttgagctcttgcctccccctggccagtcccagattgacactagtgagaaaggagggcagtttagcttgcacatactcaagcattccaccattgtggcaaagccaaggtcattttag

SEQ ID NO: 100418 - DNA, 447 bp, Glycine max
  Peptide Sequence Number=SeqID_217196
atgaaagggtctttgtatgttgctgatttccatatgttatccacttctctttctatgagtaaatccaataacccttcctctccttgtcaaacccgtgtctctcctagtagtgtgagaggtttgagcttcaagcgacaaaagaagaagaataacaatggttttgttgtggtggggtgtgcaaaatgggatttggaagctgacatgaaaccacaagaagatgaggaaaagggtaggagtggaatggcaacgtttaggcacaagtgtggagaaagaaagggggttgtggagctgttggagtgtttggaaagagaagctataatgggtgaagatgtgggaaaagagccttctgattacaaccgaagggctcagatatttgatagaagttctcaagttttccaagctctcaagcaactcaacaatgatgttttcccagagtcttcacaatag

SEQ ID NO: 100419 - DNA, 2130 bp, Glycine max
  Peptide Sequence Number=SeqID_217197
atggcacctacactgtcaatttctggatttccccttttgtgttcctttgcttccccctcagacatagtgatgctggtctgtaatgcatatcatgacagcagaacagatcaaaatacattttggtggttagaagcactccatcatgctgagcagaacaaagatttctccactgagttgattaggaagattgaagaagccatttcaggaacttcaaacaattcaaagtcatcaagagtagcttctcggatctccataaaaaaagttgctgaacaatgtaatccagttagaactgacatcaacaacataccatatcttgttatgagcaatgttctagtatatagtttccgaagcataagctctttgaagtatcaaattcagacaggtttggatcagttagaggcctctagaaaaacgctcctagatcaactgctagaaattgatcagacaatggaaaaaccaaatgaagaaaatattgaatgtgtgggtaaatgtcgaaattgtcagcctaattgtgatggtccgtgtgctttgtgtgaactagatattttgtttcaggattatgaagcaagactctttgttcttaagaatgaacgtggaaggataatttcatctgctgaggaggcagtggattttcagaagaaaaacttggcattgaatcatttcctctcaaagctatcacaatctagtcacagttctacagtatctgatatcagtcatgaagaatcaaagaaaaggaatgttggacaaagagttgtggtttcaaaatcagcatctgagttggagctaattcttggagttttaaactactgcaagtctcgattaggaagagacagtgtctcagctgccaccaagcatttacatgtttttgaggggatgcgaaagcagtttggccacacaaggtctttggcattagctcaagctcagtatctgcgtgcacacgatgaaataaagatggcagtttcccgtttgcacccaagggaaaatgaagatgataaatctcttgatgatttaggtgaaaatgaattagctgcagctagctcaaacttttcccatgataagtttatgtcattgaccatgttgtcacagataaaaggaaaactccgctacttaaagggtttggttcaatctaagcaaaaactgcaattcgaaagtccaaatagttctttattcacacgagagacaactgcaatgtcaaactctacagaagagaagggtgcacttttatctaagactgatgatgaaacatgcccaatttgccaagaaaagctaggcaaacagaaaatggtttttcaatgtgggcacgttacatgctgtaaatgtttatttgctatgactgagaaaagacttcaaaataacaaacttcataattgggtgatgtgccctacatgtcgacagcatactgattttggaaacattgtgttgatgcacggaacgaatcttccaatccttcagtgctgcatagaattgacaattgaagcagtcacaagaagaatcctgtgggtaaaggctaatgatcatagagcaaaagttcttgtattttcaagttggaatgatgtacttgatgtattggagcatgcctttgctgccaataacattaccttctttcggatgaagggaggcagaaaagcacatgttgccatcagtcaatttagaggaaaacaaaatggcacaaaaggatgtgaagggtcaacaccaaaatctattcaggtgttgttgcttttaattcaacatggagccaatggactcaatcttttggaagcacagcatgcggtccttgtagagccgttactcaatccagctgctgaagcactagcaatcagtcgtgtacatcggattggacaaaaaaataagaccctcattcatcgtttcattgtaaaagacacggttgaagagagtatatataaattgaacagaagcaggagcaatcattcattcatcagtggcaacactaaaaatcaagatcaacctgttttaaccctgaaggatgtggaagccttactgtctagagcaccactaacaatgccagaaagtgatgaaaatcataacacaaacacgaatcttagacacttgccaccatcagtggccactgctatagctgctgagaggagacttaatgaacaaaggacatga

SEQ ID NO: 100420 - DNA, 1005 bp, Glycine max
  Peptide Sequence Number=SeqID_217198
atgcaagaggaaggattaaagccaaaccaggtcacattcattggtgtcctcaatgcatgtggctcttcaggtcatatcgaagaaggttgtaggctttttcggattatgactggagtatttggtattgagcccttacctgatcactatatatgcatagttgatctccttgggaaggctgggcaactagaaagagcatacgatctaataaagcagaatgcaaccagttccattgcaacaacctggggttctttattggcagcttgcaggctttatggtaatgtggaactcggtgagattgcagccaaacatctctttgagattgaccctgaggattctggaaattatgtgcttctagcaaacacttatgcgtcaaatgataaatgggaacgtgcacaagaggttaagaagatgaaactttgggacagaggttgtaatatcgtttctgtctgcaatctttgtgagcagaattttgaaaccagtgatcatctcttcttttggtgccctttttctgtgaagatctggaattggaagcagcagctgctaaacaaatcctttgattgttcatcaatccaaggtatcctttcttcggctgttttgggatggtctcctcaaatgaaagatactgttttggctgcggttattttttctgtctggatgatttggcactgcagaaacagaaaacgtttccatagccgagccatcacctatcaaagtgcaatggctcttattgttgctaaggacaaagtcactggcaacatgacttcggcctacatgagcaactcaatttcagagttcagcatcaatagagctttaggagtggttggttaccccaggaaatctgttcacatcatccaggtttatcacctggaaggtggaattctaaaatatcttgagattccagactcaagagacagagagcctctaggaaggagagtgctttgttttcgacagaagagtctctggggagcatggtttggtgccaggaaatttcaagtctctgggtga

SEQ ID NO: 100421 - DNA, 1420 bp, Glycine max
  Peptide Sequence Number=SeqID_217199
atggatacctcagagccctacaccggagcaatgaaaggcgccatgcataaacctcaagcaaacctaggggaaaatcagaagttttcacccaataggttccctgctacaagggtggagccttgggtagtagtacctatcaccttcagagggctacgcgccctcgtcttcagagggctgcacaccctcgcctttagagggctacactcccttgtcttcagagggctgcactccatcgcctacagagggctgcacgtcctcgccttcagaggacagcacatcctcgccttcatagggctacatgacctcgccttcagagggctacacgcccttgcctacaaagggatgcacgccttcgcctataaagggctgcacaccctcgcctttagagggctgcagtccttcgcctacagagggcagcacaccctcgccttcagagtgttgcacgtcctcgcctccagagggttgcacatccttgtcttcagagggttgcgcatcctcgtcttcagagggctgcatgccctcgcctttagagggctacatgccctcgtctttagagggctgcacgtcctcgccttcagaagactgcacaccttcgccttcagaggactacacgccctcgccttcagagggttgcgcgtcctcgtcttcagagggctgcactccctcgccttcagggggctgcatgccctcaccttcagagggttgcacgccctcgccttcagagggctgcatgcccttgccttcagagggctacatcccctcaccttcagagggttgcacgtcctcgccttcagatggcttcacgccctcgccttcagagggctgcacgccctcaccttcagaggactacacgccctcgccttcagagggttgcacgccctcgctttcagagggctagacgccttcaccattagaggattgcacgccctcgcctttagagggttgcacctcctcgccttcaaagggttgaacgccctcacctttagagggttgcacgtcctcgacttcagagggctgcacaccctcgccttcagagggctgcacaccctcgctttcagagggatccacatccgcgccttcagagaactcaaggtctctggctttgatgatgaggagactatcgcacaactactatgcattctggggcaagattttgcacagccgcggcaaggagacgaggatcgcgcccaccagacacctagtggacttggagaagtccaacagggtcctggggttctagctctgattacgggccttttcaattctacggagtgcccatcgcccccaacaagacgcaccgccaccacctctagagttcacctcaactcatttacaaaggctggagtgttgcctacaacacatggccgaccagtaggcgaccaagtccaaagcaatggtgatgtaagctccattggagctt

SEQ ID NO: 100422 - DNA, 669 bp, Glycine max
  Peptide Sequence Number=SeqID_217200
atgtattgtcagatgatgggcgcacattcaagggatgaaagactacttatgtgtttcttccaggaaagtcttgctggggtagctgtcacctggtacactcatctagaaccttcccaaatccattcttggaaagacctaagggttgccttcattaagcaataccggtacaatttgggtgcagctccagataggacgcagctacgggacatgtgcaaaaaggagcacaaatctttcaaagggtacgcccaaaggtggaaggatatggcagctcatgtggcgcccctaataatggagaaggagttgatagcaatgataataaacacattgccaatgtcctaccatgcggaaatggcgagttacatgccttcaagcttcaccgatttagtgtttgccggcgaaaggatcgaggtagctctgggaattggcaagtttgatcatctcgcattgacaaggagaaggggaaggaacccgtgttctaaccgcttcctacatggccaaatttcccacctactcaaccatgccattactcagccgatatcggcccttctcattacccacctcccaatcagccacaaagtctgcctgttgcacaaccaatgtcgaactccacctttagcacaaaccaaaacaccaattgaggaaggaattttgcaaaaaagaaacttgtag

SEQ ID NO: 100423 - DNA, 240 bp, Glycine max
  Peptide Sequence Number=SeqID_217201
atggcggcttgcagcggccactggtggctgtgggttgtgtggaagaagcttgggacattggaaatggttttagggaagaggaagagaaaggaaaggttgtttttccaaggctacacgaaaaataaggcttgcaacactcaagtgttcctgctctcaagaaaggaagcatctcgaacacaccagtactcatatcagcaatgttcaggtcatggacaactttcctatgaccctccaaactaa

SEQ ID NO: 100424 - DNA, 435 bp, Glycine max
  Peptide Sequence Number=SeqID_217202
atggatactttgatgaccaggcagtatgttgcatcattggcccgagctcttatatattgctatggaaagcatgtaatacatagggatattaaaccgaagaaccttcttattggtactaaaagcaaaaagtggaggaataacgaagaaaataagaaatctacgacaaagtccaattcagatgcctcgctcaacgtgaagtttgcgctgagtgggtttggagacacgggcgctaagcgcacagcaggcgctaagtgggcaaaacagacacaggcgctaagcatgaggagcccgctaagcgcacgatctacacactctaagcgagcctacaaaggcccaaagcccacttcaacagctataaatagagagccggaccaagggggaaaacacacccccacaaccccgaagactcagagctttctaatgaatacatcttaa

SEQ ID NO: 100425 - DNA, 387 bp, Glycine max
  Peptide Sequence Number=SeqID_217203
atgaataacatcgtttgttttgcaagtgaaattagtgtctcaacccaaaagaagagagtgataatcgaagaacttcttaaggggcaagaagctgctacccaactcaaggttcttcttcttgagaagcccttttggagtgaagcctttctctcttttcaggaagtcatggacaatgttctgagatctttttcagaagctctttctattctaaactcttcttcttcttctgaaccagctggttcagcagctgaggtggctcatcggagtctcctgaattccggccaaaatgggtcgccggtggcagcttccggcgagaagagattccagaaggatgggagaggtcgctacaatagaagtttttcacgacaaagcgatttgggttgctga

SEQ ID NO: 100426 - DNA, 264 bp, Glycine max
  Peptide Sequence Number=SeqID_217204
ctgtccttagagtatctcccatgtgatttaatgataaaatttccacaatttcagagcagtcaccctcagtggaccatttgggctcagtgcgcatctgacgctaagcgccgcttcagcgcgcttagagtgacaaaggaatctggcagagctcaagagtcaaggccttgcgctaagcgtgagatcagctcgctaagcgcgatggttgtccttagccaggctcagcgcatgactggcgctaagctcaaattcactaactcacactaa

SEQ ID NO: 100427 - DNA, 258 bp, Glycine max
  Peptide Sequence Number=SeqID_217205
atggctgattcatttggtggaagtggaaaggctttttcagagggaaactgcgaaggacagatcaaagtcgctactgatgacttatcttctgctaataagattggggaagccggttttggtcctgtatactgtagacaaaggatcaagctgaaagttttgatgatgccaaaggattacatgaatcatatgcttctcaaagatttactcaagacaaagcaattagagttaatcaagatggatgatcaagacagtctatag

SEQ ID NO: 100428 - DNA, 776 bp, Glycine max
  Peptide Sequence Number=SeqID_217206
atgccgattggcggtgacagtagcctgagctacagccagcaaaccagcggtaagcaaaccactcactcggccagtttttatgaccggctggacagtaacaacagctacagcctgagcgccggccttaatagcgatcgccgtcagtcgttcagcgggttttacagtcatcagggcagtctgaccagcatgacggccagcgccagcgcgcagcagggacagtaccgcagcgccagcctgtcactgcagggcggtttaacgctcacgccgcagggcgcggcgctgcaccggctgggcatgcccggcagcacgcgtctgatggtcgataccgatggcgtctccggcgtaccggtcaacggtggtggcagtaacacgtataccaatttctttggcaaagcggtgatttcggatgtgaacagctattaccgcaacaccgccagtatcgatgtcaccggactggctgacaacgtggaagcgtcgcgcccggtaacccagatcaccctgaccgaaggcgccatcggttaccggcgttttggtgtgattaaaggcattaaagccatggctgccatccggctggaagatggcagctggccgccctttggtgccagcgtccagagtaacggacgcgaagtgggcattctggatgatgacggcctggtatggctgagtggcattgaggccggtgccagcatggatgtgcgctggaacggcgaaacccagtgtcagctggcattgcccgatcctctgccgcagcagttgctcgacgaaggacagaactt

SEQ ID NO: 100429 - DNA, 291 bp, Glycine max
  Peptide Sequence Number=SeqID_217207
atggatttacctaaagattggaaacactctgcaaatatttatgaagtcaatgtaaggcaatatacacaagaagggacttttagagcttttgaaaaagagatgccccgtttaaagtttatgggaataaaagttctttggtttatgccggttactccgattgctcagcaaaataaaaaaggaagcctgggaagtccatatgctgctgcagattatacttctgttaatcctgaatttgggacacttgatgattttaagcacatggtaaatgaagcccacagattaggatttaag

SEQ ID NO: 100430 - DNA, 597 bp, Glycine max
  Peptide Sequence Number=SeqID_217208
atggtttacaagatccgcgtaatattagatgcgaaagaagatattttccgtgatatcgaagtgaagggaaaacagacactatggaatttacatctgggaattaagagtgcgttcagcttgcagggagatgaactttcaacttttaatttattggaagaagatggtacgatagtaaaaagtgttccattagaagatatgagtgatgacggtgatggggaaattatgtcagatgtttatattgatgaagcttttgcaagtgtaggaaataaagctcagtttcaatatggacttctggatctttgggaattcttctgtgaattaattgaagtaatcgaggaaaccaaaggagttaattatcctataacagtatacagatttggaaacgttccgttaaaagctccaagcaagagcggaaacgggggtggatctaaaaagaaatctgcaatgcctcttatcgatgatgaatttaattttgatgacgatttcgaaagcggagggaatttttccgatgaagacgacagttttgatgatgaggaagaagaagactacaatgacgatgtattcgatgaagatgatgacaacgatgatgaaagataa

SEQ ID NO: 100431 - DNA, 405 bp, Glycine max
  Peptide Sequence Number=SeqID_217209
atggcggataccctgccagtactggatctggccctgctggaactaccggacgcagagcaggcagcttacctggcgcagctgcgggagaccgcgcgtgacgtcggtttcttctatctggttaatcacggcatcaacccgcaactgctgcacaacgtgcagagtatcacgcgggcgttttttgccctgccgcaggcggagaagcagcgcgtggcaatgatccactcgccgcattttcgcggctacaaccacgccggcgtggaatacacccgcgaccagcgcgatcagcgcgaacagtttgatatcggtgccgaacgcgcggcgctgacgctgcagccgggcgatccggcgtggaaacggctgcaggggcccaacttatggccggaggcgttaccgcaattgcgtccg

SEQ ID NO: 100432 - DNA, 231 bp, Glycine max
  Peptide Sequence Number=SeqID_217210
atggtggctcgtggtggccatcagtggtcgtgggtggtggagaagaaggtgttagtgtttgggtgggcgtttggagagaaggagagtgaaaaaatcatgtttttcatgctgaagaatcaagcaacatatgatgtaatccagtcatatgctcatgctatgccttctctagatcccataattgaatgtttgttggttaaagctaggttttcagatgttgcaaagctcagatag

SEQ ID NO: 100433 - DNA, 1215 bp, Glycine max
  Peptide Sequence Number=SeqID_217211
atgaatgaggaagacgctaagcgcgcctgcgcactaagcgtcatcagtgctaagcatgccctgtgcgctaagcctgaggttcattctactgaggttgagctaagcgtgccctactgcgctaagctcaagaaaatactcccagagaggaatgtggtgatctactacactgagtttgatgacttcaaggaggaaatagagagaagaaaatgggatgaagagttaactagttttatagagggtagtatcgatgttgccattgtcagagaattctatgcaaacctctacgatccgaaagataagtcacctaagtttgcactcctgaggcctgatcctcaagaattggcagccaagctctgtatcccaaggaggggattcgagcttaatgttgatggcttgcccttaaagatcctcaggaagaatttgactactgttgctcacacctggagcgtactgtccttctccaacttgatgcccacctttcacacatcagacattactttggatatggccaagcttggatttccaaccttaatcacaactttgtgtaaagctaaaggagtcacttctgattctaggaccctggagagtctcagccccgctattaacattgcttatatgaagaagaactgttggaatcttgatgatccaacagtgaccttcagaggaccaaggaaggccaagggtaagcggtttgaggctcctccatcttctgaggttccccctaccacatcagttccttcttcagtaccagcttcttctgctccagctttacctgcaccattaccagctcagttaccagcttctattggaccactttcatttacttcagagacactacatgccatgatgcagagcttgcacagaggacaggtcattatgatgcagagcttgggcataccctctatcatgagtatggaggaattccacacccaggtagcttggccaggagtccagccttctctttttggagggggtggggccttcgcagcccaagagcccgggcctatagaggagcatacaccagtagcagaggatgagcacactcctcctgagcccttttcatttgcttctaatttaattgtggctcaagaggaagtaccttcaccaaagctcatgctagagccatcttctacacctatttttgaggatattcagccatctgcatcagcattggaggcagagcagcacatctcacaggatctatcagctgctccg

SEQ ID NO: 100434 - DNA, 204 bp, Glycine max
  Peptide Sequence Number=SeqID_217212
atgaacaagagttacttcaggtgcggttacaagtatgatcaaggttgcaaagcaaacaaacaggtgcagcgggatcaagagaatccgaatatgtaccgaattacgtacattggaattcacacatgcaatgccactccaaaggctacacattcggccactgattctaacacttgggaatcatttcttctgaattctgatggtgag

SEQ ID NO: 100435 - DNA, 369 bp, Glycine max
  Peptide Sequence Number=SeqID_217213
atgaataactccctttgtcctgaaagtgaaattagtatctcagccaaaaagaacagaatgataatgaaagaacttgttaagggtcaggaatctgctactcaactcaaggttcttcttgagaagccctttgggagtgaagggtctctctcttgtcaggaactcacggccaatgtcctcagatctttcactcaagctatttctatcataaactcttcttctgcagatgaggtggctcatcggagtctcctgaattccggccaaaatgggtcgccggtggccgtttccggcgagaacagatcccaaaagggtgggagaggtcgctacaatagaagtttccgcgatttgggttactataagaggctttgttga

SEQ ID NO: 100436 - DNA, 597 bp, Glycine max
  Peptide Sequence Number=SeqID_217214
atgatgctgtacggtctgctctggtctgatctggtctggttgtacagtgtactctcatgcgatggtcaaatccttgtcggattgagtgggtgtcagaagcaatttgtgggtgggtgctcgtgggctagtagccctgtacttaaccattattcgatcgcctttgagataatctgctcagaagaaatcatgagtgacaaaaatgatgggggtgtgtcttcggacgaagatttgagtaccggagatggtgatgctcaagatggccaattaaagggtgaagatcgtgagctcaaggataggcttttacgaaagtttgggagtcacatcggtactttgaaactcgagttttcaaagaagaaaaagaagggtaagcttccaaaggaagcaagacaagcattgcttcaatggtggaatgttcactacaaatggccttaccctacggaagctgataagattgaactggctaagtcaacagggctggaccagaagcaaattaacaattggtttattaaccaaagaaaacgtcattggaaaccatcagagaatatgcagttttctatgatggaaaattttaacggacggatccttgctgatgaatga

SEQ ID NO: 100437 - DNA, 672 bp, Glycine max
  Peptide Sequence Number=SeqID_217215
atggcgatgacgtttgttccttcaacatcttccagtttccgaccgacgttgattcgatgcgccaactccaacgagcggcgggcgctgtttagccgcattgctcctgtctatgataacctgaatgatttgctgagccttggccaacaccggatttggaagcgaatggcagtgtcctggactggagcgaaaatgggagaccgtgtgttggatgtgtgctgtggaagtggggatttgtcctttctcttgtccgatcaagttggctctcatggcaaggtgattggtcttgatttctcgaaggatcagctattgtttgcctcatctcggcaggaatcactttcaaagaattgcttcacaaatatcgataccattggtgatatgggaaggtttaatggtttgttgcaagataggtgggttgaaggtgatgctcttgacttgccattttctgatggttggtttgatgctatcactatgggctatggtcttcgaaatgtggttgataagcaaaaggccatgcaagaaattttccgcgtcctaaaaactggctctacagtgtctatcctggactttaataaaagcaatgagttgctaacttctgcatttacgcaatgctccattttgaacaagtgtagtcactcttctgatcttcttagtaaatcggaaggcttggcttga

SEQ ID NO: 100438 - DNA, 895 bp, Glycine max
  Peptide Sequence Number=SeqID_217216
atgaaagaacttgttaagggtcaggaatctgctactcaactcaaggttcttcttgagaagccctttgggagtgaagggtctctctcttgtcaggaactcacggccaatgtcctcagatctttcactcaagctatttctatcataaactcttcttctgcagatgaggtggctcatcggagtctcctgaattccggccaaaatgggtcgccggtggccgtttccggcgagaacagatcccaaaagggtcggagaggtcgctacaatagaaggaagaatgcacttacatggaccatactctcatgcaccactgatgataatcatgcatggaggaagtatggacaaaagagaatcctgaattctgaatttcctaggtgcagtcacaagtatgatcaaggttgccgagcaatcaaacaggtgcaggtggatcaagagaatccgaatatgttgcaaactacttacattggaattcacacatgcaatggcacccctatggctacacattcagccataggttctagttctactgaatgggaatcatcatatcttctgaattttgatcatcatgactccaaggtaccaaatgtacaagatcaccacattagctcaccaaacctaactataaaacaagaatttcccaaagaagacacccatagtgatgttgcagatcataagtactcggatcctaacttgtggtcagatctaaaggattttcaaccattcaagcctaccattatgcccttcaggatggaatctgataataataataataataatactaatgcagataatgtgcattcttcatgtacagactatcaacgtctgaacatgaattttgagatggcatctgttcattttgacactgacttccactttgacgaaagtcactttgacgaaa

SEQ ID NO: 100439 - DNA, 1947 bp, Glycine max
  Peptide Sequence Number=SeqID_217217
atgtccttcgcatcattttttcttatcttcctttgttaccatgcacttcctgctcttgctgatccaagagccacagaggtagcagtgttgtgcaccaacacaacagcaccaatgcctcagagacaagctttcttaacaaacttctatgatgccttggaagccttaaccgctttggttacaaggcaaaagtatgcttttgttgttaaagggactactcaaaataatgccactgtctatgcttttggtgagtgcaggaaagatcttacaaaaccagattgtgatgtgtgctttgcacagtgcaagacacgtgtccttaggtgctctccatttcagagaggcattgatggtggcatgtttttctttgatggatgctttcttaggtatgatggctacaacttcttcaatgagagtcttagtcctcaggactttactgtttgtggaaccgaagattttagtgggaattggagtgtgtataaggccaatactgtggagttggtgagaaatttgagcattgaagcacctaagaatgaagggttctttgtggggtatgtgagtcaaaggaatgtgactgtttatgggttggctcaatgctggaagtttatgaatggcagtgcttgtcagaactgtttggttgaagctgtcactaggattgattcttgtgcttcaaaagcagaagggaaggcattgaatgctggatgttacttgaggtattccacacacaatttctataatagttcaaacaacaatgttcctcatgaaaatcaaggacacaaaaatcttgctataattgtggctgtagcatctgcttccctggctcttctgctgattgttgcaaccgtggttttctttgtgaggacaaatttactgaagcggaggagagaaagaagacaatttggtgcacttttgaacacggtgaacaagtccaaactaaatatgccatatgaaattcttgaaaaggccacagattacttcagtcattccaataagctaggagaagggggatctggatcagtttataaaggagttctgccagatggaaataccatggctataaaaaggcttagctttaacacatcacaatgggcagatcatttcttcaatgaggtcaacttgatcagtggcattcatcacaaaaatctagtgaagcttttagggtgcagcattacaggacctgaaagccttcttgtttatgaatttgtgcctaatcacagcctctatgatcacctatctggtagaaagaattctcaacagttgacatgggaagtcaggcataaaatcatattgggaacagctgagggcttggcctatcttcatgaggaatcacagagaatcattcatagggatataaaattagccaacattctcgttgatgataacttcacacccaagattgctgattttggacttgccagattatttccagaagacaagtctcaccttagcacagccatttgtggcacattgggttatatggctccagaatatgtagtgttagggaagttaactgagaaagcagatgtgtacagttttggggttctaataatggaaattatatccggcaaaaagagcaaatccttcgttgaaaattcatattccatcctacaaacggtttggagcctttatggatcaaacaggctatgtgacattgttgatccaatcttggatggaaattatccggaaatggaagcatgcaaactcctcaagatagggttgctttgtgcacaagcatctgcagagcttagaccaccaatgtcagtagttgtggaaatgattaacaacaatcatggaattactcagccaacacaaccaccatttcttagttgtagtagtgcagaattcagcaaatttattttacaaggagagagttttcatcctatatcctacactcagccttcagaggacagcgtgaccgaaattctgattcagcataaacgggttacaatataa

SEQ ID NO: 100440 - DNA, 1959 bp, Glycine max
  Peptide Sequence Number=SeqID_217218
atgatgaaacaagtctctctcgtctcttatcaatgcaaatttttccttctcatcaagttactgctactatcaaagactgtaatagcagaaccaagggccaagacagtcctaacaacatgtggtcatgaactagagcacaatactactatctttgttccaaattttgttgcaactatggagaagatcagtgatgagatgcgcaaaactggctttggcacagcaattgtagggacagggcctgatactaactatggccttgcccagtgttatggagatctttcattacttgactgtgtattatgctatgctgaggcacgcacggttcttcctcagtgcttcccttataattctggtcgaattttcctcgatggttgtttcatgagggctgagaattatagtttctttaatgagtatttgggaccgggagacagagctgtatgtgggaacacaacaaggaagaactcgagttttcaagcagcggcaagacaggcagttctaagagcagttcaagatgcacctaacaacaaaggatatgccaaagggaatgttgctgttgcaggaacaactaaccaatctgcttatgttttggctgattgttggaggactttggataaaaggtcttgcaaagcatgtcttgagaatgcatcctcttccatattgggatgcttgccttggtcagaagggagagcgctcaacaccggttgcttcatgaggtactcagacacagattttcttaacaaggagcaggaaaatgggagttcgtcaggtaatgtggtagtgatagtgattgcagtagtcagttcggtgattgtttcggtggttggagtaactattggagtttatatatggaaacaaagaaacattcaaaagaaacgaagaggttcaaatgatgcagagaagttggcaaaaacactacagaacaataacttgaacttcaagtactctacattggacaaggctactgaatcttttcatgaaaataacaagttagggcaaggaggatttggaacagtttataaaggagttctagctgatggaagagagattgctgtgaagagattatttttcaacaacagacatagagcagcagatttctacaatgaagtcaacataattagtagtgtggaacacaagaatctagtcagactgttgggatgcagttgttcgggacctgaaagcctgcttgtatatgaatttctacccaacagaagtcttgatcgctacattttcgataaaaacaagggcaaggaattgaactgggaaaagagatatgaaattatcattgggacagccgaaggattagtttatctgcatgagaactccaaaacaaggataattcacagagatataaaagccagcaacatcttattggatgcaaagcttcgtgctaaaattgcagattttggtttggccaggtcctttcaagaggacaagagccacataagtacagctattgcaggaactttggggtatatggctcctgaatacctagctcatggtcagttaacagaaaaggcagacgtatatagttttggagtgttgctgctagagatagtcactgctagacagaacaacaggagcaaagcatcagaatattcagacagcttagttacagtggcatggaagcattttcaggcagggactgctgaacaattatttgatccaaacctagacttgcaggaagatcacaatagcaatgttaatgttaaggatgagattttaagagtggttcacataggacttctatgcacccaagaggtctcttctttacgaccaagcatgtcaaaggcactgcaaatgctaacaaagaaagaggaggatcttgttgctccctctaatccacccttccttgatgagagtaccatggaacttcatgacacaagtggtgacccattttatcctcttactgcacctgattcaattgccactatgtcccatagctctttttatcccaggtga

SEQ ID NO: 100441 - DNA, 318 bp, Glycine max
  Peptide Sequence Number=SeqID_217219
gataaggctgctgaagttgtcaaacatctatctgaaagtcactggaattcatcttgtatcgttacaatgaagaaatttcaggacatgtgtggaggaccggatgaggcatctgtaatgttgaggtatctgtctgggtgtagaacagcacagtatctatcagtgaataagaaagattttttagagggggtaaaagtttctctctcagcaggagcattatctagtatcactaatttagattatgatgtactgcacttgatttggaccactgagaagcttcagctacaactggatgtgactgataggcgttatgaattgtaa

SEQ ID NO: 100442 - DNA, 636 bp, Glycine max
  Peptide Sequence Number=SeqID_217220
atgctgcatcagtgttgggatttttctcaaaaatgtttagttgcctcacagattgattttattaggttgagaaaatcagcattggcttctctacaatctgggaacaaaaaattggcccttaactatgcaagggagctgaagttagtcacccagagtagagaaaaatgttcatcacttttgaacagagtagaggaagtacttagcgttattgccgatgccgagtcaacaaaaaaggttactgaagctatgcagattggagcccgggctattaaagaaaataagatcagcgtggaagatgttgatctttgtttaagagatatccaagagagcattgattcacacaaggaagttgagaatgccctagaacgaatgccgtcatatgtggatattgaggatgaagatattgaagaggaattcaagaagttggagctggctgttgggcaagatgctcaagttcctgcactggagaaggcattcaatgaagaaggaagaatggcttcagaagctgctgattttattagtgacactttctcaaatctcaagctttcagatcgtccagctgagaagccaggaatcactcaggcagtgtcagagggagacaaaataacaaaaaaattagaaatggaagcggtgtaa

SEQ ID NO: 100443 - DNA, 465 bp, Glycine max
  Peptide Sequence Number=SeqID_217221
atgcctggtttgagttctgacatcgtacaacacagactaccttttaatcctgagtgttccccgataaagcaaaaactgaggaggatgaggcccgagacgtccctcaaaataaaagaagtaaagaagcaatttgacgttggctttctggctgtcgctcggtacccagaatgggtcgccaacattgtaccagtccctaagaaggatgggaagataaagatggcgccagaggatatggaaaataccacttttgacaccttgtggggaatgttctgctataaagtgatgtcctttgggctaaaaaacgtcggggcaacctatcaatgggctaaggtggctttgttccacgacatgatgcaccgagaaatcgaagtctatgtagactacatgatcgccaagtctaaaactgaggaggacaccttgtcaatctgcggaagttgttcgaaaggcttaggaagtatcgattga

SEQ ID NO: 100444 - DNA, 1389 bp, Glycine max
  Peptide Sequence Number=SeqID_217222
atgaagaggagcagaagcttttccttactcttttacctgtacttgttggtgattgtctttgccaccttctctatagtttccatggaagcaaggaagactaacatcaagaaaaaacttcacaaacgtcacaaaggtggtcacactcgagggtcacattctccatgtccagttccagcccctcaagggagtacctttgatgttttggcttttggcgccaagggaaatggagtttctgatgattcagaggcacttctagctgcatggaatggtgcatgtaaagttgctgctgctacagttaaaattccagcacaattcaagttcctcatgaaacctgttactttacaaggcccttgtatgcccgatcttactcttcagatagatggaactctattggcaccttctgaagcatcttcctggccacaatctagtctgtttcagtggataaatttcaagtgggtgcagaacttcaccatcataggttctggcactgttgatggccaaggctataattggtggagctcctcagaattttatgacatgcagaagacctactccaaacatattcctagcattaaaccaaccgctataagattctactctagcaactttgtaacagttcgtgatatcagaatcataaacagtcctctttgccatctaaaatttgacaactcaaaggggattaaagttaacaacattacaatatcctcccccgagaatagccccaacactgatggcattcacttacaaaacacacaggacgtagaaattcaacgttctatcatttcaacaggagatgactgtgtatccatccaaactggttgctctaatgttcatgtccaccacattaattgtggacctggacatggtataagtttgggaggattaggaaaagacaagactagtgcggcatgtgtgtctgacatcactgttgaggatatctcaatgaaaaacactctatttggagcaaggatcaaaacatggcagggaggcattggcatggttaaaaatgtgacattttccagaattcaagtctatgatgtcatgtacccaataatgatagaccaatactattgtgacaaggaaatctgcaagaaccacacaagcactgtggtgatttctggggttaagtttgatcaaatacatggaacttatggcatgcagcctgtgcatctagcttgcagcaattccataccatgcacagatgttgatttgagcgatattcaactgagtccctcccctaagtatagaggtttgcaacaagctgtgtgctggaactcctatggaaaatcacaaggtcctttgataccttcaagcattgattattgcttgagaagtggtggtggattaatcaagaggatagcaaggtcacatgatagagtgtgttactaa

SEQ ID NO: 100445 - DNA, 1200 bp, Glycine max
  Peptide Sequence Number=SeqID_217223
atggatttcagcttgtgtttgagctccccaatcatttccacacttgtacattttctccttgttgcttctttgttttgtcctgtttgttcctcagatattggcaacaccctagttgccaaccagactttcaagccgcaagaagaggctcacaagttgaacatcataagaactcgtcttcaacagatcaacaaacccgccgttaagtcaattcagagtcctgatggtgatgtaatagactgtgtggtatctcatcagcaaccagcttttgaccatcccatgttgaagggacacaaaccactggatcctccagaaaggcctaaaggtcataaccaaatggacatgagtgagaattttcagttatggaccatgtcaggggagtcatgtccagaaggtacaattccaattagaagaacaacagaacaagacatgttaagggctagttctgttagcagatttggaagaaaaataagaagacgtgttagaagggacaccaacagcaatggacatgagcatgcagttgggtatgtgagtggagagcagtactacggagcaaaggctagcataaacgtgtgggcaccccgagtggaaaatcaagatgaattcagcttgtcccaaatgtgggtcatctctggctcatttggggatgatctcaacaccattgaggctggtcagccccgagatctacggggacagatacccgagattctttacgtattggacggctttgttcaaacgaataatagaattgcaattggagctgcaatctctccaacttcttcctatgctggtggacagtttgatattagcctgctaatctggaaggatccaaagcatggaaattggtggcttgaatttggatccggaatcttagttgggtattggccatcattcttgttcacacacctaagggatcatgcaagcatggtgcaatttgggggagaaattgtgaattcaaggcaatcagggtctcacacttcgacccaaatgggtagtggacattttgcaagtgaaggttttggaaaagcttcatattttaggaacatgcaagttgtggattgggataacaacttggtaccattgtcaaatcttcgggttctagcggatcacccgaattgctatgacattcaaggagggattaataatgtttgggggaattacttttactatggtggacctgggagaaatgtgagatgtccctaa

SEQ ID NO: 100446 - DNA, 264 bp, Glycine max
  Peptide Sequence Number=SeqID_217224
atggagtctcttgggaaggtgaggagggagggagagtcggaggtagccgggggagagggatcagagatcggaattcaagtttggttgttgagtttagcgggaaagaaggaaaggagaggttggtggactttaagtctcgtcgcacttatacactcgagactgaaagattatgcacccttttcggccagttgtatatcaacaaggacaatcccatctggttgtttggagaccgacctatatttcacctcagacatctatttttag

SEQ ID NO: 100447 - DNA, 468 bp, Glycine max
  Peptide Sequence Number=SeqID_217225
atggcgtcgtggaatttcgaaaaaacgtcaccaaatagcggtggcgttgcgcgttgcgaaactcggagcgcgagaacgaagccacaaacagaacagcacaacagtcttcagcggtgcgaccagcagcagtctccagggcatgaacggcggcgacgacgatgcacacgacacccgcacacgacgttctcgagtgcgacgacggcagccggccagcagcacgacgcacgcgagagacccgagcaagacgcacgcgagagagaggacgcagatgaccgagcgacgtcgacagtgttctggacagataaaatgagtgaagctgccatattagaagtggtgaaaaagaattttgaagatcatcttattcttggggaagaaggaggagttataggagatgcagcatctgattatctctggtgcattgatcctctaggtctgggatttcatttgacacttccttctaaaccataa

SEQ ID NO: 100448 - DNA, 351 bp, Glycine max
  Peptide Sequence Number=SeqID_217226
atggtgtgggtcaattggcaatacatgcatgctaagtttgtgggggaggttctgagtttgatcccacagaatatactcttggggatggatgagaagagctttaaagtgactaagcttcagactaagagtctgactatacaagtacaaaacatcatcgaaaggcgaaccaagaccgaaaatcatctagacttaacaaaacaaggatcccatccacacctcatggtggaaacctccaatcagtcgccgtctagtgaactctcacaacttccggcacatttcccctcatgcgactctcttgaagaatatctttgcattccactacgagtctgcgtctgcttgcacgtctcttaa

SEQ ID NO: 100449 - DNA, 543 bp, Glycine max
  Peptide Sequence Number=SeqID_217227
atgacattctccagcactggcaacaagtaccagctagggagtaataataagaattccaacctaggaggcatggattgcggtgctggtgtcatatcggttgaacttgctagagacatgcttatggttcactggagcacttatgtagttgtgataaacttggctcggcaaaagccaatgaagacttgcagtgatgatagagaccaaattgacgcttgctggagatgcgccacgcattgtgtgcgtgaacttcatgtgctacggccatccatcgggtcgctgaaaagtgacgaagcacgatgttgggccgctagactgtgggtcagccaaacaaccacaaacagagccaaacaacagccaaaccaagaggtcgctggaaaggtgacatgtcggagtctggggagcgtggtggcacatgcggtggcgttgggtttgttggagagagacacttctgatcagagggtcacaccagcgagatggcagcacagtggcggtgggaacattgcggcgaaaatgggaaaaatcgccgaaaagagggatagttag

SEQ ID NO: 100450 - DNA, 345 bp, Glycine max
  Peptide Sequence Number=SeqID_217228
atgggctcaaaaatctaccctgagattcatgagaaccctagggccttcttcagcagccctaatccaattctcttggagtctcttgctcatggctctagtgactggtcccttactagggaggattgcatcaggatgtcgtgtccaccgccatgtaaatcaacggaagacgagtcaatggtcgaaaatgtcgttggagtggcaatgctgcttgcagcagaaaatgtcgccagaaagtggaagaagggagacaacagaggacaagcaaagaagtacactagggatagtaggtcctcggtgcagaacgatttttcattatccctcaaccaggctctgataccaacttga

SEQ ID NO: 100451 - DNA, 210 bp, Glycine max
  Peptide Sequence Number=SeqID_217229
atgtttcaaaaactctacctaccggagagttatctagaagcaggagaccaagcaatgttatcaatgacggatggcagaacacaacggaaggccgaaattcctccatataagcacgccattacagcctatggcagcaccatagcggacctcccttcacaaattgcctatggcagttggcaaaaaaaccgccatagcacctcttgtgtttga

SEQ ID NO: 100452 - DNA, 294 bp, Glycine max
  Peptide Sequence Number=SeqID_217230
atgtccctcacacatacacatgtctgtgcgcaacttcctttgcgggtgaactgtacccgtgcccactgttgggattgtttgcgatctttcaagaatgccacgttgcaaccaactcaacacactgatgcagcgaccccatgtagggccctcttctggcgagagaaattcacgcgcatgacgcgtgactcatctccgacaagtgtcacattgcaaccgcctccttccgcctcagggcatgctttattcacaggtgaacacccattgcaactacgggtttttgttggctgccgttga

SEQ ID NO: 100453 - DNA, 1770 bp, Glycine max
  Peptide Sequence Number=SeqID_217231
atggcgatgaaacctgttagagctcttagagtcaaaggacaccagtgtaatccaaaagcaaacgttggtgagattctgttcaacactggcaagactttggcaaatggtactccaactccggtcacttatacaccgatgaaccaagatattcctccttcgtcaatttctacaacaaatttttcgcaacaaatcacggaaaagcttgataagaattttttgctgtggagacagcaaattgagccagcgattactgcgcttggcctaaatagtttcatagctagtcctcaaatccctccacgatacctttctgatgccaatcatgatcttgatcgcgttaatcctcagttcttgatgtggcagaagcaagacaaatttcttcttatcaagacgattattgatgatctcacttcagtaggagatgctgcaacctatcacgaacatatggattcaatccttgaaggtcttcctaaggattttgattcggttgttgctctcatagagagtagtcttccacatatttcaatcgaagaggctgaaggtttaattcttgcgccagaactgcgacttcagaagtatgtcactcatctagttgagcaattcctttgtgccaacagtgaatcacactcacagaaactcttggcagtcgatgtggaggaggcttcaaccgctgtggtggtcgtagtggtggccgcagtagtcggagttcagtttagtgtcaagtgtgttttaagtacaatcacgctgccctcacttgttacaatagatacaatccttagtatcaagcctcaaacaatggcaataatgaactctggatcttgtcctccacaagctatggtagccaattccgatgctacttcttccacctcttggtttccagattctggagctttgcttcatgtgaccaacaattctcagaaaattcagcagaattcaccttttgagagtccagaccaaatctttggtaaaagacaaggtctgaaaatttcagctcctggacactctaatttcctttctccttataatcctaatattaatcttgctcttataaatatgattcatgttcctcaaataactaagaatctcataagtgtcagcaaatttgttcatgacaatcatgttttctttgagtttcatgctaatcgttgcttttccaaatctcaggattccaatgaaatccttcttcaaggtgacattggacctgatggctgtatcagtttcctagccggaaattctgctcagctgtctcttcttcagctgctaggacacccaaaatcccaacctttaaagcttgttcttaatcactgtaatctaaaattttctgttaaggatgatatgccctttccttctgcttgttgtatgggcaagatacgtttaccttctcaatcttctcaaactgtgtataaatctcctttggaattattatacagtgtacatctgggacaaagacaagggctagtgcatctaagacatagacaagggtcaatgcaactgggacaaagacaagggccaaggcaactggacaaagtcaaggccagggcatatcttaaggacaaacaaagatcagatttggacagaccagcaactggcaagtttgtcagtgatgtcaccggcaaaaaaggatatcacgcactgacaaaaggcctaggatcttcttcatcaatggattcctttgcttcttggaagatgaatgacagcgaaatggagaaggaagagaaagaggagacgccacttcaaggagaagatgagtctagaaaaagctcaccaccatag

SEQ ID NO: 100454 - DNA, 588 bp, Glycine max
  Peptide Sequence Number=SeqID_217232
atgggatcatttatcctggtgaggcagaagacggacaaaatcacaaggttgagtttgttggaggttcaatgtgttggaatacccgccttttctctgcaactgcagttctcttgtaggtggtggggcattctgcaatggccaaaggatccaataatcgatgaatcacacaaagagcttcccattgtttttagaagcagggtaattgattatctaggaaggcaattgattatcctaagcggtagatcctttcttcttctgaaactgactttggtactcgattaccaagctaggaaatcgattaattcgatggttgcagccaaatttcaagtagaggtggaacgatctcttctagtgacaggctttgggtatgatcatgatgatgcatgggctacgaacatagacttattcaaagaatttacggatgtcagcaggggtgtaagacgacttggcgcagctgccgtggacatgtgtcatgttgcattgggaattgtagaagcttattgggaatatcgtctaaagccatgggatatggctgctggtgttttggtatgctttgagttttatatcattgataatgattctgactag

SEQ ID NO: 100455 - DNA, 249 bp, Glycine max
  Peptide Sequence Number=SeqID_217233
atggattccgatgtgtcaggctccaacgaactcgacgacgtcatggatctggtgcgggtgcaccatggatttcgaagcgtcagacgtgaatctctcgcagcaattgttcaaatcgcaaaagtcatgatgatggtgcggatttgttgtcgtgaatctggtgcggctttcatgaagttgatgacgttgcggatttggtgtggcacgtacgagaggaatgagagatcgcaacaattggggaagcaaatctag

SEQ ID NO: 100456 - DNA, 309 bp, Glycine max
  Peptide Sequence Number=SeqID_217234
atgggtgcaagggattcatcattcatgaacagggatcatcttgaggtgaagacggagcatccttggctggcaatgatgtgttctgagctggagtgggccaaggatcccaagtgttctgcgccgccgccatgtcagctgcataatctgtatctgcagcgccatcctcttcccagtagcctccataagtggtgttgcagcaggggtgacctctggtgtctcctccagagtagcctcaggtgtcgcctccggctgcggctcctaggctataggagcctcacctccccccaaaggagaagactggacttctag

SEQ ID NO: 100457 - DNA, 540 bp, Glycine max
  Peptide Sequence Number=SeqID_217235
atggcctctaggaagaggaaaacaactgcctcccgacctcgggaaccatatgacatgaccaaatttatttttgaggtcgcttgggagtgttacgagcagatcgttcactctcggaacatccttttggagaggaacgtcactttatatttcatggagtacgatgagttccgcagggagctcgagtggaggcagtggcacaaggccttgaccaagcagtctgatggtcgtattgatgtggccctggtcaaggaattctatgttaatttatttgatccggaagataagtccccgaggcaggtcagagtgaggggcaagctgataaagttcgatgctgagacacttaacacattcttagagacctcgatgattttggagccagtggagaggtacttcacttactctagattctgtcattcacatttagacccacaggagtttgcatccaagctctgcattccagggcgaggatttgtcttgaacgctgaggaagcgccttggaagcttctgaggaaggacctcaccactcttgcccagacttag

SEQ ID NO: 100458 - DNA, 561 bp, Glycine max
  Peptide Sequence Number=SeqID_217236
atgtgcgtgtcgatgcattgcgacgaagaagactgtgaagaaggtatctacagcgacgtacaggcagcgcctggatcgtctgaggatcccaaatgtttgctggatgtcatatgcgaagcaccgacctgtgcaggactttcatccaatttcgtgcttctcgggacagctcccttgggggcctgttgttgtcagatacagaccagagagggttatgcgtcagttcggttacgtccatgtgtgcctgactacatggactggttcttcgtcatatcatatccattcatgactgtgccacagacggttcctcctcgagatgcatatgcgacgcagcccagtcatatccctcatgaggtagcactggcatcgacacatgcggatcctgatgcgaacgagcctggacatgcagtggcttgtcatgtgatcgtggaggcgttggagcagcatctaaatgcgccaggcacatccacacatgaagaggtcatccaaaaatgtctcaggattgccaagggtgtcacagaagacgtgaggtctcgacgttggcaccgcacggatcaacaatag

SEQ ID NO: 100459 - DNA, 261 bp, Glycine max
  Peptide Sequence Number=SeqID_217237
atggcttcctatggtgtggcatctccattcatctttctccttctccattccgctgcaatcagacctcaagaagcaaaggaatccattgatgaagaagatccaaggcctacaagccccaatggagctacatcagagggaatgatgcaatcctaccccgtaagggcattagatagaaaactctatgtagattgggctagagatgcaagagaaggccctaggattttcatgagcctgagggtagatttcgggcccatgggataa

SEQ ID NO: 100460 - DNA, 352 bp, Glycine max
  Peptide Sequence Number=SeqID_217238
acctgtttgtcacctacaaggtcaccacatgtgtgccgagaaagggaaagcaaattgggagcagctcttggctggtatgctgaaagctaggacacaagagataacttggctcccaaagctaaagatttcaagtgaggaagaggctaaagtccctgaggaaagcaaagacgtgcaagccttgaaagtgaaacttgaaaggacacaagtggtcaaggaaaagttcaagacgacagccatcagggtcaggaaggaatgtgatgagctgagggatgtcaatgtggccacggctgaagcattggaacgagaaacgaagagggcccgaaaaaaagaatggggtcgaaacaagttctga

SEQ ID NO: 100461 - DNA, 667 bp, Glycine max
  Peptide Sequence Number=SeqID_217239
atggagcttcaggacactgctgcaagccgtgtgtcaattggatttcctctgggctcagcccttctctttgtctgtttaatcttcatttgtggcttcttttgctgctgcttacattggactaagcttcaatcatttcttcaatctcatggcatcatcaacactcaatctttggcacagactcaaatacaagcagaattagcttcctcctaccacaaaccagcttttcctgttgtgatgatgaagcagaattatgcaaagactatacctgtgttgatgccgggggatgacattccaaaattcatagccacggcatgcccatgtgagcctccaagagatgaaagtatcacaatccttgtgcagaaggaagaagctactgatttatgcaaagattgttgtcagcttagccacactacgttgcatagtccttcaggtgttacgagtccacccagatcctctaggatcccaaggtctgtcccggcaaagctcacttggtttagcaagcaaggcgcatgcggcatggaaagcgaagccgataatggtgcgggacttggttgcctgggtgcggagcatggaggtggagtcgatatggaaggcggaggcggtgatggtgactatgtggaggaagaagatgggatcgggatatgcaattttagaagaatggcatcaa

SEQ ID NO: 100462 - DNA, 306 bp, Glycine max
  Peptide Sequence Number=SeqID_217240
atgcccttcatacttttttgcaaacttgttccgttgacaggggcggacaacggaagatttcttccgcccctgtcaatagcagaagaaatgcggaagaaccttcttccgtggttacacacactccagtcacacacttcttcctctctctatttctctaactctgaccatgcaattggcattggtctcattgcattctctatagaaatgacgaacaaggtcaaaggaaaaggcaaggaggttgccggaaaaggttatgccggcaagcgcaagggcgcctttgacgacgacaagaccggtggcggctga

SEQ ID NO: 100463 - DNA, 450 bp, Glycine max
  Peptide Sequence Number=SeqID_217241
atgaaggtttttaatctaacagctgctcactcttcttccatggtacgtgtatgttacctacaagctaacacatttctcagcccacaaatcagcaaattagagtacaaaaaaaccaatgacaatgacaaaggtttatatgtaggtccgtgtagcacaggttttggttcgcataccttgagtgaaaaaccgcacacagtttttgatgagaatggagtgagagaaaggttcacaaacaatggcagaaccagaccgcaagaggaaaactcaaaaaggagaaagagccaggcagagacaaacaattacgagagcgagagagacgactccagcgatggcaatgtgatgggtagggtttatgaaaggcagggcaataatggcgagggtcaaggaatagagcttcgtgagggcaacagtggtgaagtcacggatacaaaccctacattgtccccataa

SEQ ID NO: 100464 - DNA, 276 bp, Glycine max
  Peptide Sequence Number=SeqID_217242
atgagagaaaggattccctgtgcacgccacacggtggcgccgccgtacaccactgacggtctaacagcaggtttctttgacacagtggtttcccgtgttgctggcaacgggttctggtttgagggtttgacggtggtgagtggcggagtcgaaagggaaagaaagaatgcaccgtcgccaccgggggccttttccggcggtggcacacggttaaacgcagcgacgaaggcgctggagaaacttgaaaatgatgacactggtgcagaggaagtttga

SEQ ID NO: 100465 - DNA, 237 bp, Glycine max
  Peptide Sequence Number=SeqID_217243
atggaagggtggttaagaggagatgagcggaaaattgtggtgatggagcagaacgagtttgaaaatggaggaaggcatgggtggtgtagggtgcggtgctgcagagaaaaactcaagctccagtgccaatcactacattcgcatgttttgtcgatacatttcaaaattcataagtcagtccctgattttgtgaccttggtcattggattccttgtacgtaacaacattaatcattaa

SEQ ID NO: 100466 - DNA, 1011 bp, Glycine max
  Peptide Sequence Number=SeqID_217244
atggagcttcatgaccatgatttcttggaggaattaatgtctctaagaagagaaacatgggatacaaatccatgttcacaagaaaaccagcttttctctaatggctggagttttgattgttttgatcaaaactatcatcaagcttttcctccaaactctttctcttgccaacaagttcctcaaagttacaaccacgactacacctacaatgaaatctatagttccttacttcacgaattctctgcaccacaagttatagattcatcatcctataacacccttgatagtactccacataatacccctccttttcttgctcaagaagattatccattgtccatgatggaagaagaagatccgggttttctcggggaagagcttcaatgcttggaccttcaaaccacatgcaaaatggagtcaagccattcccctgaaatgcctattttcaacacaacttcatcatgtgtggagagaaagaatagagcaaagaagcttcaggggcagccttcaaagaacctaatggcagagaggagaagaagaaagagattaaatgacaggctctccatgctaagatcaattgtgcctaagataagtaagatggacagaacagctatacttggagacactatcgattatatgaaggagctcttggaaaagattaataatttgaagcaagaaatagaagttgattccaacatggctagcattttcaaggatgtaaagccaaatgaaatcatagtgaggaattctccaaagtttgatgtggagaggagaaatgtcactacaagggtggagatctgctgtgcagggaagccaggcttgttgctgtctacagtaaacaccttggaaacgttaggcctcgagatccaacaatgtgttattagctgtttcaatgatttcacagtgcaagcttcttgttcagaggaattgcagcagaagacaattctgagttccgaagatataaaacaagcactatttagaagcgcaggatatggtggacgatgtttgtga

SEQ ID NO: 100467 - DNA, 834 bp, Glycine max
  Peptide Sequence Number=SeqID_217245
atgtggtgttatgagtggaaaaagagtgaggctttgagagttggaaggctaagtctgaattctgtggattttgcacaagtgcagaaaaatgcttgtgtgtggttggttgtggaaagtctagtacagaatgagttctggatgtttgctagtagatcccaacgtgagaaaagctgtgatttggttggtgttttggcagagttttctgcctatgctctgttttgcttggctgtgatagcttgtgcgaggattgatggggacccggtgttgagagaaacgaggatatgggctacgtgggagtacgtgagctcagatggaggtgggcaacaggggatgcttgagatgaggaagtgtagaagggtgaaacttcctgcttttattgttgaccacagagtggtacctggagatatgtcgcgggggtcaggagaccttggggacgtcaggcgagctcctggcagtcaacagataaaaggaacaaagaccacaaagcaagaaggcttgtggtggctggccagctgtgaattttgtgtgatatgtggattatggcctctggtaatcgattaccaagggcttgaaaacgaagtcaggaaactaagggagcctctggtaatcgattaccagcctatcgtgatggcggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcacggtggagtggacagcttttttttggattagttttatatacttttga

SEQ ID NO: 100468 - DNA, 408 bp, Glycine max
  Peptide Sequence Number=SeqID_217246
atggccacgcatgcaccgaaccctgccgatgccggaaccccggcaactgaactgatcgatgcgcgcatcgccgagctgggcgactggcgtggcgaagtgctggcacgcgtgcgtgcgttgatccatgaagcgctgccggacgtgcaggaaacctggaagtggcgcggtacaccggtgtgggagcacaacggcatcctgtgcaccggcgagacctacaagcaggcggtgaagctgaccttcgccaacggggcggcgctggccgatccgaaaggcctgttcaacgccagcctggagggcaacacgcggcgcgcgatcgacatccatgaaggtgcgatgccgaatgccgctgcgttgaaggcgttgctgcgcgcggcggcggcgttcaacgcggcgaagaagaaacgctga

SEQ ID NO: 100469 - DNA, 153 bp, Glycine max
  Peptide Sequence Number=SeqID_217247
atgtttaatcagttcatctcaaacatagaattagaagatgttgctgttgtaggagtggttcaatcgttgactggggggttggagcattgtcctattttgctaaaggagcatctcagatcattgtcctattttgctaaaggagttggagattga

SEQ ID NO: 100470 - DNA, 413 bp, Glycine max
  Peptide Sequence Number=SeqID_217248
atggcaagaataaatgatttgggcaagaaagatgagctacaaccactctttgaggaggaattgtctataagaatccaacttcaagagatgttctgggagatgattaggaggaatgaatccttactgagacataagtctagatctaattggttgttggatagggatggccctgggaaagttaaagagttagtgatatcattcttcacatctagattcagtgaggatgagattagaagaccttacttagatggagcggaattttctaaaatttcacaagtagactatgggtggtcaatctttcatgaaaacggtagtttgtggagagacacattggagtcaaagtatgagggggaatcttttggaggtggaaattggagtgaaggcatagatggtttgaatgggagaagccacaa

SEQ ID NO: 100471 - DNA, 492 bp, Glycine max
  Peptide Sequence Number=SeqID_217249
atgggaaagttggatcatctaaaggaaaggctcagggccatcgaaggaggtgaagattatgcctttgctagcctagaagagttgttcctagtatccaatatcatcacccctcccaatttcaaggtgccagactttgacaagtacaaagggactaattgccctaagaaccatctaaagatgtgttgtcaaaagatgggggcatacgcaaaagatgaggaactgttgatacatttcttccaagaaagtcttactggagtagctgctacttggtacactaacttggaaccttcccgagtccattcttggaaggacctaatggttgccttcgttaggcagtatcagtacaattttgatatgattccggataggatacaactacagaacatgtgcaaaaagggggcacggatctttcaaagaatatgcccaaagatggagagacttggcaactcaagtggcacctacaatgacggagaaagagatgatcacaaataa

SEQ ID NO: 100472 - DNA, 165 bp, Glycine max
  Peptide Sequence Number=SeqID_217250
atggcattgatggataagttggaccaacgtctccctcatccaacaaagccaattggtaaggaagtggcatcaattgcaaagatagcaatggcctgcttgactgaaagtccacgatctcgccctaccatggagcaggttgccaatgagctggtcattttattttag

SEQ ID NO: 100473 - DNA, 390 bp, Glycine max
  Peptide Sequence Number=SeqID_217251
atgtctttgggtgcaggaaattcaaggatatttgcccttgaaaaaatcattgctacttcttctacaacattgctgtcaatggcatctcatttaccaaaggcagaagagccggaacgggttttcagtggcaagggacgttggaaccaagtgcattccgttcttgaagccaagaatttgatgaatcatttgttcaatctggcatcttcctccagcacagggcaaaccaacacaggggaattaggagcagacaagaaacaaaaggagaatatgcaagccacactacctggaggactacgtgaccagtgccaacaacaaacgctgagctggcagcctctcattggtcgaaggagatcctgttgctggctaggaatcatgcttcactaccattaa

SEQ ID NO: 100474 - DNA, 432 bp, Glycine max
  Peptide Sequence Number=SeqID_217252
atggtgatccatataaggaaaagctattgctcattgtgggaatgggtgaagaaggccagtaatatacggaaggaagtgactaaaatcgctgcatggatttgtattctccaacttcccttggagctatataatgatcattttctttggagagtggggtgtaaacaagggaggccattgaagattgacaaattgacctctattcattctcgaggccattttgctcaaatgtgtgtggaaatcaacctgtccaaaagattgattcctcatatcattgttaggggagtgaagcttaaccttgagtacaagggattacactcagtttgtttcaaatttggtcactacgggcataagaaggaaagatgtccagaggtcggagtttctgattcacaacatcccaatctacatggtggcattatgaggagggaaaagtaa

SEQ ID NO: 100475 - DNA, 1782 bp, Glycine max
  Peptide Sequence Number=SeqID_217253
atgtttatggttatggattcagcagaaaggtgcttagattctcaactatggcatgcctgtgctggtgccatggttcaaatgccacccctcaacacaaaagtcttctactttccccagggccacgctgaacacgctcatgggaagagggtagatttccccaaaaaccaaacccgtgttccaccactcatcccttgcagactctctgccatgaaatacatggcagaccctgacactgacgaggtgtatgtcaaaatgaggctcacccctttgagggaacatgaattgttggattcacaagatgattgtttcttggggaacagtgctggtggaggaggagttgatcagggtcaagagaagcctccaacttcttttgccaagacactcacacaatctgatgcaaacaatggtggaggcttttctgtgcctcgttactgtgctgaaaccattttcccaaggttggattattctgctgagcctcctgttcagaccatcattgctaaggatatgcttggacagtgctggaagttcaggcatatctatagagggacaccaaggaggcatcttttgaccactggatggagcaatttcgtgaaccagaagaggcttgttgctggcgactctattgtgtttctgagggcagaaaatggggatctttgtgttgggataaggcgggctaagaaggggattggtggagggactgagttctcttctggtggatggaataaccctctctttggtggtggcttcttgtgtgggagtgagagcaatttgatgagtggtggtgatcatgagatgttggtgggaagagtggctgctgaatctgttgttgaggctgtgacttgtgctgttaatggaaggccctttgaggttgtgtactatccaagggctagttcgccagagttttgtgttaaggcttctgttgtgaaggctgcaatgcaaattcagtggtgttctgggatgagattcaaaatgccctttgagactgaggattcttctaggatcagctggttcatgggaaccatttcttctgttcaagttgcagatcccatcctttggcctgattctccatggcgtcttctgcaggtggtgtgggatgagccagatttacttcaaaatgtgaagtgtgtaaacccgtggctggttgaactagtctcaaacatgcctacattcaatctctctgcatactcacctcctagaaagaaacaacgttttctacaggacccttattttcaagtcatcaaccaactcccaatgccttcattctctagcaaccttctcaattacaccaactctatttgtaccattgaagataacaatagttctggaggcatacagggagccaggcatcctcaatttggactatctccttctgattttcccttcaacaagctcccagcagacatgcttctaggtggtttctcaaggcttgaccatgcagcagcacaacctattatgcctcattgtggaacctttaagaacaacaccactactaaggccaatgttgacatttcttgcttgttgactgtgggaaatcctggccagaatttcaaggaatccaatgaaacaaaagcacctcacatcttgttatttggaaaactcattcacactgagcagaagagctcaaacactactagctctgctagtactaatggtaatagtgtatctgaggggaattcactcaagacatctaatgcttctgatggaggatctccctggtacaaggaacaacacaagtctgatcttggaaatgacaatgttaacacattgtgtattgctttataa

SEQ ID NO: 100476 - DNA, 147 bp, Glycine max
  Peptide Sequence Number=SeqID_217254
atggggctcaggcttcggttcatgcttcttgtggtgattgaggactatccaaaggttaaaagtttggcttgggtgggctcaacatggaagcaccaatcattagaacaaggaataagagatttaaagaagaacttgacaagaggctaa

SEQ ID NO: 100477 - DNA, 324 bp, Glycine max
  Peptide Sequence Number=SeqID_217255
atgggtaaggactggggtcctggcgctgctgatgcatggtatactgataaaagctctcattcaactgcacttggcccctatgattggcctcctactggtcatccaaatgccgcatgtagagttccatcctctgcattacttttctatgaaggacttgttaatgggaggccggatgagcttcgtgggtgtaactggcaccctatagaactggcagagatctgtgatcaaggccaaaaatctcagtgctctgttggacttttccaggtccactgggtgtcttggaggcgcgatccctgcaaattgttaaatggcgtccgagattag

SEQ ID NO: 100478 - DNA, 597 bp, Glycine max
  Peptide Sequence Number=SeqID_217256
atgtcttgcctagtgatcataactccgaccttcctctgtcgaagtgtcagctggtgtatgccacccaccaggcaccctctagacccggataagtgtaacagggccctggggtttctggcattgatcacgggcctctgccagtcattcggggttcccgtcacccctagtaaggtgatccgaccgccgatcacctgggccttcattgagaagtattgcacgcctaagcaggagcagggtgatgcacctcaggccgcagacgcaccgctaccacctcatcaggctgatcccgctgggtcactaggcatggagcgttatctacatcacttggttcgccagcaggcggccaaccaccggaggcaggtacagatacatgagtgtctttaccagctcagcctcagtcagcaggggcagggtttcgctccttttgcgtgccctactccagagcagtttagggctgaggtcgcatggcccggagattggcccaaggcccgtgcaagggaggcacttgcaggatcccccgccgatgcagaggaggcctgtatggatgaggagatgacggacttgctcggtttcttgggaggaagcggagccacgtga

SEQ ID NO: 100479 - DNA, 171 bp, Glycine max
  Peptide Sequence Number=SeqID_217257
atggcaagttcaacacactttcaacaaatctcttcacaaataactatcacaaagcataaaccaaaaatggtgaccaaaggttggagctttaatggaggcttcaatggagaggaagaagaaagaaaaagcaacgtgagggagagggagaaagcttctgaaattttctgttga

SEQ ID NO: 100480 - DNA, 228 bp, Glycine max
  Peptide Sequence Number=SeqID_217258
atgcaaagaagatctactgcaggatttagaagtagtagcaactccagaagaagaaccttgatcttccgaggcatcttctatttttcctattgcagagattctcatatagaacctgttgaagatacaatcatggctgaagagccaagaagagtaaccctggaggattattcaagttctaatgtgctacaatttttcaccagcattgcacaaccagaagttcaagcataa

SEQ ID NO: 100481 - DNA, 710 bp, Glycine max
  Peptide Sequence Number=SeqID_217259
atggatgtgcgggcaaccagtggtggaacagacatgaaaggcacgtttatacggttggccgacagggatggaacaggatcgcgttcggacccattaccactaggtgccgctcggggctggcaatgtgaccctaaactatgcctcaatctgccagcaaggtggggcacaagcaaacggtggcatatgggagatatgaagccgcaaatgaggcgaaaaacaggaggcatcatgtccaaggtcctagacacccgctcaggttcaagggtggatactggggccaaggggattgttggggctgccggtgagacagaaacatcggaggatcactggaaaactattgatagcctaaagccctgggcagggtggtcttctgtaagcttgcgccaacgctctggctctccggcacggtactccacaggtagcggggcgcacgatggatccgtctggccgagggatacccaaggggtgagccgcgcaaacacgggtgaaggaggcacccccggggccgtgttgggccgagctcgacaggtccctcgaccagtggaagcacgtgactcggagccccattccgcgctggcaaaggttagaggtaggagaggcgcaaagcttctggtaggcaatctgtggtcccagggctctaaggcaaaaggggtctcagacaaggaacgacaggccgggctttgccggggtgggatcgggactggtgaaag

SEQ ID NO: 100482 - DNA, 354 bp, Glycine max
  Peptide Sequence Number=SeqID_217260
atgaattcattgcctagcgctgttcatgtgtcctccaccatcgagtctggagccccgcgaattcattgcctagctctgttcgccaattctccattctccacttttattcagagacccatgaattcattgcctagcgctgttcatgtgtcctccaccaacgagtctggagccccgcgaattcattgcctagcgttgttcgccaattctccattctccacttttattcaaagacccatgaattcattgcctagcgctattcatgtgtcctccaccatcgagtatggagccccacgaattcattgcctagcgctgtttgccaattcttcattctcaatcttattcggagacccatga

SEQ ID NO: 100483 - DNA, 234 bp, Glycine max
  Peptide Sequence Number=SeqID_217261
atgagattgggtggcgacggtgcggtctggggagaagtgaacgatgcgacacgatctaggacgagaaggacttgtggggcgggggaaactgtccctatccttgtcgtgcctgtggggaaatatttattcccattcccatcctctcggggaaatattccctgtctgtggggccccgagcaggacagtcccttcggggatccccgattatggtacaaattgatacctctattgtag

SEQ ID NO: 100484 - DNA, 258 bp, Glycine max
  Peptide Sequence Number=SeqID_217262
atggaggttgtttgctcaaaaagaggaattgttgtttccctacagaagtatattctagacctcttggaagaaactggaatgagcggttgtagaccagcagatacccctatcgatcccaatgggaaattgtgggaaaaaggaagtgtttctgttgatgttggaagataccaaaggtatttaaagagaaatcctggaaaaggtctgttttttaagaaaaatagtgacttggagaagagcaaatgccttcatacacaatga

SEQ ID NO: 100485 - DNA, 336 bp, Glycine max
  Peptide Sequence Number=SeqID_217263
atggagcatccagacatccaagatttgtctcttgaagatgaggaggaagaagagatggtgtttacaagtaacactatcataaaatcgggactgaactattccttgtgcctggttggtagattcttaaagaaaaaaactatcagagtaaacatcatgaaagaaagaatgacaaatgtgtggagtccggtgaagggtatcgtgatcacgaaggctggaccaattatgcagactcaagaacaagaagataatgcagaagcaataggacaacaggtgcaattagcaaatagacccaagagggtagtaacaaaaccatcttacctaaaagactacgtctga

SEQ ID NO: 100486 - DNA, 4357 bp, Glycine max
  Peptide Sequence Number=SeqID_217264
gccctatcagttacccccattaccagaagagggaaatcgaagagcaagttgatttgatgctccaaaaggggctcatccaacctagcaccagccccttttcttctccggtgctgctggttaagaaacaggacgaatcatggcatttctgcgtcgactatcgcgcattgaatgccttgactgtgcgtgacaggttccccatccccaccattgatgagcttttggacgaattggggggagcttgctacttttcgaaacttgatcttctgcaggggtaccaccaaatcagaatgcactccgatgacattccgaaaactgcattcagaactcatcacgagcattacgagttcaaggtgatgccgtttggattctgtaatgccccttcatcatttcaagctacgatgaaccagatattccagccataccttcgccagttcatcatcttcttcttcgacgatattttaatctacagctgctccatggatgatcatctccgacacttaacacttaccttccaggtattgcttgtgaaccagtttgttctcaaactttctaaattttattttgctcagcctcaggtggaataccttggccatttggtctcacataaaggagtcgagccgttaccttctaagatcactgccattcagcaatggcctattcctcacacaaccaaggcagttcgaagtttcctagacttggctgggttctacagaagatttatacaagggtatgctacccttgcagcgcccttggtcaaggcaacgaccctcgagccctttcaatggacaccgaaagcacaacttgcttttgaaaagctgaagcttgctttatcatcagcaccggtgttggcactaccagatttcagcataccctttacagtggagacggatgcctcaggtgtaggcatgggggccatcctttctcaaaaaggacatccaatagagtttttcagtaaaccatttagcgccaaattgctccgttcatccacttatgtaagggaactattcgccattacagctgccatcaagaaatggcgtcagtacctgctgggacatcatttcattattctaacatatcacataagtcttaaggagcttctcactcaagctgtgcagaccccggaacaacatatgtatctggtcagacttatggggtatgattatcagattttgtatcgatctggcgcccataatcaagctgcagacgcactatccagagttcctgagtctcagtccaccttctctatgatcctctatgttccctgcttcacatttttagaggaactcgcgcaacaattggaccacaatgaggactatcttcagttacgccggaacattaatgaagctcctgctgagtttgagggattttctctcactgacagcttcattctctttcgaaatcgtatttggctccctcgcactctccctctcatacccactctccttcaggaattccattccactcccactgggggtcatgccgaaatcacaaagacactaatccgcttgtctgaaaacttcttctggtcagggatgcgagctgatgtatcgacatttgtggcaaattgcttcgaatgccaatgtaccaagtatgaaacaaagaagatgcctggcctattaaatcctttaccggtgccgcgccaaccatgggaggatctctcccttgacttcattacgggtttgccaccctccaatggacacactgtcattctggttgtagtggatagattctcaaaaggagtccatttaggcacattacccacggcccatactgcacatactgttgcttccttattcctgaacatcgtggcaaagattcatggcccaccccatagcttggtctctgacagagaccctttattcataagcaagttttggcaggaactttttcgtttgagtggtactcaattaaggatgagttcagcatatcaccctcaaagtgacggccaaactgaggttctcaacagggtcatcgagcaatacttgagggcttttgctcaccggcgacccaccacgtggaggaagttccttccctgggcagagtactcacacaatacgtcttggagctcttcgacaggttcaaccccctacgaagttacctttggtaagaagccattcaattttccgacgtacattacaggacaatcctccattgatgctgtggacaccatgttaacggaccggaatgaggtcttccaaatgattcacaagaaattgttgaaggcacaagagatcatgaagaccaaggttgataccaaacgacgagaggtgaattatcaaattggggattggatgcttctccggctcagaccctatcgtcagtcctcagctaaaggcgcggaccagaccacaggcaagctatcaaagcggttctttggacccttccaagttgttgagcgcgtaggcaaggtcgcttatcggctccaacttccggcagaggccaaggtacaccctgtttttcattgttcattgctgaaactttttcatggagatccagaggcggtatccgcgtctctccccgctaccattttcacgcctcaatcctcagttgctcctttagctatcttagctgcgcgcaaggcccccaatgcaacgactgaagtcttagtccagtggcagggcctttcacccgatgatgccacttgggaagattggaccgaactcagcaatgaatttcaccttgaggacaaggtgcttccccaagggcagtggagtgatacgggggaacagaccattgcagttcaagcccagaatgcaagaccaattatgcagactaatgcaggaccaattatgcagactcaagaacaagaaggaggttctggttcctcgaaaaccagttttgttttccttcctttgattagaacatatcaagtggtgctttcattgcctcccatgtccgatcaaccaccgctttcttcgactaagctcaaggacattctcgttgcccttaccacacagcaattgactttttcccataaaattgatgacctcatacagcatatcgcccctgttcttcacccccaaccatctatcaccgcctccatccctcgtccgtactccatacctgcacaacaacacagaatgaagttggaggttccccgcttcgacggtgctgatccaatggggtggatcttcaaggtaaatcagttctttgattaccatagtacacccgagcacgagcgattacagatcgctgcattttacatggagggtcgcgccctctcttggtttcaatggatgtctgccaatgcacagttcacctcgtggccggcgttcatccaagcgctgcaaacacgatttgcgccatctcagtatgaggatccaattggaaccttgtgtaaactaatgcagaaaggcacagtcgcgacttacctgtcggagttcaaagacgtcgcaaatcgaattgtcggcattccccctgcgtttctccttggctgtttcatctccggcctcacaccggagattcgccgtgaagtccaagcccatcaatccttcactctcacccaagctgccggccttgccaaactccaagaggaaaaactcctagattcccatccctctccaccaccgccccgacctcgcccaccctccacatccttcttccccaccctacctctccgacacacgaaccctctctccctacccccttccttaccctcatcttctctgcgccaatcacactcatccctttccccacttccttcacccaaccctcgacctaacccacctccaccatttcaatgcctcacctctgaggaaattgcatctcgccgagaaaggggcctttgtttcagttgcgatgagaaataccatagaggacaccggtgtgcctctagggtattcctcttgctggctgaagacatcgacacaccccctctccctgaaacccctcttataagtcatctggaccctgaccctgacccgctactcgacccggcccatcatcacgacccgtacccgacccatgacccagacccatacccggcccaattgagtttgaactctatggcaggacatctcgcgcctgaaacactctgtttcattgccaccatttccggcaacgaagtcgtgcttctcgtggatggcaggagcacgcataattttatcctaaagcagctcgtggaccatttgggccttccttctcgatcgacaacccccctgcgtgtcatggtcggcaatggccaacaactggactgtgacaccatctgtgaggccattccaatcctcattcagactcatgaatttcacgtggacctttatgttctccccatctccggtgctaacgtgggggacatggatgcttcccttacctcccttttgtcttttcgccgtctcactcgtaagctcgatactccaat

SEQ ID NO: 100487 - DNA, 444 bp, Glycine max
  Peptide Sequence Number=SeqID_217265
atgacgaggatgaaggcttcgagcaagagctccaatggcagaacccgacaattggaaccccagcctagaccgcctcgaggccgccattgcccactttgtcgttcccaagcctccatggctgccaaactagatgcccttctcctaaaaatgaataccctattaaccagccaacattttccatctttttcctctacgaaggcaccacctgctcatgcacccatgtcgactctgcttcccatggttgctttccacctccccgccaacagcaagccctacgcgacttcctccgaccttcacttctcccaccgcttaggctccgacgacattagctccatataccttgccaaactcaacaacgactccttcgcagtcatgtttgccgccaaggtcatggttttcccaatggcaccgaaggatgtgcgcatcaatttgatggtttggtag

SEQ ID NO: 100488 - DNA, 960 bp, Glycine max
  Peptide Sequence Number=SeqID_217266
atggtcaaacatggttggagccaaaacgtgtatgacgagataatctcaaagttggattattgtgccaatgctctcatgccgtggggaaaccaggtttgtgcctgcttcgaaaaggatattcaacgctgcaaacagaagctagaggaattgaggtatttatctaatcaacattctatccgtgagttcatgtgcctaagagatgagttgaactgcctttttgcgcaagaagaggcttactggagacaacatgcaagagtattttggatccatgatggaaagcttatgccacctagcaaggaattatttccaaaatctctattaaggctattgtttgtttggttccaagaaaaatttcagcaagagagaactctaccctattggctccttttgagaaaggagaatttagagcagcagtttttcagatgcactcggataaatcgattccctggtcctgatggttttaacccaggacggtccatcttggacaatactttggttcaacatatggagtgcaaagtgaggggaaaggaggctaagattactttaaaaattgacgtaagcaaatcatttgacaaggtggattggaagtatctgaatgccatccttcttcagatgggttttgatgttacttgggaacacccaacagcccataaaggagcaaatttctctacaacttggtgtctctcaatgtcttgggacaggaagaaacacgggaaaggaatcaattgtcttagttgggaacatttgtctatgaggaaagagcatggagaatatcccgagagtccctcccagccaggcaaaggctctcgaccaagggagtgcaatgccccatcacttgtgcatcatgcggaaactgcccagaaacatatcaccatgcttttgttggttgctgcaacgttgaaacagtttgggagaaagcttccttatggcacatcatcaatcttgttcgcgacaaggtag

SEQ ID NO: 100489 - DNA, 420 bp, Glycine max
  Peptide Sequence Number=SeqID_217267
atgtcgggtctgagcaatccgagagcagttgtttccctttgtgacctcatccagacctataaactggatgttctttttttgtctgagacttgtattggtagaagtggtggtttggccctcttttggcggaaaccatttggtctaattaacttctcacaaaattttattaatgttgaggtgcatcatcctgagaacccaacttggagactcacaagattctatgaccttccagaaagaagtagaagaaaatattcttgggaccttttacattctctggcgacagataaacaattctcatggtgcatcataggacattttaatgatcttctttctacagaggataagaaaggacgtgttgaccaccctttatggccaatgcaaggctttcatgatgttgctattatattgatgcagacttaa

SEQ ID NO: 100490 - DNA, 606 bp, Glycine max
  Peptide Sequence Number=SeqID_217268
atggtggtgaagtttgatgatgtgaaggagtcatggaacgaagaggaggacagaatcctgatcgaagctcacaaggaggttggaaacaggtgggccgaaatcgcaaggagaatgcctggtaggacggagaacaccatcaagaaccactggaacgcaacaaagcgtcgcttgaacgccaagaggctgaggaacaagcgcaggggtttgaagggaccaacgcttttggagagctacataaggcaagtcactgcaaatgaagaaacccaaaaggagatgatcaagaattccatgagcaacatgaacctgaagggcgagagtagtagcaacaccaccaccactaataccaataccaataccaataccagatatccgcatctctttcgggtttggtatgagagctcagagggtgggttcagttctgaggaggatgaggctgggtggagtgtgcagcagccacatggtgttggtggcggctatgtgcctatgatgctaaatgctactgtggaagatggcacaatgggttatgatgttgcgatggagatggcgccggaggttcagatgaagaaggaaatggatctcatggagatgatcattagaaaagcttaa

SEQ ID NO: 100491 - DNA, 414 bp, Glycine max
  Peptide Sequence Number=SeqID_217269
atggcaccacctctgcatactcttatcttgagctttgactttgaggatgaggatgatgtagcaacattagattgctacctagcaggtggacaatggaatgtaaatgttgttgctaatgtaataaaaaagaatgatgtctctgctacaatatttgttcccggttgggtctatgagacaaagcaactctttatctgctcacctgatcaacttgacctaatgcaaggcttcaggacagaatttttaaggcctataattgtgctaggaaactcttcatctaaaggaatgttcatagactcttgctatgcccactgccaaactaaaaagcaggggacatggttgagaagtgactctctagagatgaaaaagacaacaattgcaagggttgtagcaaattggttttattccatcagatag

SEQ ID NO: 100492 - DNA, 168 bp, Glycine max
  Peptide Sequence Number=SeqID_217270
atggtgagcaaaggttggagctttgatggagcttcaatggtggaggaggaagggagaaaaagcaacctgtgccacatgtcttcttttgagtggagcaaaaagaggcccacttttcctcttgatgtgactcatactcagtcacaagaagagaaaaatctgaccttttga

SEQ ID NO: 100493 - DNA, 471 bp, Glycine max
  Peptide Sequence Number=SeqID_217271
atgacatttgaaatcagaatgataatgagaatgcgtgaaggtgatcacgacactggtggcaatgacaacaatgatgatggtggtagtaacgccaatgatcatagtggtgatcacagtggtggtgacaacgaaaacaataatagttatgttggtggtaacaacgatggtgacaatgacgatcatggtggttgtgacaacaacaatgatggtcatattgatagcgacaacaataaccatgacggtgattgtagtgatggtggtggttgtgataacgatcttatcgagcttgcgtttgattcttgttcttcttgttgtcgtgaagaggagccacgaaccactgccgctgtcaagggagcgtcgtcaacgtcgaccgtcgagggaagcttagaggagcttacggatcaagtgatccgtaagcgttttccggatcaagttgatttggaacatgcttacggatcacttgatccgtaa

SEQ ID NO: 100494 - DNA, 216 bp, Glycine max
  Peptide Sequence Number=SeqID_217272
atgacagattgctacaaggaatcattatggccacttgaccaggctaacacatgcaacctatgtttgtcttcttacttgattccacaaactgcccaaatacaaggacctatgaccagaagtatggccaaacagttaaaggatacccttcaacaaatggtatcagacatacttaataaggtccaagtggagaaggatgaaggctcaaagaccccatga

SEQ ID NO: 100495 - DNA, 570 bp, Glycine max
  Peptide Sequence Number=SeqID_217273
atgacgtacggtgggaactgcagcctgcatctaacacagctggagggatattatgcttgtggagtgaagcagctttcaaactacaaagtggaggatgcaccatgggtgggaagaaagtttacttggtatcgaccaaacggattagccaaaagtaagctcgacagattcttagtatcctatgattggttcagcaaatggcctgtaaccacccaggttaccatagacagaaacttctcatatcactgcccggtcatgattagatccaaggtcatagattggggacccaaaccatttaaggtttggagcaaggagcaatttggggatacttttaagaaggtcaagcatattcaagaagagctcaataaatttgaagaggatacaatggatagacaattatccccacaggagatgatgtctaagaagcagctacaggaagcattgtgggtggctgcccaatcacatgagtcattattaaggcaaaagtcgagatccagatggattaaagaaggagattgtaactcaaagtactttcacaagctgatgaatgtgtcacgtaggaataatctatga

SEQ ID NO: 100496 - DNA, 378 bp, Glycine max
  Peptide Sequence Number=SeqID_217274
atggcccgacgaactgcttcgatggtttttgcctggatgcgcccgctctccaaggacttgagcccatattggccaaacctcagatctgtgctattggacttggtgcgcttgcatcacacccatttagggaattcctcgatctatggtggctctaagggccaccccttacaagttaacgcccctcttgctcgtgctgcgcaagcgctgcaaacgcagcaagcagggtttgccttgcaaggccttgctgtgatgcgcaagcgcatcaagcaagcgcatcaagcaagcgcatcaagcaagcgcatcaaggaccccacgcacgcatcagcaatgcaaatgggcaactgtgtagccgtggccccagagggcattactctgtga

SEQ ID NO: 100497 - DNA, 2162 bp, Glycine max
  Peptide Sequence Number=SeqID_217275
acctaatcacttggtcattgcttaccgtcggggagaggcaaacgatcgagacggttgaaaacctgaaggctttaggttttcagttcgcaactcaagcaggtgtttcacttagcgtagacgatctgaagataccccctgagaagttgtctcttgtttcccaagcaagccagcaggtagaagcaacccagcaggcataccaccgaggcaaccttactgcaatagagaaactacaacaattggtggacacctggcatcgggcaagtgagacccttaagcagacggtagttaatcatttcctatcaacagacaagctcaacccggtttacatgatggctttctcgggggcacggggcaacatctcgcaagttcggcaattggcaggcatgaggggattaatggcggatccacaaggacagattattggtttcccgatacggagcaatttccgggaggggttaacgttaaccgagtacatgatctcttgttatggggcccggaaggggctagttgatacagcgcttcggactgccgacgctggatacctaacacggcgcttggttgacgtctcgcaacacatgattgttaaggctgccacctgtgccacacccagaggaatagtgctcaaagaccttcagtcctcagccaaggttattctcccattgcgtgaacgtttaatcgggcgtgtcttggcagaagatgtgtccggggacaatgagttgcctggaggtgagcaaggatctcagggcgccgcaatctcaacaggcagcgggcataccactactgtagcctcatcagggcgctccattgccgtaaatggggtctctacacagtcaagacaagcgggtttgcttgcttatcgcaatcaggagatatcggctaagctcgccgcacgtatcgcttcatgccgagatgccgttgtcgttcgttcaccccttacctgcgcgattcggcatggggtctgtcaactctgttatggctggagcctatctgaggggcgacttgttacattaggggaagcagttggtattattgccgcacaatctattggtgagccaggcacgcagttgacgatgcgaacctttcacacaggtggtgtcttctcaggggatgtgatggctgaggtccgtgcaccacatgatggaattgtggacttccctcagcccctgcagggattgcttatccgtacatcgcatggcaagatagctttcctgacaaaggcatccggatcgctcctgttggggagcgatcgaagcctagcaatagcgggggagggcaccctcttctctctggaaccgttaacagttctttttgttcgccaacatgagaaagttgcccgaacacagctcattgcggaattctcctcaatggggacagaaatgaatgaaacgattgaggcaaaacggatcttattctccgaaatggtcggccaagtttcctttgcaaatgtgcgcctaggtactcgtcgtcgagagagcggaggcattcttcaagtttcgagaaatctaggctttgtttgggtcttgtctggccgaagatcgcctgttacaccactgcttggaatctatggcaagggttctcatcttgtgaacccagggtctctagtgactcgtgtggctaacaaatcaacatggcatggcaacagagcacccattagaccggagtcaaccgatacacaattccgccctacagtgtcgggtgttgctccagagcgcctccttgtttccaaaaacaggcctcacaggcctcacaggagttcggcgttccgtcggacggatgcaatttggcaaaaaactggttttggtgtggttattgctcgattgattgatttgagacagtgcttagaatcagctctactcaattggctaccagggacgcagggtgagcggagatgcgagcagcttcgggaatggtcctcctgcttgtctgagcaagtcagcagcaagggaaggcccatgttacacgaaggccctggtccacttgggcctgttcgggattttattagggctaaccgaatcttgtctgcactaattgctaatcactctggactccctgtgacattcgggagcagggagagctctctagctgcattaaacattattggagccgttggggtaagtggaacaagccgagctgcaatgttttactcaatctttattgggtag

SEQ ID NO: 100498 - DNA, 201 bp, Glycine max
  Peptide Sequence Number=SeqID_217276
atggtgattgaactgaaaactgcacctgctgattttcattttcctacaacaaatcataccagacattgtttcactcgctacacagagtttcacagatgcttggcaacaaagggtggaaattctggtgaatgtgagagatttgctaaatattaccgctccctttgcccgggtgaatggtgtgtgttgctgaatcgaggatag

SEQ ID NO: 100499 - DNA, 195 bp, Glycine max
  Peptide Sequence Number=SeqID_217277
atggcagaagggaacggtgacaaaactctgcgaaagatcgcagaagcattcaaggaccttgcaaacgttgtcaccgattctcagagcgcagaggttaaggtttcccccttctcacatgcctgctctctcgtttcccctctctttggttgcttgggcgttgccttcaagttcgccgaaatggattacgtcgcaaag

SEQ ID NO: 100500 - DNA, 1007 bp, Glycine max
  Peptide Sequence Number=SeqID_217278
cgaacgctcgtgtcgccgacttcttcgacgccgctgctggctccggcattggcggcgtcctcgccgcactgctcttcacgcgcggcaaggacggccggccgctgtgcaccgccgaggaggcgctgcggttcctcaccgacaaccgccgcaggatctcgcggcggtcggggattctccgtcgtgttctccggccggcggagaagctcttccgcaagacgtttggagagtgcacgctgaaggacacggtgaagcccgtgctgatcccgtgctacgacctcgtcacgcgcgcaccgttcgttttctcgcgcgccgacgcgctggaagtggacggcttcgatttcaagatgcgcgacgtgtgcgccgccacgtcagcggacccctcctctgcgggccccaccgagatgctgtccgtcgacggcaggaccaggatcgtcgccgtcgatggaggcgtcgccatgaacaatccaacggctgccgccatcacgcacgtgctcaataacaaacacgagttcccgttctgtaacggcgtttccgacctcctcgtactctccctcggtaacggagagtcagactttaacgccgttaagtcaccctctggcttcgtaaggatcgctggcgaaggagcttccgatatggttgatcaagccgtatcgatggcatttggtgagtgtcggatgagcaattatgtgagaattcagtcaaacggaatcatggcaaacaagggcacacaagccaagtcctgcaaaacggcgtcggatttgttatctatttcggaggagatgttggcacagaagaacgttgagtcccttttgttcaaggggaagaaggtggcggagaacaccaacatggacaagttggagttgtttgggggagagttaattaaggaacaagagagaagaaaaaccagcattttaccaacggtggtgttgaagaacaacaatgcctcaccttcccccagcagaacttcctctgccactaccttgtccactttgtcttcgactagttaa

SEQ ID NO: 100501 - DNA, 2026 bp, Glycine max
  Peptide Sequence Number=SeqID_217279
atgctggaaggacaagaagagactggcgttgttgttaaaactcgggcaactctacaaggaagggtggaggacctagttttcgaaacaagggggttcattggccatccgtcggacgggtggatccagatttgttccgttcaatggcctgaactaagcaacacaagccctttaggagagcccgggagcaacctatttgaccaaggaacaagataccagttcttaggacttgcggcatcaaaacatcctgtaaaaaacggtgcaagttttagcaaacaagaaattgttaagatcgaaggacagcatttcaggggaattggcgctgaacgaaggggccagccaaataaaacggacacaagtaaggcagagccagatcggtacggaaccagattttttaaggtgccaatcaacacccttcaattcgtctttgcgacacatcgaacaaatccattagcgagaaaaagtgcagttggcgacaagcaaagcaatagcgttgaacgagaatctcaacgcaaagggcgaggcttcaataaatcgaatgggaaggatgccccttcgtcggccgaaggtggtcttcgaacaccacggctcgagaccacaattgtagtcagcaggtcggctgccggcacgtcatctccgcaacaagagacacggttgggagcaaaagaaaaagacagcctcaaaacctcccaggtcttacagggccaagctctacaagagccctcgctcaagagcgctccatcggatgggttcagccttttactagacggattggtcaagggaacaaatcgtccaaaagaggaagtgcaggtagcttgggaagcgcggtccgataggcttcacctgcgcatcaaaccgggctgggcctatttgccacacgaacaggcaaatctcctaaggtctcatgaatcaatccaattctgcggtgggagccaacttgataacctgttctttgagcctgcattggtctaccttgaggcgtttaagagtgggcagttctcctattcaactgctgacacagggttgattgccagcctaagagtccagctgttggaattgggcttagtggtaagaaacatgggagaacgccgcagagagacgggcataagccctgggattagaagaggcggttccatatttcaaaatctagcaacgcaagcatttgatattgaaagagaaatcgaaggatgtgaatccatcccgcctacccatgcatgggcatctcatgccccggtttccagcttccatagagccggtgaaaagcatttccaaagctccatagagcgcacaccaaggatttggccattggggcaagaaatcctggttcgtttgcgcaagatgctttggttgtcacaggcttttgctccacggttggccgaattaggtgtagacaggtccttcttgcaggccctcctgccgaagcgagcaggttgggaaggtgtagcgcgccacaatcaccctaaccgccgaactgatttgtatcaaatgttgtttatacgcaacctgttaaaccgtgaaccatttctatggctaagggctttcccggtgcaggttcaaatagttaccaatcaaaaagcccgtcatttaggcatggtttcgccgttacacaacaggcttagtcaagccaatgctgttcccataacgaacttgacacttctccaggctggtaaagagatcgaaggggtcacaacttctgagagacaattgggacagatcaaaagccacacttatgttgtggctggctcggagcttgttcaagccaagccacacatggggagggggttgttgccacttgttcaagctgagttcctgtttccgtatggcttcacccttgggctcgttagcagttgtcttcctgtctccttgccgttaaaatttcttaaggagcgggcgggcacagaggcaacgcacaaactagtggcagctacttggcaaagcgctaggcgtattgttcaggcagtgcgaccaaccagggcggatcgcaataggtttcagtcaacaggctggtcaacgtggcaggcctcacaag

SEQ ID NO: 100502 - DNA, 318 bp, Glycine max
  Peptide Sequence Number=SeqID_217280
atggataaaaaacaactgtgcaacacgtctcaagatcctgaagtgagaaaaggaccttggacgatggaagaagacttgatcttgatcaactatattgcaaatcatggggaaggtgtttggaattctttggccaaagctgctggtctcaaacgtaccggaaagagttgccggctaaggtggctaaactacctccgtcctgatgttagaagagggaatattacacccgaggaacaacttttgatcatggagcttcacgcaaagtggggaaacaggcgaaagagaggtcctgggcctttagatctaacaagaaccacatga

SEQ ID NO: 100503 - DNA, 612 bp, Glycine max
  Peptide Sequence Number=SeqID_217281
atgcagggggagtgtgaaattttaatgatgggggagttaaactatttccttggtctacgagtgaagaaaatgaaccatggaacttttctctatcaaaccaagtattgtaaggaacttctcaagaagtttgatatggataaaagcaaggaggttgcaactcttaaggctataaattactaccttaatgcagatgataaagggaagcccattgaccaagcaaagtatagaggaaatggcctaatatcttggaatagcaagaagcaaacatgtgttgtcttatctttggttgaggttgagtacattactacgaggagttgtagtgcacaaatattgtgtcttaaacaactactttttgactttggattgcatttagaacacattccttttagatgcgataacattaatttcattagtctcaccaaaaatcctatcatgcattctacgacaaagcatatagagattaggcatcatttcattagagatcatattcacaagagtgattatgacatggagtttgttgatacaaactcacaactagctgatatcttttctaaacctctaccaagagataggtttttccaccttcgtaatgatcttggcatcctaagttag

SEQ ID NO: 100504 - DNA, 465 bp, Glycine max
  Peptide Sequence Number=SeqID_217282
atggatttcatcggagggttaccaaaagctcaagggaaggacactatattagtggtattggataagctgactaaatatgctcatttttttgcgttaagtcacccttatacagctcaggaagtagctgagttattcattaaagaagtggtgagactgcatgattttcctgcctcaatagtatctgacagagacatacttttcatgagtctcttttggaaggaattgttcaggagagcaagaacccaattgaagatgagcacagcctatcatcctcaaactgatgggcaaactgaagaacccccacttttagttaaagtagctgaaattccttccagattagaagaggtaaatcagttgagtaaggacagagatgaattattgcaggaactgagctacaacctgctcaaggctcaggatcagatgaaaagatatgcaaataatcatagaagtgagctagtcctttag

SEQ ID NO: 100505 - DNA, 951 bp, Glycine max
  Peptide Sequence Number=SeqID_217283
gttacagctgttaatcttagagatggaaccacgctatctgtggacatggttgtggtgggaattggaatacgtccaaatacaggtttgtttgaaggccaacttactttggagaaaggtggaatcaaagtaaatgggatgttgcagtcaagcaacagctcagtctatgccattggagatgttgcagcatttccagtcaaagcatttggggaaacacgaagacttgagcatgttgattcagcacggaaatctgcaatacatgttgtttcttccataatggaaccaaacaaaacgggagaatttgattacattccttttttctactccagagtcttcacactgtcttggcaattttatggggataatgttggggaagttgtctattatggagatatgtcaggtagtgcatttggggcatactgggtaagcaagggtcaccttgttggggctttccttgaaggtggaactaaagaagaatatgaagccatagccaaggctactaggttaaggccagcaattgaagacttgactgaactggagagacagggtttgagttttgcagttacagttagccagaaaccggtggtgccacccccagtcgaggttagggcctcggacctacttttggaaaaaccactatatgcttggcatgccacagccggggttattattgctgcatcaatagctgcatttgcatatttttacggaaaaaagcgccgcagatgccaaaggatgccctggattttactccgtcttatgtctagagctctgcaaacaaacatatccggaattgggaagttatggattcaaattccaatcctagtccagaaaatagaagcaggacatataatttatcagtttcaaattgttcctttttctttttctactgcttcagactggagcaaatttgaggatgagatacaatgtgaacagtgcttgaaccctgctgaatag

SEQ ID NO: 100506 - DNA, 216 bp, Glycine max
  Peptide Sequence Number=SeqID_217284
atggaaatttattccaaggattacctaatgaagacccctatgcacatttggcaacgagagaccaagaggtggcttcacttgtttaagggtaacagtctgaaaacctgggaagaagttgttgaaaagtttctaaagaaatactttccagagtccaagactgcgaaagggaaagctgcaatctcttcatttcaccaagcttccctgatgaatctctga

SEQ ID NO: 100507 - DNA, 798 bp, Glycine max
  Peptide Sequence Number=SeqID_217285
atgggtacattggaggctggatcaaaggacccatctgggtgttcatcgccttctccagagaatgacaacaatgagctcagggaagctctgtgtgctctgaaaaatggggcttcagaaaacggggttggtttctctggccatgggaaccaaggttctggtgatggtggggttgtcgaagtggggaagagcagggtctctgagaccaaggtttcggatgagaagggttttgaggggagagaaatggaggatgattgtcaaggtttggcagattcggagatgaatggggtctcctctttgttgaaaatgagagagagtggtaggaacttaatgtttttgtatggtggtgcgagtgagagtgctgggaaggtgaactctgagggtggttcttttgaggttggagtggaaggaggagaaagagatgggaagaaaattgagggcgaggatgatcgaaatgggaaaaccgtgactgcagatgttccaattgctgatacaagtgaaaacaaggatgtggaaatggaagatttgggtgatgaaggatgtggtgggttcttggttggtgattttgtttggggtaaaattaagagtcatccctggtggcctggcagggtttatgacccttccgatgcttctgattttgctttgaagctgagacaaaagagtagactacttgttgcttactttggggatggaacctttgcttggtgccatccttcacaattgaagccatttgaggagaactttgaggatatgatgaagcagagtagctcccgggcttttgttaatgctgtacagaaagct

SEQ ID NO: 100508 - DNA, 186 bp, Glycine max
  Peptide Sequence Number=SeqID_217286
atggagtacatcaagtctaagaagctagagttggatggattgagaagaggaaagaagatgatgctagaaaagattgatgacctcatgagagtgcataaaaaggactatgccaagcttaaggagtgctttgagtctatcttagaaaggttgaaggctatggaagcagcacatgtggatgatatctaa

SEQ ID NO: 100509 - DNA, 1089 bp, Glycine max
  Peptide Sequence Number=SeqID_217287
atggctatggaagcagagcatgtgaattgtgaagtgttcttctttcttggtcttgttaaagaaagaaagaatcttgaaaggtttgcggaagagagggcacggggtgagggtaagaaaatgcaaggtggtgctgcgaaagttaagtgggccgttggatatgatacgttattttttgagggatctccggtgaagggttttttgattttgtggctttgtaagtcagttaggaatgttttgtgtagggctggtagacttcgaaaggtggtgttgtgcaaaggttgggatggtgggtttttgatcgatgtgattgttaggcttgtgaggctttttaagttgaatcagacatgggttcgaagagaaaaaggaaataagtatggatgtcatggtcaaccctcagtggatggaggtggaggatttgatggtggtgacttaggtggtgaaagtgcaggcgcaggattggcaatcgaggaaagcacaggaattggaggtggaggtggcagaggtggttggacggtggaaggcaacctctgttgcataagcatattcatgttgaaaaggaaaaagttattgaaggacttgagcgaagcctctaatgtgtttttgatcaacacggaaccttttttccatgacacacctgttggagcatggacattcaaaagagtgatttctcttgaagtattagaagtgttaatagttgtgagtgcatcgtcactttttcctgctggttcttggcttctgcatctccatgagctaccggttaagcttgtcctgtttttgtttgagttcaacagtcattccttgtcctggaacccaaggattctagtcaagagaaaggagatgttctttgagtttaggatgatgtgcccaagcagtgacaatggctcttcacattgcaactttagggtgttggtgcaagttgaaaatgaaaggagtgcaaataggagggatgtcatgaatgatgcattgggaattggaggcaaggcaatgttgtctttgggactagggtccaatggaggaaaccttggagcaactctatccgccatgaacttgatggttgtggtttggcaaatatggatacctagagggtag

SEQ ID NO: 100510 - DNA, 795 bp, Glycine max
  Peptide Sequence Number=SeqID_217288
atgcagaaagaagaacaagaaaaagagtatttagaatcgttgacgtgtccaagcttcaactgctactccaccgatgaactcccaggtatcgctcaaagcaggattcaaaaggacgacgcgtcgttttcggcctctcaaaatgacgaccctgacttcgagttcgccgcgtttcgagacgacgccttcgagttctccaacgacgacgccgttttccctctcttcaacagcgacgttgcgagggaccgccggaacagtgtctccggcggtctcgattccgacgcggcggtgctccggtttccgataaccggcgaggagcttcgaaggggtgagcacgatccgtcactgtcgccgtcgtcggagtcgtcgtcggaggcggatgagttggaggttgttccggcggggacgtactgcttgtggaggtcgaattcgcctcaggcttcgccgagaaagtgcaagaagagcaattcgacgggatcgtcgtcgtcgttgaagaaatggaagcttctggatttgcttcgccggagcaacagcgaggggaaggagtcgttgatgatcctgacgccggcgccggagaagaaaaatgtgaacgagcggtggagcattgaggtcgccggaaaatcgaaggggaatggtttcgccggcgagaagaaggtggcggtgtcgccgcacgaggctttgtatcttagaaacagagaattgagaatggttgataagaaaaagtcgtttttgccctataagcctggcttggttgggttctgcactaatcgtttgggcaaggcattcccttcattctga

SEQ ID NO: 100511 - DNA, 1983 bp, Glycine max
  Peptide Sequence Number=SeqID_217289
atgagttcttcatgtgctgcggataaaactagctctgaatttgttcggccgttagctgccaattctggagtcaaggagggaattcttatacctgaaaacggtatagagaaactttctgatgttctgattgatccagcagaattcctttctcgagtgaaacaaattgccgaaattatttccattgctaatattctggagctggaaatattgaaggctcagctttcagctttttatctatcaagaggaggttatagattacctatgtatgaggtgccccagccagttcctggacttgaagatagtttaagggataaaacagtgaatgtaggcagcagtgagtgtgcagtggaagcacctgcacatgggccatttgaagaggactactctaccatgccaatgagcccaaaatctggtgaattgagtcattcacatgggatttcaggaaatagattgaatcataggattaagcagaaaagcattgctgaaattatgggagaggacaaagatgtcaataccaaaaatcaggaaggagatgcaactgaaaaagtgactgtaagaaagaagaggaaaggcagtgaggatacaatggcatctaaatctgtgcagatgagaaaagcgttgttctcaaatactgatagaaatgtggcaggtgctgaaaatgatggtggttgttggggcaaagaggacggtgacaatggaacattggcgcagttgaaaaagaagaaaaaagcttttggtattggaaagtctagtagtgggagcaaaaaggaaactgatctagaagggaagttcaaaggaaaaaatgagaagggttctttgtcaagagaaaagaagaaaagcaagtacttgtcccctccttttactattccagccagagagcagaggaaaggagagatagaaacagaatcccctaaagtttctggcaaagatcaggaatcagagccactgaccagagcttctgatcaacttctcaagtcccctgtacctttgaagttgaatgatgaggcatttcaggagaatgtttcgaaggaacttgtcaaagaacaggaccttcctgatagctcaaattaccgaacaccagaatatgatgagaacaagactattgatacaacgaaaatccaggttccacttggggaagttctgtctgaagtccgttatgcagctattaatccacaaactccatcgaataccaattctcttgaaagaattgtggattttatttttatctacagaagctcgttatttcgccaaggatcctactataaaatatacaagaagcataaacctagcaagaagagaaagaagccagaatctgatcttgggattttgaggaaagatcaaatacaatctgatcatatatcagctattaatgattcagagccaaagaagagaagaataaagaaagagacagctttaggtttgcctaaagagaagctatctgctgcagctaagattggcaagaaggggactgataaaaatgcttcaggtgctgccctttttgtctcatttgagccaggatcctctctgccttcaaaatcggatcttatcacactgtatggtaagtttggagctctaaatgaatcagaaacggctatgttcgctagtgattacactgctcgtgtcttcttcctgaaagcctccaatgctgaaaaggccttaagccattcacagaacctgaacccctttgactcttccggagcctctttcagactcgagtatctttctgctggttccaagtctgaaaaatccaagcctaaagcttcttcaacaaagaagaaagacaagactccagccaagccatctgcttcattgtcaccaggtactgaagcatccaaattgaactacataaagcagaaacttcagtgtctgacctcaatgctagaagcatctgatgctaaattacctgatatcaaggcaaaattagagagtgagatgaaacgccttttggaggatgtgaacaaaatggttgaatcttcttcctaa

SEQ ID NO: 100512 - DNA, 360 bp, Glycine max
  Peptide Sequence Number=SeqID_217290
atggaggaacatgttgcacctatactcacaccttgtgcctttgagttgctccaacatgagattgagtcatctataaaatatgcatcaagtaaaggtagtaatgactcttacatagtgcggcaccataccaaacatgatggaggttgctccattcaatctctagaagttgaatgcttaaagacaaaagatcgagttaaagttgctactgaagaaatcggaagaaatgttgagttgatgaaagacatgtttgaagttcaagagcattcaattgagttagaagtgtttcaaatgacaatgagggtgatgttgaaaatctcacaatatctaaaacaaaaggtcgaccaagaggatcgaggctaa

SEQ ID NO: 100513 - DNA, 153 bp, Glycine max
  Peptide Sequence Number=SeqID_217291
atggatgaggcctgtgctggggacgttgacgcggatgctcatgacctggaagcagaggaagagatcctgggcctcgaggccgtagattgcgtcgattttctggggagtacaccttatttctttgatgctttaggagaacagatgattaactaa

SEQ ID NO: 100514 - DNA, 432 bp, Glycine max
  Peptide Sequence Number=SeqID_217292
atgtttcaacctttcttctctggcgtcaacaagttgagccagttatcaagtctcatcgtcttcagcgatttgttgcaaatccacaaattccgctacgttttctttctgaggaagattgaaaattctgtgtatgaagcttgggagcaacaagatcaggtgcttcttacattgcttcaatcgacactttcaacgtcgatcttgtttcgtgtgttaggatgtgcttactccgatgaagtttgggagcggattcacgattacttccacaagcaaacacgagccacagcacgccaaccacgaactcagctacatgctacaagtctcggaggcaagttgatgtgtgagtttttatcgcagatcgaatggatttctgattcccttgcctctgtcaaaagtccgattatgcttcagaagcatattgactcgattgcttaa

SEQ ID NO: 100515 - DNA, 921 bp, Glycine max
  Peptide Sequence Number=SeqID_217293
atggaagaggctggggacaagggtagaaaggatgtcataaggaatggctatgaaagatcacaacataaacaatcagcggtgggagagtggtgggagagttatgggaacatgaccaagtgtaggaaagctgctgatgaagaagtagtggacacaactgcttctcaagctcagaagagaaccaaaaagaagatggacacaccattgtccaaagctgctcctgcaccacaacatctaccttccactttggttgctctaaaggcaatgggtttgagtgagactgatgatgatgaagataggttagtgttcagaaaaaggaaagttacacctcctttggatgagaccactaagcctcaaaggaataagcaatcctctactgttgctgccactaattctccacttgtagagattcctcccgtaggagaacaaatctccattgtccaacaatttgaaagaagcttaagaaggactgaggttattcacctcaagaagaagaaaagaaccaagtccaatgctaatatggatggtgacattcaacaccaagcacctctatcacccatccaccttgtcatcgacctaaacctcattacagatgacataacaagtttacaatttcttgtggcctttctctatgagaatgcttacaacattcaaaggagattggacgtggaattccaaccttccatagactggatgcaattacccctggatgttaaggaggagattgtcaattgccctccatccatgcataatgatgatgaagttgcaccatcttttgctgctttggatcaatctacaaggattaaggtccttcctccaccaacttggaagcatcttcaccctaaaataaccaagcctacatcccaatggccttgcgcaaaagtgtttaaaagatttcatccagtgcctgcagaggagtgttga

SEQ ID NO: 100516 - DNA, 936 bp, Glycine max
  Peptide Sequence Number=SeqID_217294
atgtggtcccagatcatttactatagcattcttgatatgaccatttgtgagaattcacttgataacccaagcttgtggaagcggaaggtgctaaaggagcaaacaagttcttttagcttggttcttgagaggccaacatctccttttcccattcaactactgcacaagatgaatgatcttgaaatagtgttcaatagaggtcgagttcctattgccacatggaacaagaccctattggcatcaaatttacaatcatctagtgagagctgtgggaatgccggatttttgatgttcaactcaaaatttcttaaaccaaatggaagcaagttattgggcaatcaaaatcaacataccatcacccatggtgagagaaacattgttactgaacacacaacacaacttgcttgtgtttttactgaagaagtgtgtggagatggggattgggctcatggaagttttccgcttgaggaatatattcaggctctggatcgttccaaagatgagatgtactataatcactctcttggtatgcgctatagtaagggagttactgctgttctgaacttccaaagtggaactgaagctgaaaattggggaatcaatgcaaaatcaatcaatgaatcttttcaaaggaaaaatattctcacgatcaactatccgatacgggagggagattcttatgatatgaggaaaaaactcccattttgtgtggggcttttattacggctgctaaggaagaatcttcgtgtttttgttacttgcacttctggatttgatcgggctcctgcttgtgtgattgcatacctacattggatgacggatgtttcccttcatgcagcatatacttgggtcactgggatgcacacatgcagacctgacaggttcatcttgcctaacttcaaacacttttgcatcatatgtttacttttcaattga

SEQ ID NO: 100517 - DNA, 342 bp, Glycine max
  Peptide Sequence Number=SeqID_217295
atgaatgcatgtcccaaaaatatgtgcaaaccaaattgccccatgggttgtttccctacaaaatcacgcgctaatgccattgaggcatttcaccgaacacttggcctagggccatctcatacaaacccccaattcaacttaatcaagcgagaaaacaaaccaaaattgccccacatatttgagcacattcccacaattaagagcaccaaaaggagatcaaaatacaccaatgaaaagctagaaagcttagggatggaatacttacttgttggtgatgaacaaaagcgcgaaacggaatcaaaaaatgcgaaaagtgatgaccctaagactgcaaactcgtaa

SEQ ID NO: 100518 - DNA, 213 bp, Glycine max
  Peptide Sequence Number=SeqID_217296
atgatgcgtgtggtgatggtggtgggggtgggagtgcagtggtgcatttggtctggtgtggaggtgtttgcatgcagtggtggtgagtggagccgtgggggtgcaatgcgtctgccatggaggtttggtagagaggaagctagggtttttcttgggagaagaagaataaaaaggggatataaagaagatagaggtgcacaaagcaacccatag

SEQ ID NO: 100519 - DNA, 930 bp, Glycine max
  Peptide Sequence Number=SeqID_217297
atggtctatgctgacatctgttttaaagggacaaatgccaccactcataggcttgaaggcgcaagtccaaacttcaaggcaccttcactctcttcaacccgaaccgcttccaaacctccgaaatccactctcaaattcctctgtagctacggcggcaaaattctccttcgttaccccgatggcaagctccgttacctcggcggccatacctgcgtcctcgccgtcgatcgctccattccattctccgagctattgctgaagctagaggagctctgcggtgcctctgtgaggcacctccgctgccaattaccttctgaagacctcgatgctcttgtctccatcacctccgacgaggatctcacaaaacctcatcgaggaatacgatcgcgtttcattgccgaaattatacatttcaagtatctgatttgtcgtacttaccacagacatgatgcagccagggctgagaatgctttgactcttctttatggcaatgagccaattggcatgcaaagagactggaatgaagagctgcagtcttgtagagaatttcctcgtacatctcctcagaagaggattttgcgggatagggcactttataaagtgacatcagactttgttgatgcagctattaatggtgctattggagtgatcagtggttgcattcctccgataaacccgactgaccctgaatgctttcacatgtatgtgcacaacaatatattctttagttttgctattgatgctgaccttgagaagctgtcaaagaaacttgtggatgctaattcaaaatcttggagctccaactctttgcaaagttcttctgataaagattccattccagttcatggagaaagtcaggttcctaatgggggtaaagatgatggttcaagttctgaagatcttaatagcacagaaattagcgaactttaa

SEQ ID NO: 100520 - DNA, 192 bp, Glycine max
  Peptide Sequence Number=SeqID_217298
atgtttgtattgaacactactttgaaaggatttgacgatactccacaaagtaaatccaaggctgctgctaggtggattattattaaatattttaatgatgctagattattcgaatcagagagattgaaggcgcttcgcatccagtgggcaacctattatttgaaagttaaaaatgaaacaattggtgtttaa

SEQ ID NO: 100521 - DNA, 1446 bp, Glycine max
  Peptide Sequence Number=SeqID_217299
atgaccatgaaccctttggatccacaagaattcaggaggcaagggcacatgatcattgacttccttgctgattattaccagaacattgccaactatccagtgttgagccatgtagaaccaggttatcttagagaactcatgccatcttttgcacctctcaaccctgaaccaattgaaaccatccttcgagatttgcagcagcacatagtccctggcataacacactggcaaagccctaattactttgcttactttccctccagcggtagcacagcagggtttcttggtgagatgctgagcacagggttcaacttggtagggttcaattgggtgtcttcaccagcagcaacagaattagaaagcattgtcatggagtggctaggtcaggttctgaagctcccaaaggcttttctcttttcaggtagtggtggaggtgtgctgctaggtacaacatgtgaggccattttggtcacactagttgctgctagggataaagtacttagccaaattggtagagaaaatatttgcaagcttgttgtttatgtctctgatcaaacacattgtgctgtacagaaagcagctcatataataggaattctccccaaaaatattagggttgtcaagactatgaagtcaacttcattcactttgttgccagagtcactggtatcttccattcacacagatgttcaaaaaggattggttccttgttatctttgtgccactgtgggaacaacttcaaccactgcaattgatccattaggaccactgtgcaaggtggcaaaagaatatggcatgtgggtccatgttgatgctgcttatgctggaagtgcatgcatttgtcctgagttcagacacttgattgatggagttgaggattgttgctgtctttgggtgaaggatccagcttctgtgattaagtccctatcaacaaattcagtgtacttagaaaacagtgcttctgattcaaatcaagtggtggactacaaggactggcagataaccttgagcagaagattccgtgcactcaaagtttggcttgttctgagaagctatggtgttgctaatctcagaaacttcctcagaagccacgttgaaatggctaagacttttgaagggttggtaagaatggataagaggtttgagatttttgtgcctagaaatcttgctgtggtttgctttaggattttaccttgtgcagttgcaaggattggtaatggtagggtccaaaatggatatctaacaactgaggatgctgcaaatgaaatcaaccgcaaattgcttgattcaataaatggttcaggacttgtgtacatgactcatgcaattgttggaggggctttcgttattaggtgtgccataggagcaactttaactgagaaaacacatgtcatcatggcctggaaagtggtgcaggaacatgcagatacaattctaaaccattaa

SEQ ID NO: 100522 - DNA, 666 bp, Glycine max
  Peptide Sequence Number=SeqID_217300
atgttcaaaactttcttcattattttccttctctctttttcggtgttcactccagaacccttacttatatcagctacaccctcccttcaaaatcccgagaacattcaaaagggtgtgacactagaaagtgttgaaatcacaagtgccagaaaatatctcaaggcatttggatacctagaagactacgaaaccaatttcaacaacaccgacaccagcaacacgcatgatttagaaacctcaataaaaaaaaaccatgaaactaatatcgttaccaagatgcgacacctaaggtacgtgttcgaatccggtacggaaggtgcaccgttagggtttctacggagggttttcagagaggcgtttcggcaatggtcgtttttcagcggagaccagggagatgagttttcgtttgacaagtttggaccggttttggcacatgcttttcaaccacccgatggaaggttgcatgttgatgcagataagccgtggagtgttgaagttccgatagagagggagtattatgattttgtgtgggtggccatgcatgagattggtcaccttcttgggcttggtcatagctcgcatcgtcgtgctgtgatgtatgcgtctgtgcatgctggagtgaataggatcggaggaaacttaatgtggatgatgttgcaagtataa

SEQ ID NO: 100523 - DNA, 354 bp, Glycine max
  Peptide Sequence Number=SeqID_217301
atgaaggaaggtggtggtagaaagcaaggtgcagcctcaccttgtgctgcatgcaagcttctgaggagaaggtgtgctcaggattgtgtttttgctccatattttccagcagatgaaccacaaaagtttgcaaatgtgcacaaggtgtttggtgctagcaatgtcaacaagatgcttcaggacctaccgatgcatcaacgaggggatgcagtgagtagcatggtgtatgaggccaatgccagagtccgagaccctgtttatgggtgtgttggggccatctcttcgcttcagcaacagattgatgtgttacagacccaattggcccgggcccaggctgaggtggcccatcttcgg

SEQ ID NO: 100524 - DNA, 1077 bp, Glycine max
  Peptide Sequence Number=SeqID_217302
atggagaagctcattttcttttcttcttcttattttcttctcttagaagcacttccagagagacttacccaaacagggttcttatggactcgcaccgcgttggaaatcgcctcgccttcaataaagcgtttgagaagcttggactcgattgcgccaactggactgaacctgtctattccgatctttcaaagagaagtgctggagatgaggaaaagatggtgtttctgtattttaatcgtgaatttttttaaagaaaggggtaagattgggtggccttcttcgttacccacaaatgagcagggactgtttgcaaaaagagttttgcagcaaaagatttacgagaataacttgccctcagttcttttattccaaaaacaaattcaaaaagaaagtatagatgggaaaaaatttccaattggaggcagggaaaaggcattagaagagtttgtgatgtcaaaaagtctacctttacgacctggtcttgaacagtttattgatgatgcatataatgaaggaattccagtggtaatattaacggcctacagtaaaagtggtgataatattgccaggtccataatggaaaagcttggtgacgatcgaagcataaaggtcattattgtagggaataaggaggttgagcaaagtttatatggacaactagtctcgggaaaggtaattgcttctggtttggatgaagagcttgccaaggaagccaaaagagctgtttctgctgaaaaacaaaggttagcaaaggaggtagcatccatgctaaaattgagtgttgagattgataccggctcatctgaaagtctagctaagattgtggctgcactacgtgccggagctgaatatgcgggtatacccgtctgcaactgtgtccttgttgcaggaagccaatctggcgtagctggagctacacaggtgggcatgccatgtgttgttttacgaagcagtttgacatctagagccgagtttccattggcaaacgctacaatggatggatttggaggtgtggatctaacaatttcaaaattacgcaatctactccccaagaacagccaaaggactgaatggtaa

SEQ ID NO: 100525 - DNA, 237 bp, Glycine max
  Peptide Sequence Number=SeqID_217303
atgaaggatatcaggctttctgacaacccaattactgattctggaagaggtggagttccaagatttgttttgattgcccgtttagcaaaaattcagatattaaacggaagtgaggttactcctcgcgaaaggaaggactctgagattaggtatgttcggctagtggtctcaaggttgcatgctagtcctgaagaaatcaaacagcatcccaggttcttcaggatatttggattttga

SEQ ID NO: 100526 - DNA, 482 bp, Glycine max
  Peptide Sequence Number=SeqID_217304
caacctcctacaacgtggtggatttcggagccaaacccgacggcacgacggatgccacgtcggcgttccttggcgcgtggaacaaagcttgtagttcacccaaacccgctggcatccacgtgccgcaagggaggttcttgataggaagagccgtaacctttagtgggcaatgttcgaaccgtgccatctccataacaattcgtggcaccttgctggctccttctcaatacaccttcctagggaattctttgtattggttcacctttgaccaagttactgggctttccattcatggtggggtgcttgatgctcgaggcagtttcttgtgggattgcaagtacaaagccatgcctaattgccctattggagccgcgggcttagatgcagaaaatggactgtggagaattgggcgaattaagcgtcttttcaatgtgtatttgcctaatcatttgtttgatatggtggaaatagtgaggaaataa

SEQ ID NO: 100527 - DNA, 312 bp, Glycine max
  Peptide Sequence Number=SeqID_217305
atgggtgagaagccatcattgacgaagaagctaccagcaacaactacagttgaatatcaatactactctagcaatgtaatgctcagtctgtcaagatttaaaacaacccttctgattagctttttttctcaggtcggtaagctgaaatttctctgtgaaagcttttttaagctgaagtccatgaagctaaaattatatcttcgagaagagggttctccatttcccatgctgcttgacaatgacacttcatctcttatggaccttggaatcggcaatgattctattatccttgttgacgaagaaagttcataa

SEQ ID NO: 100528 - DNA, 808 bp, Glycine max
  Peptide Sequence Number=SeqID_217306
atggcgagtaaggaggttcgacgtagcaatgaggttataaaattctctcggtctcgagtgatgtttctgtgtcaaaagacacttaggttcacaaactctgaacacattgtgatcactgggttgacttctgaaaatagtcaaaaggttcacatactgataaatgcatgccacaacgtgaaaatgcatggagtgaagctcatggctgatggaaacagccctaacactgatggcatccacgtccaattctcaaccgatgtcaccatcctcgcacctagaattcaaacgggagacgattgcatctctgttggccctggttgtagaaacttgtggattgaagatgttgcatgcggacctggtcatgggataagcattggaagcttaggatgggacttggacgaacctggtgtgaaaaatgtgacagttagaaaggctacattctctaaaactcaaaatggttttagaataaagtcttgggggaggcctagcaggggatttgtgcaggatgtccattttgaacatgcaacaatgaatgatgtccaaaaccccattataatagaccaacattattgcccatttcgcaatggttgccctagtcaggcctctggggtgaagataagtgatgtttcatacaaagacattcatggaacatctgcaacacaggttgctgtgaaatttgattgtagttctgagcagccatgcgaaagaataacgttggaggatattacattcacttacaagatcaacaaagctccccaagctttgtgtaatcacgctggtggaatcacattgggtgtagttcagccacaaa

SEQ ID NO: 100529 - DNA, 192 bp, Glycine max
  Peptide Sequence Number=SeqID_217307
atgtcagcatcatcatcagctgccactagagcttatgattgggtttccaattggggtgaggacaagttcccctacatggcaaatgcatctgtggctttgtccttggttgcttttgtggcctttgccttagcctctcttgtctctggttctattgttgtggatttacagcttgctgaactggcttgtatatga

SEQ ID NO: 100530 - DNA, 882 bp, Glycine max
  Peptide Sequence Number=SeqID_217308
atgtccattgaagcagatgagatttacaaaatatgcagtgtgctaggtagtccaaccactgaatcttgggcagatggactcaaacttgccagggatatcaactatcagtttccacagcttgctggtgtacatctctctacactgatcccatccagaagcgatgatgcaatcagccttgtgacgtcactttgttcatgggatccctgcaagagaccaactgcagcagagagttgcttttacatccctccatcccttcgcaccagagctgtaaccagaactccaccatctgaaatgacctacggttcaattggaggtgatcctaaactagttgtctttctggttgcagctgggaccaggggatcactggatcggctgggcctcaagagatactctggtgctttgcctaatacaaaaatcaccaacaattttacttccccaaaagtacaagcttctatagcttcaggcaaaccagtaccagtggtaccagaaatagaaattacaaggcacctaagtgctgccctccaaaaacatgatactcattcctttctaaacattacaggtgtgcaaaggaagctggatatggcaaatgaggatggaattaagagcaagaaatcattgaagactactcaacaatcaaaatatcgattaccaggaaaaggcagcccaacttctataaacaaggggaggactgcacgtggggtttcagaaacagctgagaagttggtcaatatgtcaatcggtactcgaagactgtccttgggacaaacccgtccgcctcccatgaaggctggagtcaattggatttctgaatctggaaacttgctcaggtccggacaacaaattccaactgaaagaactttgacaagaaaagttgccgggtga

SEQ ID NO: 100531 - DNA, 300 bp, Glycine max
  Peptide Sequence Number=SeqID_217309
atggattcacaggttgcagaaacaccaatcctttccacaatgaaacacacattagacaatttcatcttcaatgacctcaccaataaatcaaatcattcaaccttttgcgagacactcccgaatcttctacttcagcatgcccttgtagtcaccgtagaccagagcgtactccagcagctcctcccactccaccatcccaagaaactcctccttggagatgaagatgtagtccttcccatcaacctcgatagggtagcggggcgcgtggtagtggtgacaaggaaatggagggtgcaatag

SEQ ID NO: 100532 - DNA, 204 bp, Glycine max
  Peptide Sequence Number=SeqID_217310
atggagagggaggggttgacggcgttagcaagagacgttagttttgacggaaaatgtttggggagagtatggaagccgttacagaaaaacgatggtcgagggcgtagaagacatgagggcccacatgttcatgctgatgcaatgcaacaacacacagaggtatctttaacgtgcgtaggtagcatgacacgtgtcggattttga

SEQ ID NO: 100533 - DNA, 2982 bp, Glycine max
  Peptide Sequence Number=SeqID_217311
atggctgagtttgtccttgaaattgtgcttgagaatttgatctcacttgttcgaaaggagttggtactatttctgggttttgaccaagacttggaaaggctttcaagcttgttcactacaatcaaggctacacttcaagatgctgaggagaaacaattctcaaacgcagccataaaagattggctgggaaaactaaaatatgcagctcacgttctggatgacttcattgacgagtgtgcctatgaaggattgaggttggagaaccaaggggtcatgtgtggtccttcagacaaggtacaatgctcttgcttatcctctttgcatcccaagcgtgttgttttccgttacaaaattgttaagaaaatgaaaaggataagtcagagattaatacaaatcgctgaagaaaggactaagtttcatttgactgagatggttcctgagagaagaagtggagtccttgagtggcgccaaactgtctctctacttactgaaccaaaagtctatggaagagaagaagagaaagataaaattttagactttttgattggtgatgcttctcattttgaggatttatctgtctatccaataactggtctaggtggacttggaaaaacaacacttgcccaattcatcttcaatcatgagaaggtagtcaaccactttgagttaagaatttgggtatgtgtttcagaagattttagtttgaagagaatgacgaaagttatcattgaagcagcatctgggcgtgcttgtgaagatttggatctagagccacaacaaagaagacttcaagatttacttcaaagaaaaagatatttgcttgttttggatgacgtgtgggatgataaacaacagaattggcagaggttgaaacctgtacttgcttgtggggccaaaggtgcttctattttagttactactcgccttttgcaggttgcaaaaatcatgggaacattgcctcctcatgaattatcagtcctgtccgacaatgattgttgggaattgtttaaacaccaagcctttggaccgaatgagggagaacagatagagcttgagaagatagggaaggagatagtaaagaagtgtcaaggaatgcctcttgctgcaaaagcactaggaggtcttttacgcttcaagagaaacaaaaatgagtggctcaatgctaaggaaagcaaccttttggagttatcacacaatgaaaaccccataagtcatgtcctgagattgagttacttgaacttaccaattgagcacaagcaatgttttgcttattgcgcaatatttcccaaagatgaaagcatagggaaacaatacataattgaactttggatggctaatggattcatttcatctaatgaaagattagatgccctagatgtcggggatgatttgtggaatgaattatattggagatcattttttcaagatattgagacaaatgaatttggcaacattacaagtttcaagatgcatgatcttgttcatgatcttgcactatctgttgcagaagatgtttgttgcactacaaaagacagtcgtgtaactacttttcctggaagaattctccatctctcagatcataggtccatgcagaatgtacatgaggaacccattgattcagtgcagttgcatctattcaaaactttgaggacctatatattgccagatcactatggtgaccaactttctccgcatcctaatgtgttgaaatgtcattccttgcgggtgcttgattttgtaaagcgagaaaaattgtcatcatcaattggtcttttaaagcatctaaggtacttgaatctttctgggggtggcttcgaaactctgccagaatcagtatgtaaactatggaatttgcagatattgaaattagatcgttgcagtcgtctcaaaatgttgcctaacagtttggtatgcttaaaagctctacaacaactatcttttaatggttgcccagaactatcaagattacctcctcgaatagggaagttaacttccctaaggattttaccgaagttctttgttggcaaagaaagagggttccgtttggaagaattgggaccgctaaagcttaaaggagatcttgacatcaagcatcttgaaaatgtaaaaagtgtaatggatgtcaaagaagccaatatgtcaagtaagcagttgaataagtcgtttctgtcatgggaaaaaaatgaaaactgtgaattagaggacaatgtagaagagactcttgaagtgcttcaacctgatacccaacaactttggagactagaagtggacggatatgaaggtgcccatttcccgcagtggatatctagtctttctctcaaatatttaaacttgaaagattgcaaaaactgtttacagcttccaccgttgtataaacttccttctcttaacactctaagaatacttaacatgattcatgttgagtacctctacgaggagtcctatgatggggaagtggttttcagggctctagaagagctgacattgcgtcgacttccaaacctaaaaaggttatcaagggaggatagggaaaacatgttcccatgcttttccagacttgaaattgatgaatgtcctaaattttttggagaggaagttttgctacaagggttgcgctctctctcagtattcaattgtggcaaattcaatgtgtcctcagcagtggaagatttgcaggctttacaagatatgacttccctgcaggagttaagattaacgggtcttccaaagctagaatccttgccagactgctttggagacattcccttgcttcacacatttagtattttttactgttccaagttgacgtatcttccaatgagcctaagacttaccaccagtctgcaacaattgactatttttggttgtcatcctgagttagagaagagatgtgataaagaaacgggagaggactggccaaacatagttcacatttcccatatttcattgggaattaaacattatgatcataattccgattga

SEQ ID NO: 100534 - DNA, 216 bp, Glycine max
  Peptide Sequence Number=SeqID_217312
atgggtggctgcggactgcggtttcagttaaaattaaaattggataaatattctacggattctcctgtgcaccaccagagaatggataaaaaccgtagctgggcagtggaggccggcggcggcggcgtggtggcgcctgagggggagatcgagtgcggagtcagagaaagcttcaagaagaaaacgagagcggtggagacggggaagcatgagtag

SEQ ID NO: 100535 - DNA, 801 bp, Glycine max
  Peptide Sequence Number=SeqID_217313
atggaagttttgctgccaaaacttccttctttcaaatttccaagtgccacttattgctgctcgatcactagtaggagctcttcatatgtcagatttgggttccgtcgtgtatctgtttgtgcatcaactgtcaatgaaacagtagctgaacctacagttggttcctcttctttgggtcactccacgcgaccccatttccctatacttcaccaggaagtaaatggctcaaaacttgtttacttagacaatgcagcaacttctcagaagcccaccactgtgttgaaggcattgcaaaactattatgaagcttacaattcaaatgtgcatcggggcatacatttcttgagccaaatgctttattgtataattgtttatggatgtagtgcaaaggccacagatgagtatgaatcggctagaaggaaagttgcgtcttttataaatgccactgattccagagagattatattcacaaaaaatgcttctgaagctatcaatcttgttgcctattcttgggggctgtcaaacttaaaaccagatgatgagatcatacttacagttgctgaacatcacagtgcgattgttccttggcaaatagtagctcaaaaaacaggggctgttttgaattttgtggatctaaaccaagatgaaattccagacatagacaaattgaaagaaatgctctcaaggaagaccaaaatagttgttgtccatcatctttctaaaatccctgattatatcacaaaaaggtcactaggttttgaaggcctctatactggtttcaacaatgttttcccaccttga

SEQ ID NO: 100536 - DNA, 264 bp, Glycine max
  Peptide Sequence Number=SeqID_217314
atgacaaggtcgagtttagccgctcttagacttcatcttcgtcatcctcatcatccctcaacgattctgttgtacattacaagcctaggaaaattggtatcctggtttgggtgtcggtgttatttggttggagatggtggcagttttgtgaagatggcactgtttgagaagaagaagaagatgaataggggaaggtggcgacatgtaccattgtgtttcttcacgagtaaaacgggtgaagaaaaagggttattgctgggttga

SEQ ID NO: 100537 - DNA, 1185 bp, Glycine max
  Peptide Sequence Number=SeqID_217315
atgaggaatttatttgaggaatccgttaattcagtgcacttgcgtctagtcaaatctttgaggacctatatattgtcagatcactatggtgaccaactttctcctcattctaatgtgttgaaatgtcattctttggaggtgcttgattttgtaaaaagacaaaatttgtcatcttcaataggtcttttaaaacatcttagaggattccgtttagaagaattaggtccactaaagcttaaaggagatcttgacatcaagcatctggggaatgtaaaaagtgtaaaggatgccgaaaaagctaatatgtcaagtaagcagctgaataatctgttgttgtcttgggacaaaaatgaggagtctgaatcacaagaaaatgttgaagaaattcttgaagtgcttcatcctgatacccaacaactttggagattagacgtggaaggatataaggggttccattttccacaatggatatctagttctcctctcaaacatctaatgcttaaagattgtgaaaactgtttacaactttcaccaattgcgaaactgccttctctaaagactctaagaatacttaacatgattcatgtagaatacctctacgaggagtcctatgatggggaagtagttttcagggctctagaagatctgtcactctgtcggctgccgaagcttaaaaggttatcgagggaggatggggaaaacatgtttccgtgtctttccatacttgaaattgatggttgtgatagatttttgggagaggaagtttttctgcatcggttgcactctctcactctaattaattgtggcaagatcaatgtgtcggcaggttttaactgccttgagaaattgtggatttcagaatgcagagtggaaagtttgcaggctttacaagatatgacttccctgaaggagttacgattaaggaatcttccaaagctagaaaccttgcctgactgctttggaaaccttcccttgcttcacacattgagtatttttttctgttccaagttgacatgtcttccaatgagcctaagctttagcggtctacatcaattgactatttttggttgccattctgagttagagaagagatatgagaaggaaacgggagaggactggccaaacatagctcacattccccatatttcagtgggcagtaatctttatgatcatatttccgattga

SEQ ID NO: 100538 - DNA, 533 bp, Glycine max
  Peptide Sequence Number=SeqID_217316
atgcccccggtggtatcgctcgtcacaattgaagcacaacccgcgctccctgtgggttgcaatctcctccggggtcaaccgcttgacggcggggggagggtaaaggcgggggtggtttggggcgtagttggggtcgcgcatcagcaatcttttcctcctgcagacgagccaggcctgccacctgaacgaggggggaaggccaatcgtgcggtttgcgagttcttcgaaggcggcaagccttgccatgaagtgaactggtggttactattcatccattggaaccaagacaaggctcggccatccatggggagcaacaggggtcggagaagacgaaggcactgggtcagggagcacaggaggaagacggtggaggagctcatcaagtttcagagtcatggtttgaagggtctcagcaagggaaatttggtgggttgtaagcttgcggatggcttcttcgagggtaaggggagagtcggccatggaggaggaatcaacgagagcaccaagatgatagggggcgaaatagaagactg

SEQ ID NO: 100539 - DNA, 981 bp, Glycine max
  Peptide Sequence Number=SeqID_217317
atggatggccgagccttgtcttggttccaatggatgaatagtaaccaccagttcacttcatggcaaggcttccttcaagcacttcaaacctgtttcgcaccgtcccagtatgaggatccgacggggacccttttcaaattaacgcagcgtggcacggtggctgagtaccttgccgccttcgaagaactcgcaaaccgcacgattggccttccccctccctttttactgagttgctttgtttcgggcctcacccccgaaattcgtcgtgaggtggcaggcctggctcgtctgcaggaggaaaagattgctgatgcgcgaccccaactacgccccaaaccacccccgcctttaccctccccctctatcacacaaccccttcctctcagaactcttaaccctaaccctacccctctcttacctagcccttcgcgacccaccccacccgccgtcaagcggttgaccccggaggagattgcaacccacagggagcgcgggttgtgcttcaattgtgacgagcgataccaccgggggcatcgctgttcatctcgagtttttctcctcatctctgaggatgatgaccttccaccctttcaaatacctcagcccaacccgcaacccgaacccgaaccccaaacacccgacccgatagacccgtacccggcccaaattagctttaactctttagctggaaatgttgcgcccgaaacgctgcatttcatggggaccatcggaaaccgccatgtggtactgctggttgacggtggcagtactcacaatttcatccaacatcaactggtttcccaattgagcttgactcctcgcacgaccacccctttgcgtgtcttggtggggaacggacaacaattagagtgcagcagtgtttgtgagtccgttccggtcaccatccaagctactgaattcatcgtcgacctccatgttcttcctattgcaggggccaatgtggttctgggcgtccaatag

SEQ ID NO: 100540 - DNA, 294 bp, Glycine max
  Peptide Sequence Number=SeqID_217318
atggagaaagatgcatcgcacgtaggaccttggaatttaggctttaatcccttctttttctctcaaacgtttgggaaccttaacagatcaatcagaggagaagctctagagaacaccagaaatatcacaattgataacagagaacgcttgaacgactacatcgagtgttgttatagtgtgattccaaaaattattcaagtgttggagtttgagaatattatggttagatttgaggggttggacctgaatcaagagggagagaccctaacagactcttcggagtgtaggccttag

SEQ ID NO: 100541 - DNA, 342 bp, Glycine max
  Peptide Sequence Number=SeqID_217319
atgtcttcatttggcagtggtgatcttattcaaaattttggaatgagtgtcaacacaagcattacaactattgtaggacgtgtacttggttctccagagttgaagttaggtgatccaaatagaaagatcatcaaattaacagtggatatggagaaatgtcactggaatctttctggaagatcaatggtggaaggtaaaccgattgagtattggggcattcttgatttcactagttgtggttcatataagtacaaattaaggggaaaggaattcattcaaaagcttatagggagccccatttggtatgaagaatcttcaatggaagatacttgcaagttatga

SEQ ID NO: 100542 - DNA, 2823 bp, Glycine max
  Peptide Sequence Number=SeqID_217320
atggcttcctttggagaacaacactctacccaatatccaaccccagagaggcctaaacacaaactttcacaacatgagaaaaaaccactttctgcatacatctgtcatgatccaagaagccttggttcatctaagcacaaggcagagaaaggcacaacacaaacacaaagtatgtcttcttcttctcaattcacaaggggtggttcagcttcagaaagatcaaattctaagtcactggtgtctgcagattcaagaagggtgggacacttgatggatgatgtttccattaaagcagtgattgctattctcagtggctacataggaagatatgtgaaagatgataagtttagggaaacaatgagagataagtgtagttctttattggacagaagaagaacaacaacaacaacaaaggattcaggtggtgaggtttttgtgaacatggaattgggtatgaagaaggttgacagattggtagaaaatcaaggaacaatggaacaggtgaggatgatcaaaaggttaaggaattccattgagcttttgaccatagtttctagtttgaattctaaaacttccagggatgcttcaacctgtggtgtaccaaattcacatctctcagcttgtgctcaactatacttggcaattgcttacaagttgcagaaaaatgacagggtttcctctaagcatttactgcaagtgttttgtgattctccaaatttggctagaacttacttgcttcctgacctttgggagcatttgtttcttccccatcttctacatgctaaaatttggtacaacactgagcttgagtttctttcaaatgaagctcacggtcagaaggaaaagaaaatgaaggtgctgagcaaagtttacaatgaaaaaatggatatggggactaatctgtttgctcagtactacaagcaatggcttaaagttggagctagtgagcctcctcttcctaatgtctctttgccatcaaggccaagttacagatcatcaagaaggtcttcagattcctttatttcaaattcctcaatcaacccaaacttatacaagacagtgtttggctccaaactagagcagaaaacgactggtcttggtgaccaaaatggagtgttggcaattactacaggtttggagattgatgaaaagttgtatgtagatgaacacagatgcagttcagttcagaaatatgatagggtattcgttgaaagatcaagccaacttggtaagagtcaagctcaattatggcctgtgccgcagagatcagattattttcaatgcctttcttgcaggttcataccagaggaaagcttcaaaaacagcaactatagatccaagaatgtttcaactctttcgagagactttgttggagccattacaactatatgttcatcagatgttctaagtgaatgtgaattcgctattcgtgtggttaccaaagcttggttgaactctcctggcgatcctcttgttgaagaagcactaacacaacctaatgtcgttgaagctatgcttgaggtgctattttcctcaactgaggatgagatccttgaattgatcatatcaattttagcagaattaataggaaagaatgatgcaattagacaaattattctgaactctgatcctcaactagaaatatttgtgaggcttctaaaaagcactagtctgtttctaaaagctgcagttcttctttatctgtcaaaaccaaaggcaaagcagatgttatcttcggaatgggtgccattaatacttcgagtgttggaatttggtgacaaattgcagaccctcttcacagtacaatgcagtcctcaagtggcagcattttatgttttggaccaaattcttacaggttttgatgaagacaagaacttagaaaatgcccggcaagttctttcacttgggggattgacactgctaatgagaagaattgatggagaggtccatgagagaaacaatgctgctatgataatttcatgttgcattcgtgccgaaggaagctgtagaagttttttagctgacaacataaataagacttctttgcttgaacttattgttattgggagtaaacaaaattccagtggctatgccttgtctgtgctagctgagttgctctaccttgataggtatatgttgagaggacttaattttcataccagaagaaccaagactttaaatttcttgagaggacttaaagatggatggggtggctttaatgtgatgcacattttcttcatttaccttcagaagtctccacctgaagaacgccctatagttgcagtgatattattgctgcttgatcttatgttcacaaatgcagtagcagttgtgctgcaggaagatcctttcaagggaagcttacatagatcagaagcaattgagacacttatagaagctttaaattgtcaaacatgtaatgatagagtgcaacagcaatcggcccgagctctagtcctattagtaggtcacttttctgattcaggggaatcattaatggaaaaattgcttttacaaaaagcaggtttcagagaaatttgcttagaagattcatatcctggcaaggaaattgttgtttatgatccaattcacaagaatgtggaagaggaagaagcagaaagttggcaaaaaagagcagcttgtgtcttgttcaaaagtggaaataagaatttgctatcagcacttgcagattccatagccaatggcatcccatgtttagcacgagcaagcctcataactatttcatggatgagcagctacctcaacatggttgaagatcgaaagttgccaccaatgatttttcatcacggtgtctcccaatga

SEQ ID NO: 100543 - DNA, 3021 bp, Glycine max
  Peptide Sequence Number=SeqID_217321
atggctgagtttacccttgaaaccgtgcttaggaatttgaacacacttgttcaaaaggagttgccactatttctgggttttgataaagacttagaaaggcttgccaccttgttcactacaatcaaggctgcgcttgaagatgctgaagagaaacaattctcagacagagctatgaaagattggctgggaaagctaaaagatgcagcactcatcctggatgacatcattgatgagtgtgcctatgaaggattggcgttggagaaccagcgggtcaagtctggtccatcagataaggtacaaggctcttgcttatcctcttttaatcccaagcgtgttgttttccgttacaaaattgctacaaaaatgaaagggataaatgagagattaattgaaattgctgaagaaaggaaaaagtttcatttgactgagctggttcgtgagagaagaagtgaagtcattcagttgcgccaaactggctcttccatcactgaaacacaagtctttggaagagaagaagataagaataaaattttagactttttaattggtgatgctactcattcagaggagttatccgtctatccaatagctggtgtaggtggacttggaaaaacaacagttgcccaactcatcttcaatcatgagagagtagtcaaccactttgagttaagaatgtgggtatgtgtttcagaatattttagtttgaagagagtgacaaaagctatcatcgaagcagctggccatacctgtcaggatttggatctagagtcacaacaaagaagacttcatgatctgcttcaaagaaaaagatatttgcttgttttggatgacgtgtgggatgataatcaagagaattggcagaggctgaaatctgcactagcttgtggggcaaaaggcgcttcccttttagttactactcgccttttgaaggttgtggcaatcatggggacattgcctcgtcatgaattatcggtcctgtccgacaatgattgttgggaattgtttaaacaccaagcctttggaccaaatgaggaagaacatgtggagctcgaggacatagggaaagagatggtaaagaagtgtcggggaatgcctcttgctgcaaaagcactaggaggtcttttacgcttcaagaggaacaaaaatgagtggctcaatgttaaggaaaacaaccttttggagttatcacacaacgagaactccataattcctgtcctgagattgagttacttaaacttaccaattgagcacaaacaatgttttgcttattgcgcaatatttcccaaagatgaaagcatagggaagcaatatttaattgaactttggatggctaatgggttcatttcatctaatgaaagattagatgttgaagatgtcggtgatcaagtttggaatgaattatatcaaagatctttttttcaggatattgagacagatgaatttggcaaagttacaagtttcaagatgcatgaccttgttcacgatctagcacagtctattgcagaagatgtttgttgcattgcagaagacaatcgagtaactactttgcctgaaagaatacaccatctctcagatcataggtccatgtggaatgtatatggggaatccaaaaattcagtgttgctgcatccagtcaaatctttgagaacctatatattgccagatcactatggtgaccaactttctcctcatcctgatgtgttgaaatgtctttctttgcgggtccttgattttttaaagcaagaaacattgtcatcttcaataggtcttttaaaacatctaaggtacttgaatctttctgggggtggcttcgaaactctgccagaatccctgtgtaaattatggaatttgcagatattgaaattagatcgttgcaatcgtctcaaaatgttgcctaaaagcttggtatgcttaaaagctctacgacagttatctttcaatgattgccaagaactatcaagcttgcctcctcagataggaatgttgacttccctaaggatcttgaccaagttctttgttgaaaaagaaaaagggtttcgtatggaagaattgggacctctgaagcttaaaggggatcttgacatcaaacatctaggaaatgtaaaaagtgtaatagatgccaaagaagccaatatgtcaagtaagcaattgaataagttgcgattgtcatgggacaaaaatgaagaccttaaattacaagaaaatgttgaggagattcttgaagtgctccaacctgatgcccaacaactttggagattagatgtggaagaatataaaggtgtccattttccaggatggatgtctagtccttctcttaagtatttaacccttttaaatctgctgaattgcgaaaactgtttccaacttcctccattgggaaaacttccttctctaaagattctaggaataatgaagaataatcatgtagaatacctctacgaggagtcctataatggggaagtagttttcggagccctagaagttctgaccatacgtcatttgccaaactttaaaaggttgtcaagggaggatgggaaaagcatgtttccccgcatttccattcttgaaattgatgaatgtcctgaattcctcggagatgaagtattgctgaaagggttggactctctctcggtattcaattgtgataagttcaatgtgtcggcaggttttcaacacctttggaaattgtggatttccaattgcagagatgtgggagatttgcatgctttaaaagatatgacttccctcaaggtgttaagattgaggaatcttccaaagctagaatcattgcccaactgctttggaaaccttcccttgctttgcgaattgagtatttttttttgttccaagttgtcgtgtcttccaacaagcctaagcctcatcaatctgcaacacttgactatttttggttgccatcctgacttagagaagcgatgtgagaaggaaaccagggaggactggtcaaaaatagctcatgttccctatatttcagtgggaagtaaacactatagtcctgattga

SEQ ID NO: 100544 - DNA, 912 bp, Glycine max
  Peptide Sequence Number=SeqID_217322
atggctaaaaaaagtcctggttataagtacctcaagtggatttctgagaccaaacttgggatagtgacacaatgctgcttgtctaatagtgctaatgaaggggaggacaaattttatactaatctggctctcaagatcaatgccaagcttggaggcagtaacgtggagctcagggttgatgtcaaccatcctggctatcaagacaccaagagtccatcgattactgctgcggttgctactgttaattggcctgctacaaatcgttatgcagcacgtgttttcccacaatacaatcgaagtgagaaaatattgaactttggggatgtttgtcttgagcttgttgcatgctataggaggatgaatggagttaggccagaaagaattgttattcgtgatggcgtgagtgagtaccagtttgacatggttctcaatgaagagctactagatttgaagagagtatttcaaggagtaaattactttccaacaatcactcttattgtagcacaaaaacgacatcaaactcgattttttccagtgggaatatcttgccggcaacagttgtggacacaaaattactatggaaacctaggtacaagcaagccaactcattaccatgtcttatgggacaagcacaagtttacatctgatgaattgcagaagctaatatacgagatgtgcttcacctttgcaaagtgcactaaacctgtatctttagttccttctgtgtattatgttgaccttgctgtttatagaggacgattataccgtgaagcaaggattgggatgcaatctccaaagtcaacagcatcttcatcttctaaagatgcttcatcagcttcacgaactgcttcatttgaactgggattttacacattgcatgctgacctggaaaacataatgttcttgatctaa

SEQ ID NO: 100545 - DNA, 1536 bp, Glycine max
  Peptide Sequence Number=SeqID_217323
atgggggatcaaggtgttaatgttgggagagaggaagaggaagatgagttttgcagttgttgtggagatgaagatgaggaagtgtggaaagagactgaggaacctgttgtggaaaaagggttgaaggatgagcttgatgaattttcagtgaaaatgttctttaaggggttgtcaatggcaggggtcgaaaatttaagttctgggttttcagggattggagtgttcatggaaaggtcttcaggtctacctgctataagggtgcagaaaaagcttgacttttatgcggaggagtctgtggttgactatttggcactcttggatgggttgctggaagctgtgcagaaaaagatccgcagggtttttgctttcactgattctgagttgttgcatgatcagataacatttgggaaaaaattggagatgcctcttttgacggcactgcgagaaaggattcttgaacttgccaataattttgaagattttgttttaaagcttataccttctagtgatcttgagcagccactgcatttggccaaagtagctattggacttgttactttccctgtaaatgatgagagattgcttaagaactgttctatttgctgtgatgacaagccagtgccaattatgattaccttaaaatgttctcacacattctgttcacattgcttgagggcctatgctgatggtaaagtacaatcttgtcaagtccctataagatgccctcaaccaggatgcaagtattgcacatctgtaactgagtgcaggtcttttcttccattcacctcctttgaatctctggagaaatccctttctgaagcaaatattggctgttcagatagaatttattgtccatttccaaattgctctgttctccttgatcctcatgaatgttcatcagcaagggactgttcatctagtcagtctgacaactcttgtatcgagtgtcctgtttgtcggaggtttatctgtgtggattgtaaggttccttggcattcttctatgagttgtgtagaataccagaatctgccagaggagagggatgcttctgacattacctttcaccgtcttgctcagaataaaaggtggaagcgttgtcagcagtgtcgtagaacgattgagcttactcaaggctgctaccacatgacatgctggtgtggacatgagttttgctattcatgtggtggggagtaccgagaagggcaacaaacatgccagtgtgcatattgggatgaagataactctgatgactcagtggcgcactctcttcaagaatcagaacaatgggcatgggagacattcaattctctctccatgattgtggatgcatactcggaccaagaacgatcgcagcttgctcttattcaaaggttcctaactgggggtttcagtctcagtgaccataatccttaccaatctcctcctcgcagtacagagtcctatgtagaccccatgaaggatctacatcaacttccatggctagagaggtttgtgtctgtgattagtgacaactactatgaggattacattcaatga

SEQ ID NO: 100546 - DNA, 1317 bp, Glycine max
  Peptide Sequence Number=SeqID_217324
atggaagtgttggctggcgcattgcattcaataactagcaaatgtatggttttgcttgttactgttttgatccttagagcactgttgtttgcatccttccctggctttggtgggatcgaatggggcaaccttgtatatctccgcgctccgttgttgaatttcgactttgggattcgacaagataagttcttggtggttcctcagctcgtgtggggattaaacaaccagaagattgcatttgcaagggcttgccttactgccagattgctgaatagaacattgttgatgccaagccttagtgcctcactgttttacaaagaaattgacctcttgcaacccatttcctttgacaaggtattccaatttgagaagtttaatgccctttgccgtggttttgtccggttggggcgctattcagatgtcttgaatagaacagaagtgctagaaatggagaagggaagtggcaggaggtggacagtggagagagatttgtcacaattgaaggagcatagtgagggctcttttgatgactacgagataattcggatcatagggaagaaccctttcttgtggcatgatcattggcctgtgaaggactatgcaaggatttttgagtgcttggatttgacagaggagattgctaaggaagcagacagggttgtgtctaggattcgagccgtcggaagagaggtaacaggtaacactgaagcagtggaagtgaagagcagtattatcacctctgatggatcttcatttcagcctcttccatttgttgctgtccacatgaggatagaaatcgactggatgattcactgtaaaaacttagagcggagattgaacacgaatcgaatctgcagtggcaagaaagcgatagtggaaagagttaggaacattgctggtttgaagactccagttgttgtttatcttgctgttgctgataaactcctgaacaattcttccatactggatggttgggaagaagggtttcttccttttgagaagaagaaacttggtgttgttggaatttataagaagtatccctatttaattcagtctgcaattgactatgaagtatgtttaaaagctgatatctttgtggggaacagtttctccacattttcaagtcttatagttcttgaaagaacacagaagatgatcagaatgagtgtcaccaacatgtgtggagaaaatgtaagatggccttcttatgcttacaatataccaggagaatcaaatggtccaatgagatgggttacaaatatgtcagaatcaagtcttcaagcaatcagctatggcaccaatcatatctcttgttga

SEQ ID NO: 100547 - DNA, 195 bp, Glycine max
  Peptide Sequence Number=SeqID_217325
atggcgatgaagcagatcgcgggatcacagggagcttctgccattgcttcttgcttctcgtcatggttcgtgaaactccgacacacttggcacaatcgtgtgcctcagcacataataagagataagcctagagtccttttcggtaacattattgtgataattaacgatcaggcatataaacatatatgtaattag

SEQ ID NO: 100548 - DNA, 429 bp, Glycine max
  Peptide Sequence Number=SeqID_217326
atgactaccactacagtcaccatcataattgtcgtgccatcaccactatcatcaaccatcaccacctcggtcgctatgaccttcattgttgtcgttgccaccatcgttgcagtcaccaccatgattgtcattgctaccaccatcgtcatcaactaccatcaccactgttaccgtgactgcggtagtggtgacgacaacgatagtgacgacggtcatgccgatggaggtggtgacagtcatggtgatggtgatggattaatggtaattgagatattttataacgtgatttgcttgatgaatcttttagaaattgtacactttttcttgacctatgtttgcgagttgatgctggagaagaaaaaagtgcttgaagatggtgcattttctacaattggttatgaaggtggtgaggatcaagggaaattgtga

SEQ ID NO: 100549 - DNA, 234 bp, Glycine max
  Peptide Sequence Number=SeqID_217327
atggtggcaacgacaacaatgaaggtcatagcgaccgaggtggtgatggttgatgatagtggtgatggcacgacaattatgatggtgactgtagtgccatctatccttatcaccatgactgctactacctttgccaataggactatcatcgtcattgtcaccaccactgttttcgtcagcagtggtggtggcaacaatgatgacatgtttggtggcaaagctggtgacggttga

SEQ ID NO: 100550 - DNA, 528 bp, Glycine max
  Peptide Sequence Number=SeqID_217328
atgggctttgcaaatttgcatatggccaacttatggaaatggaaatttggatcaatccccaagatgtctatcggccaagctggaaggtggatgtctcctctaccggcttcacttggttgtcatcgttggtctggccttccagaattgagttctagttcctccacctcttcgatttccatcttggcctccacgcaacttttagggcttcctcccttacatgaggacgatttcaaattcaagtatctccatttgcttgaacgtgttctaaaacaaaatgtcagtcaagctcccttggtctacaagggtcttccgaattatgcaattggctatctctacgctaataaccatgggatcatcttgtaccaggcagtggctcgcaatggtgtttataacccaccttggttggtcgaaagtgaccatgattacggtggtaccgacaacgttttgagtagtcggcctttggtgggtgggcataacgcgattctcggggtggctgatccctcctcatgtcgtcttaggctttgttga

SEQ ID NO: 100551 - DNA, 477 bp, Glycine max
  Peptide Sequence Number=SeqID_217329
atgcaggggaaaggtttcagggcactgtcccagtttgcatttaaaaatacggatatttgttgggaggagctggagtggaaaggaaagcatggacagtcactggcaatggttgctacgaagccccattattttcttgatttggacatccagcgaacggtggaaaattttcttgataatgtgcctgaattttggtcatttgaagagtttgctgagtcggtgaaggatgatgatatttttttcattgataggtcattctttgtgcattatttcattgctttaatgcataaacaggaattcagagatgtatgggatgttgtaaatgaattcctcatgcaacagcctttctcctctttgtgtaggcttcttcttattactcttgaagaccaggactttgctactttgtggaattgctttataagtctctcggccctaaattggaacttcaacattccaatgacgtctctaatttgtttgtga

SEQ ID NO: 100552 - DNA, 459 bp, Glycine max
  Peptide Sequence Number=SeqID_217330
atgccactatcacctcggactacacccgtgagctcgcatagagatgccctggatcaaaatgaggctagaatcgttgccctggaatcctcaattgaaatcctgaagaagactaccagcaaacaggggaatcacattgccgaaatcaagaagagtgtggagggcatcaatgacatgaaggggatgctcaaaaggtggatggaaaagcagggcattatggatgaaggcgacaatatattggcgaaaaaatgccaagaaccttacttggaaggaattcacaacagcactgttgaggaggtatggcaacaatgggcgcggcattggaaacagagaaggaaggtcagcgatataaggattcgtgaaatcggaacatgggtttcaggtttcaatctgcaggtggcaacgttttatgtggcaacgtttcaacctgcagatgaagaagaagaaacagaggagatttag

SEQ ID NO: 100553 - DNA, 452 bp, Glycine max
  Peptide Sequence Number=SeqID_217331
atgtcgtcacgctcggcctcaacaccgtcaagaacccttggaggagctcttgttcccactgagtctcaatcgttctcaacctcaaaggctggtagtgttcatgttgcaaaatgggagaatgaactaaatttgaaattggattctgctgatagtgcaaattgggctaagcgtgcatccatcgctaagcacagcttcggtgtgcttagcgcgacaaaagaatctaggagagcatcaatattagggttgtgcgctaagcacgagatcagtgtgctaagcgtagcagttgttttcatccaggctcagcgcatgactggcgctaagctcaaatccacttactcagtaagaatccagagaattaccatcactcatagaagtcagagcacaacacaatgcctatttcaggaaaaagctctggaggcagcaagaggagcagcttttgcagagatacctag

SEQ ID NO: 100554 - DNA, 1194 bp, Glycine max
  Peptide Sequence Number=SeqID_217332
atggagaaaacaaggccctcagaccaagttgttctgttcttggaccagcataaccctaaaccaccctctatagagtccgaaaaccatcaaaataaacctaaacaccccttaaaggtcagaactcttaaccgtctcagcttctcaaaacccaaatcccgaatcctagaatacaactataatgtcccccgcaacaaagttgcaatctctgaagaaattagtgacgttattcaacccacctataagctctcgtccaacgatgacgacaaagaggacgacgaagatgattgcgaatgggatgaggacgagacggaggaggatggttcggagcatggcccaaagttgcaccaaaagaggaagtgcaaaatcaagtggaggctcatgatggagtggattttgttcctaaacatattgacatgcttggtatgttctttgaccatatcttccataaccaacatgcaccttttgggattggagatttggaagtggtgtttgatggcaatggtcacattcagtggccgtttggtttcggggtggctggtaggtctaacggtgttcatcatcgagcgaaacttcatgctccgagagaaggtactgtacttcatctacgggctccgaaagagcataagaaactgcatgtggctaggcctggtgctactctcctactggagcgtggtgttcgacgacgtgcaaaagaagaaccacaagttcctcaacaaggtcttccaagccctagtagcagtcttagttggggccaccatctggctcctgaagatcgtgctggtgaagatgctggcgtcctcgtttcacgtcaccacctacttcgaccgaatgaaggagagcgtcttccatcactacatcttggagaccctgtcggatccaccgatgatggacgatgtcgccgaacagcagcaccatctcaccaggtggaacaacgccaagaacttgaacaagtccaagaagtttgggtcaaggaggattgatatggagaagctgaggaagctcagcatggagagcaccgcttcggcgtggagcgtgaagaggcttgtgaactacgttaggtcttctgggttgtccactatttcaaggactgtcgatgattttggcaacgccgagtctgagattaatagtgagtgggaagctaggaactgtgctcagaggattttcaagaacgttgccaaacctggtgccaagtaa

SEQ ID NO: 100555 - DNA, 714 bp, Glycine max
  Peptide Sequence Number=SeqID_217333
atgccttcgacgacagccgccgagagtcgttccctctacactccaccaaaaatagaagttcgtagtggaggggcatttggtcattgtatcgggggaggaagacgtcttgccttgcctgtccgatacggcaatgatggtggcccgggtgatgttggggtacggctccgagccaggaatgggtttaggcaagaacaacggcagcagaccagcttggtaagcattagaggaaaccacgggaagtttgggttaggctataaacccacgcaagcagacataaggaaaagtatcgcggaaaggaagaacagaggccaaggttcacggttgggacaacaagtcgaaggggccccgccctgccacatcagtaggagctttataagtgtgggtctaagacacgaaggccaagttgtcgcgatatgcgaggatgactccccgagtaggtcggatttggtacgaccatgtcctcctagtttccgactaggaaattggcgagtggaggagcgcccggacatttacgcgacaagcataatatccgacgacgaatccctcgaaggtactaatacccgggacccggccattgatttcaagcaagaagcgggccagacggagagtgaagagaatgaggatgtgggacttcccccagagttggagaggatagtcgctcaggaggaccgaaagatggggcctgatgtgccatcattttcttctattttctaa

SEQ ID NO: 100556 - DNA, 1323 bp, Glycine max
  Peptide Sequence Number=SeqID_217334
atggttgtgcaacaatatgtggaatgggtcttagaaagatttaatatgaagaatgtcaagcttgttagcccaccactggccaatcattttaagctcaacaaaatgagttgtcctactagtccaaatgaaaaagaagctactatggttgctataccatactcctcaacagtcgagagtttgatgtatgcaatggtctacacaaggccagatattgctaatgcggtcggagtggttagcagtaagaatgtgatatatcactctcgcacaaagcacattgatgcaagatatcattggttgggacaagaagtggaagaacattacatcaagttggaaaagattcacactgataaaagcccaacagatataaagacaaaagttgtagcacgagaaaagcttcaactttgtggtaaggtaattgacatggattgcctgtatattgaagaggaggatctcatgagatttttgaagagggttgagatacacaccatatttcccctctttgaaggcgctctcgaaacgggacatatcagcaggtcttcatttagaaattgggtgattcgagcatattatgaacgaaaagctctagcacaatcattgaatgataccaaaacagcagtgcagcagcttcacaaaatagcaagcgcaatcgttagtgtgataataatcattgtgatgctcttggtgatggaggtggctacgctcaagataatattattttgtattacacaaactgttttgataggtgttgctttccaaggtacctgcaagactgtattggaggccatcatctttgtcttcgtcatgcacccttttgatattggagaccgctgcgtcattgatggagttcatatgattgtggaagagatgaatatcttgacaacagtgtttcttcgatatgacaatgagaaaatatactaccctaacgcagttttactctctaagcctataagcaatttctataggagtccagagatgtgtgattcaattgatttcaccattgatgtatcaacttctatggagaccatccttgcactcaagaaatcaatacaaatgtacattgagagcaagccaaagtattggaatccaaaacacagcatgatagcaaaaggaattgagaatatggacaagctaaagttgtgcttatctgtgcaacataccatcaaccatcagaactacggtgaacgaaacgtcaggataacagagcttctcttggaactgaagaagatctttgagattcatggtattaagtaccatcttcttcctcaagagatccagataacccatatgaatattgaacatggcaaagttttgtttcaatcatga

SEQ ID NO: 100557 - DNA, 813 bp, Glycine max
  Peptide Sequence Number=SeqID_217335
cgcctgctcgccccgttacaactggcgcgaggtcgacgtggccgatggccgcgtgcgggcggctttcccgaaccgcgtgcagaccgagacccgccagttgcggctggatacccatacgctggatttcacgctggccagcgccaccgtgggcgaggcggtgttcgccatcggctcggcgccgctgccgcgggagatcgcggccgatcccgtggcgcggcaggcgctgggcatggcgctgatgcgctcgctgtatgtcaacatgcaggcgccgccgcccaccgagtggccgccctatgggcaggacatcgacgtgcagggcaaggccatgggcaagcccggctggctgcgcgcgcgggtgtgggtgaccgacaccatgctgatcgaggccgtggcggcgggcaccgaagccagcctgcccgaggagcgggcgcgcgaattcctgaggtcggtcgtggtcaagccgtgaccgtgttcagcagtccgcgccggatggccgtggccaccgcggcgcgccggccgcgcacctgcagcttgcggcaggcgttgcgcagatggaaattgacggtgctttcgctgatgtcgaggatgcgggcggtttcccagctggtcttgccgatggcgctccagtgcagcgaggcggattctcgaggcgaaagccggacgggggcgggcgcccgcgggatggcggaagcgggtttggcggacatgacggatagggcgctgatagcctggaaaaagacaacccatgctccgacccccgatggccaccggacaagcggcgatgccgccacgtatctcactttgaatctctga

SEQ ID NO: 100558 - DNA, 222 bp, Glycine max
  Peptide Sequence Number=SeqID_217336
atgagtctcagcctgcagagtcagagctttacttcttttccgtgccctactccggaccagttcagggcagaggtcgcgtggcctggggattggcctgaggcccaggcaggagaggcaccagcaggggcaccagcagaggctcccgatgaggcagaagaggcccgcgaggatgaagagatgaccgatttacttgatttcttaggagggagcggagccgcatga

SEQ ID NO: 100559 - DNA, 825 bp, Glycine max
  Peptide Sequence Number=SeqID_217337
atgtatgatacattagaaagtgattcaaagaattctttgtatccggggtgcaagaagtctatgacgctgttgtcagtggtgttaagtctagttaatgtcaaggccaaatatgggtggagtgacaaaagcttcacttcattgcttcaagtagtgcaggatatgcttccagaggaaaacacattgccaaaaatgaaggacgatgatgagcgtagtaatgacgaaagcataaagaaaggctccccagcgaaggtgttatggtatcttcgaatcattccaaggttcaagcatttgtttgctaatggagatgatgcaaaagaccttacatggcatgcagatgggagaaactgcgatggaatgctccgtcatccggctgattcttcccattggaagaagattaatcgtttgtatccggatttcggcaaagaggaaagaaatcttaggcttggatttgcaactaatgcaatgaatccctatggcagtttaagcactcaacatagttcgtggcttgttttgctagtaatttacaacttggctccttggttgtgcatgaagcaaaaatacatgatgttgtctatgatgatatcaggcccaagacaacaaggaattgacattgatgtttatcatagtcccttaattgaagacttaacaaagttgtgggatgagagggttatcgtgttttatgtgtatccaaaagggacattcaagttgcgtgcaatgatattttttaccattaatgactttccagcatacgggaatttgagtggatacactgttaagagccatcatgcatgccctatctatgaagaagacacaagctatgtacaa

SEQ ID NO: 100560 - DNA, 646 bp, Glycine max
  Peptide Sequence Number=SeqID_217338
caaggttttggttgaagatgccagcgatcgcctgcttactgttgggctcgccagcgacaagctctcaacctcaattgaacacctgcctgcgacgccacatcaactgtcctcaaccaaccttggcactctgatacgcttggctgatgcaggcaatcagcaacgcgccctgctggttgttcagagtgaaggagctcaagcgtgctggcagtcattagtggcaacattcactccaagtagcacatctgcgtgggaagcactggaaatacaagcaggcattccacaggtctatgccgcgaccaaggagcagttcgtcccacaaatggtcaacctggatgcactcaatggcatcaatttcaagaaaggctgctacacaggccaggaaatcgtagcgcgtacgcattacctcggcaaagtcaaacgccgtaccctgctggcacaactttccagcgaacaagcaccacaagcaggggatatattgcaggatgcccaacagcaggaggccggtcagttggtgcgcgtggcaccgtcaacagatcgtggctggtggctgttggctgaatgccgcctggaagccaaagaagctggtacgattagttggcaagggcaaccattggcctttaaagaactgccttatgccttagcataa

SEQ ID NO: 100561 - DNA, 359 bp, Glycine max
  Peptide Sequence Number=SeqID_217339
gcagctggttgcgtgtctggcaatatgctcagcagatcgaggcgcatgaaaaacgcaacgaatattaccggcaacgtaacgaaaccctgcgtgcggaagtgcgtgacttgaaacaggggcaatctgcgatagaggagcgggcccgtagcgagttgggtctggtcaagcaggatgaagtattctttcaggtgatccagaataaacaaccggggctgtcaaataagtcaacttctccgctggacgcaaagccagctgctgcaaaacagttagaggctaagccggtggatgccaagccagcaatggtaaagccacctggtcccaatcacgatgtcccggaaccacttccagaggcacaataa

SEQ ID NO: 100562 - DNA, 147 bp, Glycine max
  Peptide Sequence Number=SeqID_217340
atgactcctaggtcgacagctacaaaatcagaaccatgggcttggaagggaaaaccgtcaagctgcagattgaagtccgagattccgtccatgtctcacttgagactctcaatgaacgaaagtagcaagccttcatttaaatggtga

SEQ ID NO: 100563 - DNA, 378 bp, Glycine max
  Peptide Sequence Number=SeqID_217341
atggttaacattcctaggttttcgagggcaagatgggagaagagtaaaccagtggaaaaggaagtccttggctatggaggatgtgggcatgagtgtaagggggagaatgggcgcaaagggaagaaaggtaagaaggcaaacactaggggaggaggggataagcatgataactctgccatggttgagtttacaatcactaaagatatagaagaaaaatgtctaagagcatatgtaggtaaggtgaagaacaagggtgactcctatttgacacgacaaaaattccatcttgaaggtttgtttggcatgagagctactcccttgggctcttccttggttctgctagagaatgcaaatgtcaaggagttagtgattacgtga

SEQ ID NO: 100564 - DNA, 318 bp, Glycine max
  Peptide Sequence Number=SeqID_217342
atgcacagtgattgcttagtgcaattctctattctcaatctttttcggagccccatgaattgccttttcgttcatgcgtcctacaccttcgagtttggagctatgcgtagtgattgcttagtgcaattctccattctcaacccttttcggagccccatgaattgccttttcgttcatgcgtcctccaccttcgagtttggagctatgcgtagtgattgcttagtgcaattctccattctcaaccccttttcggagccccatgaattgcgttttcgttcatgtgtcttccaccttcgaatttggagccatgcgcagtga

SEQ ID NO: 100565 - DNA, 303 bp, Glycine max
  Peptide Sequence Number=SeqID_217343
attcaaggaaaactgtaccttagaattgaccataaaggtgaaggtgctaattggtgtcgcacagttgggcaggaattatattcaccattgctgttggccttcacagaacaggaaggagacaattggttgcatttcattccatcaacattttctggcatagattcttcctacagtttacctgacaacactgctcttttaaccctccaggaatttaaaaatggaaaagtactcctaagattggctcacctttatgaggttgtatttttttttactgatgtattgataactttggttctctcttaa

SEQ ID NO: 100566 - DNA, 232 bp, Glycine max
  Peptide Sequence Number=SeqID_217344
atggcgaagggaagtgtcgtggttgttcaaccttcatgcaaccctttcttgaccgcttcaaggtacttaacatccatcgttaggcaatccgtggagttccgcgacatgccggaagtcgaagggaagcattgttgcacaatccgtaaagttccgcaacattccagaagtcaaagaaggggtgtgcaaatagcaatcaggcccacttgggccttccaggatgttccaacagaag

SEQ ID NO: 100567 - DNA, 247 bp, Glycine max
  Peptide Sequence Number=SeqID_217345
gggcaatttatgggtgaggatgctagattcaaaatatgaagggttgaagggtttagatgagggaggagtgaagtcttgtgagtcaatttggtggagggacttgaaattgaacaaaaacatgaagtcgtgggagacttgggagcttgggaaaatgagatatggaaatggaagttttcttggaggagaccatggtttgattgggaaagggacagggtcattgagtttgagaggttgttggagggtgtag

SEQ ID NO: 100568 - DNA, 159 bp, Glycine max
  Peptide Sequence Number=SeqID_217346
gtggactgcattgtttttgataagacgggtactctcactgttgggaaacctgtgatagtgagaacagaactattgacaaaaatggtgctccaggagttctatgaacttgtggctgctggggaggaaggcgtctctactatctccctctcaaaggcttag

SEQ ID NO: 100569 - DNA, 375 bp, Glycine max
  Peptide Sequence Number=SeqID_217347
atgagtctcggaattaagctgtctgtattgacgtctttcagtgtggcaatcgtgctgtttgccctgacgttaacgctcagccataacgccgcgcgccagctggagcagctggctgtcgacgatatgcaaaaccaggtgctcggcattaatgaaatggccacgatgtttaacgcgaccttatcggaagaagtggcgaactatacccggctgtttcagagctttttacctaagcgattcagccgtgacgacagctcacgcattcaggtgggatcgttcagcacgccgacgctgcgtgccgggctgaaaaccctcaacctcgatcagatcgccgtggacgattttctcgatcgtaccggtgcagtctccaccattttt

SEQ ID NO: 100570 - DNA, 378 bp, Glycine max
  Peptide Sequence Number=SeqID_217348
atgtggctcgcgttttggccggcagcacgtacactgagaccagtgataatcattctcaacggagacggtatgattgagttggcaacggagaacctggcgggcattgagtgtattcacgcggcaccggccggacagcggctggcgcgcttacccaccatcctgttttatcacggatttacctcgtcgaaagaggtgtacagctactttgccgtggcgctggcgcaggccggtttccgtgtggtgatgccggatgcagagatgcacggcgcgcgctacaacggtgataccgacgcgcgcatgacgcacttctgggagattttgcgccagaacattgatgaagtgccgctgctggaagcggcgctgcgcgacaacgattgg

SEQ ID NO: 100571 - DNA, 444 bp, Glycine max
  Peptide Sequence Number=SeqID_217349
atggccgagtttttcgagcgtggccaggatgcggtcgcagtgatcgccctgcacctcgatgacgccgtccttgacggtgccgccggagccgcaggcggtgcgcaactgcttgcccagcgcctccagcgcgtcgtcgtccagcggcaggcccttgacgacggtcacggccttgccgccgcggcccttggtttcgcgcgagacgcgcacgccgccgggcgccggcacgggccgggccgccgccttgcactggcaatcggcgagcgggcggcggcattgcgagcacatccggccgccgtcggtggagtagacgaccattatgccggagccgccgccgcgagcccggcgtgggtgcgctcactcgtcgaagccgcgaggccccagcgattcgaccaggtagtcgatgaaggacttgatgcgcgaggagatcgcgggtattgccggtaa

SEQ ID NO: 100572 - DNA, 228 bp, Glycine max
  Peptide Sequence Number=SeqID_217350
atgatcctggaccccgccatcgtcgacagctggcacgcccacgtctacttcaacgccgacagccgcgacgcggcctgggcgctgcgcgaacaggcgctggacgcattcggcgacagcatccagatgggccgcttccacgagcgccctgtcggcccgcatccacaatggagctaccagctcgccttcgcgccggccgcgctgccgcgcgtgctcacctggctggcgcag

SEQ ID NO: 100573 - DNA, 731 bp, Glycine max
  Peptide Sequence Number=SeqID_217351
tagtgatagataattcccatcgagagtttgatgttattagagaacaaggatttgatgttatcaaaggtgccttagcatttgacatagactatgctcactgggttgatgagcatcaacgtcttctcaatgatctaagaacagcagtaaattctcaaatgagtgatagtgacttgcatattctggtagatagtgtcatggcacattataacgagttatttaggttaaagagcttaggtacaaaggctgatgtattacacatacataatgggatgtggaagacacctgtggaaagatgttttatgtggcttggtggattccgttcatccgaacttctcaagatcatcaagaaccaccttgagccattaacagatcagcagttgatgggaatttataatctgcaacagtcttcccagcaggctgaggatgctttatctcaaggcttggaagcattgcaacaatctcttgtagaaacactttcctccatctccctaggacccactgatagtggaaatgtagttgattacatgggccaaatggcacttgcaatgggcaagcttgctgatctggagagttttgttcgtcaggctgacctcttgaagcaacaaactcttcaacagttgcaacgaattttgacaacgcgtcaaactgcccgagccctccttgtccaaactgattacatttctagactaagagcgcttagttcgttatggttggcgcgccctagagagtag

SEQ ID NO: 100574 - DNA, 516 bp, Glycine max
  Peptide Sequence Number=SeqID_217352
atgaaatctgatagtgtagacttacaattagagcattcctccccacatcacatcactaagtcagatagcagtgttggagaagcaattactctaggtagcagtacccaagaaggagttactagtgaccctcagccagaaaagagattaaaaaaactccaagatctgcagtcaaatatgttcagcacactagagggcaaaaggtctttaaaacaaccttcatcaacaattggaacaaagggtagttctcttggcaacgaaaaaaatgttgacatgctcctcggatccatcactcaagcacggtgtgttatgcttgtgataatagttatagttattggcctttcaatggtggaatgttcatttatatcactcaatagggagaacttcaggtcaaatgacactaaacatggaaggaaactggtaggtgattccctcacagattccagcaaattaatgaggaatgcaggagtttttcttggtagtaaagatgatcttaaaagttgtagcaataccaggtaa

SEQ ID NO: 100575 - DNA, 249 bp, Glycine max
  Peptide Sequence Number=SeqID_217353
atggaggggctttcgtttcttcgatgtggaatttggggtggtcatgttggtgcaaacttcaggagctttggagctaacagggttctaacaacttctttacaccaaaaagaaacaaactccctactaagctctggccaaagcatggacaaatggggtattacaacatcaaagaatgaccattctattgacaacagtgacaatcagaagtcctcaaccccatttttgaagaggaaaactattgaggtttga

SEQ ID NO: 100576 - DNA, 381 bp, Glycine max
  Peptide Sequence Number=SeqID_217354
atgggaagcagtgagatggataaaactacaaaagagaaggagtcaaagacgccgccaccacctacatcacaggagcagtcttcgaccaccggcactggaacaattaatcctgagtggcctggctttcaggcatattctcctatacctccacatggtttcttggcatcaagtccccaggctcacccttatatgtggggtgtccaggctagagatggtgcagtgaggcacacaaacacaacggcaaaagtgatgggaatacagtatcatgctttcccatgcactaaaaaggacaccacaggtcaagcaagaatggtggctgatggaagtaggggcatggatgctggagcagtgatatttaggtggtgtgtgggcattgagtag

SEQ ID NO: 100577 - DNA, 891 bp, Glycine max
  Peptide Sequence Number=SeqID_217355
atggtttatttttctaagcctgttgagcttattggctttccatttgcaattgcatactggcgatttatgctgattgggaaatcttggctttgtagtggtgagagtgctagtgaaggtgaaggtaccagtgaaggaagtgatgcaaattctcagaatgactctcaattaaaatcagggggccggcaggattcttttgaagatgaaccctctcaaaatggcagttcagcatatactcctcaaaatgggggactaaatatacctcatacagtggtcaatcaaaccatgtctatcatacctatctctgcaggtggtgctcctggagctgttcctggtcccacgacaaacttaaatataggaatggattattggggtacaccaggttcatccaacattcctggacttggcagaaaggttccatctactgcagttgctggagggatggttactgttggatcacgggatagtgctcagtcacaactctggctacaggatgaaagagagcttaaaaggcaaaggcggaagcagtctaacagggaatctgctcgcaggtccaggttgcgcaagcaggccgagtgtgatgagttagctcagcgtgctgaggctttgaaggaagaaaatgcttctctccggtcagaagtaaatcgaatcaggagtgattatgagcagctactctccgagaatgcagctctcaagcctatactactctcccagaatcccttgatatctgaaagatttgtgggaagactaaccatgctgtccgatctacaggagagacttggggaactacctccgaatgatgatcatcatcataggtctggcaggaatgatcagcatgtgggtaatgacactcaacagagtgggcagacagaggccgtgcagggtggtcattag

SEQ ID NO: 100578 - DNA, 1740 bp, Glycine max
  Peptide Sequence Number=SeqID_217356
atggcagaagcagaatccgaagctctgcgcctcaaggccatggcggagtccaagttcaaaggctccaacaataacgccaaatccgctctaaagtacgctaagcgcgcccaccgcctctgcccgcacctcgccggtgtgtcggagaccgtcgccgccctctccgtcctcgccgcgccagattggtaccgcgccctaggcgcagagcccttcgccagcagcagcgtcatccgaaggcagtacaagaagctcgccctgctcctccaccccgacaagaacccccacgtggcttccgaggaggccttcaagctcctcggcgaggccttcagctttctctccgacagaaaccgccgccgcgagtacgacgccaagcttcgacgtaaaatcgaggcggctgagatcgagagcgagacgttctggactgcttgctccacttgcaggctcctgcaccagtttgagcggaagtacctggggcaggaattagtgtgtccgagttgtgagaagagttttagggctgtggaagcggctcagagtgatgatgatgacgatgatgatgatggggatattagggttaggagtaggaggttgaagttgaaagagatggagaagagggaaattggggtgaaagggaaagtgggtggtgagaaaggtaatgaattggggagtgagaaggaagggagattgaggaagagaatgtgttcggttggggaggttttggagagggctaaacaaagtaatagtaagagggttaaaaatggagaggaaatgatgacattggctgaatttcagaatcaagtgaagagaaaattgcaggagggaaagttgaaggaaaaagaaaaagaaaaggaaaaggaaaaggaggaggagggaattgagaagaggagaaaccccgcggagaggaggcggcggcggttgggattgagaaataatggaggtttagaggctggggaggtgaggggtttgaagaagagtgtgaagcctgcgattgaggagaagaggaaggggttgataattgagaagcatagggggggttctagtggaggggagttggagactatggcggtggtggattctgatttttatgattttgacaaagatagagttggaagaagctttaagaaaggccaagtgtgggcggtgtatgatgatgatgatggaatgccgaggaattatgccttgattgatgaaactgtctcggtgaatccttttggagtgaggataagttggttggatgtacagaacagtggggatgggaggattgttagtagggagaaaatggagtttcatataccttgtgggagatttaaggttgccaggaggaaggcttctgtaaattcggtgaatatcttttctcatgttgtggattgtgaccgggctgcacgtgaggtttacaaaatttaccccaagaagggctccgtatggatgctttatggcgagggtagtattgatgcggatgagggtaagggatgctatgacattgttgtgtttttgacgagttacaatgaggtgaatggtctgagtatggcgcatcttgagaaggttgatggttacaagacagtatttaagaggctggagagggggagcggtgctattagatttcttgggaaggatgacatgtggttagtttcacatcagattcctgcacggaagcttctttgtgatgaaactcctgaactgttgaaagattgttgggaacttgatcctgcttcacttccttctgatttacttactattggtggatag

SEQ ID NO: 100579 - DNA, 420 bp, Glycine max
  Peptide Sequence Number=SeqID_217357
atgaggaggagcaggaaggaggaaggaggaaggattagagtacctgagagtggaaaggtcgagagctttatcgtcgtcgtcagaatcgaaggacttgcgggagcgggggtcattgggggagcggggagaggcgccgccgctgccaccgtagtagcgggcagtgacgtaggagagagaggtattggagagagaagaagggtcgaatttgatggaatagggattggagaggggaaggccgaagagtttggaatcggaagtagagaagagaggacaatgagagagtttgaaggagaaggttgtgatgccaaccatgaagcaaatatatttggaactaataatgaaaaatttaagctgattaaatcatgcaagcactactttagcagtaaattaggtgaaagaaagcaaccaaaaactagctag

SEQ ID NO: 100580 - DNA, 672 bp, Glycine max
  Peptide Sequence Number=SeqID_217358
atgccgatgcagtccttggattggatgattttatttcaaaaccttttctatgagtcattggctttaacatcagcaacatttgcgtctgctctctacaacctcattccagccattacctttgtcttggccatctcctgcagtttcgaaaggttaaatttgagggtggcaaaaggaaaggccaaggtgttgggaactttacttggaattggtggagcaatgttgttgacctttatcaaaggggcagaaattaatatctggcctttccatatcaaccttatgcatccagatcagcaccaaaacagccacatggcatcattaaatgttgactctggcaataataagttgttgggagcaatttgctccctagcaagctgcttctcttttgctttatggctcaccattcaggctaagatgagcaaagaatacccatgtcactactcaagcacagctctgatgtctactgcgggagcaatacaagccactacttttggtttctgttttgacagggatttgatccaatggaagttgggttggaatattcggctactggctgtggcttattcaatacgggaaggtagatttcagacacttgaccaatgcttgttgcgtgaatacagtatgactttacaagcaatgcatgggcagatatttagggacttctgtgaggtataa

SEQ ID NO: 100581 - DNA, 336 bp, Glycine max
  Peptide Sequence Number=SeqID_217359
atgaggaggaagaacttggagggacatttatgccctcaacttaacttctcatcacaattaaagcatggccctcaatcacgacgaatggctatctcttccggtgacaaccttttgataggtatgggaggcgattttggcgaggaaggtaacaatgttgaaccataccgctttggggatctatgccatcaaatcatggtacttccaacttcatgcgatgaggatgtgaaacaggtggagttggggagtaaggaatcacggaagacaatgaagcaggagaatggtggctattttcaatggcggaaacgcgttggaggagctcatccagcttggcattaa

SEQ ID NO: 100582 - DNA, 711 bp, Glycine max
  Peptide Sequence Number=SeqID_217360
atgaagttcatccacgatgggaggattattgaattgaggggtgatcgtgatgtcagtctccaccttattacactatcgcaactccgacgactggttgaaacagaggaaactagtgccttcttccatatccagatcgaaaaccaagacgaatccatgtcatgtagtggattaatccatccaagtatgagtctcttctcgtctccggttcttttggtgaagaaacaagatgggacatggcatttccgcataaattatggggcgttgaatgttatcaccggttatcatcaaattttgatgaaggaagaagatgcaaccgtgaatgatgtcttcaaacctttcttgcacaaatttacaatagtcttctttgatgacgtcttggtttatatggaatacttgggccataaagtcaccaaatcaggagtggaacctctagaggagaaaattcaagctatccaacaagggcccttgcctcgctctgtcaaggccttgcgtggattcttaggattattggaggccattgatgctttcgagcagttgaaaaatgcagtatgcaaggcaccagttatgagtttacctgactttgccttgccctttgtgattgaaatagatgcattaggcgttggtatgggcatttatgaaaatggcggcaatacttactcggtcatcacttcaccattctcactgatcaccgaagactcaaagagctcatga

SEQ ID NO: 100583 - DNA, 324 bp, Glycine max
  Peptide Sequence Number=SeqID_217361
atggacatagactatgctataaggaaagacgaaccacctataatcactgatgaaaatgcaatcactgatgaaaatatcccaactgctattgatgaccagttcatcacttcagatatggttttagcaagcaccctgatcatgatattctactctttctccctcaccagtgtgaaaggtgtgagtgtgtacataatgcacatgcgagatatttcagctcaacgtaagaaattggaggttgaaaggcttgtaatggagatgagtgagagtgcattgctgacaactgcttgtggaaagaacaaagctactaagtctcatgctaattag

SEQ ID NO: 100584 - DNA, 222 bp, Glycine max
  Peptide Sequence Number=SeqID_217362
atgtacactctcattttttgctcaccacatgaccagcactctagagccaatggtcagatctgcccaatcaaaagtcgctcattcggcacattcagtaggggtgtcgcattggagcagatgccaacaggtgctaagtccacaatcggatttactcacaatcaagggaaagaattaagaagaatgagatggcgaagcctcgaccacaaccatgcgttcggctaa

SEQ ID NO: 100585 - DNA, 474 bp, Glycine max
  Peptide Sequence Number=SeqID_217363
atgacacttcactcaacttcacattggtcagaatcctctgtagctacttccaggatccatgactatccccataaaccaacacgagactttttagtgtgctttgtcttgattgacatgcttttcgagaaactttctagaaggccaccctgtggaagcaatgctttccaagattatgttgatgatgccaaagactcaattcaagaatcaagagtcaagcaagtttcaagaatcaaagagtcgttcaatcaagattcaagattcaaagggtacatctgcttgggttgtaatactgagaacaagagagggtacatctcttgtggatcagttcaagtagagggtacatccacttggttgttcaaagagaacaagggagggtacatcccttatggatctttgcttggactaagtgagggctccatatataaccatggagcacatcaaaagggtgagtgtaagatccacttagataagtaa

SEQ ID NO: 100586 - DNA, 135 bp, Glycine max
  Peptide Sequence Number=SeqID_217364
atgaactcatgcaggcatactcatgttgttgaatatctaaaggttccacttcacatgttcttcacaatgccatggacgtctactagtgaatttcttaatcctctttcccgtgttaagaaaccaattggcaactga

SEQ ID NO: 100587 - DNA, 186 bp, Glycine max
  Peptide Sequence Number=SeqID_217365
atggagctacattatgatgaaccatacattcaagcttctcaagctcaattggtgtattatgtggaggacaataaggataatggatggtgtacccttgttcatctaaaaccaagagacttgtttgacatgggtgatgatggtacaatgacaacttatgaaaatgatgacttatgcaatctgaaataa

SEQ ID NO: 100588 - DNA, 675 bp, Glycine max
  Peptide Sequence Number=SeqID_217366
atgaaggttatagaagtttacaaccttccacctagagatatgattgtggtaccttttgagggaagtcaaccaagtcccacagatgcagatgagatcttatatagatttctaggtaaattggctcaagataacaatttgtttcccatttgttatgagaaattgcctaaggtgctaaacaaacaaaaggataaagcttggaattatatcattaagcaaatgtgcaaaagaaatgctaaaaatagacccaagctcacaataaatcatattggtggatctaaaaaactcaaaagaaagaagacaaagattgtccctaatcattttgttagtcttcaagttataaatatagtggaattaggcttgttggagaaagttaatgttaacatggaagtaagtatgggttctttgtttatctatactcataagagagcagatggaacatatataagtgaagaggctcagcttgtttgtgagaaaattggtgagattgagagtcaaggaactggtcctatgcaaatctcacctaatgactttgttagtaaacaaagacccttctactctgcatcatcatcaaggccatgcgctaagcgcgagatcagtgcgctaagtgcaacaggtgtcttcagccaggctcagtgcacgactggtgctaagcccgaatccacttacccgcgctaa

SEQ ID NO: 100589 - DNA, 342 bp, Glycine max
  Peptide Sequence Number=SeqID_217367
atgaccatgaccattgaattcttgcatgatgccttcaagcatgtaaacatccctacatctaattatgatgccaaaaaactcctcaacaagctttgtcttaattacactaagatacatgcatgttttaagaattgtatgttacattggggggaagatgtagatagagagaaatgcaaaacatgtcatgcatttagatggaagcaaaagggtcatgaaaatgctagtgatcatgggctgaaaatgatatttatgtcttcaaagacaattaagagtatggtttggcatggtgaagagaataaaaatgatgggttgatgaggcatcctagagatttaaaggcttga

SEQ ID NO: 100590 - DNA, 183 bp, Glycine max
  Peptide Sequence Number=SeqID_217368
atggatgtggcaagcgacgtggcacttcaatacacatgccgaccctccatgtcaaccttggtagaggagcacaggcgtctcgcccttagcagccaggccactaggcagtcaaggttgttgcaccaccgtaacaacccttacaaacaaggatctgaagctcctactccactatatgagtactag

SEQ ID NO: 100591 - DNA, 630 bp, Glycine max
  Peptide Sequence Number=SeqID_217369
atggttactacactggtctcttcagtcaattctgtcgtggctcctccatccaccattgttacacctttgctgagtgttggtgtgatgaccactagtgctctagaaatgccacctctttcttctttagtgccatcagtggcatcgacgtcgccttcctcctcttctcgcccaagtgtctccctagatcacatctacatttctcgtgatactaactcaatgtggagcatgggaagtctagtgatttgggagcaaaatgggcaatggtaccaggaagctctgagcaaggtggcatccttagaggttgaggtcgctaagtggagggccactgctcgaactttttggagagtggagtgttccaaagtggccaattccattattgtctttgttgaggccgtttcgtcgaaccaccagttgtcatccaagggggagaaaaatgacttggctggcaaggtagagagcattgtcgttgagaagaatgagctcgccaaggtgactgtagacctcaaggcccgattgaaggagtcagagtccaggttagaggagtctgagctgagggcgtcaaaggaaagggaagccagcaaggagttagagaaggagctgctgctatacaagaaagaggccatggagtag

SEQ ID NO: 100592 - DNA, 387 bp, Glycine max
  Peptide Sequence Number=SeqID_217370
atggcagatggcaatagcggtttcgccaagctggtttgcgaaacagggtgccatggggtttcgccattcccattggcgaaacaccctctgctaaaaagtgttggtgctgttacgcgtgcggtggtggcaaaaagcttgtgctatgtagtggcaaattggttgcggtggtggtcattccagtcccataattttgttgtgtcaaattctggaagacttgtacctttctccataggaacttctctccggtgcactttgatttccttgaaagaggagagaaataagatttcacttcctttggcctttcttttctgcctctctccgttagtgatagctatgagtgagagagaacacttttctggtcaggaaggggaccttatttcacgttag

SEQ ID NO: 100593 - DNA, 390 bp, Glycine max
  Peptide Sequence Number=SeqID_217371
atgtatgatgatgttgtgctttgtgcagactttagcagagattcaaaaatgcttgcatctgggtctcaagatggaaagattaaagtgtgcactgcacgtataactttgatatttctgttaaatagaactgagccaccaaacataattcattttgtgaattttagattgtatggctatgaagcacagcattttaggattagaatcccttcatccatacagaaaagccagccacccctcatcctccatgggcacatccatattcttccctcatcttttctggctaccaagtctggcgttttaggactagtcaatgcttgtggcgtcttgaacgtgctcattctcaaggtgtcacaagtgtttccttctctcgtgatggaagccagttattaa

SEQ ID NO: 100594 - DNA, 1098 bp, Glycine max
  Peptide Sequence Number=SeqID_217372
atgaagaaggttgataggtttctcaacagtggcattttgattgaaattctgtcccatgttcctgctaaggatttgctgagtctgaagcgcgtttgcaaggagtggcatcacgttatttcgagtcgttgcttcgtggaagcccaactgcaaagaaccaaagaggaggcattaaatgggttcattttccaggagaagttcatgtggtgcaatgaggacatcaaaaccattagctacatctctgtggaagtcacaaccaaagggggttccaaggtgaaccaaaaggtttttgattttcttccagaagatgttgttatgatggcatcttgcaagggtggaaataattgtcttagaagcatggtattagcattggctttcgattttgacccttcaaaaggttttgttgaaaaattcaaattggtgagagttaagctagttgaggtagaaggggaagaggaggaggcacaggaggaggaggaagagggagagggggaattgttcataacatttgagttgtactcatcagagaaaggagcatggaagacatgcaatgaaatatgtcaatgttataacatgatcaataatggaggaatatacattgggggtgtcatgcattggctcaatggtgacaatgtcctcacctttaatgttgagaatgagctgtcttggttggttctggcaccggttccagcatcggagttcatgatggttcccgaagcctgcattggggaatctgaagggaggctccattatgtggttgtgtcagagcagggtgtccatgtttggtgtcttgaggattattatgactataaatgggcaatagtgtattgcaagcctcttgaggagattgaaggagaatggcctctgttcttgaatttgaagagccatgcgttagagaaggtgaatggcccgtgggtgaatcctctagctttcaaagatgggctcttgctaataaaggtgtgtgttagtctgtacttgtttgatgttaagaacaacagcatgactaaagcttgctccattcaagacctgaaatcacagtgcatgttcaatcctactgtaattgcccattcactgagcttggttcatttgagtcctgcatga

SEQ ID NO: 100595 - DNA, 1561 bp, Glycine max
  Peptide Sequence Number=SeqID_217373
tgtggtagattcaaccaactcaaagtccaacttggaccttgaggatgccatagctaaggtcacctctgcccaatttcatctatccactaagtcggaggacctgttccaaaaggttgcgcacatggaaactcaacctccttctccatcgtcttccacgaccaatccatttgcagctccttcgtccctgccctctcatcgcatgaaattagaggtgccacgctttgacgaatcggatccttttggggccttgcattggcctggttccaatggatgtccagaaacgggtagctcttgtcgtggcccagcattttacaagctcttgaagctctccctcgccaatcgaattattgacctccctacaccttttttactcagctacttcatctcaagactgactcccgagattcgccgcaaagttcaggcgttgcagccccttatgctggttcaagcggtggccctggttcgtctccatgaagagaaattggcggactcccgtaagcttttccaacatcgtccacctaccccgggaccattaggatcacttcctcagcattctgtaccaccaggtttgtgcttcaattgtgatgaaaaatttagtcatgaccattggtgctcctcaaaactattccttctaatcgccgatgaagacgacaaccctttagacgacctggttccacctgatgagtttggcgatataggggaggtagttgcgccacttccggcccaaatcagcttgcactcacttgcgggccatatggccccagagactctatgccttgtgggctatattgtaggtcaaagggggcatgacttctgggttcacttccatgttcttcctctatgtggagttgatctggttcttggtgttgaatggttgaagtcattgggttcggtcttaatgaactataataaactgaatatgaagttccatcatgtgggtagggtcatggaattaaagggcgaccatgacagtggtgtcggatccatcacgacaaaccaactttgtcatttaatgaagacaaacgcgactagcgaattctttcatcttcgcgttgagcccccttcaacccaaactcctcaatcgtcactactcatgcctgagatcaagcacctacttcgcaaatttcaacatatgttccaagccctaacaacgttacctccttcacggacaaccaatcatgcgatcaactatcaccctaattcagagccagcgaatgtacatccataccgatatccccactttcagaagcaggaaattgaattgcaagtaaaatctatgctgaggaatggcgtcattagactgagcacgagccccttctcgtcccttgttctactggtcaagaaacgcgacgactcgtggcacttctgtgttgattatcatgctcttaacgctatcatgatcaaagacaggttctcgataccgatggtggatgagttattagatgagttgagaggtgctcaatggtttttgaaattggatttgttgcaagggtatcatcaaattctgatgaaggacgacgacgttagcaggacaggattctgcacccatcatggccattag

SEQ ID NO: 100596 - DNA, 792 bp, Glycine max
  Peptide Sequence Number=SeqID_217374
atgtgtaatgatgttcatcaatttgtcttaacttgtcttgattgtcaactcactaagtatgaagccaagaagcctactggactcctttttcctttaccaatttcctcatggccatgggaagacctatccttggaatttatcgtgggtcttcctccttatcatggcaataccatcattctggtggtcgttgacaggttccccaaaggaattgatttgggcatattgtcggctaattacacaaccctcactgttgccttgctattcatggagattgtcggtaagtatcatagaatgcctaagagccttgtatctgatagggacccgttgtttgttagcatgttctggaaagagttgtttcgcttgagtgaaacgaagctgagaataagttcatcttaccatccacagtccgatggtcagatagagtggtgttacaacacctccttccattcagctactggggccttaccattcgaaataacctttggacgcaaaccaccaagcattcctttgaaatcgcaggaacgaataaaggccactgcggatgcccaccgacaggatgcctcttttgagccaagggagtgggtcatgcacatcaacaataatcctattatcataccactgtcatttctaggaactcgttgggagatgggagaagctactcaccaccttgaggacaaggtgttgctagatgggctggggaatgataggcccaagactgaaaatggggaagacactcgaggaagacccaagaaagggaccactgctccaatttgcttgaaggattatgtctga

SEQ ID NO: 100597 - DNA, 339 bp, Glycine max
  Peptide Sequence Number=SeqID_217375
atggaggcctttcttactagtcacgctagcaaattggaaacctaccaacttggcatagtgtgtaagggaatgatcaatcatagaaggatatgcgaaaaagaaaaagagaattacatattacatggatggagaattttgttgaccacagttgtggaagcaatgccttccaaggttattttgatgatgccaaagaatcaagagctaagcaaattccaaagattcaagaatcaagattcaagaattcaagaatcaagtttcaagaatcaagattcaagaataatcaagatcaagattcaagactcaagattcaagaatcaagagaagactcaatcaagataa

SEQ ID NO: 100598 - DNA, 159 bp, Glycine max
  Peptide Sequence Number=SeqID_217376
atgccagctggtctacactatcttgacccattttgcaaggatcacgccttcgagacacctagtggacctggaaaagtccaacagggcattgggattccaagcttttatcacaggtctctaccagttctatggggtgctagttacgtgatgaggacatga

SEQ ID NO: 100599 - DNA, 309 bp, Glycine max
  Peptide Sequence Number=SeqID_217377
atggatctcgtcaagtacatctttgaaagtcccacactcattggacaaatgtctcaatggcagctcaacagcccatcaatgacttttgacaagagagtgtgcccatgcaagttcagtgatggggaccttgttctaaagaaagtgtcgcaggctcaaaaagaccatagagggaaatgggccccgaattatgaagcatcatttatcgtgaagaaggctttctcaggaggggcattactgcttatgaacatggatgacaaaaagttgtcttcgcctgtaaattctgatatcgtcaagcggtattacgcctaa

SEQ ID NO: 100600 - DNA, 426 bp, Glycine max
  Peptide Sequence Number=SeqID_217378
atgacaagtaacccttcaagagctaaaaagaaggaaaaatcctttaagtatctggacttggaatggttctctcaacatgagatcaactttcccaatctgttggaagtgcaagggctatcaaagctggtgcagatggaagggactttttatcctaagctagtcaaggtttactacacttgtgcattatatatggtcattgatgctgcaatgtggaaggaagtagttggtctagacataggtggagttcgcaagtttggtgaaacagttaatggatacaacaagatgcagacctataagggaatgcttcttgatcctactaggattttaaggaatcacttaggagttggtggactaactgcagagggcagaatgctagtatacgtcatcacctacattctcgcaccaaggtcaagcaatcatgcttaa

SEQ ID NO: 100601 - DNA, 435 bp, Glycine max
  Peptide Sequence Number=SeqID_217379
atggtgatcgacctaagtcttaagggagttccaaaccgagtgacatgcccgcaaacgtatcgcatcccattagctgaaaacattatctttcttgaaaaccaccatacacagggacaaacatgcattcctataattggattccctaaccccaattatgctcctctctacattgctcaaagacctctctcgttcaccttcgttagtccaaacgcaaggttctatataccaaatcgaaggaaacttcgtatagatttcaaaaacaaggttctactacaaggagacgtcaatttgaaatttcgaccacgtcaatgtgaccggggttcagtgaagatctcgcttagcgagctcatctcgctaagcgagaatgcacttttggtgctaagaataacttttcacgctaagcgcaaacccctcttaggttggcatttgtgttga

SEQ ID NO: 100602 - DNA, 132 bp, Glycine max
  Peptide Sequence Number=SeqID_217380
atggaagacacacccgtaagcctcgcctcgctcgcccgcaaaagggaatggggtggtagggataccaaggaagcgcttggaggagaaggcagaagccttggtagatcaaggagaatggacctcgttcattga

SEQ ID NO: 100603 - DNA, 288 bp, Glycine max
  Peptide Sequence Number=SeqID_217381
atgtatttcttccaagaaagtcttattggggtagctgtcacctggtatactaacttggaaccttcccaagtccattcttggaaggacctaatggttgccttcattaggcagtatcaatacaattctgatatggctccggataggatgcagctacagaacatgggtaaaaaggggcacaaatctttcaaagaatatgcccaaaggtggaaggatctggcagctcaagtggcacccccaatgatggaaagggagatgataacaatgataatagacactgtcataccctaa

SEQ ID NO: 100604 - DNA, 1722 bp, Glycine max
  Peptide Sequence Number=SeqID_217382
atggcggcagcgagaagcgtgtcgttgaggcaaatattcgcggagaggagcaaggagaggctcctctcgcggaaggacttttctgacctgaggctaaacggcaccaccgccacctccgcctctgtcgctactccccacgccctctccgatcgtgtggcgcagttcggcgagggcgtggggaggttcttccgcgagctgcgggagatggcgcggtcggatccgcggaaggtggtgtttgcggcgaaggcggggctgtcgctggcgctggtgtcgctgttcatttacatcaaggaggagcagctcagcaagtactccatctgggccattctcaccgtcgttgtcgtcttcgaattcagcgtaggtgcaactttgaacaaagggttcaatcgttctttgggcacaatttccgctggagggcttgcgctgggaattgctgagttggccgttttgtctggaaagttcgaggaacttatcattgtactatgcatatttatcgcaggattttgtgcaagctatgtgaagctactgcctgcaatgaagacatatgaatatggttttcgtgtgtttttgttgacattttgtattgtattggtatctggaagaactagcagggaatttttctccacagccttttatagattaattcttattgcaattggtgctggcatatgtttgtttgtaaatattttcatataccccatctggtctggggaggatctgcataaattggtggtgaaaaatttcaatggagttgctgcatctttagaaggctgtgttaatggttacctgcaatgtgttgcatatgagagggtcccttcaaaaattcttgtttatcaagcctcagatgatccactttaccgtggctatagagcagcagttcaatcatcaagtcaagaagagtctttggtagattttgcattatgggagccacctcatggtccatacaagacattcaattatccttggagaagctatgttaaagtcagcggagctttgaggcattgtgctttcatggtcatggcaatgcatggatgcattctttcggaaatacaggaggaagatgctgatgtttgtgaaccaggcagactggtttattccaaaatgtctgaggcacccccagaaaagaggctggttttcagtaatgaacttcagaaggttggtactgaaggagctaaagtattgcgtcaacttggaagcaaagtggaaaagatggaaaagctaagcaacatagacatactcttgaaagtgcatgaagcagctgagcaattgtcgatgaagattgaccaacaatcattcctcctagtaaattcagagagctggcaggctgcaaaaaagcctaaagaagttgaaaatcatgacaatttgtttattgatctcaaagaccatcatgaacacaaacactccctgatctcttccctcagtgaaacaggagttgattcaagacttaacataaacatagagccttcagttcctgaattgcacatttctcaaagcttgttgtccaataaaatatcatggccacgtctctcattttatggagataacatgttacttgagcaagattccaaagtatatgaaagtgcaagctctctgtctttggcaacatttgcttcccttttgatagagtttgttgcaaggcttcaaaatcttgtggatgaattccaagatctcagtgagaaggccaatttcaaagacccctttgaccaaacagtgttgaagtag

SEQ ID NO: 100605 - DNA, 468 bp, Glycine max
  Peptide Sequence Number=SeqID_217383
atgtgtgctagagcaagagtaatgggagaaatagaggaggtgcaagagtggatgaaggccgacatggaggccatgaaagagcaaatggccacaatgttggaggccatgatgagcatggagaagataatgaaggtcaatgcaactgcagttgccactacaagggccattgctgaggtggacccgactcccccatctggcctcaaccaaataaatcatccgacctcgaataaatataggcaaagagttgggaaggccctcaatttttgcccacaaccacaaccattgcatttcacaacgggaagaatccctcctgctatggtggaaaaaggaaagttggatcatttagaggaaaggctcaaggccattgaaagaggcagagaatatgcctttgctaacctagaagagttgttcctagtatccaacgtcgtaatccctcctaagttcaaggtgccagactttgacaagtag

SEQ ID NO: 100606 - DNA, 294 bp, Glycine max
  Peptide Sequence Number=SeqID_217384
atggttaaaggaagtgagcatatggtttataaacctcacaatgccttgtatgagcttggtttagccgcattgaatcttacatcatcagtgaaggattccaaaaaagtcaaaataaattatgcaaatatgaaggaggagtcaaggaaaatgaaacatagctcaaacaaatgcttggtcttctcaaaagcaaacaattgttacactctccacaatagaagtggagttcattgcagtagttggatgtgcctgtcaagcaacttggatgacaagaattttgaaggagttgggatatga

SEQ ID NO: 100607 - DNA, 579 bp, Glycine max
  Peptide Sequence Number=SeqID_217385
atggattttgacgttcttgagatgaaagttggtgaaaccttaactaagtaccgtgctcaagttatgggtttggccaaaaagatgaggagcaatgaagggtacatgaaggaagtcaccattgtgaagaaaatccttagatctttgactaagaaattcaactatgttgttgtctcaattgaaaagtctaaggacattgataaacttaccattgatgaactacaaagttcccaagttgttcatgaacacaagtttattagaccaagactccaaacaagaaagaaacatgttttagcatcacaaaacaagatcttcctcacttgtggcactgtagatatgctcatcttagttacagagggctataattgctacaaacttggaaaatggtttgtggtttgcctcaattatttgcctccacaattgtatgctttgattgtgtcaaagggaagcaacatcgtgagccaatgtcaaagaaaagtcaatggagagcaagccataagttgcaattggtccatgcaaacatttgtggtccaattactccaccatctaacaatcaaaatagacatattttgtgcttcatag

SEQ ID NO: 100608 - DNA, 339 bp, Glycine max
  Peptide Sequence Number=SeqID_217386
atggatgcaatccttaaaagtaggcttaagcttcttcctcacatgaaaaattcctactcttggatctctatgggttggaaatctccccctcaaggttggattaaagctaatgctgatggatcagttcgtggtggaggacactttgcagcctgtggaggagttttcagggattctcaaggtgacaagtggtgctgtggcatattgccttggaagaaaagcaaaagcaaaatgcaaaaagtgaaaaagcaatcccaacagaattgtactgcacagccacagaaggacagcccttgctcactccactacctactgcattttgttgttgttccttgttcctaa

SEQ ID NO: 100609 - DNA, 153 bp, Glycine max
  Peptide Sequence Number=SeqID_217387
atgaagatggaacataaagctatgaaaatccccaaggttgtggatagactggtgcaaggagaaggaggatcctttggggatgcctcacgagttcaagtagctttgccttatccacctggaattgactacaaaatatggttgagagcacactag

SEQ ID NO: 100610 - DNA, 192 bp, Glycine max
  Peptide Sequence Number=SeqID_217388
atggcgtcagcaatcacctgggccacgtggacgctcatccgtctgggcaatggcctcctcgtcgaccccgtcggccttgttcctcctctagctgaactcgcacttctggccttcctccaacacttgcgggtcacccaggaactggctaagggcaactgcgtcaaaggaaatccactgacccctcacccatga

SEQ ID NO: 100611 - DNA, 501 bp, Glycine max
  Peptide Sequence Number=SeqID_217389
ttttccatgtgcccggtggtcggttatgccccgtggctaggtctgggcaagccgttggtgaaattttgccccccggtcaacttcgtggtttttgcccgttgttggcttggctagggtcggcggtgctgggttatggccccgtgataagtttcggattggttggccccctcctcccccccgtgatcagttttgttgccaggattttgccaactttggcttgcgccccgttggctaagtctgtgcctcggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 100612 - DNA, 510 bp, Glycine max
  Peptide Sequence Number=SeqID_217390
atgaacactcttacacagatatgtatgacattgctacttagcaacattttgtccagcggccacaataccgatctccccctgcggaggaatcacgcccgcaaaacacccagtggacccggaggagcccaacagggccctggggttttcggctctagtaacggacctttgttagtcctacagtgtgcccgttccccccagcaagggatagcgcccgcaagacacccagtggacccaaagaagtccaacagggtcctagggtttccagctctgattatgggcctctatcagttctacggagtgcccatcgcccccagcaagttcatcaggccccctattaatcaggctttcatcaagaagtactgcgcccccaggcaggcgcagggcgagacaccacaacagcctggggatggccagcaacaggcaacaaatgcaccgccgccacctctagagcacctcagctcatccacaaaaaggttagagcgttgcctacgacacatggccgaccaatag

SEQ ID NO: 100613 - DNA, 222 bp, Glycine max
  Peptide Sequence Number=SeqID_217391
atggatcagccttatagtgaagtcagtaggtcatttgttgtaagatggaaggatgaactagagcatacttggcatttgctatactctagtggcagcatgcactcatttacatacaaccaagatatggtgagtctagctcttctactagctggatggatagaactcagagaattctatgggttcactggaaatcatcaagtgaccttgacccactttagataa

SEQ ID NO: 100614 - DNA, 582 bp, Glycine max
  Peptide Sequence Number=SeqID_217392
atggtgattaaaaatcatcttagtcccctgcacaagattgatcatgtcattgttactcatgatcttccctcgttgtggaatgctaacatcaaagggttcgagttcatctctactgataaattgcttacaaaggttgactcgaagatgatgggctatgttggggccgacattagtttggattctattgagtcttactttatatgtctgttgctactattttccattggagaactagagagagacttggctggtcaagaaacttcaaaattacaagcacaacttgtcgatcaaaagagtgcaacagaaaagaaaagtgttgagcatgtacaacaattgcaacaagccttcaagatagttcatgaagatggttttaagaaagctctctaccaacttgctctattcgcccataaaataaatttaaagaaattcgatgtgctaaaagatgtaaaggatggggagttggtaagagaatctcaaatggagagttttgaagatgactctgatagtgaaacgatctctaaggcaagaaatgttgaggcgaccttactccctgttctgaccttaaatcgttcaacaacatag

SEQ ID NO: 100615 - DNA, 360 bp, Glycine max
  Peptide Sequence Number=SeqID_217393
atgttatgtgttaatggagcttgtaaccccaagggtagcagagtaggaatcacctttgaaggacctagagatgtctcactcgagcaatcattaaggttggatttcaaaacttctaacaatcaagctgggtatgaggctctgattccagggttaaaattagcaaaagaagttggagtgaagaaaatcgggtgtagaagtgactccaagtttgtcattggccaagtgaatggagattttcaagtcaaagatacacatatgcaaataggaatctacgacatgcacttagaaggaaggaacatggaagctcgggttctccgagttggttattattggccaacaatgcttactaattatgcataa

SEQ ID NO: 100616 - DNA, 144 bp, Glycine max
  Peptide Sequence Number=SeqID_217394
atgaagcaccagaagaggaataccagagaaatcaaagaatggagtgaagggtcaagagaagggctgaggcgctttgaagaatctgagatccgcattggttatgggaaccaaagaattgagtcttgtgattctaagaatcattaa

SEQ ID NO: 100617 - DNA, 477 bp, Glycine max
  Peptide Sequence Number=SeqID_217395
atgccgcaaaggaaaaaagttaaccaagtcatcattgttgaggctgttggagggtcgattatgccgaccgctctcccattgaatgtggtggtgccagaaaagactcataatttaagaaagatggctcaaacggaagttgacaaccataagcatatccaagttgattcagatgtggatgaaataggggataactggagccctatggacttttgcaaccctcagaatgaggagagatcattttggaacatggttttccctcacacgatccataaccacactcacaaaatgtcgaaggccgattgtgaggacttggaaaaattgagcttcatgactgtagaagtaaagcctcatgatgatgacaaaggtgatgacaaaaagctcaaagatcaatcaaagaacaactcaagtgaatcaagaacaattcaagagttcaagataagaatcaagaagaattcaagactcaagaagaaagtttag

SEQ ID NO: 100618 - DNA, 210 bp, Glycine max
  Peptide Sequence Number=SeqID_217396
atgagtacatcggtagaacatccaaggatcctaaacaacatatcaccgtccaagtggaaaggtgaaatacgaccgaggatatcgaggaggtaccaacccttacctaataaattcaagattgatgcagagagaaaaatcaaagctactagagagaaacataacttgagaaaatccaaatccaaagtgggagaaaaaagtgtaggtaggtga

SEQ ID NO: 100619 - DNA, 321 bp, Glycine max
  Peptide Sequence Number=SeqID_217397
atgtataaaagaggaatccagatatacaatcatagcagggaagctttaccgaaaaggtttatatactcccctccttcgatgcttggctctagcccaggcccaagcagtcgttatcaagaggtacgagggctagcacaaattcaagaagcgatggccaagcttagagttgaggggaagtacaattctcgagtttttctaagggaattcaaggaggaagacttagtgataaagaaggctcaaccaaacttgatcataaacaagctatctccaaaatgggtcggcccttacaaaatcatccaggtagtcagatgggtaacgtaa

SEQ ID NO: 100620 - DNA, 1011 bp, Glycine max
  Peptide Sequence Number=SeqID_217398
atggttgtgacaactttctacaagggaatatgggcaaggacgttcagtgagtcactagtttgctgtcatctggacaccatgatgaatgttcattctcgggtcttaagagatttgatggggccccacccaagggtgttggtcggatttatgggggcaaaaacaaaggttcaaggttatgttgatcttgaaataacttttggcgaccaaagagccaaaagttttatgattcgatatatggttgtgaatgcacccttaacaaacaacatcctgattggacgactatcattgaataagttgggagcaatcatgtcaagagtccatctgaaagtgaagtttccactagaggacaggtcagtcaacactattagcgtcaaccaagagatttcttggaagttcaatgaggagagccttaaggcaaggaaagggttttatggaccagcaaagcagtatgaggcaaagaaggtaaacataggcacaacctttacacctcaacttgaagacaaccttgtggaggtgctaaagcgcaactcaaatgcttttgagtggagtttgagggacatgtcgaggaatgtaggagcaacgtaccagcagctgattaacaaaatcttggctaaacttatagggaaaactattgagacttatgttgatgatacagtggtaaaatcatcaaaagttgataaacacactaccaacctccatgaactttttgatatgatggacctttatcagataaaattaaatcccgagaagtgcttatttgacgtttgggctggaaagttccttggcttgatgctaacaagcaggagaaacaaggccaaccttaattggtgctccgtggtcattgatatgatgagccttaccaacatcaaggaggatatggcattaacttcaagaaaaagaggtgccattaaaggccaagtacttgttgactttgtgggtctcaatagtgtcatagttgaacaatctctaaatttcaactttagcttgacccataaccaagtggaatactag

SEQ ID NO: 100621 - DNA, 537 bp, Glycine max
  Peptide Sequence Number=SeqID_217399
atgggtctaagcaagctcggaaccgcaataacggcgataacggccgttactctggtgtttctgttcatggagatcgtttacgtgctgtggcaacgccgtcagaggctccgtccgcgcgtgcgcgtggagccgcaggaggcttcgccccagtgttcttccacctcgtcttctccaagtgacgatgatgacgtggagctcgaaatcgaacagcacgtgatgaagtggcagcagtgtcttaacggtaacggtaacggcccctccagggtgctcttcaccatcaaggaggaagagagagaagaggttgactccgataacggcaacgacaatggtttgtccgaggagtgtaacaagagtgcgcgtgcgtggttggatcatgagcgcgtggcagcggtggtggacgaggttgtggtcgtggttgaggagttgttgttattgaacgaaacgacgacgccgtgtgcttcgcctccgtactacacaccctacgcttcgccgagtcgtgaagagtgtcgtaaagatttaaacgacagtaatggatga

SEQ ID NO: 100622 - DNA, 456 bp, Glycine max
  Peptide Sequence Number=SeqID_217400
atgaaaaaggaaaggaaagaggaaaagagaagatggatagatggcctgcgttgtttgcggtttgctggtgaggttgaaaggtggcggatggatagttggacagaaaacgatgtttttttttccctcggaaatgtgggtgttattattgcagtgcggcactttaaaattgagagtagtacctctgacgctgatcatttgaggaaaataatatggatgatcgaggagatgaaagagatggaggaattggtgcgggtgggtctccagaggttccttggcggcagtgaccagcaacggtggtggtggaggaagatccctttcgcttctttgatgattctgccatttgaaggtgttccagctaattttgatcggtgggtttggaagagaattgaaaaagatgaagattggactttgtttaaagcgatttggttaagaaatgagagagatacgcagatttga

SEQ ID NO: 100623 - DNA, 589 bp, Glycine max
  Peptide Sequence Number=SeqID_217401
gcttctttgtaaacttaaccacactaagtcgtctacagtcttacggctgaaggcgatttggttaaaggctaagctacctttcgagttgtggcttggccagtgctgtcctgtcgacccttatttaaaaggtcgattgatctggaagcttcaacaagctttcagacctaaggatcttgtggtgcctccaacgagtacttataagtctgagacttttgagtacttagaggatatgacacttctaagatcttggactgaagcctggctcaagtacgtcaggtggtattacgctactgctttatccccagatgtttccatcgaggattttatccaagctcctgttgttactactcgctctttccagcgaggagtgagaacctctttgatgctgaggttgcggctcatcgagaactgttgcggggagaccatagctgaggctgggcttgatcctaaacctctaactatcctaggttctaggttaggtggaagtgaaaagactaagggagatgcagattacagcattgctgattcagaggagattactgatattgtggggacaaatttaatttttcatgacaggccctgttattga

SEQ ID NO: 100624 - DNA, 591 bp, Glycine max
  Peptide Sequence Number=SeqID_217402
atgtcgaggaaggacaattctcgcgaactcgagagggtcccacacgacgaagctgaggcccgtggagttccacgagatgatcgggtcgagagtcggggcgtcgacgaggtcgaaggtcttagaaagaaacggaggaaccgggttgaccatctccaagggcttgggactgggagagttgttgccatcgttggggttcatgttcaaagaagaagaatgaggaggggtgagaaaagaaaagagagggaggtggggatattaaaagggtgtgagggcggtggagggtggagaggtgatggcggtggaagggaaaggccattgcacattacgttggttagttgcaactgggggtggttacttcttggttgtgtgttgcgaccgcgtctagggctcacacgtaggactgttgttgctgttcattggttgggttggattttgagagcgactccttctgttgtgttcacactcgacagtgctgtcaacttgtctggtcgcccaacccaactttaccacccaatcgcgacagcttgtctttttctggggatttttcatgggcccgcgggtcttcattttactacttttattggaaaataa

SEQ ID NO: 100625 - DNA, 714 bp, Glycine max
  Peptide Sequence Number=SeqID_217403
atgacaagtatcctctttaggaggcaattccgcttgagtcagtatggatctcactcgaagaagcggcctgataaccttgttattgggagaacttatgatcatcatatctatgatttagtggaggttggagttgaaaattttaaacccatggagtcttttagttatgataagaagttggctcctaaggaagggtcaaagccttttattgtttttattggagaaggatttgaggctgtggaagagctaaagcatttgaaggaagttttgctcgatcttcttcgcggtgaggttgtggagaatctaaatcttgctggagtggatcgtgcatatgtatgtgctgccctttctccgaatcgtgtgttttttacacactgtgcattgcggctgaaaaagtcaggcaccgttgtgccaaggatggaattggaagaagttggcccgtccatggattttgttcttcgtaggcatcgtcctcctaatgaaagtttgaggaaggaagcactgaaaacgtcgagggagaagccgaagaaaaaggagaagaatgttaaaaaggatgaattacagggaaagattggaagtatttatatcccagatcagaaggttggagaaactcctttaccttacaaagcaaaaggagtgaagagggagcgccgagaatcgaagcggaaaaatgagagtgatggaagtgcttcaaaacggaagaaggaagattcttaa

SEQ ID NO: 100626 - DNA, 615 bp, Glycine max
  Peptide Sequence Number=SeqID_217404
atggagaagaaacttagaggagtcaaatccgctcgggcggccttcggctggcctgaaatcggagttcatcgcgcacaatggagcgcgatgctgatctgcctgacggcgatcggcggggcgcaggccgccaactatatagagaacggcaaagcaggcgatccggccagctggcgcagcagtgagttcaacgcggaatgggggctgggggcgatccacgccgaccaggcctacgccgctggttataccggaaaaggcatcaaacttggcattttcgatcagccggtctacgccaagcatcccgaatttgccggtgagaataaggtgatcaatttggtcaccgaaggcatccgcgaatacaccgatccctatatcccggtgaaaaaaggcgacactttccgctatgacggtacgccgagcgtggactccgatggcacgctcggttcgcacggtacccacgtgggcggcatcgccgccggcagccgcgacggcggcgccatgcacggcgtggcgttcaacgcgcagatcatcagcgccgaaaacggcgatcccggcccggaggacggcatcatcctcggcaacgacggcgcggtgtaccaggccggctgggatgcgctg

SEQ ID NO: 100627 - DNA, 168 bp, Glycine max
  Peptide Sequence Number=SeqID_217405
atggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaag

SEQ ID NO: 100628 - DNA, 447 bp, Glycine max
  Peptide Sequence Number=SeqID_217406
atgaacaagcaacaacttaaaagaaagtctacttcaaaatcttatggctctcactcttatccaaagaaagaccaaggtctaggcatcttaggggcatcaccttctaagcccaaagatgataaggggaagccaatagaaaagcaaccccctaaggctagtatggaagagaagactagctctataaatagccaagatgagactactacttcaccttcctctagtgaaagtgaagaagcaaaaggggaagaatctagggaagaaatctacccccaagaagaagaacaaccattaatggttaagaaggagtgtaaggaggagttgttggatgagggtttggttcataagagcttaaatccttgtgctttatatggagctacatcatgtggtatccatgtggagcttgtaggccttggatcttcttcatcaatggagtccttttcttcatga

SEQ ID NO: 100629 - DNA, 486 bp, Glycine max
  Peptide Sequence Number=SeqID_217407
atggctggagttgatccacttggagaattggttaagaacttgcttgatgtttaccaaatgccaattgagttgtcgtgggatgggacaaaatttgggctacctaatgtaaaagatgactttttcatcacacatacaaatgtaactaaacttattttaggtgacaaatgtttaaacatatctacactacagttgtggatgataacttgtaaaaggattttacaagatagtggaactctcaagcgggttgcttggggactggacgtaggcacaagggtgtggccaaaccagtatttcaaattagtgtcatgtgttactttgaaagtactagctttgatgtggtgcatagtgagcggcaatttgaagaatgaatggaacaggtggttttctaatggaacaacattagacaatgaggccatgacaacacttcgcaagaaatggacaacatattttctacaagttaaaaacattgtatttagacaaatttag

SEQ ID NO: 100630 - DNA, 216 bp, Glycine max
  Peptide Sequence Number=SeqID_217408
atgtggagagggagtgtgaagtcccttattagcatgccatgctttatgtcaaatgcagcatacctgttgctttttgcaaggctagaggtggtaaacttagcttcagatcatgggttgatggatgctcgagagaatgcactcctttgctatggtatagaaggagacaagagattggttgagatggcaaagcctataaatgatcctgcaggtctatag

SEQ ID NO: 100631 - DNA, 198 bp, Glycine max
  Peptide Sequence Number=SeqID_217409
atgtttcaggcatggagaagtgaggaaatcaagctatggacaagtgaggaagacaaggttactatggccattttgaaaaattgggaggtgcaggaagcaaacaaggagaatatggaaacattgaaattgatggcacaaattttgaagcttcctatcactgttacgaaaagcaaatcaaattgtcctgttaaactataa

SEQ ID NO: 100632 - DNA, 234 bp, Glycine max
  Peptide Sequence Number=SeqID_217410
atggaagacgattatgtaaggaagatgtcaaatgaagtggatatagaggttgacatgaataataacattagaatagacagaaatatttgtaaacattatggacaagagactggaaaaatttttgattgtagcaaagcattcataactacaaaggtttttgctactcaagatgaattattgaaatgggcccaggatgttgcatttgaaatagatttttttttgttgtcattttga

SEQ ID NO: 100633 - DNA, 369 bp, Glycine max
  Peptide Sequence Number=SeqID_217411
gcttttagtgataattcccaaggtggtcatatctttcttgatggtttctagaggaatcatccccttcgaaaaacatattacggcagcagggactaccagcaacaatatgttatcaaagagaaaaactctagatgagggttcactgttatcaagcaagtcagagacccagcatgatcacagattcacctccactccttatgttcccatggacacgagtatagggccccttttcaacttaccgcctaactctctaaaaacaatccccagcggagtcaccaactatgtcaacctacccttcgctgggagggcgacgcgagggctcacgggtgcgtcttccaagggaggaaggcacgcggagtcaccaccaac

SEQ ID NO: 100634 - DNA, 192 bp, Glycine max
  Peptide Sequence Number=SeqID_217412
atgagccatgggcgactataccaaagcatagtggaaaacgctttcaacaaaagagtgctctcacataagttcagcaagggggaccttgttctgaagaaagtattgcaggctttctcaagaggagcattatttctcatgaatatggatgatgaagagctgccttcccgtgtgaattccaatgtcatcaagtga

SEQ ID NO: 100635 - DNA, 531 bp, Glycine max
  Peptide Sequence Number=SeqID_217413
atgggtgaagttgaggaggtgaaagagcagatgaaggccgacacgaaggccttgaaagagcaaatggtcaccatgatgagcataaaggagataatggaggtcaatgcggctgcaataaccgctaccagcatcattgctgaggtggacctgacccccctatatggcctcaaccaaataaatcatccaacctcagatatggtaggtctagaaggcaaagagttgggaggtacaggcggccctcatttagtgcaaaaaacaagcatgccttcccaccatatcgcttgcctcccaactatacaccacccaatgtggcaaacacttccagtgaggatgtcaataactccgcttccatactcattgaaagtcgataacctcaaactgatcatgatcaaagtgggtctagaaaaaggcaaatctgatcatccagctttgatgaatgtgaaaattggggcaaatgaaaaggatgagaatgagggagaaacccttgctatgacagccattcctacacggtcaaatttcccatcagcctaa

SEQ ID NO: 100636 - DNA, 420 bp, Glycine max
  Peptide Sequence Number=SeqID_217414
atgtggtcatctgcgccctttccggagatgtcagcatcttccggtggagactttttcagtctcacaagttatctagaactacacacagtcgtgtccggtggcgcgcagagacaaaatttggtcattctgcaccctttgtcatccagaggcggcgggcccgatgacatgcggagacaaaatttggtcattctgcacccctttgccattcagacacagtcgtgtccagtggcgcgcagagacaaaatttggtcattctgcaccctttgtcatccagaggcggcgggcccgatgacatgcggagacaaaatttggtcattccgcacccctttgccattcagacacagtcgtgtccgatggtgcgcagaggcaaaatttggtcattctgcaccctttgtcatccagaggcggcgggcccgatga

SEQ ID NO: 100637 - DNA, 282 bp, Glycine max
  Peptide Sequence Number=SeqID_217415
atgtcgatgatgctcgttcaacacagatggacgttacctgtccaccatggagtcgaccttgatgtactacgaaacaactatacaactaaagcaagttgccatagagagggaattggaggaaaaaggccaaatgctataaggtctggtgacataaaatggaagaaacttttgttgatgagggagagggagagcaaaagcaaaagcgagagtaagactgagagtgaggggttgatgcaatcctaccccccaagggcattggatagaagactccaagaagattag

SEQ ID NO: 100638 - DNA, 336 bp, Glycine max
  Peptide Sequence Number=SeqID_217416
atggaggtgacaaagagtggaataatagtgaccaacaatgatggaggtgacagaatggtggcaatagtggtggtggaatggtggtggaaagggtatgctgctggtggtggtggtagtgacgacaacaatggtggtgggggtggaatagtggtagtagtggcgacaatggtggtagtggaggtgccaaaagtgaggtgcagtggtggtggaaaggcagtaacgacagggtgtggtggcggcggttgtggtaaaggtggcaacgacgatgatgtggtggcaatggtgggggcaaggatggggacgatggtggagtggtggttagaatgtgttttttaa

SEQ ID NO: 100639 - DNA, 459 bp, Glycine max
  Peptide Sequence Number=SeqID_217417
atggggttgtgggaatcttttctcaattggcttcgcagcctctttttcaagcaggaaatggaattatctctgattggacttcagaatgctgggaagacttcacttgtaaatgttattgctactggcgggtatagcgaggacatgattcctacagtgggattcaatatgaggaagttagagcagtttgtacagcgagaaaatccagataaccttagcatatcaaagagtgaactacatgatttgttgagtaagccatcattgagtggtattccattgctggtattggggaacaagattgacaaacctggggttctgtctaaagaagctttgaccgaccaaatggatctgaagtcaattactgacagagaagtttgctgcttcatgatctcgtgcaaaaactcgactaacattgactctgttatcgattggcttgtaaagcactccaaatcaaagagctaa

SEQ ID NO: 100640 - DNA, 165 bp, Glycine max
  Peptide Sequence Number=SeqID_217418
atgaatgcagtgcagatgtggggcaggctcgctcagcccaattcgagaattagaaaaccagagaaggatttgggcttagcgcacagatgcgcgcttagcgagttctgcagctctgattggtctgcaactttcgctaagcgagacgtggccggcttagcgaattaa

SEQ ID NO: 100641 - DNA, 870 bp, Glycine max
  Peptide Sequence Number=SeqID_217419
attcctcctcagattgggaatctctccaatttggtctaccttgacctcggaggttattctggtttcgaacctcctctgtttgctgaaaatgtagaatgggtatcaagtatgtggaagcttgaatatcttcatttgagaaatgcaaacctatccaaagcatttcattggctacacactctccaatctcttccttctttgacccacctatatttgtcactctgcacactccctcactataatgaaccatccttgctcaacttctcatctctgcaaactctctatctttacaataccagttattcccctgccatttcttttgtccccaagtggatattcaaattgaagaaacttgtttctcttcaattaaggggtaatgaaatccaaggtccgattccttgtggtattcgaaacctcacacatcttcaaaatcttgacttgtcttccaattcattctcatcttctatacctgatgccttgggaaatttgacttctcttgttgaacttgatttatcaggtaatcaacttgaaggaaacattccaacttctttgggtaatttgacttctcttgttgaaattgatttgtcatatagtcaacttgaaggaaacattccaacttctttgggtaatctctgcaacttaagggtgatagatttatcatatctcaaactcaaccaacaggttaatgaacttttagaaattcttgctccttgtatttcccatggactcacaagacttgcagttcagagttcacgactttcaggcaatctgacagatcatattggggcatttaaaaatattgagctgctagattttttcaacaactcaattggtggtgctcttcctagattatttggaaactttcatcattaa

SEQ ID NO: 100642 - DNA, 645 bp, Glycine max
  Peptide Sequence Number=SeqID_217420
atggcatcatcaagctcctacaattctccatgtgcagcctgcaaattcttgaggaggaagtgccttcccgggtgcatctttgcaccttacttcccaccagaagagcctcaaaaattcgccaacgtgcacaagatcttcggtgccagcaatgtgacgaagctcctcaatgaacttctccctcaccagagggaagatgcagtgaactctcttgcatatgaagccgaggcacgcgtgagagaccccgtttatggttgcgtaggtgccatatctttcctccagagacaagtccaaaagctccagaaggagcttgattccgcaaatgctgatctccttcgctttgcctgcaatgacatgcctccaccctctctttctgtgccaccacaaatcccccaaaggtcttttagtgcagggtttggtaataataatgaatcagcaagtggaggagagttctataggccttctcctaccaccacttactcttacccttattctcttccatggactgatacctcttctgaggatatcaatgatggaggagcctcacttggactcttctggctagatgtgactgatcaagtgcaactctctacaggcatgtgcagtgagcatgcggagttgacatgctctgtcattgtttatgattaa

SEQ ID NO: 100643 - DNA, 252 bp, Glycine max
  Peptide Sequence Number=SeqID_217421
atgcagagacaaattatggtcattctgcgtcttgtatcaaccaagaggaacaagttcgacagtatcgggatgatgttcggtattgatcattttcagattttcgcaggttcagtggccgaaaggcccacttggaccctccagaagattcctccagaaggcggttgcttctggaggaagccaccttgctcgcctgggcaagctgagctcgcctgggcgagctgggtggcaaacatctcccccattttcctataa

SEQ ID NO: 100644 - DNA, 2781 bp, Glycine max
  Peptide Sequence Number=SeqID_217422
atgaatgaagcatcaatcaacaacacggagagttatctatacctccatctgagcgagaacccggccactgccctcgtttccccagtcctagactcaactaactaccactcatggagtaggtccatggtcattgcattaagtgccaagaacaaagtagaattcatagatggtagcgcgcctgaaccactgaaaacggatagaatgcatggagcgtggcgtcgatgtaacaatatggttgtttcgtggatagttcactcagtggctacctccatacgtcaaagtatactttggatggacaaagctgaggaaatctggcacgatctgaaatcaagatattcacagggtgatcttctgcgaatctccgacctccagcaagaagcttcaacaatgaagcaaggctcactcacagtgactgagtatttcactcgtctacgcgtaatttgggatgagatcgagaactttagacctgatcccatctgttcctgtaatatcaggtgctcctgcaatgccttcaccattatcgcgcaacgaaagctcgaggatagagctatgcagttcctgcgaggcttgaacgaacaatacgctaacattcgctctcacgttcttctcatggatcccataccctccatatccaaaatattatcctatgtagctcaacaggaaaggcaactgctaggtaacaccggaccaagtatcaacttcgaacccaaagatatctccattaacgccgcaaagaccacttgcgatttttgtggacgtattggtcatgtggaaagtgcgtgttataagaagcatgaagtgccctctaattacgatgcaaagaataagagtaacattggaagaaaaacgtgcacccactgcggcaagataggacatacagtggatttctgctatcggaaacacgggtacccgccgggatacaagccttacagtggaaggaccaccgtgaacaacgtagtggcagttgaaagcaaagccactgatgatcaagctcagcatcacgagtctcatgagttcgttcgcttctcccctgagcagtacaaggcacttcttgccttaatccaggagccatccgccgggaacacgacacccactcaacccaaacaggttgcttcaatttcctcatgcaccgtcaatactccaataaacccagtaccctcatccaatgaaccttcaaatgagcaacctcttccacaccttaggcattccacaagagccaaacatgcctcgacatatctccaagactatcacagagaccttgcttcatctacaccaaatacttcggtggttgttcgttaccctctaagttcagtgctctcatactcacgtttgtcacctgcacacaggaatttcgtcatgagcatctcctcaacaacagaaccctcctcatacgccgaagcttctagccatgactgctggattaaggcgatgaaggtcgagttacaggctctccagtcgaacaacacatggagactcacacctcttccccctcacaagacagctattggatgtaggtggatatataaaatcaagtatcgggcaaatggttccatagagagacacaaagcgcgattagttgcaaaagggtacacccaaatggaggggttggattacctcgacacattctctccggtagcaaagctcactacagttcatcttcttcttgccttagctgcactcaaccaatggcatctacggcagctggacgtcaacaatgcgtttctccatggagaacttgacgaagaggtgtatatgcaaataccaccaggtctttcggttgacaatccacagcttgtgtgtcgtcttcaacggtctctttacgggcttaaacaagctagcagacaatggttcatgaagttatctagcttcttaagctctcatgggttccaacaatcgaatgcagatcactcactcttcttgcgcttcacaggagtcatcactacaatactcttagtgtacgtggatgatatcatcctcactggaaacaacatagctgaaatacaaactatgatcaccctcttggatcgcgagttcagaattaaggaccttggagatttgaagttctttcttgggctcgaaattgcacgcacctctgagggaatccatctgtgtcaacgtaagtataccttggatattttatgtgattcaggaatgctaggttgcaagcccaactcaacaccaatggattactccacaaagctgcaagcaaattcaggaagccttctttcagctgagtcttcatcctcctatagaagattgataggcaaactcatataccttaccaacacacgacccgatataacatatgctgtccagcaactcagccagtacatggccactcctaccaacactcatcttcaagctgcctttcgcatccttcgatacctcaaggggtgtaaagattcgaggaaatctactacggggtacttggtttaccttggttcttcccttgtctcttggcaatcaaagaagcaatcaaccgtgtcgcgtagctcctccgaagctgagtatcgagctctcgcctccaccacttgcgagctacaatggctgacttttctgcttaaagactttcgcgccacattcattcaaccaacaaccttatattgcgacaaccagtctgcaattcaaatagccacgaatcccgttttccatgaacgaaccaaacacattgagatagattgccatattgtccgacaaaagattaactcgggtctcatcaaactccttccagtttcatcatccctgcaactcgcggatatattcaccaaggccctgacgcct

SEQ ID NO: 100645 - DNA, 543 bp, Glycine max
  Peptide Sequence Number=SeqID_217423
atggaaaacctaaacacacccagggatctggaaaaaattcgatgtcaaatatctaaagccaccatagcacgttttctctcctatgtgcctgaggccaggggacagggactgaaccttagcaggattagagcttccgatttctcatgctgtcatgcatatagtgcccatataagtctctctgggtgtttgtgttggtggggggttggcttacactgggaagtggttacaacttacaattttgattatgatctatacccaaatgccttttcatgtctaccagcagacctgacatggagctttcctactccagattacaatatatatgcaaagaatacattactggaacaactttccaggcttccccatgcacccagtgcaccttttcaaacaacaccatcggtcatcgaagttccagaagaggaagaggaggacatggatgtaaggccaaaacgtcgtatatggagtggtgaagattttgattcggatcatgatgatgacatggctagttcaaagaactctgatttaactgcacaaacgaggtaa

SEQ ID NO: 100646 - DNA, 546 bp, Glycine max
  Peptide Sequence Number=SeqID_217424
atggtggaggtcaatgcggctacagtcattgccgcaagtactgccactgagggggaccagactcacccatctagcctcaatcaagtaaatcctccagtttcggatatggtaggtcagggaggagaagcattgggaagtacaagcagtcctcatgttgtgcagagcaagaattctttcccaccatacggcttgcctcccaactatacactacctaatgttgcacatgctcccgatcagaatgtcaataactttactcccatactcattgagagccaacaatctcaatctaattatgcacatgtctctcaacccatgggggaggcacatgaggcaccccgagaccataatctagctaactttgagcctcacctcggatatgccgctcgggggcaggcattttgcggcgtacccctgccaaacactttgggggagccctcagtatcacccacaaccacaacccttgcattttgtgaggggaagagtccctcctgctatggtggaaagggagaaattcaatcatatggagggaaggctgaggtccattga

SEQ ID NO: 100647 - DNA, 462 bp, Glycine max
  Peptide Sequence Number=SeqID_217425
atggctccgaaaaagctttccgtgaagagatctaggagggacgttgtggttgaagggaccagtgccgctcccgaggacgatgagtacacagattttcaagaagagatagctcaccgacattggacgtcgctggtcactcccatggctaagtttgacctagatatagtcctagagttttatgctaatgcttggcccataaaagaggaagtgcgggacatgcggtcatgggtgagggatgccctcagccagttcctgggtgacccgctagtgttagaggaaggccaggagtgcgagtttagtcagaggaggaacagggccgatcggtttggcgaagaggccattgcccagctattatgcataccgggtcaggattttgcccggaccgctgccggaaggcaggtgttagctggtgtatgccatcctgacacggatgagcgtccatgtggctcagttgattgctga

SEQ ID NO: 100648 - DNA, 346 bp, Glycine max
  Peptide Sequence Number=SeqID_217426
atgaatattagtgttgcaaaagaaaagccaattggcgatgtcgatagtggcatgaaggatgcggcggctggggaactctgtgtgtatctggaggatggcggcttagcggcggctggaggagaacgtgtggggcttgctgcaacaatgggaaggggagctagcaagggtgttgggttttgctgcaagagtgcgagacgtggaggtggaatcggcatggaggcgtctagtgtcggtgactgcacaggggaggaagatggaaaatgtggactggtgagttctgcgatggatggtttgatgcgatctatagcagagttagccattgaggctttcaatgaaagcaccaaat

SEQ ID NO: 100649 - DNA, 888 bp, Glycine max
  Peptide Sequence Number=SeqID_217427
gagaagggtttggagtgtttggttgacggaagtagagagaaaagagagaaaataatggcaacaagggagagagcagaaatagagaatggtgtttcattaccatctgtgggtatggatgcaaataagcgtagagtgacatatttctacaaaccgaacatcgacgcccactatcatggtgaagagtacccaatgaatccttttcgtgttgacattacccacaacctcatcgtccactatgggctacatcgactcatgcaaatcaatcgccctttccttgccgacaaggttgacattgctcgcttccattccgatgactatgtcgagttcctgtccactgtttcaccacagatccttgctgaaaactttgattccaactattgccaacttaagcgcttcaacatcggtggggatttccctatcttgaacggccttttcgacttttgtcgtgtctctgctggcggctctatcggtgctgctgtttgcctaaactgctccaatgccgacatcaccatcaattgggctgggggttggcaccatgctaaaaagactaaagcctctggattttgctacgtcaacgacattgttcttggcattcttgaacttctcaaagttcataggtgtggtgacggtagcacaacaatgataggagatatggacggaggtggtgcgacctgggtagagttgggtgaggcaatgcaaggaacaattgaagaagcatttgagtgcgactataactgcaagagaggcataaacactacacgatggtggctagactggattgcgactatcggagaaatgcgcaatgacgtgaccttgaaggagaggcaatgtgaggaagaaggacttgagattatgagttgtaagttagtctgtgaacccatagattaa

SEQ ID NO: 100650 - DNA, 1821 bp, Glycine max
  Peptide Sequence Number=SeqID_217428
gttgtcccaattgatgatttctcatcagaggagacacaccccaaggcttccgacaatgggtcttcctctttcgagaggttcctggaccagtgccatgtcgacgagggtagctctcgaccatgtgagagggttccaccttttgttactcttttggaagaggaactcatccccgtcatgacaatccttctctcttctccttcgacggcttcaggaaggggtgacaatggtgtcgttagggttttgcctcgtaacaggtgtagccatagcatcgggatgtcctcgcctcctccctttgttgttgattacgagtgggtgagggacgatgtcctgaagtatcagtccttaaaaacatttgttatgagcgtcgcgactctgtggcgccaactggatctagccaacccaagagattcctgcaagatgactgtccaggcttacgaaaaaaatgagtttccgtttatgcgggcagtgccgggttttccaccctttttcaacttgacccttcccctgaactcctttcaatgtgccctgctggagcatctaaacattgcgccatcccagcttcatcctaacaattgggcaatgttgaaccccttaaggttcaaatcctttgatgaggatctaatgaccctggtggacaaagccattgtagagaaatttccaacctcattggacgctcggactatcttgtctcttccttcagtagacgaccctctcactgttctggatggtatgatggacaattttgaatggcgatcgttggtgaagggtcaacctaaggccagagtcaaccctccttgggattccgaggctggtgaggatgaagttgtcgaggttgcgcccgacgtgccaccacctattcctaccaaaaggaagcacgatgaagaggatagggggtccgtgcctccatctgctcccactcaaacaattcctactcctccttccttcacgcctgctatgtcgaccccctcggctgctcctactactactcctctttcttccactgtcatgccattacttagtgtcggtgtggcgactatgagtatgtcaacggacttgcctcattcctcttcagccttgttaggtttagctatgattgtcttgccgtcaatgacacttgcctcctcttcttgcccaagtatctcactagaccatgtttatacttcttgcgacacaaattctatgtggaaaattggctacagaccagagcagaggactcctagtgactatgtgtcccttttttaccaaaacctcattcggtcaattggggtacaaaattcaaccgatgctacgaaggtcttccttcagaggagtgtgaagattttggaagagaatattcaaaggcaccaagaagctctaaacaaagctgcatttttagaggctgaggtcactaaatggagggccaatgcttggactgtaaaggatagtgaattgcttgacgaggaagacattgatgttggggaggaagatgttggcgaagaagatgatggggccaatgttcagagtgatgagaatggttctctattaggtgtgattttgcctttcctcaagagcctggcggagcttgaatttgatgagccttggagagtcgacgaggattaccaagggtggaccttgggtttgatgaaccttagcaagaactttagatgggtagcattccatgttcttggaattgctttaccatttaattcctatagcatgtatgctccattgtctaagcttgccacgaccctgaataggccttcccagttgggccctgactttcctgctcgtgagtctttccttgcttcacctcagactcgccgcactaggtcttcagggtga

SEQ ID NO: 100651 - DNA, 1160 bp, Glycine max
  Peptide Sequence Number=SeqID_217429
gcccctcctcgtgccccccggtagaggacatttgtaaatccgacgtgggagattgtggagtccatcttgactacatcagtgtactccaaatctcggtaagtattcattctcaactcactcacgtctgttatagggtcatgcccttaggacaaaatgtcgaggtatatgtggatgacatggtcgttaagtctcacagtgtagcacaacatgtggcagacttggaagaggtgttcatagagattaacaagtatgacaagacccttaacctcaaaaaatgcacctttagggttggcgacgaaaattttttgggcttcatcattacccatcgcgaaatagaagctaaccctgacaagtgcacaacgatactagaaatgcatagtcttactaacgtcagagaagttcagaagttgaatgcggtagcagatgataaaaaaggtagcgttgacactcataaccttggcacgacgtctcaagccgtatttccagagtcaccaagtgaagttggagtgaggaaacttaggtgctacagtgactcacaacttgtccagggacaagtggcaaacaaatgtcaagccaaggcggcagcaagaatcaaatactaccatgtcgtgaaaaccttggttgatgattttgattgtttcgagatgtatcacatgccaagggaaagcaacactaggaaagacttgctctccaagttggtaagcactaagaagactggacacctcaataccatcatccaagagacacttcaagcaccaaccataggcaccaaggaggtagaaaagttcacctggaaacatctcatacgcagatatggtgttccttatgccattgtcactgacaacgacactcaatttaaagctcaagcttatgaagaattcctatcaaggctaagtgtcaagcacctcgtgacttatgttgaacaccttcagaccaacggtcaggtggaggcagcaaacaaggttatccttaaagccttacgcacaggactcgacaagttaaagagtctatcgaaggaggaacttcctagcatactttgggcttatcattgttcacctcagacaacaatcaatgaaactccttgctgccttacatacggcacggatgccatgatccttgtcaaagtcagggaactgtcaacgaggaggttttttttctag

SEQ ID NO: 100652 - DNA, 396 bp, Glycine max
  Peptide Sequence Number=SeqID_217430
atgtttgcacattcgattaaaggctgccgtcccttgggacgggcgtgtggggtgctaataccttccccgtgcgtaaatacaactcccgaacctttcactaaaaaagttcgtagatctcgtcttttccggtttttccgacgttttcctcaaataaacgttggtggcgactccaggaatcatccaaatctgagatgggcaaatcctccacaacaacaacagcagcaacaacagcctgtccctctcttccagaatgctgctagtctaagcaggccatatgttcctcctccaatgcaacagcagcaacaacaacaaagacaacaagcaactgaggccccttctcaaccttccttagaggagttagtggggaaaatgaccatccagaatatgcaattttag

SEQ ID NO: 100653 - DNA, 171 bp, Glycine max
  Peptide Sequence Number=SeqID_217431
atgcctagtaaagctacgacgactgaaattatggctgaagaagtcgatggcttgaagataattgaagatatggtaacaaaagctatcaatgttgaagattttgctcctgaaaggagtaataaggaggtggaccctaccaacggggtgcaaagagtaacgcatggtcaatag

SEQ ID NO: 100654 - DNA, 525 bp, Glycine max
  Peptide Sequence Number=SeqID_217432
atggagtttgagaatagtaaggagagcaaggagagtagattgtatatggagaaattgctaaagaatggggggccaattccctttttccattttaatgggaggtgctttggtgaaccaaataaggaggtgcccctgccgccaatctccaaggaggacatggctaggtttcaggaggtgcctattacggatggaaagtttaatgattggtgcaaaccttggaaaaactccttcatgatcacaatgttagggaagcgagttttacccttggagtcatccttaagattgataggttacatcctttcaagcgagaacatgctttgcaagaatctgtgtggagatcgatttagactcattgttgcagccaaagattattctccatatagagcttgtaggccttggatcttctttatcaatggagtcctttacttcttaaagtttaatggtagcggaatggagaaggaagaaagatggttggagacgccacttcaaggagaggatgagtcaagaagaaactcaccaccatag

SEQ ID NO: 100655 - DNA, 324 bp, Glycine max
  Peptide Sequence Number=SeqID_217433
atcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaa

SEQ ID NO: 100656 - DNA, 192 bp, Glycine max
  Peptide Sequence Number=SeqID_217434
atggcatatcaacttgctacttcaagaaaaattacagtatctttgagaaagaagtggtacatagatagcggatgctcaaaacatatgactggagatgtatcaaattttacacacatatctccaaagaaaagcgggcatgtcttaagcatagcctgcttagcgttagtcaactatgtgacaaaggctatctag

SEQ ID NO: 100657 - DNA, 471 bp, Glycine max
  Peptide Sequence Number=SeqID_217435
atgaataatttcgctcctgtcgtgctgtttgtttataacagagcagaacatacaaaaaaaacacttgatgctttagctagtaataaatattcatctcagacagatttgattatttattcagatgcagctaagaatttgtcggcagaagagagcgtaagacaagtaagaaaggttattaggaaatattcttctcttttttcaaatgtcagcattgtagaacgtgatattaattgcggattagctaaaaatatcattgaaggggtaacacaagttgttaataagtatggtcaggttattgtacttgaagatgatattgttacttcgccttcatttctggagttcatgaattctgcattggacaaatataaaaactcagatcaggtcagctatcacgggcaacccttcagttcccttataaacttccactatcaagcatgttctcaaatgcatcaaggccaatgggaccactag

SEQ ID NO: 100658 - DNA, 278 bp, Glycine max
  Peptide Sequence Number=SeqID_217436
gttcaaagaagtatttacgaagtacaaagctaagacaagaaagaggacttcgagctattgggcaattcgaactggtgtatggacgagtcgaagtcgaggcagcaagagttctggacttagcgtaatttctgaacaaatcttcaccaaatcagttcgatctcgagtaatgtggataaccgttctaggaagcggttatgcaagggtcgcaaatcatttctacaaaatccttagatactcaaagtacccagcgcagagagaaacgagtacacaaggagaat

SEQ ID NO: 100659 - DNA, 468 bp, Glycine max
  Peptide Sequence Number=SeqID_217437
atggatatacttgactgtttcttatggtgtataaaaaagaagttcttcttctgcaccagggaacttcttaaaggaccactgtattatgccgcaactattactttggcagccataatatactggagaacttcacctatttccattgctgcaatatgtaatctgtgtgcaggagatggcatggctgacattgttggaaggcgacttggcggtgaaaagataccttacaacaaaaacaagtccttcgctggttcaattgcgatggccactgctgtatacttaacttccattgggtatatgtggtatttttcctcatttggatttattgagggaagctggaaattggttctaggttttctgttagtgtctattgtgacagcatttgtcgagtccctgcctatcagcacagagcttgatgacaacctcacagttcccctcacttccatattggtgggcagtatcattctttga

SEQ ID NO: 100660 - DNA, 876 bp, Glycine max
  Peptide Sequence Number=SeqID_217438
atgggcgcagggccaccttgttgcgcggcacggagccggggtgcgcaggatacgctccgcgctggggaccaggtggctgtcggacggaagctggcaggcaagggtttccgcagcgccgccgatgatggccaagggcgtgcgcagctcatggctggcatcgccgctgaagcattgctcgcgatgcaggaaccgttcgagctcatcactgtgccgggcgaaggcacgggcgagtacaccgatctcgtcgcgggcgtcctgacagggaaagggcttccgcccgctctgcacggcatcggccaactgcgtgatgggcgcgatgacgtgcgatgccaccctgcgaccgatcaggaaggcgccgagcacgcagatcgaaatgaccaccgcggcaaaggcattgatcaggtgttccaggtagccatagggtgcagcgtcctgcagcaggtagtagcgctggccgccactgtcgaacacacgcaggtgccactcgtcgggtcctgcttcgccgtggtagcccaggccgtactggcgcagcaccatcggcacgctatggctgtcgtacagctggctacccgggggcagggcggtgcgctcgccacgggccagtgctgcctgcagcttgtgcacggcactgtcctgggtccgggcgatgaccgcggccctgacctggtcgtagtccacctgttcggccaggacgatgaagcccatcgcgccggccatcagcagcacgaacgaaatcgtgatgcgggtacgcagggccaggcggcggtagagagcggcaggggtcacgccggcatgcgccagccgacgctgtgcaccgtggcgatcaacgtggtgtcgaagctgcggtccacctgcaggcgcagctcatggctgtgg

SEQ ID NO: 100661 - DNA, 348 bp, Glycine max
  Peptide Sequence Number=SeqID_217439
atgaaagatattgagctggtagaggaggaacaggcatggattggtgctgatccttctagtgggacctccaataaatctgagaattataaggaggaagcatggaagaaaacacagaagcataaaccaaagagggtggagagtgtcaacgctgatgcagaagcctttgctgaagcagtagaacatacgaacaaaagagatacaggccatcaaaatgtggcattggacaataagacaggagattcaactatgctgaagatgggagattcagctaaagttgtgatcaaacaagacatgaagggaagaaggcataaatatgggtttaacaacaatgaacgtgagaaggcatag

SEQ ID NO: 100662 - DNA, 534 bp, Glycine max
  Peptide Sequence Number=SeqID_217440
atggaagccaatgcggttacaattgctgctactagcgctgtttctaaggtgaactcgatgtccccatctgatctcaaccaaatgaatcattcaacctcagatatggtgggcaaagatttgggaagtacagacggccccatgatgtgcaaattcaaaacgagcatgccttcccgccatatggcttgcctcccaactatacaccacccaatgtggcgtacactcctaatgaggatgtcaataactccgctcccatactcattgaaagtcgacaacctcatcatatatgccattgaagggcaagcagttggtggtatacccctgcaaaacactttggagggccctcagttttgcccccaaccacaacctttgcattccacagcagaggaaaggctcagggccattgaaggaggcaaagattatgcctttgctaatctaaaagagttgttccaagtacccaatatcatcaccctcccaagttcaaggtgtcagactttgacaagtacaaggggactacttgccccaagaaccatctaa

SEQ ID NO: 100663 - DNA, 183 bp, Glycine max
  Peptide Sequence Number=SeqID_217441
gccagcgcagggcgaaacaccatagtagcctgggatggccggcaacgggcaacagacgcaccgccatcacctctagagttcacctctgctcatccacaaaaaggtttgagtattgcctacaccacatggctgaccaataggcgaccaagtccaaagccaaaggacgcacctagttgctcatga

SEQ ID NO: 100664 - DNA, 234 bp, Glycine max
  Peptide Sequence Number=SeqID_217442
atggactggtcatctgtgaagcttttagttgctttctttcttctgaccgatgtgaagcaacctccctactgggggaaccctctaacccactttcccctccccgtcagaggagtattgtacatttacctcaaagatatggatcggtcaaccgcagcaggggaagagaagcagatgggaaataataagctcgacttaaaggagaggaagaataagaagagcaagctagacgtgcag

SEQ ID NO: 100665 - DNA, 1108 bp, Glycine max
  Peptide Sequence Number=SeqID_217443
cgtcctcaactttagtgggctacacgccctagcctttagaggactacacgtcctcgccaccagaggactacacgtcctcgcctttagaggacttcatgtcctcaccttcagagggctacacgccttcgccttcagagggcagcacaccctcaccttcagagggctgcacgctctcgccttcaaagggcgacacgtcctcaactttagtaggctacacacccacgcctttagaggactacacgtcctcgccatcagaggactacatgtcctcgccttcagaggacttcacgtcctcaccttaagaaggcaacacaccttcgccttcgtaggactacatgtcctcacctttagagggctacacgtcctcactattagaggactacacgtcctcaccttcagaggacttcacgccctcaccttcagagggctactcgccatcacctttgtagggctgcatgccctaaacttaagaggactacacgtcctcgccatcagaggagggctgcacaccctcaacttcagaggattacacgccctcgccttcagaaggctgtacgccctcgcctttagagggctgcacgccctcgccttcaaagggcgacacgtcctcagctttagagggccacctgccctcgcctttagaggactacatgtcctcaactttagagggctacacgccctcacctttagagcactacacgtcctcacctccagagggctgcatgcccttacctttagaggactgcacctcctcaccttcagaggactgcccgtcctcacctttagaggactgcacgcccttgccttcaaagggcgacacatcctcaactttagtgggctacacgccctagcctttagaggactacacgtcttcgccactagaggacttcacatcctcaccttgagagggctacacgccttcgccttcagagggctgcacaccctcgccttcagagggctgcatgccctcaccttcaaagggcgacacatcctcaacattattgggctacacgcctatgccttcagaggactacacgtcctcgccatcacaggacttcatgtcctcaccttcagagggttgcacgccctcaccttcagaggactgcac

SEQ ID NO: 100666 - DNA, 426 bp, Glycine max
  Peptide Sequence Number=SeqID_217444
tctcgcaaacaaaccctttctcttctcccttacccgcaagacctgtcatcgccgtttgcgacctgtcaccaccgtctcctcctcaccatcgtcgctgctgaacagctccacgagttggggttcgtcactgccacgaggttgatcatccgttggagtttgacatcaatgcaagttgggcctattagggtgaagtggggagagagggcgctaatattagttgcttgtacacaacatggaatgggtggtgcggaggaggaggagagtttaattcttgcttttgctgttgcttttggttttggaaacaaagaaattaagacaaaccatacccatcctgcaacttcaattctaattcaagctttcacaagagcgtttttccaacttctgataccctttaaacgtgacttccttgtggcttctacttactga

SEQ ID NO: 100667 - DNA, 449 bp, Glycine max
  Peptide Sequence Number=SeqID_217445
gaaaaaaaggaaaagctcaagctgatggtgagattggatctaatggtgttgataagcatgtagaaggagatgatgagatgactgagggtatacatgagttcaaagaagcaatacttgaacattctatcctgaatgggagacaaattgtgtttagaccaaatgacagagtaagggccagggcaaagtgcaaccaaaaatttggtcatgtgattttttgcagcaaggttgggaggagtgaaatttacaagattaagacttgtagaccaaaacatcactgtggtaaggttttcaaaaacaagaatgcaagctctgagtgggtggctatgctttctgcagagaaactgaggtccaacaatgatattaaattgacacaaataatggatgatgtcatattcagatatggcattgccataagtttggttgttgcttggaaactggatgattgctag

SEQ ID NO: 100668 - DNA, 372 bp, Glycine max
  Peptide Sequence Number=SeqID_217446
atgaaaaaagtggaacacaaaagtaaccgcaggggaaatccaacaaaaagatctactgtaggtgatttgattcacactgatttggagattagcgccacctgtagaaagcgtaattcagagagaatcagaaatgttttgcaggatttagaagcagcaacaaccccagaagaagaacctcgatcttccgaggcatcttctagttttcctattgcagggcattctcatatagtacatgttgaagatacaatcatagctgaagagccaagaagagtaaccctcgaggattattcaagttctaatttgccacaacttttcaccagcattgctcaacctgcatatcaagcattaccaccacatatccaccctcattga

SEQ ID NO: 100669 - DNA, 126 bp, Glycine max
  Peptide Sequence Number=SeqID_217447
atggtggtgacgggtatgggcaccataacgaagggaaaaagacctctggaggatagtataaatgcaggggtggtggccaccatggagggaggtgggaagcatgggaggccacaagttggccagtaa

SEQ ID NO: 100670 - DNA, 474 bp, Glycine max
  Peptide Sequence Number=SeqID_217448
atgccaatctcccccagtgaaagtatcggttggtttgtgccgtcacgacataggggttgcgcccacaagacacccagtggacccggagaagtccaacagggccctggggttttcagctttggttacggacctctatcagtcctacagtcatgccatcacgacatagggatcgcgcccgcaggacaccttgtggacccaaagaagtccaacagggccctggggcttccagctctgattacgggcctttgtcagttctatggagtgttcgtcatccccaacaagatcatcaggcctcctactaaccgagctttcatcaagaagtattgcgcccccagacaggcagagggcaagacaccacaacaacctggggatggccagcaacaggcaacaaatgcatcgccgccacctcaagagcccttcagctcatccacaaaaaggttaaagtattgcctacgacacatggtcgaccaatag

SEQ ID NO: 100671 - DNA, 2967 bp, Glycine max
  Peptide Sequence Number=SeqID_217449
atgatttgctcagaatcaaagaaaattgatgagttgcgaagccctgaacctgataatcagcttgagaggcgaatgagaaagaagagggacgactatagtgatggtgacaagcatcaagataatgttgaagatggttatgatagacatttgtcttctagggatgacattgccaaggatggaaaaaagaaggatgataggcgaaaagaggagaaatatagagacaaatatagagaagaaataggcagggagaacaaacatcgacatgacaagcaacgtgatgagcgccctgctaaagatcatactaccattaggtctgatgataaacatgctagggaagaaaagaacagcctagagtcacggcaaaagagaaccaagcttccagagagtgacaaggaccataatcgcgatgcggatcgtgatttggaatctgttcgggatcgagaacgccacagtgaacgcgatcgtgattatgatattgacagggatcatgattatgacagagatcgagattgggactgggatcgagatcatgatcgtgatcgagacagggatcgtgaccgtcgccgtgatcgtgatgggtcacatgtggatgatagaagtggtagaggcaaagagagtggaacaaagaaaaggactttggatgatcgcgatgattatagtgactctaaatctagagctgttaagagctactatcttgattctgataagaggagtttgagcaccagcagagctgaatctgatgttgacagaggaagatctcaacctcaacaagctcatgcagattcatctggaactagcaataaacacagatcttctcctgcctcaaatacacacattggcaaagatgactatagaagcttaaatgcaaaagctgaagattcaaagtacagagacccttcagtagaacagagaaccaaaggctcaagggagggttactctgggacatcagatagaggttctaaatacaaattaatggaaaaacccattaaaatagatgaatttcctgctggagacttgtcaactgaaagatcttccagtgccaaggcttctcctggggccctgatggaaagatctccatcatcaacaagcattgagcgcaggtatgtgaatagaagtagtgttaagcggaatcttgaaattgacgaaagtggaaggaggaacagtactaatgtaagagatttctctgcttctgatgatagacttggcagggagtctactctagagaaaccgctcttggatgagccctctcaagcagattcatctttatatggtaggactaatcagagcaatgcaccattgatttcacctcctcctggtttcagggctaccttagatagaccttatatgggttctttagaggatgatgttagagataactctaattcacgatacagaagaagtagtgaacctggatttggaagaggacatggtggcaattcctggagggcagttccaaactggaattcaccagtaccaaatgggtatgttcccttcccacctgggccagctcatggaggttttcaaacaatggtgccacagtttacatctcaacctctctttggtgttaggcctcctatggaagttaaccatgctggcattccttatcatattgctgatgctgacagatttccaggtcatttgcgcccaccacttgggtggccaaatttgatggatggtacaggagctgctcatttgcatggatgggataacaataatggtgtcttcagagatgatcctcacatgtatggtggttctgattgggacaggaacaggcattcgactaatagtcatggatgggaatctggttcagagacttggaaagagcagagttgtgattcaaagaaggaattgccttcccctgcctacaaagatgaatcagttcctgccctggttgataatggtctgagtgatcagacaagtcaaatgtctcaggatgaacataaccgggatgaacttgctgagaaatctcctgaaagaaagttgtccagtctcacttctccagcagaagtaccattgaactcttcatcctcaactgttcttgaaaaggtgcctgatacttcgatgccaagtgacaatacttccctcttcagccgtttctacctttccaaacttgacatttcggtggacttagtactgccagagttgtatgaccagtgtatgtgtgctttgaatatggacaagaatgcttcagttgatgcagttgccagtacagaactattattgaagaatggatcaagaacacgacagaaatatgctgccaccttatcaaggcgttcaccttttccagaaattgataattctatcttccagagagccatagatctttacaagaagcacagggtgaacctgcctaacaagagggaggtagatgatactgtggtattccaccagatgcaagtggatgagtcatttcctgttcctaatttggagaatggccatgtttctgtctcagcatgcaatgggataaaagatgtgccaatgcctacattagaatcagacaaagtggaaactacatctcctgcaaaggagcaattggaagggatcaatcaaacctacatccaaatggagcaagatcatgacaaaactggcatgtctagcccatcttctagtcgtgtgaaccaagaagaaactgtagcaggtttgcaagagaaagagcccaaaatcacttatgataaggtgaattcaggggatgcagaagaggattactccttggcagctaaaaatgaagctcagttggcccatactttgcaccaagagggtgaaaacatagatagcgaagccaaaactactggttttgcccattgtgcagatgaaaagctgggttttggtgacacaaaggttaatcctaatcccttaattgttgaggatgggtctcccaaagcttgtgatgctttgatgcctggttcaaatgagtctgagtcgctaattttaagccggatacatcattctcctgaaagtacacattga

SEQ ID NO: 100672 - DNA, 927 bp, Glycine max
  Peptide Sequence Number=SeqID_217450
gtaacaactgaatttgaagaaagttgggttgttggaaaggtacagcgatgggaaaatgacaatcaggaaaatggacatgtacttgctgagcatgctcccattgatcttgattattatagtacaattgaagaattgatggaagtcggccctgaaaggttaaaggaggcactggctgcattggggcttaagactggtggtactgttcagcaacgcgcagagaggctcttcctcacaaagcacacacctcttgaaaagttggacaggaagcattttgctaagggtgcatgtggtgtagaaaagaatggggttgctgcagttccacaagaagatggaaattctaaagaaattgcattgatggaagccaaaatgacaaaactttgtcatttgttagaggagacaattgctcgaacaaaagacaatgttgtaaagaagcaagccctaacatatgaggaaatggaagcagaacgtgaggaggaagagacacaagaggactctgaaagcgaagatgaggagcagcagatatataatcccctaaaattaccaatgggatgggatgggaagcctataccttactggctgtataagctacatggtctgggtcaggaatttaagtgtgagatatgcgggaactacagttattgggggcgtcgggctttcgaacgacattttaaagaatggcgccatcaacatgggatgcggtgtcttggtataccaaatactaagaatttcaacgaaatcacatcaattgagagagtgctaaccagtgtcttaagagcactggaagcaaaggaactttggaagaagatacagcaaagacaaggagtgaacaagtggcgcccagatcttgaggaagagtatgaagacaaagaaggcaacatctataataagaagacatacactgacttacagcgccagggactgatatga

SEQ ID NO: 100673 - DNA, 246 bp, Glycine max
  Peptide Sequence Number=SeqID_217451
atgttacagaacggtgctatcaagggtcttgatgatgctccacagcctaaatcaaaggcttctgctaggtggattgtcgtcaagtgtaatagacaaagaggaagtactgagtgcggctactatgtgaagcactggatgtccaccatcattttaggaacttttaggaataattgggaagcgaccattggagccagagagattaaaagcattgcggatctagtgggcacaattttatctccgagttag

SEQ ID NO: 100674 - DNA, 252 bp, Glycine max
  Peptide Sequence Number=SeqID_217452
atgaagaatcaaggtgtaacagaggacagaatggtgtttttgaaaggtgttagtggtgcatttagacctggtgttctcacagccttgatgggtgtaagtggtgttggtaagaagaggaagtctacggcctcaaaccttattttctgtggggaaaatgaacttgaggatgtcaaatctttcacgagggatctactaaagaaaaggttgctaactaaacacaatgaaacacaggggaggtggaaggattcctaa

SEQ ID NO: 100675 - DNA, 465 bp, Glycine max
  Peptide Sequence Number=SeqID_217453
atgcagcatttggacgaggaaaaaattatcaatgttgtgagtcctgaaaaggatgtggatggctttcatcccttaaatattggaaatcttgcaataagaggaagaaagcccttctttgttccttgtgctcctaagggctgcattgagttgttacttagtcacggtgtggaaatcaaggggaaaagagcagtgataattggaagaagtaaaattgtggggttacccacttccttgctattgcagaggcaccacgcaacagtcagcgtgttacacgcgtatacgaagaacccagaacatataacttctgaagcagatattgtggtagtagtagatgttggagtccccaacatagttcgtggcaattggctaaagaaaggagttgtggtgattgacatgggaacaaatcaagttaagaacttggtgctctatccaaatgaattatcatgtttaaaaagcacaagatag

SEQ ID NO: 100676 - DNA, 252 bp, Glycine max
  Peptide Sequence Number=SeqID_217454
atggataaatcaaaaatagatatttggggagggcagaggttgacgtgcgagaaacacgtgggaaaacgtttcgagcattccctcgcacgcaactctcacacgcttggtttctatatgtacaacacgtgttctgcatctccatgctcttctcttctcttgctctttctccttctgaatagagaattatttgctcaattcaggcatgcgagggaaactgagggtagatacatgtttttaaattgcaaggtctga

SEQ ID NO: 100677 - DNA, 720 bp, Glycine max
  Peptide Sequence Number=SeqID_217455
atgaataatgagaaatggaggagagggcctcactctgggggtgggggtggggataatgagaaacggtttgttttgacggaaatgcccttgtttgtttggccttatgtcggtggtgtccctgtgcggcgcgggtttcgtgtgcttggttatcacagtggctgtaaattaggttacaaagcttggcctcttgtagtggaggttcgccagaggaggggtgatgctgacagactgttcgaggtgatagacaggtcaccagaagcggcatataggctcatccgaaatgatgaatccatggcccttagagttagtcgcactcccattagctgtaaggaggaaaacaaatccttggaaaatgacgctacaattgaaagcaatgccggtaaggatttgacaaaggagaaaacctttgattttcaatcggtgtcatccttttcttcttgtgaaggtttgccatatgctcctaaagggtggcctaatcatggtgatatatggggccggaaagtgggaagaaggacaaacaaggctggctattttcatgatagatacctttgtctttcaagatctcttcagagctcttctcgcaagacaaggagcttccaaagcaagcttgctgttaagtggtatattgaaccagattttcccaacatgaaaattgaagaattctttcctttatttagcaggaaggttcccacaaataagcgaactcgtacaaaaggttag

SEQ ID NO: 100678 - DNA, 984 bp, Glycine max
  Peptide Sequence Number=SeqID_217456
catggcgaagccggccgaaaagccgatgaacgagccgaaggtgccgacatacagccagcacatcagccagttgtgcttgcgcttgaagatcaccgcctggtcggcgaacgaggcgcgcgcatcggcgatgtcgttcatgccgaaccatgccgcgagcgaggccagcgcgatgggaacgacccagatgaagccggcgttctgcagccacaggctgcgctgtgcgtcgccggcggtaatcgtctgcggctcgccgccgagggcgccgaacacgcccatcgagatcaccaccggcaccacgaactgcaccagcgacacgcccaggttgccgatgccggcattaaggcccgtggccaggcctttcttgtccttgggaaagaagaagctgatgttggccatgctggagctgaagttgccgccgcccaggccgcacagcagcgccaggatcagcagcgtcgggaacgaggtggtcgggtcgcgcaacgcaaagcccatgcccagcgccgggatcagcagcgaggcggtcgagatcgcggtccacttgcggccgccgaacaccggcaccaggaacgaatagaagatgcgcagcgtggcgcccgacagggccggcagcgcggtcagccagaacatctggttcttggacagcatgaagccggcgcggtcgaggttgaccaccaccacgctccacagcatccagatgctgaacgccagcatcagcgcgggaatggaaatccacaggttgcggttggcgatgcgggcgccggtctgtttccagaagccggggcggcttggcgccgcgcggtggcggcgctttcgggccggaaactgaaatgcatgaagatgagcgagacgcagaccgtgccgtacagcagcatgaaggcgctggaacgcacgccggtcatgtccagcagcacgcctgaacaggatcggcaggatgaagtcgcccaggccgccggccaggccgacgatgcccgagatctgcgctga

SEQ ID NO: 100679 - DNA, 264 bp, Glycine max
  Peptide Sequence Number=SeqID_217457
atggtaggccatgaagaagggttagagatagtgagagcaagaaggatattggtgccactaagccttgaagaagtgtataatttttgcctagaaatgaagggtgaaggagaaggaggagtggagggtgtgggcggagattttgaagcaagcatagtacaaggggagaagaaaagagtaagaaagttgagtgttaaaagtagtattcctgtgtggttgattaatgggagtggactaacagaggaggatgccaagagttacctttga

SEQ ID NO: 100680 - DNA, 462 bp, Glycine max
  Peptide Sequence Number=SeqID_217458
atgtctacccttgaaaaccttcaaacacttcatctctctattaaccatttgaacttgtctttcattccaccatgtctaaccagcgtatcatcgttttcccgcgtttaccctctctaccttccaaacctgtcaacaaatatagttaattcaaacataccaaaatcccttacaaactcgactaatcttgttgttcatcttcactcaaaaagcataacaagtgatgcaagatccattggagcttgtaggcctaggatcttcttcatcaatggattcctttgcttcttggaagatgaatggcagcggaatggagaaaggaagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 100681 - DNA, 1512 bp, Glycine max
  Peptide Sequence Number=SeqID_217459
atggaaagcctgatccctgaatactctgtgtttgatcatatccgccagcccgccggcagcagcctgcccggcattgcgccaaccaatgcttatcgttgtaaagatggcaaatacgctctggtagccggaaatggcgactttatttttcagcgtttgatgcagattattgatcgcccggatctggccgccgatccggcactggcacacaatgacggacgtgtgaagcaggtcgaaatgctggacgcggcgattggagaatggaccagtcaacgcagcctgcaggaagtgctggcctcgttgaatgagggaggcattccggccggaaaaatctatgacgctgcagatattgctaatgatccgcattataaagcgcgcgacatgctgttaccggcgcagttatctgacggcacgccggttaccctgccgggtatcgttcctaaactgctgtctactcctggtagtgtcaggcatgcggcgccagaactgggtcagcacacggaagaggtgctgtctgagctggggggccgtatgactctccagcgacaatccccggccggccgcatttatatgcaggaagtctgcccacgtgatggcttacagaatgaggccgtttttgtagaaacgcaggacaagattgcgttaatcgatcgccttagtcagtgtggttttgtgaaggtggaagtcacgtcatttacctcgcctaaagccataccggctctgaaagatgctgaagccgtaatgcacgggatccgtcgaatgcccggcgtcgaatacagcgtgctggtgccgaaccagcgtggcgcggaacgtgccatggcctgccggattgatgaagccaatctggtcatgtctgcgagcgaaagccataacaatacgaatctgcgcatgagcagagaagcctctttctcgcagctgagccaggtggttcacgagctgagtaatacgcctgttgcgatcaacgtttctttgtcagcggcttttggttgcccgtttgaaggcgatgtaccgcaaaatacggtcctgaattttgtcgatcgcttcgccagcctcggcgttcgcggcgtgacgttatgtgataccacaggaatggctttcccgactcaggtcgcttcgctgagccgtatggtaaaacagcatttcccgcatttagagattaccttgcactttcatgatacccgcgggctcgcgctggctaacaccgttgcagcgctatctgaaggtattgaccgatttgattcatcaacaggtggcctgggtggatgcccctacgccccgggcgccagcggcaacgtctgtacagaagatatggtgcatatgcttgagctgatgggttatcagactaacgtcgatctgcctgctctcctcggtctatcacgtgaccttgagtcgcttatcgggcataaagttcacggcgcagttgtaaaatccggtcagcgttctgacttacatcaaatgccggcatcactggaacaaaattttaataactttaataaaacagggagtccaacatga

SEQ ID NO: 100682 - DNA, 844 bp, Glycine max
  Peptide Sequence Number=SeqID_217460
atggatattgtcaaacgcctccgccgcgtcggcctgccgcggctcatcgttcacgccagcgttctgatcgtcgtgctgctctggctcttgccaacgctcggcattctcgtgagttcgctgcgcgacaaggatcagatcacggtgtcgggctggtggaccgctttttcgagctccgaacaaacgcaagccgttcgtctggccgatgcctcggctcagaagcaggatggcagccgctacgtcatatcaggcaatgtcttcgaaaacggccagggcggaaaggttgcggccttcggcgtgcgcgtgcaggagccgacagctttcaaggcaggtgaagccgctgacatcggcgatggcgagacgctgcttatcaatgaagacggcacttacgaatatagcaaagccgcaagcttcgagggttcgcgcggcaagcgcgtctacatctctgtcgcaacgccgcccgtcttcaccctcgacaactaccgtacggttctaacatcggaaggcatcggccagtccttcgtcaactcgctgacggtcgccgtacctgcaaccgtcatccctatactcatcgccgcctttgccgcctatgccctgtcatggatgaacttttccggccgcaatctgctgatcgccatggtggtgggcctgatcgtcgtgcccttgcagatgtcgctgatcccgcttctgagactgtataatgaaattggcaccatcttcggcgtgccatccaagacctatgccggtatctggctggcgcacaccgccttcggcctgccgctcgccatctatctgctgcgcaactatatttcccggcctgccgaaagagatcatcgaaagcgcccgt

SEQ ID NO: 100683 - DNA, 775 bp, Glycine max
  Peptide Sequence Number=SeqID_217461
gcacacccgaactcgtacgctttggttctaagcacagaaaacgaaatatcaagcatgtactggggcaacaacccttcaatgctgctggtcaattgcctcttccgcatgggcggctctgcagccctcctatcaagccacctctccgaccgccagcgctcgaagtacgagctcttccacacgctccggacccacgttggtgccgacgacaacagctacaaatgtgtctttcaggaagaggacgatgagaacaaggtaggcgtgtctctatccaaagagctcatgaacgtcgcaagggatgccttgaaagtccacatcacctccctcggcccggtggtgctcccgatctctgagaaactcaagtttctggttaacctaatcgagaggaaggtattgaagacgaagatcgagtcctacatgccgaacttcaagcttgcgttcaagcatttttgtatccacacgggaggtagggctgtgttggatcgcatgcagaagagcctcgagcttgaggattggcacatggagccttctagaatgacactttacaggtttggcaacacgtcttctagctcggtctggtatgagttggcatattgtgaggccaaggggaggattaagaagggtgatagggtttggcaaatggcgttcgggtccgggttcaagtgtaacactgctgtgtgggttgctttgaatacgatcgaaccagggtccatcaagagtccgtggagggatgagatacataattttcctgtcaaggttgatccactccctgtgaaga

SEQ ID NO: 100684 - DNA, 619 bp, Glycine max
  Peptide Sequence Number=SeqID_217462
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctg

SEQ ID NO: 100685 - DNA, 339 bp, Glycine max
  Peptide Sequence Number=SeqID_217463
atgtatatggtttcattccatgtaagcgaagaactagttgtagaaagctcgatctttgaaattctaaaaatcaaaacaactttctacattacagttcagaggaattctatagtttgtgatggttgtggcatttcatcaaacataacgacacaaagattcacaaacccacagaaacagaacagacctaatgtgaagttagaggtagaagaacatggaagccgtgttgatgagagaaagaaagaggtctgtacaaagccgaatcccaatattcaacttcatagagatctaacagagtacaaagttttcaaaaaagccatgaacagaggttcaggcaactaa

SEQ ID NO: 100686 - DNA, 414 bp, Glycine max
  Peptide Sequence Number=SeqID_217464
atgcctttgagctggttattagagaacctaagaccaatagcttcaaataacccctctagaaaattgggctcacttggtggtatgttaaaatacacatctgttgaaacttattcagtccttcaagcaagctgccttcaacactggtttaaaaactggcaagcacttaggagaaacaaattgacagctagcacttttgctgctgctattgggttcatagcattggcagaggagatcaaggcaagatatgataaagcagctgtcaaagttgttgacctgattcttacacttctacaatttggaggatatacactagtgcaaaattcagttgatctgtatcgaagctttgggtttgatacacagccagtcctcattgggctcatcatatttcaggcttccagtgcattagacatttag

SEQ ID NO: 100687 - DNA, 174 bp, Glycine max
  Peptide Sequence Number=SeqID_217465
atggatgaatttgacatccttgtctctctcatcctctcacaaacacatctttgcttattcaacttccaccggaatgtgagtgttgggaaaacaaagatggatacctcagagccctacactagggcaatgaggggcatcgtgcatgaacctcaagtgaacctaggggcagattag

SEQ ID NO: 100688 - DNA, 186 bp, Glycine max
  Peptide Sequence Number=SeqID_217466
atggtggcacctccagactctactccttcagtagagcagattaatgagatggtagcctggcccgagacccaaccttctcttcacaaggaagatgcaggtcccacagcccaggatgagtcatctgaggccaccatcctagagccatttgttatacgagaagaggccgaggagacacaagtgagacag

SEQ ID NO: 100689 - DNA, 669 bp, Glycine max
  Peptide Sequence Number=SeqID_217467
atgcaacagattaatgggatgttgaatgaggctcaaaggaaaaaagtcactgagagcacatcaagccaaacatttgcaatggaaggaagtgtagctgtatcaaatgagaatagtcacctggagcaatctgagaatatggagcaagatgtaggtgaaatggaaaaagataaaggactgaacaaagcttttgacatggagaggaatggagaagggggaaacataaagaatgctaaagcaactaatgagacaagggaaatagagagtgacaaagatcttgcagctcaatcagccttcattcatgaagaatttattggaaaacagaaggtatctaaagaatctgttgctgaccaagatattggactgatgagaaccgaatgcaaagttggagaaaagaaattgaaagagataggggtggaaaatcaacaggctaatgaaaaaatcagagcacctgaaatgactgcaggagatgcagagcattcaggaacccagacagaaaaggagggagacacagtgacaaaggctgattacagaggcacagaagcagctggacctgctgcagtacaagagactgtaaatgtccagaaaactgcccagtggttccatgttggtcaatccacagaaagcaaagcaaagagctcccccaagaagaagaagaagcagaagaactaa

SEQ ID NO: 100690 - DNA, 294 bp, Glycine max
  Peptide Sequence Number=SeqID_217468
atgggtcacgaagatgaggaggaagatgatgatagcaacaataccaacaataacgatgatgatgacgatgatgatgatcatgttcctcaacaacaacacacaattacatgtgatcatcctaggacaagaggagatagaggtcatagaacaagaggacaaaaatcacctgcaaatccagagcaacaacaagatgagatacctcgacgcatatctagaagaattcgttgggaaggtgatcatgatgatgaggtctttgggataaaggtggttgttacttgcttattcatgatggag

SEQ ID NO: 100691 - DNA, 423 bp, Glycine max
  Peptide Sequence Number=SeqID_217469
atgtcatatccctatttcatcaaattgcaccttatcaaatctgctgcgaaggacgatttggaacaccttcaactgatgaaaaatgtctgcctcggatccatccctgaaatccacatggaatcgtgtgatatgaggaagtttggagatgacaagtcttggattcaattaataaattttagttatttacatcttaatattcgtccttatgaagaaaaatccatgattttaccattgtgcatgtctaacaacggagacttcttcatgctgaaattcactagaaatgctaatgatgaataccaaacaattctgtataaccagggggatggtaagtctcaagtttctgtcattccctcagatagtttcagaacgttgttgtggcgcaacctcaagatttttaccaaaagtttggtcataccttattga

SEQ ID NO: 100692 - DNA, 957 bp, Glycine max
  Peptide Sequence Number=SeqID_217470
atgaataattcgccaggacagcgctcgcgattgagcgaagagaaccgattgctgatcattttgtttttcgttttcggctgcgtgttcgtcgatcgtctgaccatctcttttctgtttccgatgattgccgccgatttgaagctgagcaacgtgcatcttggcacgctgtcggcggtgctggcattgacctgggcgctatctggcgcggggctgggggcgattgccgatcgctttaatatccgcaaaccgatgctgatcctgtcgatcctggtgttttcgctgttctccgcgctgtcggggctggtcagcggctttgccatgttattgatcttccgcgggctgatggggatcgccgaagggccggtgctgccgatcgcgcaatcgctgatggtggaaaaatcgcagccgcagcgccgcggcttcaatatggggctgatccagggggcggcgccgggattgttgggcggtattatcgcgccgccgctgatcatctatctggcgcagaagtggggctggagcatggcgtttcacctgaccgccgtgccgggcatcattctggcgtggctgatctatcgttatgtgaacggcaagaaggatcccgctttcagcgccgcgccggcggccgacaaggcggcgaacaaaggcgcttacggcgagctgtttaaaatcaagaacgtagcgctgtgcattctgatctcctgcgtgttcgtcacctggttcatgatcatcattaccttcacccccaactttttggtgaccgaccgtggcttcagcgagggcacgatgggcggcatcatgagcgccatcggcgccgcctgggtgttttggggcgtggcggtgccggcgatttccgatcgccttggccgcaagccgacgctgatcttcttttcgctgctggcggtgtgctgcccgctgttcctcagctacgtcgataacccgtggctgctgggcgtgctg

SEQ ID NO: 100693 - DNA, 882 bp, Glycine max
  Peptide Sequence Number=SeqID_217471
atggctgatattttgattgcgggtgtaaggatagacggcgtaaatgcccaatactttgccgcagtggccggccaagatctcggtcagcttgccgtcctgcaaatcttcatacaccatgcagcgcggcaccatggcgataccgtggccgccgatcaccgctttgcggatcgctcgcgcattgttggccgacaggttgccgttaacctgcagctcgtagatttcgttgcgtcccggtcgtttcatcagccagttggcggtgccgctctcctggtaggtgtaggtcaggcagttgtggccaagcaggtcttcggcgctacgcggttccgggtggctttccaggtaccccggcgagcagacgatcacccagcgggaatcgaagatcggccgggcaatcaggctcgaatccggcatggtgccggtgcggatcgccagatcgataccttcttccaccagatcgacaaagcggttttccagccgcatctcgaccttcaggctggggtgcagagcgcaaaattccgccacgctctcgctcagcagcagctcgccggaaatggtcggcaccgacatgcgaatggtgccggtcaactcttcgctcttttcgctgacggcgtacagcgcctcctgcactttggcgccgatctctttggcctgctggtagagcgcctggccgctttcggtcagcgtcaggctgcgggtggtgcggtacaacagccgggcacccagcgatttttccagccgcccgatgcgtttactgatcaccgagctggtgatgccggcgctctctgcggccttgctgaacgagccgcagtcgacaatcagggcgaacagaatcaggtcgttggcgtattcgtgagtggcgagcatgggcatcctgtagagtga

SEQ ID NO: 100694 - DNA, 288 bp, Glycine max
  Peptide Sequence Number=SeqID_217472
atggatgaaaacacaatttatggggctccgaaaaaaagtagagaatggaaaattgcactaagcaatcactacgcatggctccaaactcgtgggtggaggacgcatgaacgaaaacgcaattcatggggctccgaaaaaaggggtagagaatggagaattgcactaagcaatcactacgcatggctcgaaactcgtgggtggaggatgcatgaacgaaaacgcaattcatggggctccgaaaaaaggggtagagaatggagaattgcactaagcaatcactacgcatga

SEQ ID NO: 100695 - DNA, 219 bp, Glycine max
  Peptide Sequence Number=SeqID_217473
atgtgtctatcggggaaggagatgcgtggcgagaaagtcgctaacgcacaggattttgtcggcaatcaaagggagagggccactttgggtcgtggattttggctcaaggcttgtagaacggctggtcatgatacatgtcaggatttggccagcggttcggggataaaggggatgttcccacattattcccatgatacacatgcaacaaatgatgattag

SEQ ID NO: 100696 - DNA, 276 bp, Glycine max
  Peptide Sequence Number=SeqID_217474
atgggtgatttagcctctcattgtcatgagagggttactaatacaaaaagaaagcaagagccagcatgtgctcgcgaagcgcacatgcaaagtccatctgacataagtgaatgtgcgttaagccgcaaggtttcatggctggattcacatttggatttcatgtgggatttcacaatgaggtttgttgtgagttggggctcattggattttgcaacggtggtggcagtggagatcacagtcgttgggttttatgaccggttgagattgagatcatag

SEQ ID NO: 100697 - DNA, 396 bp, Glycine max
  Peptide Sequence Number=SeqID_217475
atggaacatcaaagaatactgggaaaggtaactgagtcagaggaagtgaagagaaggttaggaggtgaaagtgtggtgacagagaaaaagtaccaagagatgtatgtgaatagtccggggaaaggtgtggttgataagtttaaaggtatggttgggacatggtttaccaacccagcagagaatcaatcttcacaagtttttcgattttcttatcttggaagaagtgttttgagaaacaaacgaaattatgattatcaaagtgccacattaattttgaatttgtggtttgcatgggccgaagattcatctatgaattatgaggcaggaagggcagaagtggaacaagttaaccaaggtgcagcaggtgaaagaaggcagcaggagtcatctaattga

SEQ ID NO: 100698 - DNA, 528 bp, Glycine max
  Peptide Sequence Number=SeqID_217476
atggcatattttgttgggagagttgaaagaaggcactacgaggataccatggctgaacagagagccttatgcttactggaaaggattggtttcgagaatcacaagaggggttcagcaaatcagacttgccaagtcaatgcacttatagatataaggtgtacattgaaggttctgcttggtcagtcagtcaaaaatacattctgtcatgtgactctaccactctacgtgtacgactacatgtttcatctcctgaattcatatgctaaactcttcagatacaaaccctccataagtgctaatgctacagaactatgtgtggagtcaatggtttgtggagcagaaggatcagtaaagaaatttatgatggaatcattggtcaaggttcctgcaaataccgacccttgcaccatgcctgccccttttgaccctccaactttgtatgcaacattacagagaaaggaaagctcaattcaacaagttgaatcatgggagaaaagttgttgggataatcaaaccataacatcttaa

SEQ ID NO: 100699 - DNA, 5937 bp, Glycine max
  Peptide Sequence Number=SeqID_217477
atgaagtttaagaataatctgaatgatccttcaaataggctttggtcttggaatcataataataccaactgttgccactggtatggagtcctctgccacaaccttacttcccatcttctccagcttcacctccacacttctgattctgctttctatcatgatgcctaccattatcgattctaccatagattcgatgaggaagcttataggagatggagctttggtggagagataagtccttgtttggctgatttaaagcatttgaattacttggacttgagcgccaatgcatttcttggagaaggtatgtcaattccttctttccttgggacaatgacttccttgactcacctcaacctctcttatactggattctatgggaagattcctcctcagattgggaatctctcaaatttggtgtatcttgacctgagttatgttgttgccaacggaacagtaccctctcagatcgggaatctctctaagcttcgatatcttgacttgagctacaattattttgaaggtatgacaattccttctttcctttgtgcaatgacctccttgactcacctcgacctctcttatactccattcatggggaagattccatctcagattggaaatctctccaatttggtctatcttggcctcggaagttatgatttcgagcctctgttacctgaaaatgtagaatgggtatcaattattcccctgcctttgacttctcttgttgaacttgatttatcaaataatcaacttgaaggaaccattcgaacttctttgggaaatttgacttgtcttgttgaacttgatttatcagctaatcaacttgaaggaaccattccaacttctttgggaaatttgacttctcttgttaaacttcaattatcacgtaatcaacttgaaggaaccattccaacttctttgggaaatttgacttctctggttagacttgatttgtcatataatcaacttgaaggaacaattccaacttctttggctaatctctgcaacttaatggagattgatttctcatatctcaaactcaaccaacaggttaatgaacttttagaaattctagctccttgtatttcccatggactcacagcacttgcagttcagagttcacgactttcaggcaatctgacagatcatattggggcatttaaaaatattgacacgttacttttttccaacaactcaattggtggtgctcttcctagatcatttggaaaactttcatcattaacatatctcgatctgtctattaataaattcagtggaaatccatttgaaagtcttagatcgctttctaagatgtcatctcttcagattgatggcaataattttcaaggagttgtcaaggaagatgatcttgcaaatcttacaagtttgatggagtttcatgcatcagggaacaatttcactttaaaagttggtcccaaatggcttcctaattttcagctttcctatttggatgtgacatcatggcagttaggtcccaactttccatcatggattcagtcacaaaaccaacttcaacactttggactgtctaacacggggattttagattctattcccacctggttctgggaagcactttctcaggacgagccaatgcaattaaaaattttgaatcttgcatcaaataatttgtcaggagagatacctgattgctggatgaattggacatttcttgcggattctttacaaattcgtaacaacacactctcaggaatatttccaaccagtttgaagaagaataaaaaattgatatccttggaccttggggaaaataatctttcaggaagtattccaacatgggttggagaaaagctcttaaatgtgaaaattctccgccttcgatcaaacagttttgccggcctcatttcaaatgaaatatgtcagatgagtcttcttcaggttttagacgttgcacaaaacaatctgtctggcaatataccgagctgtttcagtaacttgagtgccatgacactaaagaaccaaagtacagatcctcgtatctattctcaagcacaatataatatgtcttccatgtatagtatagttagtgtgctactatggctgaaaggaagaggagatgagtatcgaaacattctgggtttggtaacaagcattgatctgtcaagtaacaaattattaggagaaatacctagagaaatcacagatctaaatggattgaactttttgaacttgtcccacaaccaattgattggtcctattggtaatatgggattgttacagtccattgatttttcgaggaatcaactttctggtgaaatccctccaaccatttctaatttgagctttctgagcatgctagacttgtcttataatcatttgaagggaaaaattccaacaggaactcaattgcaaacctttgatgcctccagcattatcggcaacaatctatgtggtccaccactgcccataaactgcagctccaatgggaaaactcatagttatgaaggaagtcatgggcatggagtgaattggttttttgttagtgcgacaattggatttgttgtgggattctggatagtgattgctcctttgctgatttgtagatcgtggcgtgagcgtgagacacttttgaagtttaagaataatctcatagatccttccaataggctttggtcttggaatcataataataccaactgttgccactggtatggagtcctctgccacaaccttacttcccatcttcttcagcttcacctcagctcttcagattatgctttctacgatgaggaagcttatcggagatggagctttggtggagagataagtccttgtttggctgatttaaagcatttgaattacttggacttgagcggcaatgattttgaaggtatgtcaattccttctttccttgggacaatgacttccttgactcacctcaacctctctgatagtggattccatgggaagattcctcctcagattggaaatctctcaaatttggtgtatcttgacctgagttctgttgttgacgacggaacagtaccctctcagatcgggaatctctctaagcttcgatatcttgacttgagcgacaattattttgaaggtatggcaattccttcttttctttgtgcaatgacctccttgactcacctcgacctctcttctggattcatggggaagattccatctcagattgggaatctctccaatttggtctatcttggccttggaggtagttatgatctgttagctgaaaatgtagaatgggtatcaagtatgtggaagcttgaatatcttcatttgagtaaagcaaacctatccaaagcatttcattggctacacactctccaatctcttccttctttgacccacctatatttgtcagactgcacactccctcactataatgaaccatccttgctcaacttctcatctctgcaaactctccatctttaccgtactagttattcccctgccatttcttttgtccccaagtggatattcaaattgaagaaacttgtttctcttcaattacagagtaatgaaattcaaggttcgattcctggtggtattcgaaacctcacacttcttcaaaatcttgacttgtctggaaattcattctcatcttctatacctgattgcttatacggtcttcatcgtctcatgtatctggacctaagttacaacaacttgcttgggactatttctgatgccctgggaaatttgacttctcttgttgaacttgatttatcacggaatcaacttgaaggaactattccaacttctttgggaaatttgacttctcttgttgaactttatttatcaaataatcaacttgaaggaaccattccaccttctttaggaaatttgacttctctgattagacttgatttgtcatatagtcaacttgaaggaaacattccaacttctttgggaaatttgacttctcttgttgaacttgatttatcatatagtcaacttgaaggaaacattccaacttctttgggtaatgtctgcaacttaagggtgatacgtttatcatatctcaaactcaaccaacaggttaatgaacttttagaaattcttgctccttgtatttcccatggactcacaagacttgcagttcagagttcacaactttcaggcaatctgacagatcatattggggcatttgaaaatattgtgctgctagatttttccaacaactcaattggtggtgctcttcctagatcatttggaaaactttcatcattaagatttctcaatctgtctattaataaattcagtggaaatccatttgaaagtcttggatcactctctaaattgtcatctctttatattgatggcaatctttttcatggagttgtcaaggaagatgatcttgcaaatcttacaagcttgacggagtttggagcatcagggaacaatttcactttaaaagtgggtcccaattggcgtcctaattttcggctttcctatttggatgtgacatcatggcagttaagtcccaactttccatcgtggattcagtcacaaaacaaacttcaatatgttggactgtctaacacggggattttagattctattcccacctggttctgggaaacaccttctcagattttgtatttaaacctctcttataatcatatccatggtgagattgagactacattaaagaatccaatatctatccaaactattgatctaagctcaaatcacttgtgtggtaaattaccctatctttcaagtgatgtgtttcagttagatctttcaagcaattcattctctgaatccatgaatgactttttatgtaagcatcaggacgggccagtgcaattagaatttctgaatcttgcatcaaataatttgtcaggagagatacctgattgctggatgaattggacatctcttgtgtatgtaaatttacaaagcaaccattttgttgggaacttaccccaatccatgggttccttggcagacctgcagtcgttacaaattcgtaacaacacactctcaggaatatttccaaccagtttgaagaagaataaccaattgatatccttggaccttggggaaaataatctttcaggaagtattccaacatgggttggagaaaagctcttaaatgtgaaaatcctcctccttcgatcaaacagttttaccggccacattccaaatgaaatatgtcagatgagtcttcttcaggttttagaccttgcacaaaacaatttgtctggcaatataccgagctgtttcagtaacttgagtgccatgacactaaagaaccaaagtacagatcctcatatctattctcaagcacaacttgttatgctttacacttcctggtatagcatagttagtgtgctactatggctgaaaggaagaggagatgagtatagaaacattctgggtttggtaacaagcattgatctatcaagtaacaaattattaggagaaatacctaaaaaaatcacaaatctaaatggattgaactttttgaacttgtcccacaaccaattgattggtcatattccacaaggcattggtaatatgggatcattacaatccattgatttttctaggaatcaactttctggtgaaatccctccaaccatttcaaatttgagctttttgagcatgctagacgtgtcttataatcatttgaagggaaaaattccaacaggaactcaattgcaaacctttgatgcctccagctttattggcaacaatctatgtggcccaccactgcccataaactgctggtccaatgggaaaactcatagttatgaaggaagtgatgggcatggagtgaattggttttttgttggtgcgacaattggatttgttgtgggattctggatagtgattgctcctttactgatttgtagatcatggaggtcgatccgattccctggtggtattcgaaacctcacacttctttaa

SEQ ID NO: 100700 - DNA, 1446 bp, Glycine max
  Peptide Sequence Number=SeqID_217478
atggatggactttgtggagtgtccaaagggttcaagatgaacaaatggaaaacctctagatggacttatgggttagagacaataatatcgctggactttgtggagtgtccaaaggttcaagatgaaaaaatgaaaaaccttgagacggccatgctttggttgttgagcttaccatgcagagagagtgtgtgcatcccaagtgagcgtgagacacttttgaagtttaagaataatctcaatgatccttcaaataggctttggtcttggaatcataataataccaactgttgccactggtatggagtcctctgccacaacgtcacttcccatcttcttcagcttcacctcaacactacgttttctgctgctttctatgatggctactatcacttcgatgaggaagcttatgagaaatcccagtttggtggagagataagtccttgtttggctgatttaaagcatttgaatcacttgaacttgagcggcaattatttccttggagcaggtatggcaattccttctttccttgggacaatgacttccttgactcacctcgacctctctcttactggattcatggggaagattccatctcagatagggaatctctccaatttggtctatcttgacctcggaggttattctgtcgagcctatgttagctgaaaatgtagaatgggtatcaagtatgtggaagcttgaatatcttcatttgagttatgcaaacctatccaaagcatttcattggctacacactctccaatctcttccttctttgacccacctagatttgtcaggatgcacactccctcactataatgaaccatccttgctcaacttctcatctctgcaaactctccatctttccttcactagtttttcccctgccatttcttttgtccccaagtggatattcaaattgaaaaaacttgtttctcttcaattatggggtaatgaaatccaaggtccgattcctggcggtattcgaaacctcacacttcttcaaaatcttgacttgtctggaaattcattctcatcttctatacctgattgcttatatggtcttcatcgtctcaagttcctcaacctaagggacaaccacttgcatgggactatttctgatgccctgggaaatttgacttctcttgttgaacttgatttatcaggtaatcaacttgaaggaaacattccaacttctgtgggtaatctctgcaacttaagggacattgatttctcaaatctcaaactcaaccaacaggttaatgaacttttagaaattcttgctccttgtatttcccatggactcacaagacttgcagttcagagttcacgactttcaggccatctgacagatcatattggggcatttaaaaatattgacacgttacttttttccaacaactcaattggtggtgctcttcctagatcatttggaaaactttcataa

SEQ ID NO: 100701 - DNA, 1806 bp, Glycine max
  Peptide Sequence Number=SeqID_217479
atggaacaattccatctcagattgggaatctcgacaatttgctctatcttcgccttggagggtaatgaaattcaaggtccgattcctggtggtattcgaaacctcacacttcttcaaaatcttgacttgtctggaaattcattttcatcttttatacctaattgcttatgcggtcttcatcgtctcaagttcctgaacctaatggacaacaacttacatgggactatttctgatgccctgcgaaatttgacttctcttgttgaactttatttgtcatataatcaacttgaaggaacaattccgacttttttgggaaatctccgcaactcaagggagatagatttaacatttctcgatctctctattaataaattcagtggaaatccatttgaaagtcttggatcactctctaaattgtcagttcttcatattgatggcaataattttcaaggagttgtcaacgaagatgatcttgcaaatcttacaagcttgaaggagtttattgcatcagggaacaatttcactttaaaagtgggtcctaattggattcctaattttcaacttacctatttggatgtgacatcatggcagataggtcccaactttccatcgtggattcaatcacaaaacaaacttcaatatattggactgtctaacacggggattttagattctattcccacttggttctgggaaccacactctcaggttttgcatttaaacctctctcataatcatatccatgtggaagtgaatttacaaagcaaccattttgttgggaacttccccccatccatgggttccttggctgagctgcagtcattagaaattcgtaacaacttgctctcaggaatatttcctaccagtttgaagaagactggccaattgatatccttggatcttggagaaaataatctttcaggatgtattccaacatgggttggagaaaaactctcaaatatgaaaatcctctgccttcggtcaaacagttttcccggtcacattccaaatgaaatatgtcagatgagtcttcttcaggttttagaccttgcaaaaaatagtttgtctggcaatatacccagctgtttccgtaacttgagtgccatgacactagtgaaccggagtccatatccccaaatctattctcatgcaccaaataatacagaatactcttcggtatcaggtatagttagtgtgctactatggctaaaaggaagaggagatgagtatggaaacattctgggtttggtaacaagtattgatctgtcaagtaacaaattattaggagaaattcctagagaaatcacagatctaaatggattgtactttttgaacttgtcccacaaccaattgattggtcctattccagaaggtattggtaatatgggatcgttacaaaccattgatttttcgaggaatcaactttctgatgaaatccctccaaccatttctaatttgagctttttgagcatgttagacgtgtcttataatcatttgaagggaaaaattccaacaggaactcaattgcaaacctttgatgccttcagatttattggcaacaatctatgtggtccatcactgcccataaactgcagctccaatgggaaaactcatagttatgaaggaagtcatgggcatggagtgaattggttttttgttagtgccacaattggatttgttgtgggactttggatagtgattgctcctttgctgatttgtagatcatggcggcatgcctattttcatttccttgatcatgtgtggttcaaacttcaatctttttcctcgtatagtatcactgtttag

SEQ ID NO: 100702 - DNA, 805 bp, Glycine max
  Peptide Sequence Number=SeqID_217480
atgaattcctcctccatttatattcttgtctttctccacctttggttgttcagcttaccacgcagagagagtgtgtgcatcccaagtgagcgtgagacacttttgaagtttaagaataatctgaatgatccttcaaataggctttggtcttggaatcataataattccaactgttgccactggtatggagtcctctgccacaaccttacttcccatcttcttcagcttcacctcaacacttcacgttctgctttcgagtatgactactataatggattctaccgtagattcgatgaggaagcttatcggagatggagctttggtggagagataagtccttgtttggctgatttaaagcatttgaattacttggacttgagcgccaatagatttcttggagaaggtatgtcaattccttctttccttgggacaatgacttccttgactcacctcaacctctctcatactggattcatggggaagattcctcctcagatcgggaatctctcaaatttggtgtatcttgacctgagttctgtttctgccaacggaacagtaccctctcagatcgggaatctctctaagcttcgatatcttgacttgagcgacaattattttgaaggtatggcaattccttctttcctttgtgcaatgacctccttgactcacctccacctctcttatactcgattccatgggaagattccatctcagattgggaatctctccaatttgctctatcttggccttggaggtcattctgttgtcgaacctctgttagctgaaaatgtagaatgggtatcaa

SEQ ID NO: 100703 - DNA, 4164 bp, Glycine max
  Peptide Sequence Number=SeqID_217481
atgaagttagatgttcctcgatttgatggaacggacccgttaggttggatctttaagatcaaccaatacttcgaatatcatggcacaccggagtatgatcgactcacgattgcctccttctacatggagggccgtgccctggcctggtttcagtggatgaccagtaatggtcacttcacttcgtggccgatgtttctacaggcgcttcagacacgattcgcgtcgtcgcagtacgaggaccccacggggctcatcagcctctcacgatctctcaggcagctggcctcgctcgcctccaggaagaaaagcttcgcgaccaacgccccaccacactaccgccacgacctcgaccccctcctccacctcccacacattcctctcgatttactcctttaccccccccccctttcccctacgttatcccctttaccccctccctctccacgaccccctcaattacccaccacctttaaacgcctatctccggatgaaatggcctctcgacgtgagaagggcctttgctttagttgcgatgagaagtaccatagaggccatcgctgcgcctctaaggttttcttcttcatcgcggacgaggaggaaccccctgacccgcctcatataaccctaccttcttctgacccggataataacccatccgatagcccacccacccattcagaaacatacccgacccaattaagcttaaattccttggcgggacacctggcacctgaaacgctgcgttttgtggctacaatcgccgaacacgccgtggccctcctcgtggacggcggcagtacgcataattttattcaacagcagctggtcaccctcttgggtctctctccgacaaccacgactcctttacgcatgaaggtcggtaatggtcagcaattggactgcgactcagtctgccaagacgtacccatttccattcacgacacggtcttcgttgttgacttgcatgtccttccaatctcaggagctaatgttgtgcttggggtacagtggctcaaatctttaggccccgtcctcaccgattacaataccttggcaatgcagttcttctacaatcacaaactggtccaattacaaggggatattgatgcttccatgaaccccctgtctccatcccaatttcgtcgtctctatcgcaaacaaggtcctgggttttattatcatattaccatgcttcctcagtcaccacccgagttgactgagcacattcctgatgcatttcgacccttgctcttgaagtatgaagccttatttcagcctccacagaccttaccccccccccctcgtgccactgatcaccatatccacctcttacctcaagcaaccccagttaatgtgaggccttaccggtaccctcactaccaaaagcacgagattgagacccaggtagacgccatgctccaacaaggcttaattcaacccagtactagcccgttttcatcccctgttttgttggtaaagaaacacaatagatcatggcggttttgtgtggactacagggccctgaatgccctcacgattcgtgatcgttttccgatacccaccattgatgagcttcttgatgagttgggtggtgcatgctgtttctcgaaactcgatcttcttcagggataccatcgaattcgaatgcaccctgatgacatccctaagacaacttttcggacacatcacgggcattatgaattcaaagttatgccgtttgggctctgcaacgccccatcctcttttcaggcgaccatgaacatgttattccggccatatctctgtcagttcatcatcgttttcttcaatgatattctgatttacagcagctctctcgaagatcatttgcttcatcttgatattgcttttcaggtactcctcgacaaccattttgttctgaaaatttctaaatgcttctttggtcaatctcaggttgagtacttgggacacttagtttcccataaaggtgtcgaacctctggctacgaaagtcactgccattatccactggccttcacctcgatcaactaaggctctccgcagttttttgggccttgcgggcttttaccggagattcattaaagggtatgcaacaatagcagccccattggttaaagccactacaattgctctggtgctggctttgccggattttaaattgcctttcacggtggagaccgacgcttcgggggtgggcatgggggcagttctatcccagcaaggccaccccattgccttctacagcaagccatttagtgagaagctgcttcgttcatccacttatgttagggagttgttcgcgattactgcggccgtgaaaaaatggcgccaatacttcttgggccatcatttcaccatcatcacagatcatcggagcctcaaggagctcctcacccaggttattcagactccagaacagcatttataccttgtaagacttatggggtacgattacgagatacagtatcgctccggcagccacaatccggcagctgatgccctttctcgtttaccagaacacgggccctctgtttcattattgctttcggtcactggccctcacttcttgactgagctccaccatcagtttgaagctgattccacttatcgccaacgccgagatgacattcgtaattccccagaatctcaccctgacttatccatttctggtgctctgatcctgtatcgtggccgcatttggctccctcacaattttccattgatccccaccctgctcactgagtttcatgctacccccactgggggtcatgccggcatcgccaagactctagctcgtgtttcagagaacttttattgggaaggacttcgtgccgacgtcacccaattcgtgaacaagtgtgtggactgccagtacacaaagtacgaaacaaagaaaccagctggtttgctctgcccgttaccggcgccccatcgtccttgggaggatctctccctggacttcattgtcgggcttccacccttccatggcaacacagtcatcttggtcgctgtggatcgcttctccaaaggaatccacttgggcatgcttccccaacatcactctgcctattcggttgctgttctgttcattaacatcgtcgtcaagcttcacggggtacctcggagtttagtctctgatcgcgatccgttatttgtcagccaattttggagggaactcttcgaattaagtggcactcacctccgtatgagctctgcctatcacccgcagagcgatggccaaaccgaggtcctcaatcgtgttattgagcagtacctccgcgtgtttgttcatcatcggccacgatcatggggaaggctgcttccgtgggcagagtggtcccacaatacttcgtgggttgcagccactggcaccactccttatgagctgacctttggaagaaaacctcccaattttcctaattacctgcagggttcatcttccattgctgccgtagatgagttgctaactgaccgtgaggaaacttttcgtgctattcgtaagaaattactaaaggcacaggccttcataaaagcctatgctgacactaaacgacgagaggtgacctatgctattgatgattgggtcttactccggcttcgcccttatcgtcaactatcagcccgggattctcaggctacttccggcaaattggccaaacggttttatggcccttttaaggttctcgaaaagattggtggggctgcatatcgtttacaactcccagagggcaccaagatccacccaatttttcactgttccttactcaagccatttcgaggtgttcctgatgatgttaagatagccactctaccagctacatttattgatgatcaaccactcatcaccccaacagctattcttgactactgcaagtcctccactaatcccgccaattgggaagtcttggttcaatgggatggtctttctctcgacgacacatcttgggaggattgggaccagctttgtcaacaatatcaccttgagggcaaggtgattctccaagggccacggggtgatagagaagcagatcataacacacaagcaggagcagatattcacgaagaggtgcaaacagcaacagagaaacaggacacaggggtgctagtaggaaacaagcccaagagaagaatagctaagcctacatacctcaaagactacgtttga

SEQ ID NO: 100704 - DNA, 132 bp, Glycine max
  Peptide Sequence Number=SeqID_217482
atggtgaggatcaacgagagcaccagttgttacaagcagaaatgtaaacctggtttcgaggaccaggatattacaggatcagagtttgttatgcttgtctcctactactcgacaagttccaagcaaggctaa

SEQ ID NO: 100705 - DNA, 363 bp, Glycine max
  Peptide Sequence Number=SeqID_217483
atgggatcattacagtccattgatttttctaggaatcaactttctggtgaaatccctccaaccatttcaaattcgagctttttgagcatgctagacttgtcatataatcatttgaagggaaaaattccaacaagaaaacaattgcaaacctttgatgcctccagctttattggcaacaatctatgtggtccaccactgcccataaactgcagctccaatgggaaaactcatagttatgaaggaagtgatgagcatggagtgaattggttgtttgtcagtgcggcaattggatttattgtgggattctggatagtgattgctcctttgctgatttgtagatcatggcggttgatcaatttgtag

SEQ ID NO: 100706 - DNA, 714 bp, Glycine max
  Peptide Sequence Number=SeqID_217484
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgtgacatgatcaagtcggttcatgacaacaatggtcgtggtcgtgcggcatacgtggtagattcttgcttggaccagtggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 100707 - DNA, 690 bp, Glycine max
  Peptide Sequence Number=SeqID_217485
atgaagcacttcactgacaccctcatcagtgccaacataggaacaaaagctggtaccgggccccccctcgaggtcgacggtatcgataagcttgatgttgattatggagacgacttttcaccgtccgagttcaccgatgaactcattccaaaacttgatgatactcaacaacctatagaggagattcccctactgctggtgcaattaacaaggttccatagtggtggtgattgtgaaggccttgccattggagttactttcgctcatcctttgattgatgccaccggcctcattcacttcatcaatagttgggcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 100708 - DNA, 171 bp, Glycine max
  Peptide Sequence Number=SeqID_217486
atgcatcaccaaaagacaaaaactctagatgaggcttcactgttatcaagtgagtgggagacccagcatgaccacagatcgacctccactccttatggttcacatagacctagggtgttgcccttgctcctacgtatcctcaagtgcgatgaggagttcagacctatgtag

SEQ ID NO: 100709 - DNA, 198 bp, Glycine max
  Peptide Sequence Number=SeqID_217487
gggttggacctgaatcaggaaggtgaggcccaaacggattcttcggagtctaggccttggggtgagagtgaccgagtatacccattgtgtggtgtgctttgtcatgtactcctaagcgcctcagtgttgtttttcactgacatggtgagccttcatatgatgagtcacatgctagagatggagagacttagtctgtga

SEQ ID NO: 100710 - DNA, 369 bp, Glycine max
  Peptide Sequence Number=SeqID_217488
atgacagcgcagtgggtgatgtacggaattaagaattgcgacaccataaaaaaagcacgcaactatttgagcacttccggcatcgactttcattttcatgattatcgcgctgacgggctggatgcggcgctgctgcaatcctttatcgaccagctggggtatgacgtgctgctgaacacgcgcggcaccacctggcgtcagttgccggaagcggaacgcgatgccatccgcgatgcggccagcgccaaagcgctgatgctggcgcacccggcgctgatcaaacgtccggtgctggcggcaccagacggtacattgctggtgggtttcaaagaacccgtttatcacgcctttatccaggagaagtcataa

SEQ ID NO: 100711 - DNA, 237 bp, Glycine max
  Peptide Sequence Number=SeqID_217489
aaaatagaagaaaatgatggcacatcagcgaggacgtgttgtcctctgaaggtgagggcgtctagccctacgaaggcgaaggcgaggacgtgttgtcctctaaaggcgaggacgtgtactcctctgaaggtgaggacatgtagtcctcggaaggtgaggacgtgtagccctacgaaggcgagggcgtgtagccctctgaagacgacagtactggtacccaagggtccacccttatga

SEQ ID NO: 100712 - DNA, 213 bp, Glycine max
  Peptide Sequence Number=SeqID_217490
atgatgctctcggcaaattcaaacgggcataacttttgtgtcgaatgtgtgatgatgccgattatatatcaagatgctcaaaatgaacaacagaagctcgcgaaaaattcacatggctataacttttcactcggatgtacgattctcgtgcatcatatatcgagtcccccgaaattgaacacagaagctctcggaaaattcaaacagccataa

SEQ ID NO: 100713 - DNA, 123 bp, Glycine max
  Peptide Sequence Number=SeqID_217491
atgatgaacgcgctaagcgtgccagctgcgcttagtcgcatgttcatccttctgatgagtttcaatgaagagctcactaagcgcatctacgcgctaagcgagagtagtgtttcagacacttag

SEQ ID NO: 100714 - DNA, 855 bp, Glycine max
  Peptide Sequence Number=SeqID_217492
atgtcggcctgcatttttagcaccatccacaacgtgccctatgctaatgatgttgttcgcgtgagtgtggtggaagttattttcggtgatgcggagattccaatccctacatcagaaataaagtttgtcaaagaagctttaggtagttttgttccatggccaacagatttggtcaaacccatcttgcctgaggaagcagagaaggatgtgagctcaccattgaagactgttgaggaggaaaaggcagctgaggttattgatccattgggagagttggtgaagaacttgttcgacatttaccaaaggcctgttgaggtgtcatgggatggtgctaaatttgggatcaataatgtcaaagatggcttcttcatcacacacgctgatgtgagcgagataatattaggagacaagtgtttaaacatctccattctacagctatggcttatgtttattcatgattggagtgcgagcattggttatggaccattgtatgggttccttgaacctcagtatatccacaatgcaagcagtagacatcaagagtgtgaaaattacattggaaggtggttgaaggaagcaggaaaacaaatttacatagcaccttatttaaaccaggcccattggcagctcgttgtattgtgcccaggcgacaatgtagtggtttggttttgttctttgaagaagaagccggatgctgccatcaagggtgcagtaaacagtgcaatgaaatcagtcaccaaaactgcagagggaaagccacctcagcatgggcctcagtggattgaagcaaagagtcatgttcaaataggaaattacgagtgtggatactatgttatgcaatggatatggtgcatc

SEQ ID NO: 100715 - DNA, 177 bp, Glycine max
  Peptide Sequence Number=SeqID_217493
atggcttttattccaagaggatacaacaaaatgaagcctagtaaggtttcctatcaaaacataaagcagaaaatgaagttcggcaatcaaggattgcctgtacttacaaatgagtttcactaccctgttagagaagctgttaatgacaaattcaattgtctcattgataatatttga

SEQ ID NO: 100716 - DNA, 626 bp, Glycine max
  Peptide Sequence Number=SeqID_217494
atggcaatctccaactcccaaaactctgtttccttcgacttagacttgacatcctcctggctcaaccaaactagctcctgctcccagcgccctcgttgtccaccatcaccagctacaaaccaacccctagagaatctccctcttacaaacccacccaccaagaagccacgtggcaggcccgcaggctccaagaacaagcccaagaccacccctttcctggtggcccaacctatggaaccctacatgaaggtcatcattgtccatgtgaccccaagcagcgatatcattgagtccattcttgatgttgctcagcgaggccacgttagcctcactgtccttagtgcctctggaacgatcaccggagtaaccctcaacaacttttcgcatggtgttgatgccctcacacttcgcgggcccttcaccttgctctccctcaatggctcatacttatacaacaaccactacacccttcaccctggagccacccctgcccctcccttatcctttgggataagcttttccacctctcaagggcaagtctttggcggtgccattggcggtagagtcattgccggtaatgatgtcagccttacaatttgcaccttcaagaaccctgtgatgcataa

SEQ ID NO: 100717 - DNA, 165 bp, Glycine max
  Peptide Sequence Number=SeqID_217495
atggctaagacaagtaaaaatagcattgttttaaattgcaaatgcgattattggccattaatttgtggtttcagttttgtcgtgatccttaaacgagtagaaaaattgtggacaaatgcgactgatatagttgcaattgtagccatagaaacgtcaaaaacctaa

SEQ ID NO: 100718 - DNA, 222 bp, Glycine max
  Peptide Sequence Number=SeqID_217496
atggcaaggtccttgttcatgatcaacaccaatagtccagatgttgttccacatagaccagtttcttcttcccatgtaacaacaatgtcacttgaaaagacacggttcaatgatgatggtggtgcttgcaagggactagacaggactgagtgtgtggttaaaacaacaatggttgctcatacggattatgtttacacacaagacattaataatgggccttga

SEQ ID NO: 100719 - DNA, 249 bp, Glycine max
  Peptide Sequence Number=SeqID_217497
atgacagtggtggtagtaagtgtggtgggggtgggggttgtggcgatgggatgtggtagtgatggtaacgacaacaacaacgatggaatggtgatggtgacaacaatgtcaatggtgtggcgatggaggtggaatgatgatagtggtggtggcaacaatgacaatggtagaagtgatactagtgataatagtggtagcgacaacaataatgacaatgtggtggtagtgtgggtgataatgacagtctga

SEQ ID NO: 100720 - DNA, 1235 bp, Glycine max
  Peptide Sequence Number=SeqID_217498
aaaaatcgcggccagctgctggtcacgccgcgcggtgaggttgagccgatgctggatttgccttgggagatcaccccggaacgtatcaccatcagcgacgggcgctggaacgcggtttatgccggctatccgcttagcgggcgggtggcgctatcggttggcgactggcaaaaaggcaccgaagagatggaaatcagcggccggctcaatgtgttaacgcacggtgaagcgggtaaggggaacgccgtgctgaacattggcccaggtaagctaagcatggatcacagcgacatgccgctcagcctgaccggcgaagccaagctcgacgatatgattttttacgccgtgctgcccgccaaactcagtgggccgctaacgacgccggagctggcttttcatcccggcgcgctgctgcgctcgcgcgggcgggtgattgactcgctgaatatcgatgagatccgcctgccgttggcgggagtgaaagtgactcagcagggggtggatggccgcctgcaggcgatactgcgcgcccacgaacaggaaatgggcgatttcatcctgcacctggatgggcaggccgacaactttatgcccgaccgcggtcgctggtcgtggcgatactggggagatggtcactttacgccgatgcaggcgcgctgggatgcatggtggccgaaacaggcgctaagcgtattccagccgctgattccgccggactggaaaatgaccctgcgtgaaggtgatatgtatgcgcaggtggcgttctccgcggcagccgggcagggctttgaggccgggggccatggcgtcttaaaaggcggtagcgcctggatgccggacaaccagatcaacggcgtcgactttgttctgccattccgtttcagcggcgggagctggcagctcggtacccgccgtccggtttcactgcgtattggcgaaatcgtcaaccagttcaccgccaaaaacctgagtgccgatctccagggaacatggccctggagcgagcaggatccgctggaattgagcaacgttaatgttgatatccttggcggcaagctgtccatgcagcagctaagaatgccgcagcatcaaccggcgctgctgcgtctgcagaatatctccagcagtgagttgataagcgccatcaaagtaaaacaatttgcggtctctggcgcgtttaacggcgcgttaccgttatggctgaacaacgataaatggatcattaagacggctgg

SEQ ID NO: 100721 - DNA, 174 bp, Glycine max
  Peptide Sequence Number=SeqID_217499
atggctacggatagaatgcagctacagaatatgtgtaagagggagcataaatctttcaagcaatacgcccaaagctggagcgatctagcagttcaagtagtgccctcaatgatgcagagggagatgataacaatgatggtggacacgttaccagtgttctactgtgagaagatg

SEQ ID NO: 100722 - DNA, 198 bp, Glycine max
  Peptide Sequence Number=SeqID_217500
atggcctctgtggagacctctgccatagctaggtcccagatcgtaccgcatgaagaaatgcatatgacacagatgcattttacgaatatgggagcccgggaaattgtccccttcttagatacaacattcgggcagcatggcgcccgacatatgcatttaagaaggcgacacgaaccctccgtcggtttgacaaagtga

SEQ ID NO: 100723 - DNA, 639 bp, Glycine max
  Peptide Sequence Number=SeqID_217501
atggttacttctgtgtctgattcacaatctattataagagtcaaagttgatatgctgcgtctattttttagagattctgatagtcatgatgattcgtacatcgaaagctacataagcaccattggagttgattttaaaatacgtaccgttgagcaagatggaaagaccattaaactacagatctgggacacagctgggcaagaacgatttaggacaatcaccagtagctactaccgtggtgcccatgggatcattattgtttatgatgtgacagatgaagagagcttcaataatgtgaagcagtggctcagtgaaattgatcgctatgcaagtgataatgttaacaagcttttggttggcaacaagtgtgatctggaagcaaatagagcagtgtcatatgaaacagctaaggcatttgcagatggaataggcataccttttatggaaacaagtgcaaaagatgctacaaatgtcgaacaggctttcatggcaatgactgcttcaatcaaggatagaatggcaagccaacctgcaaataatgcaaggcctccaacagtgcagatcaggggtcagccagttgcacagaaagaacagctagaccaatctcttggcatagacacgctttccacctttggctga

SEQ ID NO: 100724 - DNA, 348 bp, Glycine max
  Peptide Sequence Number=SeqID_217502
atgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcaggcaggcttatatttcttagttttcaatag

SEQ ID NO: 100725 - DNA, 372 bp, Glycine max
  Peptide Sequence Number=SeqID_217503
atgtttagcagtggaggacctgttgcaatagatgatagaccgaggccggttggaaatgagggaagttttggaaggcctaagcctttggtggtatatttcaccagagacgtagctccccaaacgcctcgatacccctcggtagttaaacctattccgtttccataccaaaacaaccacgcagctccgtggaggtatgcgcctccaagcgaaaggaaggaagaagtcaccgacatcagctcgttgtcggccaagataaccaatatcacggggctgagggaggaagaagtcatcgactcacagatagcggtcgtgtgttcgcaccccctgacctaccgacacaacccgcaaacgttaaagggaaggcaaaaataa

SEQ ID NO: 100726 - DNA, 1059 bp, Glycine max
  Peptide Sequence Number=SeqID_217504
atggagggagatcatagtgcttcatcttttactagtgctgtgagtcttgacaagcttggagtgtcttctatacctcaacgttatgttcttccaccatcacaacgtcctagccctcatgttcccatgatctccaccactcttcccattatagatttgtctactttgtgggatcaatctgttatatctagaacgatcgatgaaattggaattgcctgcaaggagattggttgctttcaggttattaaccatgaaattgatcaatcagtaatggatgaagccctagaagtcgcaacagagttcttcaacctccctaatgatgaaaagatgcgtttattttctcaagatgttcacaaacctgtaaggtatggaacaagtcttaaccaagctagggatgaagtttactgctggagagatttcatcaaacactactcttatccaatatcggattggattcacatgtggccttcaaatccatcgaattacagggagaagatgggaaagtacgtaaaagcagtgcaagttctacaaaatcaactattggaaatcatttttgaaagcctagggttaaaccgtagttacctacatgaagaaatcaatggaggctcacagacactcgccgtgaactgctaccctgcatgtccacaacctggactcaccttaggtatccaccctcactccgattacgggtccataacggtgctgctccaaacccgttccggcctagaaatcaaggacaaaaacaacaactgggtacctgtgccctttgttgaaggtgcacttgtggtgcagttgggtgaccaaatggaagttatgagcaatggacagtacaagagtgtcattcaccgcgcaacggttaacggggatgacaagaggttttccattgtgagccttcacagttttgcaatggacagaaagatgggtccagcacttgaacttgttaatgaccagcaccccaaatcctacaaagaattctgctttagggaatttctggacttcatatccggcaatgatatcacaaagggtaggtttcttgacactttgaagatgaagaaactctag

SEQ ID NO: 100727 - DNA, 655 bp, Glycine max
  Peptide Sequence Number=SeqID_217505
atgtatattctttatctaaaagcaagaaagaaaagagtccaggctaaagataaggcacaatctgaagaagtgttttccctatggagccatgatggaagaaatatgttcgaaaatatcattgaagctaccaacaatttcaatgatgagcttctcattggagtcggaggacaaggatccgtttacaaggttgagttgcgtccatctcaggtttatgcggtgaagaaacttcatttgcaaccagatgaagagaagcccaattttaaagcttttaaaaatgaaattcaagctttgaccgaaatcaggcaccgtaacattatcaagctctgtggattttgctcacatccacggttctcacttttggtttataagttcttggaaggaggtagcttggatcaaatactaagcaatgacgcaaaagcagctgcatttgactggaaaatgagggtgaatgttgttaaaggtgtggccaatgctttatcctatatgcatcatgattgctcacctccaataattcatcgtgatatatcgagcaagaatgttcttttggattcacaaaatgaagcacttatctctgattttgggacagctaagattctaaagcctggttcacacacttggaccacgtttgcatacaccattgggtatgcagctccag

SEQ ID NO: 100728 - DNA, 672 bp, Glycine max
  misc_feature (72)..(72): n is a, c, g, or t
  Peptide Sequence Number=SeqID_217506
gacctacctcatttgaggatttaagaacagttgataatgttcagtatcctacatatagagaagcatgtttgnctatggggtttttgcaagatgataaagaattcattgaggcaatcaaagaagcaaaagactggggctcagcacattatataagaaagctatttgtgttgttacttttaactgcaacaatgaacaaacctaaacaagtttgggaccaaacttggcattggatggctgatgacattgtctataattatagaaaatcatcagcaagtccaacattacagcttgatgataggactcttcaaaatctggtcttgcttgaaattgaacaactgttgcaagcaaatcaaagatcgcttaaagactatccttcaatgccatatccagaagatattgttgaagctgttaataaagatgaaggtgatatgttttctctctatggatatggaggtagaactgcacattcaaaattcaaaattccagttccagtttttgaagactcaacttgcaatatccataaaggaactcaattagctgaactattaaatcaaacgagtctgatcatttgggatgaagcacccatggctcacaaattatgttttgaggcacttgatcacaaccttagagatatcatcaaacacaactcaaaggacaataaaatctttggag

SEQ ID NO: 100729 - DNA, 1188 bp, Glycine max
  Peptide Sequence Number=SeqID_217507
atggagaaaatgatgaacatgccccagttgcaatcatcatccttatcgtcgtcgccaccattgtcgaagaaagttgggaagagatggaaagagtaccaaggaatgaacaattgggacggtttattggacccattggacgagaaccttcgcgctgagattctccgctatggccatttcgttgaggctgcgtataagtccttcgaattcgacccttcttctccaaactacgccacatgcaagttccaaaagaacacactcttcgaacagtgtgggttacgcaacacaggttacaaggtaacaaaacacctacgtgcaacctcggggatcaaattacctagctgggtagcaacacaatcgagctacgttgggtacgtagcagtgtgtaacgacaaagaagagatcaaacgattgggtcgaagagacattgttgttgcctttagaggaacggcaacgtgtttagaatggctcgagaatcttcgagccactttgacacatgtttctgttccatctgttgcaacagggatcacagcagaaccatgcagcatggatggaaatggagcaatggtggaaagtgggttcttgagtttgtacacgtcagcaggtagtagcaaacaatcatttacgagtttgcaagatatggtgaggaaagagattggtcggattcttaaaacttacgaaggagagaatttgagtttgacgataacggggcatagtttgggagcggcattggccactctcacggcatatgacataaagaacagtttcattcggcagccgccggtaacggtgatctcctttggcggtccacgggttgggaaccgaagcttccggcggcagctggaggaaactgggatcaagctgttgcgcatagtgaactccgatgatgttataaccaaggtgcccgggtttgtgttcgatgacgtggacaaaactgacgatgatgtggcatgcaatggaggtgcccacgtggttcagaggtggattcgaaagcgagcggaagaggtacagtggctattgtactctgaggttggaaaggagctacgcctctgtagcagggattctccgtacctcaggggtgtcaacattgccacctgccacgatttgaacacctacttgcaccttgttgacggctttgtcagttccacttgtccctttagagccactgccaagagattccttcagcattga

SEQ ID NO: 100730 - DNA, 126 bp, Glycine max
  Peptide Sequence Number=SeqID_217508
atgacaccacctaaactactaaaccttcaatccctcatcaggctgaatatccaagcttcgttcgcagatccctcatgtaagactacacccgatttagacagccctcttaggtttagactaacttaa

SEQ ID NO: 100731 - DNA, 1215 bp, Glycine max
  Peptide Sequence Number=SeqID_217509
atgggaaaagtgatggatcaggcactgggcccggcatttgcacaacagcatgacggtaagtatgaaggtcagggccagggggcttacggcatggcgcgcctgctggcgagcaaaaaaatcaccgctgacgtgttcgtgtctgttactcccggtccgatgcagatcctgaaaaccgccggactgatcgacaacgcagtaccggtagccagcaccagcatggtgatcgcctataacccaaaagggccgtttgcgccgcagtttgccgcagccaaaggcaatgatggccgctggcttcagctgctggcagcgccgggactgaaatttggccggaccgatccggtaaacgatcctaaaggccagaacattatttttaccctgctactggcgcagaaatattaccggcagcccggcatcgctgacaacattctcggcggttaccagaatcccgcacaaacccatctggagggtggcttgctgacgcggctcgagagcggtcaggtggatgcggcagcaggctatgaaagcgaagtgatctctgcccatctgccttacatcgcgctgcccgatgaaatcaacctcagcaatccggcgatggcgactaagtggtacaacacggtcagctttagcgtcaaagacagccagggtaaagataaaatgctgcacacccagccactggtctattacgcggcggtgctcaggaatgcgccgcacgtccgtcaggacaggcgctgtttaaacagcaaggctatgccgcgccgaagggcgatgggctttacaccccatgaaaatccgccatgctggcgcgctgtggctgtcgctgcccgccctggtgctgctggccgtaccgtttatcaccctgacgggcgtcacacactggcaacacctgcggctggctctgggcgcgatcgcgctggtgctgatctttctgaccggcttaccgctggcctggtggctgtcgcaggcgcggggaaaaatgcgctggctggtggaaacgctggtgatgatcccgctgctgacgccgccgctggcgatgggaatcctgctggtcagcgcgtacggtccgtacagtttgcccggccagctgctgagcaagctgggctggacgctggtgaacaatcccgccgcctttattctggcgcagtggtatggcgcgctgccctactttgtcaccagcgcacgctcggcgtttatcgcggtgccgccggagatccttga

SEQ ID NO: 100732 - DNA, 288 bp, Glycine max
  Peptide Sequence Number=SeqID_217510
atggcggcctgcgccggtaaactcaatccgccggcggcagtcattaacagcagggtcatcaaccaaaccatcgctgagatggtggatgaacagcaaacgctggacgtgctgagcctgcgcaggcgcttaagggaaatggcggagaacgaaactaacgaggagatggtgctgtgttactggcaggccagcaaagtgctgacgcgtttgccgcccaccgtcactgccagccagctgatagaagaggcgcgccatgcgttccgcagtccgcccagtcacgattcgctttaa

SEQ ID NO: 100733 - DNA, 498 bp, Glycine max
  Peptide Sequence Number=SeqID_217511
atgtacacatgtaacaaacacacatacaacaacgcaaccatgatcaactacacatttgagaaattgaccagcctgagccggaggaagaggcttgctagggagctgagccggcttgatctgctgagccggcgccttcttgggagcggcggtggcagccgcagcagcagccgccgccttgagttgctcggcggcgatgagctgagaagggtcctcagcgtcgtcacccaacaaatcaaaagggttcgtggttgccatctctcagaattatttgttttcccaactccaaaacgacaccgtacgtttccaaacacaaggcctcaactaacccttgctactaaacacggaacgtctccatcagagatcaaagagaagaagaaggttgaaggaatggagaggctgaaagtgaaaaacccaaaccctagccgcaataggagagagaaggagagtgagtgtgtgagagaacagacagggcaacctaatcttgaacaacgtctctaa

SEQ ID NO: 100734 - DNA, 321 bp, Glycine max
  Peptide Sequence Number=SeqID_217512
atggttgttggtgtatctggtggtgcaatgattggtgcggatgatgctggatttgtggggaaaactatgtttgttgggaaggataactgtgctttttattgtcagaacaataggaacatccttgcaaggaagaatggaagcagcaagagtggctcgtttgatgatagcatgaacaaaatgagcttttttagttcaaagggtcaaaataatgaaattttcaacttgacttttgttcaagtagacatcaattaccactttggagttgctgaaagtgctcaaaatcctatggtctatgatgaaaattcgaatatgagttggtga

SEQ ID NO: 100735 - DNA, 504 bp, Glycine max
  Peptide Sequence Number=SeqID_217513
atgtcggggatctatctcggcataatctaccacaaactaactatctgccctcaggccaaacctatatcgcagaagaaaaagaagatgggagaagagtggcgtaaagtcgtcaaagaagaagttgacaagctccttcttgccaacttcatcagagaggtcaggttttctacctggcttgccaacgtcgtcatggtaaaaaaggcaaatgggaaatggagaatgtgcaccgactacactcatctgaacagggtgtgccccaaagacgcataccctctgcccagcatcgacaggttggtcgacggagtgtccggataccaggtgctaagcttcttggacgcctactccagatacaatcatatcagaatgcatcctccagacaaggagaaaatggagaaaatgacattcatcactgaagaagctaaattttgctacaaggtcatgccattcggcctaaaaaacataggcaccatataccaaggactaatggatcgagtcttcaaatag

SEQ ID NO: 100736 - DNA, 135 bp, Glycine max
  Peptide Sequence Number=SeqID_217514
atggctggaagaaaaattgggggcaagggttttcgagagaaagaggggttgcagggatgtgttgtaatcgattacacaaatatggtaatcgattaccagagagcaacattgccagaaataactgcttgtaattga

SEQ ID NO: 100737 - DNA, 312 bp, Glycine max
  Peptide Sequence Number=SeqID_217515
atggaaaaatccgacaagatgaatttcaaagagaagaaagaaaataaaggacacatcacttgggaagataatgtcataaattattcaagtgattcagagaagaaaattataagtctgtgtatcattatgaaagactatgaaaacgaagaagagcaaagtcaatacattgatagcaatttctccaaacacatggcatgcattaaagtggttgtcatcatcaaaaagggggagaatgtaaatcatgaagattttgatgatgtcaaaaagattaagccttggataatgcttgtcatcatcaaaaagggggagaat

SEQ ID NO: 100738 - DNA, 279 bp, Glycine max
  Peptide Sequence Number=SeqID_217516
atgcaatggcggttccaaagtcagaaaagatgcaaagacaagatgaaactaacaagaaacaagcgtagaaccatggttacctcgaaagaaaacaaaagctgcagaccaaatttcgagaagatccaacggttaatgaagtctgggcgacatttttaccgaggcagctcatgtagcttcctcaagaagcttcctcaagaagcttcattaagaggcttcctcaagaagcttcctcgtggcttctttgagaagctttctcaagagtcttctttgagaagctag

SEQ ID NO: 100739 - DNA, 237 bp, Glycine max
  Peptide Sequence Number=SeqID_217517
atgtcggtggtgacgagtgagagggtgagggtgagggtgagggtgagggtgagggtgggtagtgtggttgtgtgtgaaggaatgaatgaagcagagagagagggctcatgcattgtgactgaaattggagaagtgagaatctacatagctgcttcaataacgcctatagttaccgaagaaaacatcattgagagcatacttctcaaatgtagtctggtcattgatccggcaaggtaa

SEQ ID NO: 100740 - DNA, 359 bp, Glycine max
  Peptide Sequence Number=SeqID_217518
atgactcggagcttggtgagtcggtcgagttggggagggatggggccggtgactattccgggggagaggatgagctgagtcaactcgcgagtgggagggaggtggtgccgagggagaggatggtgacgcgggagaggaagcacgtgacgccggagaaggaggagcagggatcaggtgcggtgaggttccacgtggagaagaatgacttcgtgggtgagacttcggtgagggtgttcttgatggagagaagagctttgagtggacattgtttatgttcaattgagttgtttttgagagaaagttatggtgcagaaggtgaggagagtgtgacagacaaagacgcagttaatgaaacttga

SEQ ID NO: 100741 - DNA, 408 bp, Glycine max
  Peptide Sequence Number=SeqID_217519
atgagatcagatcattggagatcatgtgctcttgtgtttgaaatagaacccaaaaccatagaagaatctcttatagatgatgacttgatcatttccatggaagaagagcttcaccagtttaataggaacaacatctggactcttgtttccaaacctaaaaaaaagagcatgattggaataagatgggtactcagaaataaactagatgaacaaggaaaggtggtaagaaacaaagctaggttagtagctcaaggctataaacaacaagaaggtattgatttcactgaaacctttgctcctgttgctagatttgaagctataagaatcatgcttgcctttgttgctcataaaaacataaagcttttccaaatggaagtcaaaggtgctttttttgaatggctttattga

SEQ ID NO: 100742 - DNA, 288 bp, Glycine max
  Peptide Sequence Number=SeqID_217520
atgcatcaccaaaagagaaaaactctagatgaggctccattgtcatcaagcgagtcggagacccagcatgaccacagattgacctccactccttatggctcacatagacccgggtccctagtggagtcgccaagtgttgcaacctacccttcggcagaagggcgaggcgagataaaagtgcttcttctcatgaagaaaatgtgtggagtcgtcaccaacgtttattcgaggaaaacgttagaaaaatcaaaaagacaaaagtctgcggattttgaaaatgagggttag

SEQ ID NO: 100743 - DNA, 453 bp, Glycine max
  Peptide Sequence Number=SeqID_217521
atgatggaggttgtgattgttgcaattgctgctacacttgtaaatcttctgatgggatgggatagttcaactattgcagttatcgggtatgacagagccttaggatatagttgcctactggagttcatggcctgggatctttggagttcgtcctatgcccaaggtttctctgagtcacattcctttccgaagagccccagaggactcactagaataagtataatcggcactgttgtgacaattttctctgggacatggtttggtaatgttgttattgttctgttagcgaggataattgatggggttgtcattgctcttgctgttactcttactcctctctacatatctgaggtagtgccggctgacatcaggggccaattgaacacttattctcagaaccttgggccgctacaagcaacaggagttagagtgtggataatatttaatatttaa

SEQ ID NO: 100744 - DNA, 1512 bp, Glycine max
  Peptide Sequence Number=SeqID_217522
atggaggaaaagatgcttatgcagagagcaaaagtggattggataaggaaaggtgatgggaataactcctttttccatgctattataaaaagcagaaataatagaagaaatatatacatgctgcagaaaactgatggaaccttgcttgaaaaccagtctgagatagaggatgagatcatggatttctacaagaaactcatggggactgaggatagccagctgcaccatattgacatagatgctatgagaaatggaaaacaagttaatatggagcaaagaagatatcttgtgagcaatatcactgagcaggatattgagagagcccttaaagggataggtgatgataaaagcccagggattgatggttttggggctaagttttttaaggccagctggtgcatagtaaaagaggatgttatagcagctattctggaatttttcaacataggaagattgtatagaggctttaataatatagtggtaactttaatccctaaaggtgataatgctaggtatgtgaaagattatcatcccatagttggctgcacaattgtgtataaaatcattgccaaaatcataactgagagattagggaaaattctgcctagcatcattagtcatagccaggctgcctttgtgcctgggcagaatattcacaaccatatccttttagcttatgagctcctcaatgggtatggcaggaaaggtggaacccctcgtgtgatgatgcaattagatttacataaggcatatgacatggttaattggagggccatggaatgtattctgaaggaaataggtttacctatgcagtttgtgagttggatcatgactggtgtctccacagtctcctataggtttaatgttaatggaacctattctgacattatgcaagccaagagagggattagacaaggagaccccatgtcccctatgctttttgtgataatcatggaatatatgcatagaactttggtgaagatgcagcaaaatcctgacttcaatcatcactcgaaatgtgaaaaaattggcctaactaatctcacttttgctgacgatgttttacttttctgcaggggggatagtaaatctgtatctatgatgatggaaaccattagaaaattttctgattctacagggttaaaggtgaatccagcaaagtgtcagatgttctttggaggaatggatggttgtagcaaagaaaatctgagaaggataactgattttgcagaaggaaaactccctgtgagataccttggcatgcccttatcttgcaaaaggctcactattcagcagtacatgccactgatagacaaaatagtggacagagtgaagcattggactagcaaattgctaagccatgctgggagaatccagttggtgaagagcatcactagtgccattgcaatgtactggatgcagtgcttcccactgcctcagtttgttcttaggaagattaatgatatttgccggagttttgtttggacagaaattctgagaatctttgggtga

SEQ ID NO: 100745 - DNA, 465 bp, Glycine max
  Peptide Sequence Number=SeqID_217523
atggaagtgttttacatcggtgagagtgagaagtgcgtggaggacgatgaatcacgcgttccgattcacatcgtgaccgcggcgtcacaacttcccgtcgactttctggaaccctcgcctcaatccaagctcgtcatcgactttgattgcgagggcgttgacctgtgtcgcaaaggcactctctgcgtaatgcagcttgcattttcggatgctgtgtacttggttgatgcgattgaagggggagaggagcttagcatagcgtgtaagcttgcacttgagtctaattacatcacaaaagtgattcatgattgcaaacgggacagcattatactttcagtttggcatcaagttgaacaacgtagtggatacccaggtttagaaggaaaatcctcactacagagtcctgaatggtcagttcacaactctattcggagtcatttctttcttaccgctcataatctctaa

SEQ ID NO: 100746 - DNA, 492 bp, Glycine max
  Peptide Sequence Number=SeqID_217524
atggttaaacacggagcactgtgcctccggtctcgccgacatcccgccagcgctgactggacacgtcatcatcaccgtcggcggcagcaccatgcagttgtaggacaagcacaacgacgccgtatcggggaccagcgttccctcccgcatcggaatccccgtgaggtagttgtgctgaaggtacaacgttctggtgctgccgcggcacacgctcttaacgtacacctccggcacgctcccaacaaacttgttattattcaagaacaggctctccacgccatcaaacacggtggagagctctccgctcagagcgttatggctcagatcgactatcgatccgggcttgggtctgagtccaggtctaggtggagtaacggcgaggtgacggttctgggtaatgtgcctgtgagggtgtttgaggcgaggatgaggactttgagttggggcaactcggtgagactcggtgggagtgacccggcgagttggttgtga

SEQ ID NO: 100747 - DNA, 1494 bp, Glycine max
  Peptide Sequence Number=SeqID_217525
atgctcgttattatttcccctgcaaaaactctcgattacgacagcccgctggcgacagaacgattcacgcagcccgaaatgctggacaagtcgaaacagctgatcaaaatttgccgcgagctgacaccggcgcaaatcgccagcctgatgagcatcagcgacaagctggccgggctgaacgccgcgcgctttagcgagtggcagccgaaatttaccccagacaatgcccgtcaggcgctgctggcgttcaagggcgacgtttacaccggcctgcaggcgcaggatttcagcgaagccgatttcgacttcgcccagcagcatctgcgcatgctgtccggcctgtatggcgtgctgcgcccgctcgatctgatgatgccgtaccggctggagatgggcatcaggcttgaaaacccgaaaggcaaagacctgtacagcttctggggcgataaaatcacccaaaaactcaacgaagcgctggagcagcagggcgacgacgtggtggtcaacctggcgtccgacgagtatttcaaggcggtgaagccggccaaactgcacggcgcgctgatcaaaccggtgttcctcgacgagaagaacggcaagtacaaggtcatcagcttctacgccaagaaagcgcgcgggcataaaaaaagccgtcgcaagacggcttttcgcattctagcctgccgaacctcaggccggcagcgccatcaggaacttgcgcagctcggcaaagccggccggcagcgtgtgcgacagcagcggcagatcggcccgcagcgccagcgctttcggcaacggcagctcctggccgaggatcgcttctacgctctctttaaacttggccgggtgcgcggtgccgagaaacagaccgaactccccttcctgcagcctatcgcgcagcgcgcgataggcaatggccgcgtgcggttcggagatataacccagctcggccagttcacgcatcgtttcccgggtggtctcatcgctgaccgccgcgtggcccagctctttcagctgccagaccttacgacggaacagctcttccacgcgcggccagttgttcggctggctgacgtccatggcgttggacagcgtcgcgaccgtggcgtgcggctgccactggccgctggtcaggaagcgcggcacggtgtcgttggcgttggtggcggcaataaagcgcttcaccggcaggcccagcgacttggccagcagcccggcggtcagatcgccgaagttgccgctcggcaccgaaatcaccagctgattgcgcgcttcctgcggcagctgcgccaccgcttcgaagtagtagcagatctgcgccagcaagcggctgatgttgatcgagttggccgagttcaggtgcagcgcgtccttcaattcccgatcgtcgaacgcctgcttcaccagcgcctggcaagcatcgaagtcgccgtcgatcgctacggtgtgaatgttgccgcccagggtacagacgcttctcctgcagcggactga

SEQ ID NO: 100748 - DNA, 291 bp, Glycine max
  Peptide Sequence Number=SeqID_217526
atggaggaagaaaatggagtgccgaactacgacgagttgacctgtaaaggcgagagagctgcgtggttcaagttgggtctccgcttttcctcttcagcagcaaaggatgatgttccaaaaccctcctcttccttcctctccaaattcgtcaaagcctactccgagtcaaagaagcaagcgcagctccaacccatccacgacaatctcaagaaaagccttctttcgagtctagggtttcgagctgggatagggacaacgatagaagtagaagatgaagtaggagcagagtaa

SEQ ID NO: 100749 - DNA, 713 bp, Glycine max
  Peptide Sequence Number=SeqID_217527
gccgagggtttgttttgaactctgagggccatcctaggaagattctcaggaaagatttgatgactcttcctcagatggacatgaatgtgggagcccttatctctggccagataacatctatagcccagtctaactcttctagacttgggttccctgctctgatcatcgccctgtgtaaggccagaggggttaattctgacagcttggtttttgagcacctaagctcggtcatcaacttggcctatattaggaaaaactgttggaatcctgatgatctaacagtttctattagaggggccaggcgggcaaggacgaggctagctgagcctccttccacatctacagctcctgttccagcacgatctattccttcaatggagcagttcgctgagttggtagcctggcccgggactcagtcttctcttcgcaaggaagatgaaggtcccacagcccaggcagaggagacacaggaagctgcggccacacttgagagatctcttgaggcagcttctgagctcccagcacaaggggaggacataccctcacctcagcttgcagcagacccttccactcctgtcttggaattatcagaggatcaaactgctctagtcctgacaatgaacacttctcctccaactactccagtattgcatctgacagatgaggaggatgttcagatacaggacacccaggaccagtcacaggaattttga

SEQ ID NO: 100750 - DNA, 405 bp, Glycine max
  Peptide Sequence Number=SeqID_217528
atgacatggggattgcgcccacaagacacccagtggacccggagaagtccaacaaggccctggggtttccagctctggttacgggcctctgtcagtcctatagggtgcctgttccccccagcaaggtcatgccatcttgacataggtaaggattgcgcccgcaagacacccagtggactcgaagaagtccaacagggtcatgggtttccagctctgattacaggcctctgtcagttctacggagtgtctgtcgcccccagcaaggtgatcaggccacctattaaccggactttcatcgagaagtattgcgccccaggcaggcacagggcgaggcatcatagtagtgggcaacaagcgcaccgccgccacctccagagcccctcagctcatccacaaaaaggttag

SEQ ID NO: 100751 - DNA, 2700 bp, Glycine max
  Peptide Sequence Number=SeqID_217529
atgccttcatggtgggggaaatcatcgtcaaccaagaagaaagcaaataaggaaagttttatcaatgcatttcaccgaaaatttaaaatcccatccgaaggtaaaccaaacagtagatccggaggatctcgtagacatagcaatgactcaatttcggagaaaggggctcagtctcctcctgaatcaagatctccttcgccttccaaagtgggaaggtgtcaaagctttgttgataggcctcatgcccagccactaccacttcctggcctgcacccatcaaatataagccgagcagattctgaaattagtataccatcatctagagcaagacatgaaaagggctccaaaccatcattgtttcttccactaccaaaaccggtgtgcatccgtggtaggttgaaccctgctgatttggatggagatttggtcactgcttcagtctctagtgagagctctgctgatagtgatgaaccagtggactctcgcaatcgtagtcctttggcaactgactgtgaaactgggactagaactgctgcaggcagtccctccagtgcattatccacatcatgggctcttatccaaggcttgatggtcaaggatcaatcaactactgtttcccaaataaactcaagggaagctaaaaaaccggcaaacattcttggtaatcatacgtcttctacttcaccaaaacgtaggcccttaagcaaccatgttacgaatctgcagattcctcctcatggtgccttctgcagtgcacctgacagttcaagatcaagtccatcaagaagtccattgagatcatttggcacagaacaggtgttgaactctgctttttgggccggaaagccatatccagaggtcaattttggtggatctggccactgctcaagtcctggttctggtcacaattctgggcataattcaatgggaggggacatgtcagggcagttattttggcaacctagcaggggtagcccagagtattcccccgtacctagtcccagaatgactagcccaggtccaagctctagaattcagagtggagctgttacacctattcatccaagagctgggggaacacccaatgaatcacaaacaggaagggttgatgatgtaaaaccacagagtcatcgtttaccccttcctcccttagcagttaccaatactttgcctttctctcattcaaattctgcagcaacttctccatctatgccaagaagtcctggaagagcagataatccaattagccctggatcacgttggaaaaaaggaaagctgcttggcagaggcacatttggacatgtctatgttggctttaataaggaaagtggtgaaatgtgtgctatgaaagaggtaactctgttttcagatgatgccaaatctaaagaaagtgctaagcaattaatgcaggtaggcgacaagctttacatatatctggagtatgttgctggaggctccatatataaacttcttcaagaatatggacaatttggtgaactagctattcgtagttttactcaacaaattttgtcaggacttgcttatttacatgctaaaaatactgtccacagggacatcaaaggagcaaatatactggtagatactaatggccgggttaagttggcagactttggcatggcaaagcatataacagggcaatcatgtccattatcattcaagggaagcccctattggatggctcctgaggttataaaaaactctaatggttgcaacctagctgttgatatatggagccttggatgcacagttttggaaatggctacaactaaacctccttggagtcagtatgaaggggttgctgccatgttcaagattggtaatagcaaggaactcccaacaatcccagatcatctctcttgtgaaggaaaggattttgttaggaaatgcctacaacgtaatccacacaatcgcccttcagccagtgaattattggaccacccttttgtaaaatatgctgcacctttagaaagacctattctgggtcctgagtctccttcagacccagcagtatcagggatcacacaaggagctacaacttcgggcattggacaaggaaggaatccatctaagttggattcagatcgactttctcttcattcttctaggtttttgaaaactaatcctcatgcaagtgaaatccatattccaaggaatatatcttgccctgtctcacccattggaagcccacttttgaggccaagatcgccacaacacatgaatgggcgaatgtctccctcccctatatctagccctcggactgcttctggtgcatccacacctctcaatggtggtagtggtgccattccatttagtaatcacttagtttacattcaagagggtcttggaagcttgccaaagtcttcaaatggtgtctacgttagtgtccctgctgctcatcatgacttgaatattgacatttttcgaggaatgcaacagacatctcacattacatcagaactggttccaagtgaaagtgatgttttggggaagcagtttgcacggtctcctcataatgagccgtatgatgttcaatcagtcttggctgaccgtgtttgccggcagctgctgggggataatcaagtcttcgatgttcgtcagaatgatccatttattgttctatttgctgaggaagctcaggctagtggagttcagaacctttcattggaagtgccaaactaa

SEQ ID NO: 100752 - DNA, 387 bp, Glycine max
  Peptide Sequence Number=SeqID_217530
atgtggtggttgggaagaaaagggccttctggattctcagcttcctctactgctgaggaagttactcagggaattgatggctctgacctcactgccattgttacaggggcaacaagtggtattggtgttgaaactgcacgtgcacttgcattgcgtggtgtccatgttgtcatggggatcagaaatatgacagctggtggggagatcaaggaaacaatattaagatataacccgattgcaaaaattgacatgatggagctggacctaagttcaatggaatcagtgaggacatttgcatcgcaattcaattctcgcggtcttcctctgaatatacttgtgtatgttactgcagatacttctcttcttgctcgtgtaatatgtacttag

SEQ ID NO: 100753 - DNA, 273 bp, Glycine max
  Peptide Sequence Number=SeqID_217531
atgaagattacaatttataacccaattgttgctcatgattatcctacaaatgtgatcatctacattaagggggacaacattgatggtgttatgagggtggcgattttggggagtttggagaagaggatgcaaagggactatatagatgatgtgataaagccacccacaaagaataggtttgtgttgggccaggaggggaagaatgaagtggatgatagttacgttagcattggttgtgtgaaccaaatgccttttgcttgtactccttcataa

SEQ ID NO: 100754 - DNA, 342 bp, Glycine max
  Peptide Sequence Number=SeqID_217532
atgtggccattcagaggaaaaggagcatctgggttttcatcatcttccactgctgaggaagttactcatggaatcgatgggagtggtctcactgctattgtcacaggagcatctagtggtattggtgctgagaccgctcgtgttcttgctttgcgtggtgtccatgtgattatgggggtgatagatatgaccaatgcggaaaatgttaaggaatctatacttaaggagattccaatagctaaaattgatgtcatgaagttagatcttagttcaatggcatccgttcagaattttgcatcagagtttaattcttcaaatcttccattgaatattttgatgtaa

SEQ ID NO: 100755 - DNA, 165 bp, Glycine max
  Peptide Sequence Number=SeqID_217533
atggagggtgtccggtgtggagggttgtggacgaagtgtggctcggagggtggtggtggtggacaaagtgtgacaatgagggttaaggatgaagaagagacatatgtgatggaaagaaggtgtcatatatctcattatctttctctgaatgcacacacatcttaa

SEQ ID NO: 100756 - DNA, 207 bp, Glycine max
  Peptide Sequence Number=SeqID_217534
atggtaatattgatgagatacggagcaatctgcttttttggtggcaaatcaaagaaatcatggcccgtttgggggtgttttggggcgggttttactttgggcaccagtacaattgttggtgcattctttatggtggttcatcgacaagtggtgattttgtcgatgtttggttttgttattaacgtcggagatgaattcttgatgtga

SEQ ID NO: 100757 - DNA, 1058 bp, Glycine max
  Peptide Sequence Number=SeqID_217535
catttgcacgtaggcaacgagaagttgcacctgttgctgaggatgttcagcatgtggatcatgcagatgatgaggaacgtcctaagctgaacttatcctcccatggaaggaaggttgagaaatttggcaggcctgctccagagattgaaggcttagaaactagtagtttccatctgctcgtaggagacgtgactatcaccctggatgatgtggtatcgttgctgcatctgcccattacaagcgtgttccatagctttgagccttttcatgtggacgatgtcatcttcctcttagtcaaattgcttgaatggattgtagaagctcgagcatatttgttgcatctagtaggttgcacactctttgctaacaagagttcgacacacgttcatgtggtattcttggacgcatttcgtgacctaacacagagtggaagctgtgcatgtggagttgctgcactagtgcatatgtacgagaatttgaatgatgcgtcaaagagcaccaccaagcaacttgcaggacatatcacacttttacagtgttggatctacgagcattttccttttgttgcttcttctattgcttcttctattgatgttgaggattatgatgagaggaaatcacgtgtctactattggaaagagtttaagattatctttttattttccgaacatttcaaatggggtccatctattgtcacacaccaaccgaagagggttgtaagacaatttgggtatgtgcaaaccattcctccacaccctattgctcattttctatgtatagaagacattgatgatagatggattcagttttccgaatacattgcaccgatgggtcagatatgtgtagcacctgaacagtgtttatcatactacaagaagtggttctatatgatatttcatcccttcatgagttcaacacagcttggggatcctcctagacatccgctcgtggtgcacgatgacacatttgttgaactagatgttcctcagcacccgatggctgcagtggctatggacgaatcacctgaagatgcatatgttgatgtagagcatccttga

SEQ ID NO: 100758 - DNA, 438 bp, Glycine max
  Peptide Sequence Number=SeqID_217536
atgcggaatctcttcaccatgatcattccaaatccaataattaggcttgaacccattcttgtaaagaaaccgctcggtcaacacccacattgccccacattcatttcgatattgtcggaaactgctggctggaacccacagaacctcctatcgaagaaaagtcgaagaaaaccctacactgctattggaactgtgtgggtcgaaaaaaccctacactgctcttggaacaatcgtgggtgctcaaagctttctacgctgccagttaacaagttgattgtgctttttctggttttcaagcttgacgagagttacacgccgagcaaagtttccatccgtgccggtgatggttttcacaacttgaaggagattaagaccgtggaactcgtgaaggcaaatgggtgggtttatctatccttgtctggagctgatcctaggtaa

SEQ ID NO: 100759 - DNA, 213 bp, Glycine max
  Peptide Sequence Number=SeqID_217537
atggccaaatttggaatgtcttcattggtaggcatgttcgctgtagccagggatggggatggtgtggatgtaggtgcaacatctgaatatctgattgccatagatacaatagatggggatgaggtagatgatgacggactatctctaggtggtagtagtctaaccacatcattttttcttcccacttgtcccttttccactggagttatgtga

SEQ ID NO: 100760 - DNA, 210 bp, Glycine max
  Peptide Sequence Number=SeqID_217538
atgtttgcgcataaatctgatagagaggaagaaagacgtacgataacgatggagaacaagacgatgactaaggcgatggtcacttgtggcgcgaacagggacacgaatggtggcagcggagttgcaacgaagaagatacaaaaacagggggagaagaagacgcaagcagtatggacgtgtagcgggagaaggaaacgattacacttttaa

SEQ ID NO: 100761 - DNA, 435 bp, Glycine max
  Peptide Sequence Number=SeqID_217539
atggtggttgtgggtgatggagaaagtgcttgggacgttagaaatggctttggaagaaagaaagaagaaatggtgtttttcctaagctacacgaaagcaaaagctgaaaacgcttatggtgttacactagtggaagttcaggaagggtcctttggaacacatgccaacagacatggcatggcccagaagattctgagggcatggtattactggcacactagggaaaatgattgttgtatccatatgataaagtgccacaagtgccaagcattagccgataatgtcaatgctctgcctgtgcctttgaatgtcttagtggcaccttggccattctctatgtggggaacagatgtgattgaagctattgaacccaaagcttcgaataaacaccgcttcattttggttgtcattgactacttcaccaagtgggtttaa

SEQ ID NO: 100762 - DNA, 486 bp, Glycine max
  Peptide Sequence Number=SeqID_217540
atgcctctcaaaagaaatggctccgaagaaactcccaaccaagaggtcgagaaaagatgccgctggatttggatgacgttgctacttagcaacattttccccaacgaccatagttcagacctccccttgctgaagtgttatctagtctacgccatcctgactcagtttgcagggatcactcttcctagacacctagtggactcgaagaagtccaatagggccctggggttcccggtgttgatcacgtgcctttgccaattctatggagtatcggttactcccaccaagctcatctggcctcccatcagcagagccttcgtagagaaatattgcatgcccaggcaggtgcagggtcaggcaccgcaacagctcaaggaggatcagcagcaaccagctacagggtcaagacccgcaggggcccctggagacgacgagggagctcaggaggatgacgacatggctgacatgctggatttcttcacttga

SEQ ID NO: 100763 - DNA, 219 bp, Glycine max
  Peptide Sequence Number=SeqID_217541
atgaggggaggaggttgcacaacagctcgcctggacaagttggttactttagccctaagctttctggtggcccagaaatataagagaagtaaagataaagagactaatttcgttcaagcaatctcaccatccgaccagccagcagtggaggtccaagcagtgaaacctgtcaaaaggaagagcacaaaaggcataaggcatattaagaaaagaccttga

SEQ ID NO: 100764 - DNA, 399 bp, Glycine max
  Peptide Sequence Number=SeqID_217542
atggttagcactcagtctagccttagacgcgagacccctctcgaagactcccatcctcattcggcagctatgatagacatagacactctacaacaactccaaacccgcatggtagaaatggaacgacgcaacaaggaggagttgagaaagctaaaggttgcccatgatcagctggaggctagtgtcaaacatccccagggtgaaaagcacttcgcttacactttgcttgagtgcacccaacgagaatcacacccccgacgcacaatcaacactgtagatgacttaagtctctcccacatacaccctccaacaaggcagactacttgtcggcatccttttgttgactgcattttggagttagacatacctttagggtggaaaccactcaacctcgagtag

SEQ ID NO: 100765 - DNA, 348 bp, Glycine max
  Peptide Sequence Number=SeqID_217543
atggaggttatgaacttgagtggtggcaaggaaaaaaaggaggtgaaggttggcacatgcatgtccacgagcatccaagatgaattggtagctctactacgagacttccaagacacatcttcagacatcgtgcaacatcaattaactctgaatcccgagtgttcctcgatcaagcaaaagctggggaggatgaagcctgagatgcccttacagttaaaagaagaggtcaaaaagaaatttgacgctggcttcttgcctgtggcgctacaaccaaataaagatggcactggaggacatggaaaagacgaccttaatcaccctatggggaatgttctgctacaaagtgat

SEQ ID NO: 100766 - DNA, 2498 bp, Glycine max
  Peptide Sequence Number=SeqID_217544
acaatggcagcgtgattggctcggcgcaggccgatgcaaacggcaactggagcttcacgccggatccggcactggaggcgggcacgcatagcctgaccaccattgtcaccgacacggcgggcaacagcgggccggcgtctgatgcgtttgatttcactatcgatctcaccacgccgactgccgccgctgatgtcgtgctgaacaacgataacggcgagacgccgcagccgattaacagcggcaccgcgaccaacgacaccacgccgcagctgagcggcaccgccgatgccggcagtaccgtcaccatcctcgatggcaacacggtgctgggcagcgtgctggtgggtgccggtggcacatggagctatgcggtaccggcgctgagtcagggcgaacatagcctgaccaccacggttaccagcccggcgggcaacgttagcgcaccgtccgcggcgattgattttaccgtggataccacggcaccggccgagccgaccggcctgctgctggtgaacgatgaggttgatccggccgtaccggtggcctctggcggggcgaccaacgacaccacaccagtgttgagcggtagcgccgagcctgacagcgtggtgatcgtgcgcgacaacggcgtgatcatcggctcggttaccgccggcaatgacggcagctggcgcttcacgccagataccgccctggaagcgggcagtcacagcctgacggccagcgtcaccgatccggcaggcaacgtcgggccggagtccgcgccgtacaccttcaccgtcgatctcacgccaccggcagcgccagtggacgtggtgctgagcaataacgacggcagcacgctggtggcgattgccgccaatggcgcgaccaacgacactacgccgcagctctccggcagcgccacggcgggcagtatcatcactgtctacgatggcgacagcacgacgccgatcggttctgtgaccgtggtcgccgatggcagctggcagtttgttaccggtacgctggacgagggcgatcacagcctgacggtaacggtgactgatgcggcgggtaacgtcagcgatccttccgcgccgattagctttaccgtggataccacggcgccggacgcggtcgtcgatctgctgctggtgaacaacaatgtcgatccggccacgccaatcacctcaggcagcaacaccaatgacagcacgccgctgctcagcggaacggcagagccgaatagcaccatcatcgtctatgacggacagacgccgatcggcacggcgacggcaggtaacgacggcgcatggagcttctcacctgaactgaccgatggctcgcacagcctcagcgtgacggtcaccgacgccgccggcaatgtcagcgcaccgagcgccagcgtggcgatcaccgtcgataccgtagcaccgtcggcggtcacccagttgagcgtcgccagcgacaatggcaacggcgatccggtcaccatcccgaacggcggcttaaccagtgacaacacgccggtgctgagcggcagcggcgatccgggcagcctgattgtgattacctcgcaggatggtccggtgggcagcgtcactgtcggcagcagcggcagctggagcttcacgccggccagtgcgctgagtgacggcagctacaccttaaccgttgtggcgcgcgacgcggcgggcaacgtcagcgcgccggtcacggcacagctggtgattgacgccaccgcaccggatcaggtgacggaaatcagtctctccaatgataacggcagtgcgctggtggatattccgtcgggatcgaccaccagcgataccacgccgctgctggcgggggttgctgagccgggcagcacggtgaacattctggataatggcgcgccgattggtacggcgattgcgggcagtgacggcgcgtggagtttcaacgtgccaaccctcaccaacgcgtcgcatagcctgacggtgacggtcaccgatgcggccggtaacaccgggccggcgtcggcaccgattacctttaccgtggataaccaggcaccggcccaggccacgctggaagtgaataacgacaacggcaccgatctggtactggtgcccgatggcacctttaccaatgacaacacgccacgcctgagcggtacggcggaggctgacagcctggtgaccatttacgatggcaatgtggtgctgggttcgaccaccgccaatgcggacggcgaatgggtgttcctgtcgcccatgctcaccgatggtcagcacaccctgacggccacggtgacggacagcctcggcaacgtcagcgcgccgtcttccagcttcaccgttcaggttgatgccacgccgccgcagccggtcagcgccgtgctgctgcagaatgacaacgatccggataatccagtcaccatcgccaacggtggcgtcactaacgacaacacgccgctgctgagcggcagcggtgaggcgggtggtctcgtcaacgtgtacaacggcaacgtgctg

SEQ ID NO: 100767 - DNA, 330 bp, Glycine max
  Peptide Sequence Number=SeqID_217545
atggaattctttggaataaacgcatttgtgaagaatcactgtgaatttttgtcacttgaggacaagcttagcgtgagattgacgctaagctcaaattcacttactcgcgctaagcatgacgtcgagatcaggaagccctttttaagcctgatttgcatagaattgaaaggggaagagaacggttcactactcagaggcctgaagagtgtgaatttcagaggtcatagagtagagcaaggggccaagttttcatcttttagggagattagtgagtttttgagtgattgtgagattcctagaggtggaggagacatccctactcctttgtaa

SEQ ID NO: 100768 - DNA, 264 bp, Glycine max
  Peptide Sequence Number=SeqID_217546
atgggcccaaaattcttctatccaatacccttgggggataggattgcatcaaaatgtccaaaaatcccaatttcaaatggagagttcttagggtggtgcaagccctggaagggggcactcatggtgaaagtgctaggaagaagagtacacttccgtttgattgtgaataagcttaaacaagaatggccaagcaaagggcatctcaagatcattgatttgcctaaggacttctaccattacatattggtgcaactttgggcataa

SEQ ID NO: 100769 - DNA, 201 bp, Glycine max
  Peptide Sequence Number=SeqID_217547
atgttcctcttggtgtggtggtttggcggcaagcaacgacggcttttgcagatgaagatctcacttagcgagctcgtctcgctaagcgggagtctacttttgtcactaagtgcgacaattcttgctgagcgcaattcctcttgcgctaagcgcaagaattctcgctcgcgcaattccctcttgggttggaattgtgcttag

SEQ ID NO: 100770 - DNA, 261 bp, Glycine max
  Peptide Sequence Number=SeqID_217548
atgtcacgaaacttcacgtattgtgcaacaaagggttccaagtacctcgaagcggtcaaacaaaggttgcatgccatcaaacaatggtcctcggacgaaattaaggcaatcaattcgtggggctccggactcgatggtggaggatgcttgaatgacaatcaattcatggggctccagacaagattcattggtggaggatgcacgaacagtgctagggaatcaattcgtggggcttcggactcgatggtggaggatgcatga

SEQ ID NO: 100771 - DNA, 810 bp, Glycine max
  Peptide Sequence Number=SeqID_217549
atggggaagaagggaagtggtagttcatggttaactgctgtcaaaagggcattcagatctcccaccaaagacagtgacaaaaggagtggcagaagaagagaagactgtgatcaagaagaagacgaagaaaagaagagggaaaagagaagatggattttcaggaagactcacatgagtcatgaaggagggaacaacaacaacaacactcaacaaaagttgaagcatgatgtggcagcaagtggtggtggttcaaggacagaccaggatcagaagcatgcagttgcggtggcggtggccaccgcagaagccgccatggccaccgctcaggcggcggtggaggtggcaaggttgtccaaacctgctagccatgccagggagcattatgctgctgttgtgatccaaactgcttttagagggtatcttgctagaagagcacttcgtgcactaaagggtttggtgaagttgcaagctttggttaggggtcacaatgttaggaagcaggcaaagatgacccttaggtgcatgcaggctttggttagagttcaagcaagggttcttgaccaacgcataaggtcttcacttgaaggtagtagaaaatccactttcagtgacactgctagtgtttgggactcgcggtatcttcaggacatttcagataggaaatcaatatcaagagagggaagcagcattacagatgactgggatgaaaggcatcacacagttgaagaagtgaaggccatgttgatgcagaggaaggaagctgctgcaatgaagagggacaagaccttatcccaagccttttcccaacag

SEQ ID NO: 100772 - DNA, 924 bp, Glycine max
  Peptide Sequence Number=SeqID_217550
atggtgggtggtaacaaccctgaccaatataatgacacaactttcaccaaaatctttgttggaggattggcttgggagactcagagggacacaatgaggaggtattttgagcagtttggagagatcttagaggctgttgtcatcacagataagaacactgggagatccaagggttatggctttgtcacatttaaggatcctgagtcagccatgagagcatgtcagaatccatctccagttattgatggtaggagggctaactgcaaccttgcttctcttggtgcaagcaagaaccgaccaccaacttttcagcatgatttaactcatcctaggcaagaaggtaccacctttaagggttggttatttagtgaaagtgcaggacggttcaggcctccacctggactagtggcatcaccacctgcttatcatggttcttcatctacatttttccatcaaccccctaggcaatacacatttccttattcagcttacagatattctggatattcacaagacaccttgtatcctacgagttattataatgtctatggagttcagcagttttcaccttactacccttctgctggagcttctggggaagttgggttgatccacaatatctaccccttttatggtcaatatgcacagagtattcaggctcctggttttggggttcagtacccccaaatggcacagtttccatttttgcctcagcattatggctccagcactgggatattgtcatatccttcttcagtgacagtgccaactactagtgcagtaacaggaattgcaaccacaactacaactacaacaacatcagcaagtgtggcagcaacagtggttggtactacttcacaagcctctcaagcagcttctgaacaaacttccacatctacaaggtcacagaacttgcaaggctaa

SEQ ID NO: 100773 - DNA, 543 bp, Glycine max
  Peptide Sequence Number=SeqID_217551
atggaaatgataaaaggaatcaaggggcatggttattatgatgaacttgtggtccccataatagagaacacagcctacgaatatgagctcacagaagctctagctaaagctattgaagcctacactaaaactacagcagttcttgtacgtaaccatggaatatatgtttggggagactcgtggatcagtgctaaaactctggctgagtgttatcattacctctttgatgctactatcaaacttcaccaattaggattggactggtctactccaaatcatggtccaatacaaagtattaggagtctaatgattgctggggagtcaaatgcatccgataagacaaggaaggctaatggtgaaattgatccatttccatgttgcattgtccttgacattgaaggaaatactactcccatatcatttgttactgaggttctcttcccatatgcatgtcaaaatgttgggaggcatctatccatgacatatgatactcctgaaactgaatctgatattaagttgctttgctcacaagtaagattctaa

SEQ ID NO: 100774 - DNA, 609 bp, Glycine max
  Peptide Sequence Number=SeqID_217552
atggccttggtagctcattttgatccagaactacatcaaatgaatgtgaaaacaacattcttaaatgggaatcttaaagaagaagtgtacatggctcaacatatgggatttgaaaatgaaaaagaccaatgcatataccttaaagtcaatgggaatgaaattttacttacaagcattgacttaggtcttttgcatgacactaaaattttcctcgaacaaaactttgatatgaaggatatgggtgaagcttcctatgtcattggcatagaaattcatagtgatagatctctaaggacagtgggattatctcaaaaggcctacatagaaaagttaaaggggaaaaaatttagtctcaatcaatgtccccaaacaacattggaacgagaagagatgaaaagaattccttatgcttcaatagtaggaagtctcgtgtatgctcaagtcagcactaggcctaatattgccttcgcaataggaatgctgaaaagatatcaaaaggatccaggcatggaacattggaaggcagcaaagaaggttatgagataccttcaaggaaccaaggattacaagttgacatacaatacaagcattctaatgatttggaaataa

SEQ ID NO: 100775 - DNA, 186 bp, Glycine max
  Peptide Sequence Number=SeqID_217553
atgttggatcatgtctcaaataaagtgatttgtaagagtctaaagatctttatcggtggtttgtcatccaagaaggctccaaacataatccaagttgattggcaccccagatggatcaaatgcaacaccgatggtgcttctcatggtgctcctggcagagcttcctgtaggggtatttcttcataa

SEQ ID NO: 100776 - DNA, 747 bp, Glycine max
  Peptide Sequence Number=SeqID_217554
atggaaatcagcttaaggctccaagacacagaaaccccaccttccatgaacaactccccaagaagcaatctgagcaacaactgctgcaccaattataataatagcattggcatccaaatccccaccacaccaaaaaccatcctcagatctgactccacgaatccttaccccaccacctttgtccaagctgacacttccactttcaaacaggttgttcaaatgctcactggctcatcagaaaccacaaagccacaactacaacaacaacaacaacaacaacaacaagatctagttcaaccacaatcatcatcatcgaagaacttcaacattcctccaatgaaagcaacaccaaagaagcagcaagggttcaagctctatgagaggaggaacaacaacaacaaccaccacctcaagaacaccctcatgatcaacaccttggtccccaattttgcacacagctcaggattctcctcatcacaccacaacaagccagagatcctctccccaagcttgcttgacttcccttccctcactctcagcagccctgtcactcctttgaatgatgacccttttgataagtcctcctcaccttcattgggaagcacttcctcagaggaggagagagccatagctgaaaaagggttctacttgcatccctctcccatgtcaactccaagagactctgagcctcagctcttgcctttgttccctgtgacttcacctagagtttctgagtcaccttcttga

SEQ ID NO: 100777 - DNA, 357 bp, Glycine max
  Peptide Sequence Number=SeqID_217555
atggtgtggatttgcttcagaggattgaacttattttactatgatgaaagcattttatccactcttgctagtgttgtggggagatcaattaaggttgatagcaacaccaaaggtgtctggcgaggtcactttgcatgtgttgagattgacttgatgaagccagttgtaggtaacatatggcttaaggatttctggtgcaaggttgaatatgagagcatccaccgtatttgttccaattatggatgctatgggcatctcacaagggagttcctttatcagccaacagtgaaagaggaggaatctaataatcctgatggaagcttgcttgagaagcttctatggaggctggatctttga

SEQ ID NO: 100778 - DNA, 396 bp, Glycine max
  Peptide Sequence Number=SeqID_217556
atggattgtaaatatgctaatattataattagaaggtatttagcaaggaagtgcatccagcaagaaggttataaagttcaattgggtagtcctgaaagtgcccagaggaacctatttagcaaggaagtagaattgcaggatctacattttctgtgtttcataatttttaatggtcaggtgcaaatggaggctaatgactcttctagtcagaaagaagagcagatgaaacctatgcgaaataagattgggtgggagaaggacatacctgtggaccttgcgacggtgagtgttttcgcacactggagaagcacacttgtgacggtggtcagcgtggtgttgcacgatgagtcttttggcacacttgcgacggtggtcagcgtggtgttgcaagagtga

SEQ ID NO: 100779 - DNA, 1020 bp, Glycine max
  Peptide Sequence Number=SeqID_217557
atggccacaaagccatgggagaatagaggaagggcttcaactgatcaaagagaccacattaagactgtggaaattgacacatctcagccttattcatatctaggaaccaattacagaagatcacatccaaagtatcaatacaacccaaaccatcaccaaccacaaaggcattccattgcttccccactccatagatctcaccaaaatggatcctcccttcaccagtcccctgccaccccttctcctgccaaatcgaggcccatccaagtccggtccgcgagtccacgttgcattagagacgacagaagctaccacacctcccaaacaccaagcttgaggtctaattaccactacgcaggaaatttgtaccaaaatgggagggttgttggaactggaactagtaatggtggtgctactgctacattgcctaattacatggcggcaaccgagtctgcaaaggctcgaattcggtcacaaagcgcgccaaggcagaggccatccacaccagagagggacagggttggatcagccaagaaaaggctttcttttccagctcctgacccttatggtgtgggagtgagttatggaaactatggacatagtttaaggagtccaagcttcaagagtgtgagtggatcacactttggggggttagaacaacaatcaaattactcttcttgctgcactgagagtattggtgggggtcaggtttctccttcttcaacagatgccaagataaaaagtgagccctatgtggtggcctacctcacttgggatgttgtgttgatgttgaaagaattgccaagaccatctgaaatagcttttaatggactgtcctgtcacaataacatttttaaaccacggtatctttttttcccaaactcttcttctagacttgtaagagcatctctagcagtttataatggactccagctggacaaccttttcttcactgaaactcataatcagaggtatcttggaattatgagctgtttggggtcccatcctactgaacactag

SEQ ID NO: 100780 - DNA, 669 bp, Glycine max
  Peptide Sequence Number=SeqID_217558
atgtcaaacaaagccttcgaatcaactactcttgtctttcttttactctctgtggtgttctctactcctccagaggatccaatcaagtgcacgacttcagagaacacaacttgtactatcacaaactcctatggttccttccctgatcgaagcatttgcaaagctgctcaagtgttataccccaccactgagcaagagcttgtgtctgttgttgcatcagcaaccagaaacaaaaccaaaatgaaaatagctacccgttattcccatagcatccccaagctggtgtgcccagatggcgaaaatgggatgctaattagcaccaaatatctcaacaaaattgtgaaggttgatgtagaagcaaatacaatgactgtggagagtggtgtgactctgcaacagtttatcaatgaggctgcaaaggtagggttggccttgccatatgcaccatattggtggggtgtgacaattggagggctaatgggaactggtgcacatggaagcactttgcgggggaagggaagtgctgtccatgattatgttgtggggcttaggattgttaggcctgcaggtcatgaagatggttatgctaaggttgagagcctcaatgaacgacatgaagatcttaatgcaaccaaagtatcactcggtgtgttgggagttatttcacag

SEQ ID NO: 100781 - DNA, 1140 bp, Glycine max
  Peptide Sequence Number=SeqID_217559
atgcaatatttttaccaacagactagcaaaatatcgaataaccaaagctggcacctcagctcccattcaacaattactctaaaactagaacgcctcttcaaacgatccatcacgtatgtggcaaaaaatgattcagatttgggagaccaagttgctgcttttggacatgcacatgagtttgcagatataatgtggtacccaagtcaacgcaaggttgtctaccgtgttgatgatcgtgttccattcaatacatcgggcaatggtctctatgactttatccctctccgtcccactccttcaaatatatcgatttttaggagaaccacggaggatattcaagaatccacaaatgatgccattggaaagtgcatagatgctaatgcctcatcgaatgccctattcaccgtagcttatggacttactaacaatggtataagcttcactggataccctgtaattggatttcagaaccaccttcagtcatctgggtcatgcttggatagtcctcaagatgcattgatcacaacatgtggctgggatcctagggtggagggcttgttctattacaataccgcatttagcattaggttgtctgttgtaaaaaaatttattgaagatgtgcaaaagctagttcaattggagccaaagggattatgtatattagggctttacaatggaattgtcatgcgctatgtcaccgcttcaagtgcctacttgggaaagcaggaggatgctttagaatttgatttcttgtactaccgtagcagagacccaatgactcccaggctttatgaagacattcttgaagaggttgaacaacttgggatttttaaatatggaggactacctcattggggtaagaataggaacttggcatttcaaggagtcatcaaaaagtacaaaaacgcaaagaaatttttgaaggttaaaaacaagtatgatccaaaaggacttttctcaaatacatggacagaccaagtgcttgggctaaaggatggagtgacaatattgaaggatgggtgtgcattagaaggtttgtgcatttgttcacaggatagtcattgcaatccaagcaaaggttactattgcaggccaggcaaggtttacaagaaagcaagagtttgtactcatttgaaataa

SEQ ID NO: 100782 - DNA, 1218 bp, Glycine max
  Peptide Sequence Number=SeqID_217560
atggcaagcaaaacaaagatctatattgtgctagagttggttaatggaggagaactatttgacaaaatagctaaatatgggaaacttaaagaggatgaagcaagaagttatttccatcaattaatcaatgccgttgattactgccacagcagaggcgtgtaccacagagatctgaagccagagaatcttcttctggactcaaatgctattctgaaagttacagattttggattgagtacgtatgcgcaacaggaggatgaacttctccgcactgcttgtggaactccaaattatgttgctcctgaggtgcttaatgatagaggttatgttggttctacatctgatatctggtcctgtggagtcattctctttgtgcttatggctgggtacttgccctttgatgagccaaatcatgcgacactgtaccaaaaaattggcagggcccaattcacatgtccatcatggttttctcccgaggcaaagaaactattgaagcgtattcttgatccaaaccctctaacaaggataaaaattcctgaactcttagaagatgaatggttcaaaaaaggatacaagccaacaacttttgtagaggaagaggatgtcaatgtagatgatgttgctgctgctttcaatgattctaaggaaaatcttgtgacagagagaaaagagaaaccagtgtcaatgaatgcttttgagctcatatctaggtcacaaagtttcaatcttgaaaatttgtttgagaagcagacacaggggattgttaagagagaaacacattttacctcacagcgccctgcaaatgaaatcatgtcaaaaattgaggaagctgcgaagcctctgggatttaatgttcacaagcgaaattataagatgaagctgcaaggtgataagagcggaaggaagggtcacctttcagttgctacagaggtactgactgctgagccatttgtggtttttgaagtggctccctccttgcacatggtggaactgcgaaagaccgggggtgacacactagagtttcacaaggcatgtgaacattttaattgtgactttggtttagaggaacaagaaaaaataatctcttcattttgctcttcttttctgttattttctttggtagaacctatgttcctcgttctattgcaattctacaaaagcttttcatcatcatcagggttgcaagacatagtgtggcattctgaagcaaaacaatga

SEQ ID NO: 100783 - DNA, 515 bp, Glycine max
  Peptide Sequence Number=SeqID_217561
ggaagctttctgcagggaagctaagtgtgaagtatgcaatcctgcataggattggcactgccaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacgcctgatcaaaagactctcagacaatggcgttgatgatggagaagcagctgaggaagaagaagatgcagcagaggatacagaatcagatgatgatgattctgatgccaccccatga

SEQ ID NO: 100784 - DNA, 498 bp, Glycine max
  Peptide Sequence Number=SeqID_217562
atgtcctctagggggaaggaaaccatacctcttctcagggttctacccctcattggccagaatttcgaaaaaagtccaaatctcggcgcaggaattagaccgccaaaggcaagtcgaaaatggggtggtcggaataccgagaaaatatttggagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcgaaggatgtccaaatgttcccttga

SEQ ID NO: 100785 - DNA, 492 bp, Glycine max
  Peptide Sequence Number=SeqID_217563
atgaaacgcatcgcggtaatcggcgccgggctgggcgggcttgccgccggctcgctgttacagaaagcgggatttcatgtcacggtctacgaacaaagcccggctttctcccgtctgggtgctggcatccacatggggccgaacgtgctcaaggtgtttcgccgcatgggcatcgaacagcagctggaggatctggcttcgcatcccgatttctggttcagccgcgacggcgagaccggggagtatttgtcacgtattccgctgggcgcttatgcgcgcaaagagtacggtgcggcttatgtcacggtgcaccggggcgatttgcaggccatgcagatgaccagtctggagccgggcagtgtccagttcggcaagtgcctgagcagcgtcgaggacagcggcaacgatgtggtgctgcgttttcaggacggcagcgaagcgcgcgcggatatcgtgattggcgcggatggcattaactcaaagctgccgtga

SEQ ID NO: 100786 - DNA, 159 bp, Glycine max
  Peptide Sequence Number=SeqID_217564
atggcagtaaatcagagccagttaggccagatgttcgagcaggttttacggctgtcgaaagtcgacgccagccagagtgtcgccatcctgaaaagtcactattccgatgcacgcaccgtgcaggccgccactgatgctgcactacgattgggcgcgaag

SEQ ID NO: 100787 - DNA, 324 bp, Glycine max
  Peptide Sequence Number=SeqID_217565
atgggaaatcctgccgctggcgctgcttatcgccctgctctccagcgccattccttactcgctggagatgatggcgttaacgcgtctgccggcgcgcattttcggcacgctgatgagtctggaaccggcgatggccgcactctccggcatgctgttcctcggcgaactgctgacgctgcagcagtggctggcgctgctggcgatcattgccgcgtcggccggctcgacgctgaccatgaaacagaaagcggcacatataaacgaagtcgatatcaacgcgccgcaataaacagtgcgggttcagccggttatttaaccggctga

SEQ ID NO: 100788 - DNA, 729 bp, Glycine max
  Peptide Sequence Number=SeqID_217566
atgaccatccgcaatgttcctttgggaaatgatcaagtgaaggtctatgttgaggaagttcaagatgctgatgctcgcgttcctgtacccactcaagaggttcagttagtggggcaaacacttaacaccttccttgcttggccaacatatcttgtaaagattttttcaaaacaaggagttgagggactggtgaaacctatagatatgctagatcttggcatcgatcccttgtacctgatgatactgaccatcctgcagtttctcctcaagccgttgcaagtgtcgtgggatgccaccatggttggggtgtataatgataacttcctattgtacataaagcatgaagatctttctgaaatagtacataatggtcaatgtctcaacatctctgttatacaattgttgatttttacatattggcaaatagtcattattttgccgaaggacaatgttgtcatctggttttgttctttgcacaataggcccgacatctacttgaaaggaattattgtagaagcaaagcttcatggtgaatcaaagaacaattcaagagttcaatataagaatcaagaagaattcaagactcaagaagaaagtttagagtcaagaatcaagattcaaggttcaagatctcaagaatcaagatcaagattcaagactcaagattcaagaatcaagagaaggcttaatcaagataagtatgaaaagtttttctcaaaaattgagtag

SEQ ID NO: 100789 - DNA, 246 bp, Glycine max
  Peptide Sequence Number=SeqID_217567
atgatattgcacgagattagaaggcctaactctcataaaacagtccccagtggagtcgtcaactgtcgcaacctacccttcggtgggagggcgacgcggggctcatgggtgtgtcttccaagaaaggaaaatgcacggagttgccaccaacgtttatttgaggaaaacgtcggaaaaatcgaaaaagggcgtttcccttgctcctacgtattcctcaattgcgataaggaaatcagacctacgtag

SEQ ID NO: 100790 - DNA, 228 bp, Glycine max
  Peptide Sequence Number=SeqID_217568
atgcaatcacaggtactcgcactacctcctgagcctgaggatggtcgttcagctactcgtatcagcacaaaggaaaatgttgtcatctggttttgttcgttgcataataggctagacttcctgaaaggaattattatcagacaaaaaggaagtcctgcgtgcgagtattacgtcatgcaccggatgtcaactataatcttaggaagtttcaagaataattggaaaatg

SEQ ID NO: 100791 - DNA, 300 bp, Glycine max
  Peptide Sequence Number=SeqID_217569
atgcagtcacatggactcgcactacctcctaagcctgaggttggtccttctgttgctcgtgtcagtacaaaggaaagttgtgccgatccctctggcaagacccagacatgggtgactcaaacaaatgtgggttgtctgtggatgaaaatcctcttcgcctggttgcccttggaagagtttatgaggggtcgaccaccatccacaacatccctttgggcaatgatcaagtcaaggtcggtgttgaagaagtttgagatgctgatgcttgtgttcctgtatccactcaagaggttcagttag

SEQ ID NO: 100792 - DNA, 270 bp, Glycine max
  Peptide Sequence Number=SeqID_217570
atggtgaaatcattcaaagttcaagtgcaaatgcagttttcagaggtgacaagacaaaaatcgttactcttgaatccaacaatgacgctgtcagacataatcaccgcaatacagtcatcaattatagacaatgatgttacgcctataattactacactttggtatcgttgtcttgtatatgaattcaatggtgaagttcaatatagggcaattcaaattattgacgaagaagttgggtcgacatggagcagaagctgggcaattccctga

SEQ ID NO: 100793 - DNA, 732 bp, Glycine max
  Peptide Sequence Number=SeqID_217571
atggcagaggtctccacagaggccattacctgcctcgcccaatattatgaccagccgttgaggtgctttacctttggggacttccagctatcacccatggtggaagaatttgaagagatcataggatgtcctctagggggaaggagaccatacctcttctcagggttctatccctcattagctagaatttctaagatagtccaaatctcgacgcaggaattagaccacagaaagcaagtcaaaaatggggtggttggaataccgagaaaatgtttggaggcaaaagcaagaatcttggcaggtaaaggcgaatgggccctgttcatagacattctcgcactgttgatctatggaggagtcctctttccaaatgtggatgggttggtggacttagcagtgatcgacgcttttctcgcctatcatgaccacaaggaaagcccgattgtcgctatgctagccgacctatatgacacctttgaccaaagatgtgagaagagaagtacgaggattgtttgttatactccggtgtcataccctaatttcgtccggggacctttgcttgatgacatgcgacctttctttggtccttgtgaggtgcttggcatccatcattgggcaatttgtgaaattccaggacatgccgaaaaaccaaaaaaatatattgatgcacaatccgtaagtttccgtgacacaccggaaatcaaatggaagcatcgttgcataattaagtga

SEQ ID NO: 100794 - DNA, 690 bp, Glycine max
  misc_feature (644)..(644): n is a, c, g, or t
  Peptide Sequence Number=SeqID_217572
atgttgctgtggtgtttcgccctgcgcctgcctgggggcgcagtacttcttgatgaaagctcgattagtagggggcctgatgcccttgctggaggcgacaggtactccgtagaaatgacagagacccgcgcgatcccttgtcggggggggtacgagcaccctgtaggactgatagaggcccgtaaccagagctggaaaccccagggccctgttggacttttccgggtccactgggtgtctctcggggggagattggcattgcggtcgttgggcagaatgttgctaagtagcaatgtcatctatatctgtgtaagagtggttatgttagtgcgcatgatccgcactcgtctttttgcagcggcacgggtgaaatcttgccccggtatgcatagtagctgtgtgatagcctccctctctggttgtgctcgcacagttggccctcctccaatatcagggggtggcccaggaaccgtgtggatatggagcccactgaaagtgaggacgcgtagtcctctaaaggcgagggcgtgtagccctctgaagttcaggacgtgtcgcctttcgaaggcgagggagtgtagttctatgatggcaaggacgtgcaatcctctgaaggtgagggcatgcccccactttgaaaatgngggaacatgtagtcctctgaaggtgaggacgtgtagtcctctgaag

SEQ ID NO: 100795 - DNA, 240 bp, Glycine max
  Peptide Sequence Number=SeqID_217573
atgaagggagaagcaagatgtcgtctcgagtttcgaagcatattacagagcaagagtctggtcaggacctgctcgaatcgaaaagagaggagaatctttaagaaggaattcccaggttcaaagaagtatttacgaagtacaaagctaagacaagaaagaggacttcgagctattgggcaattcgaactggtgtatggacgagtcgaagtcgaggcagcaagagttctggacttagcgtaa

SEQ ID NO: 100796 - DNA, 603 bp, Glycine max
  Peptide Sequence Number=SeqID_217574
gtaagagcgtgtagccctctaaaggtgagggcacgtaggcctctgaaggtgaggacgtgcagtcctctgaaggttaaggcgtgcaaccctctgaaggcgaggacgtgtagtcctctgaagctgagggcgcgtaacgctctgaaggtgagggcgtgcagtcctctgaaagtgagggcatgcaaccctctagaggcgatgatgtgtagtcctctaaaggtaagagcgtgtagccctctgaaggtgaggacgtgttgtcctcttaaggtaagatcgtgtagccctctgaaggtgaggacgcatactcctctaaaggtgaggccgtgtagccctctgaaggtgaggacgtgcggtcctcagagtgtgagggcgtgcaacactctgaaggtgaggatgtgtagtcctctgaaggttagggtgtgtagccctctgaaggtgaggacgtgcagtcctctgatggtgagggcgtgcaaccctctaatggcgaggacgtgtagtcctctgaaggtaagagtgtgtagccctctcaaggtgaggtcttgtagtcctctgaaggtgtgggtgcatagccctctgaaggtgagcacgtgcagtcctctaaggtga

SEQ ID NO: 100797 - DNA, 543 bp, Glycine max
  Peptide Sequence Number=SeqID_217575
atggggacaaggggttgcatcagctacaatcccgttccttctataagacaacttggctatcctatgagaggagcaccattagaggaagagatcgtgcctaaggttcgcaaggcatgggaggtgttgcaaaagaaagacaaggaactcagaggcagtaacaatgggcccatcggtggctaccgtgagtggttgaaagcccacgtgcaaggttcggattggctcccaagtctgagagccactaaaagggaggaagatgaggcaccggaggaagacgaaggggtgcaggcccttaggacagaactcaagcaagctcaaacagtcaaagaaaggttcaaatctgcagctcttaagatccgaaaggagaatgccgaactgagagatgtgaatatagctaccaccaaggctttggaacaagagaccaaaagggcccgtagggaagaacatagccggaacaagtttcgaggggctctgtggggcagtaacagcgaacttaaactccgaagagaggaaagggaccaatcgcgggtagacaggatgagttaa

SEQ ID NO: 100798 - DNA, 276 bp, Glycine max
  Peptide Sequence Number=SeqID_217576
atgtcagtgaaaatcctcatcaaacacctacgagtatatgacaaaacaaaccacacactgggagaccagtcaaggtcacattgtttgacgagaatgctccaaccatgtggaatcggtacaagcttaaaggagcattcaaaccgggtgtatttacccacaaggcctagacttcgaagagtctttcagagcctctccatccttattcaggtccaacctagaaaaaattttaacatgcagactccatctatgaactataaaaaacacatgactccttaa

SEQ ID NO: 100799 - DNA, 197 bp, Glycine max
  Peptide Sequence Number=SeqID_217577
gcaccatcagacatatcacagatcgcaacggtcagatcgtggacatctgtccaatgaaccttcaaaccaaatttcgtgaagatccaacggttaacgaatgcaagagggcgtttttaccgagatggcttcaggcagcttccttgagaagcttttctcgagaggcttcgttgagaagcttccttgagaggcttctttga

SEQ ID NO: 100800 - DNA, 699 bp, Glycine max
  Peptide Sequence Number=SeqID_217578
atgatcacccgcgtgcgctatcagattcacatccccaatccgctgctgagtaacatcaagcagcactatccgatggcctacgatgtgacgctggcggccgtcaccagctggggcaaatacacgccgtataccatcagcgaaaacgaaattggctttctggtgctgcacatcggcgtcgggctggagcgacattacgatgtcggctatcagcgacacccgcaggtgttgctggtctgcgacagcggcaactccacgctgcgcatgatcgaggcgctgctgctgcgcaaatacccgcagctggtggtgacggcgcggctgtcgcagcgcgactacgaagtgcgtgcgcacattgatgaagattttgttatttcaaccgcgcggctcagcgagaagaacaagccggtagtgatgatgtcgccattccctacggagtttcagctggaacagctcggcaagctggtgctggtggatcgcacccggccttacatgctggagaagtacttcgacgcgcagcatttcatggtgctcgaccggccgatgagccagtcggcgctgttccgcctgctgtgcgatcggctcgaggcggagggctatgtcgatgctgatttttatccttcggttgaagagcgtgaagcgattgtcagtaccatgctgggcgaagggattgcgctgccacactcgcgtgggattactggctaa

SEQ ID NO: 100801 - DNA, 636 bp, Glycine max
  Peptide Sequence Number=SeqID_217579
atggctgctttttggacaactcatttagtgagatccaaagaagcagatgcaaagggtccaggcccaacaggcctttgcaacctttaccttgatgagccagatgagaaatggataacccaagttgaagattttgactatgtcattcttaatggaggacattggtttacccgaaaggcttttaggactgcatttagagccatcaatagattagagaacttcaaagggacagtgtttcttaggacatttgctccatctcattttgagaatggattgtggaatgagggtgggaattgcattagaactaagccatttaagagcaatgagacacaattagagggcctcaatttggagttttatatgattcaattagaggagttcaaaattgcggagaaggaagccaaaaagaagggtttgaaatataggctatttgatatcacacaagcatcattgctgagaccagatggtcacccaagtagatatgggcactggcttaatgaaaatgtgacattgtacaatgattgtgtgcattggtgcttgccggggcctatagacacatggagtgattttctactaggaatgttgaagatggagggtgtgagctcagctgaagagaggcttcatttgcattcaaattga

SEQ ID NO: 100802 - DNA, 129 bp, Glycine max
  Peptide Sequence Number=SeqID_217580
atgaaatttgtccaggaattgaatatggttagaataaaaatagcggcttcaaagacatcaatttcgaagtatgattcggatgcagtaggggtgaacaggggctctaaccctccctcttgcaccttatag

SEQ ID NO: 100803 - DNA, 876 bp, Glycine max
  Peptide Sequence Number=SeqID_217581
atgggttgcttggggactgaacattttggggaggagccaagaaacttaaggctcaaacttgcttcagatggcatgaatccttttgacttgggaaaattatgggtagacgagattgatgtgtatgatgggaatctgggacagacatttaggttgcgggcaatggtattttgtaccattaatgactttttagcatatgagaatttaagtggatatagtgtccaaggacatcacgcatgtcctgtatatgagaaagaaacaagctacatccaattgaaacatgcaaaaaagacaatatatactaggcttcaaagatttctcaagcattatcacccgtatcgacaattgaaaaaggcttttaatggaaatcaagagtatgaaagtgtgccaaaacccttagctggaaacgaagtttatgatcggctgaaggacatcctaactatctttgggaagacccaaaagaaggatgcatgtgagaagaacatatggaagaaaaggtcaatattctttgatcttccatgtcggtccgatcttaatgttagacattgtatagacgtcatgcatgtggagaaaaatctctgtgatagtttaattggcccacttcttaacattaaaggaaagacaaagtatggtcatgaagtagattatgatttggatatcttggtaactttggtctgtaaggagcaggagtttatcaggcctgttttgagtatgatgcatgaagttgctaaacttgcaaatgttgatcgggctgctctatggttccatttatgtgctagtgaagatgaatttgtacgcgttcgtgaagaaagcaaaaatgagatttctaatatggctaaggaaaaaacaatgatatcacaaaagctgagtgaatcttag

SEQ ID NO: 100804 - DNA, 1485 bp, Glycine max
  Peptide Sequence Number=SeqID_217582
atggccactcgtgttatcccaccaagaatcctaaggaagcttcgctacaacaccgccacaaaacccctcaactcctctcaccctcctctctccccgtctctctctccttctccctgcctcctacctgctccgctgccgtcccccgccgtgctccgtccctccgccgccgcctccgacgacctcagcttccgcgacgtcgaaaagctcttctcctctgtctccaccaccagcctcctccgctcctccgccgtgctgcacgccaccgccgtcgagcccatggttgacttcggcacatggctcttgcgatcaaatctcatgcacgtgcatggcatccgcgacctcatcctcgccaccgtccgcaacaccttcttcgaccacttttgcgccggcgaggacgccatcaccaccgctgccagcatccgccacctaaaccgtgccggcctccgcggcatgctcgtctacggcgtcgaagacgcaaacgacaacgacgcctgccaccgcaacttcaagggctttcttcacaccatcgacgtcagcagatcgcttcccccttcttcggtgagctttgtgatagtgaaaatcaccgcaatatgtcctatgagcctgttggaacgaatgagtgaccttcttagatggcaacacaaggacccttgtttcagtttgccatggaagcaagattgcttccccatattctccgagtcaagccctttgtaccacacaagcaacaaacccgagcctcttaccccagaggaagaaaaagaccttcaacttgccatccagagattccatgagctttgccataagtgtgtgcaagtcaacattcctttgttggttgatgcagaacacacttctgttcaacctgctattgactacttcacatactcctctgccatcttgcacaacaaaggtgacaaccccattgtgtttgggaccatgcagacctacctcaaggatgccaaggagagactcttgctggctgcagaggctgcagacaacatgggaatcccaatgggcttcaaacttgtcaggggtgcttatatgtcaagtgaaacaaaattggctgagtctttgggctattcttccccaattcacgacaccatcgaggacacacacaagtgcttcaatgactgctcctctttcatgcttgagaaggttgctaatggccctggtggacttgttcttgcaactcataatgttgagtcagggaaactggctgctgcaaaagcacatgagctagggattggaaaggtgaaccacaagcttgaatttgcacagctgcatggaatgtcagaggcactttcctttggtttgagcaatgcaggatttcaggtgagcaagtatatgccatttggaccagtggagactgttatgccatatctcctaagaagggctgaagagaatagaggaatgttggctgcttcgggctttgacaggcaactgatgaggaaggagttgggaaggagactaaaagctgctgtcttttaa

SEQ ID NO: 100805 - DNA, 741 bp, Glycine max
  Peptide Sequence Number=SeqID_217583
atgacacgaatgaagttggcctacgacgccgccaccacgccaatggcctgggattccgtcagaggagggctttcgttgagggagaggacaagggctagagaggaatactcttttagtgtttgtttcgccttcaggagcttgcggctcggggcaacaacttgtttattagggttttgttgttgttggtgtctggtggcaatcattgggaggcagcaaaagcgacgaaggaggagaggggaagtggatgccaccgtcgcgcgatgccggagcatggagaatgatgatgcgaacgacatggaaaaattggaaatggagaaaatgaatcactggaaccccagttatcatggaagacacacaacagtaactgctcctcagactgtaaattttcaacctaatgttgtcccttccgtcatagtagatgaattgaagtctttgacaaattattttggctcaaaatatttcattggtgagggtgcatatgggaaagtatatcaagaagtagtaatcaaaaagttagattctagtaatcagacaaaacaagaatttctttctcagactgtaaaagggaatatgcttttattcagtacttctgattcccatcttgtacaagtctccatcgtatcaaggctaaagcatgaaaatgttgttgagcttgttaactattatgtggatggttctttccgtgctcttgcctatgagtatgctcctaaaggatcccttcacaatattctacatggttag

SEQ ID NO: 100806 - DNA, 303 bp, Glycine max
  Peptide Sequence Number=SeqID_217584
atggcgacatatgctgcaatgaagcccacaaagctcagcttggaggagcctcgggagcagatccacaagacaagcggctcagtgttaagggaacctgtcaggatgcccactaaggctcttcatatcacttccaggaagtccctttgtggtgaagttttgaacatgcatgccctttgtataaggagtagttttgcaatatatctcttagtttgcaaggcagtggcttcgttaagggaaaccacaggagtcatagtgaaagcgagtcttcacaaggcaattgtctatggacccgaacttgggtga

SEQ ID NO: 100807 - DNA, 709 bp, Glycine max
  Peptide Sequence Number=SeqID_217585
gatgatatgacatcctacactttacagaaacaacacggtttcaaaaccaatttaggggatctccatgacctactcttcaagttttacatggtgttgggcatcgattatgaacatgatcaaacatacatggattgtgacatgctcgagagtgatgacagagggaatggagacaatgaggctgaaaaatcagttgggattaagggtgaagctaggaaagaacattttttagaggtaccattgccaaccaatatgggttcactcagggtggaaaaggataaagtggtggttggggatatctctggtggggcaaccctggatgatatggtggctgcaataaagcatttggggcaaaaaatggaaaacatggataatcataacaaaaggagacttgatgccatggaaaagactaacacaataatgctgaaggccatgtgcaacttggttaaacaagattacaatcagtcagccaaagatgttgtcaaggatgtggcaatgagtgggactcacaatacctccacctatgatgaaacattacgttgtagaaatcctaataaggcgatatccaaggcgactgtaaggtgtagaagaaagaaagcatatgggaaatgtaaagcatatttcaaaaatatagaaaccatcttcatcccaggggacgatgatgatgactttccaatgccgaaacataatgttgtgaaggcaaaattccagg

SEQ ID NO: 100808 - DNA, 351 bp, Glycine max
  Peptide Sequence Number=SeqID_217586
atgattaacgcggtggatcatctccgccgtttttttccaacgatcttgtttccttccccgacgacatccgcaacacgcaaaacccagtcgcgacccttcaactccgcgctggtcaccgccgccgtggtgccatcggtggtcgtgggatacggaaaagcgataatgcttttcgcggcggcgcgtgctgatcggagagaaaggaggaaggaaggagaaaatgaaacgccgccaccggaaatcccctccggcgacggtacacggtgcttcgcggcggaagatgttcccctttttctctctgctgcgtatcatgttacagggtcaattcccaatcattctgaattccagttttga

SEQ ID NO: 100809 - DNA, 251 bp, Glycine max
  Peptide Sequence Number=SeqID_217587
gagtttcacatttgcaccctagtcttcgtcatacatcagtcgttcatcgatgcatagcagttttggagtggagtagaaagagtggtgtcttcaatgttgaagtcacaacacaacaaacaaatgagattttgcaaactttggttttggatgatgagactatagaggtgaagaacactggatttggggatttttcatctgttcctattggcagaattagttacagatgcaaaagcaaagatggcaatagatga

SEQ ID NO: 100810 - DNA, 192 bp, Glycine max
  Peptide Sequence Number=SeqID_217588
atggtgatgctgggtttgggaaggcttgtagtgactctaaaatccaaaataaggtctttgaaactgaagaaaccttatgataagatggagaagagtgagagcatgagagtggaaataagaagcaggaaggccagaaagcttattgaagagaccctcaaaattgctgattcacctaataaaactcttcaataa

SEQ ID NO: 100811 - DNA, 1806 bp, Glycine max
  Peptide Sequence Number=SeqID_217589
atggctcaatctcggtacttgtttgcaatatcatgctttcagatgggtcttcttagtgaagctgaagcagcactgtgtcctgctaatgagcctagtgtagaggttccaaatggggcagctggtcattatctgttagggctgatttacagatacactgacagaaggaaaagtgccatacataattttaagcaggcactctcaatggatcctctaatgtgggctgcatatgaggagttgtgcatattaggtgctgctgaagatgcaactgcagtttttggtgaagcagctgctctttgcatacaaaaacaatacctacattgctcgacctcttctaagttgcattcatcagctgaggattgtaatatagttgacactagacactctgcctcagaagacacaagtcctaggcaactgaaactcatgcagagcatgaaggatattcctggaaatcatcatgggccatccattttaggaggaactgctcaaccaattaatagtggtgttgctccaccccctttgtgtaggaatgtgcagcctaatggccaaaatctgagctcacttaatgctgacacttctcctaagtcaacagtgaactctaccattcaagcccctcgaagaaagttcgtggatgaaggaaagttacggaagatttctggaagattgttttctgattctggtcctcgacgtagttcaagactctctagtgatgcaagtgtaaatgcaaacgctaatgcaactgctgtattgggaaatggaaccagtaactcttctaagtatcttggagggtcaaagctcagcactatggcatttcgttccatgacagttcgtaaagggcagtcatgggccaatgaaaatgctgatgaagggattcgtaatgatgttttagatgattctcgtttaaatgtcgcatcgactacttctagttcttcttctaccatggaagctaaatcttatgagcaagaaacagcaaattttccaattggtggacaaatagtgagtggttcaaaagtcatatctggtgcttcagaaatactgacaattctaagaatttttggtgaaggctgtagactttcctatttgtataggtgccaggatgcactggatacctatatgaaacttccacataagcattacaatactggttgggttctttcccaggtcggaaaagtgtactttgaattggttgattacttagaagctgagcaggcctttggccttgctcgtcagattatgccttatagtttggaaggaatggatgtatactcaacagtcctttataatggaatcaaatgctaccagagtgcgctcagggttgatgcaaggcattataatgcttggtatggacttggaatggtgtaccttcgccaagaaaagtttgagttctctgaacatcattttcgaatggctttccatatcaatccacgctcatctgttataatgtcataccttggtacagctttgcatgctttaaagagaagtgaggaagcgctgatggtaatggagaaggctattttagctgataagaaaaatccccttccaatgtatcagaaggcgaatatactcataagcttggaaaagtttgacgaggcattggaagtcctagaggagcttaaagagcatgctcctcgcgaaagtagtgtctatgctttgatgggcaggatctataaaaggcgtaacatgcacgagagagcaatgcttcattatggtatttctttagatttgaaaccatctgcaacagatgctgctgctatcaaggctgccattgagaaactgcatgtaccagatgagatggaagacaacttgtag

SEQ ID NO: 100812 - DNA, 258 bp, Glycine max
  Peptide Sequence Number=SeqID_217590
atggatcaagatgatgataatgatgctggaaatgatttggtatttgaagatgatgttggaccttgtggcctcagatatcttaagaagggggggggacaacccttcccttgtgttcaggaatcctttacaacaagagaccctcggtctcttaaccccttttcagaagtaaaagaaaagaagaagaaatctctcttggaagagacagattgtacaatgaagatcaatcataattccttatttgaatatgcaagcgtttga

SEQ ID NO: 100813 - DNA, 396 bp, Glycine max
  Peptide Sequence Number=SeqID_217591
atgtttttgaagattagttgttttatgttaagcaatccaaaccttaattatgcacaacaattttttgtcgaatgcaacatcaacactggttttttgcctccaagcttccaaatcatccctcaacatcagggtgttctttgtgtcagtatagatgatgcaagctccattggagcttgtaggcctaggatcttcttcatcaatggattcctttgcttcttggaagatgaatggcagcggaatggagaaagggagagagaaaggagacgccacttcaaggagaagatgagtctagaagaagctcaccaccataggaggtcatggataagagcttggaggaagaaggagatgaatgaagggagagggagagaagagcacgaaattttgtgctctaaatga

SEQ ID NO: 100814 - DNA, 324 bp, Glycine max
  Peptide Sequence Number=SeqID_217592
atggcaaggccacatgatatagttgtcccttacccagtacaatggattagaaacgagaagattacatgtatccttgctgatcagaacattggatgggcagttaagattgcagagaaaaagagaattagaatgcaagccttctgtcctgcatcagcagcacagttggtgttgggattgagcatcccaaagatgattgatactggatcacagacaaagatgtacgaggaaagcaatttaagcattccatggactcaaccaagatatgaaccacagacaggcaaaagcaaacattcaacgaagatgccacagcactacgcattatga

SEQ ID NO: 100815 - DNA, 876 bp, Glycine max
  Peptide Sequence Number=SeqID_217593
atgcaaaattatgtgtgtgaggaaaccattacagtagctactgcttcgaaagaccggacattgaggttatggaagctcaatgcagagggtcctgtaaataatcctatgagggttagggcttacaaaatctttcgtggtcataaatcttctgtaaattgtgttgcggcgcagacttctggagagatggtttgttcggcttcttgggattgcaccatcaatctatggcaaactaatgactttaatgcggaagatgacctagtgtctaaaaagagaaaaattggagctcaagttgaggagtcccaactagagggagaggcttttactacccttgttggccatacacagtgtgtgtctgctgtggtttggccacaacaggagtcaatttattctgcatcctgggatcattctattaggaaatgggatgttgagacaggaaaaaacttgacagatttatgcttactgtgctggagtaagtggaaccctgtcatgggcataactctgttttgtgggaaggttctcaactgccttgatattggtggggaaggttctgctctgatagctgctgggggttctgaccctgtcattaggatttgggatcctcgtaaaccaggcacttctgctcctgtttttcagttttcttctcatacgtcttggatttcggcttgcaaatggcatgatcagtcttggtttcatttactttctgcatcctatgatgggaaagttatgttgtgggatctgagaactgcgtggcctctttcagttattgaatcgcacagtgataaggtattgtctgctgattggtggaaaagtaacagtgttatcagtggtggagcagactcaaaactttgcatttcttcagaaattcctgtaaaatag

SEQ ID NO: 100816 - DNA, 303 bp, Glycine max
  Peptide Sequence Number=SeqID_217594
atgaacatgaacgaagagagtgttgaaggaagcgcgaggaggatccaagtgcgcttcgtgacaaagttaggcgagccgtacaaagttccgaccaccgccatcgctatccccgccgacctcgctcgattcggcctctcctcactcgtgaacgcactccttcaatccaatgacgctgatcatcagctggagccgtttgattttttgatcgatggcgagttcgttcggatgtcgctggagcagtttcttttggccaagggaatctctgcggtgttcggagtgaagtttcatggaatgggaatttag

SEQ ID NO: 100817 - DNA, 588 bp, Glycine max
  Peptide Sequence Number=SeqID_217595
atgtccaaatcttgtggatttgggatgaccggccctctcgatgagtcgatctcttgctttctcataagggtggacccttggttaccctcaccgttgagaggactacacgtcctcgccttgagaggactacacgtcctcaccatcagagggctgcacgtcctcaccttcagaggactacacgtcctcgccttgagagggttacacgccctcaccttgggactacacgtcctcgccttgagaggactacacatcagagggctgcacgccctcacctccagaggactacatgtccttgccttgagagggctacacgccttcaccttgggtactagttaccctcaccgtcagaggactacacgtcctcgccttgagaggactacacgtcctcagcatcagagggccgcacaccctcgccttcagaggacttcacgtcctcgccttcatagggctacatgccctcaccttctgagggcttcacgccctcgccatcagagaactgcacgtcctcgccatcagagggctgcacaccctcacctccagaggactacacatcctcgccttgagagggctgcacgccctcacctttag

SEQ ID NO: 100818 - DNA, 609 bp, Glycine max
  Peptide Sequence Number=SeqID_217596
atggaggagaagagcaagcgtggacatgaggaacattcgtgtactgaaagcccaacactcaacattgacccaccatcctcagtttcaagacacttgaagtggaagatcgcccgcacaaagcggcatgaccaaatgacgtctgaagtggcacaagaaattacagacaaaattgattcattacaggaacaagcaacacatgggagttttttttcgcatgggctacaggacatactcaacatggcctttggccgacctgagcatcaaggccatgttcgcgtcgcatggacaggtgtcacaataagccaatactttggccaagcctcacgtgcttctagcacattgtcaccatcgatcaaccaacaacaattggctaatatcatcggtggaattaaggatgacataaaaaagcagctacaagatgagataagaaatgaggtacaggatgagataagaaaggagtcagcccccattaaggcgctagaaatacaagctctacttgcacgtgttagcacaaagggtagctgcgctagacttgaaggaagcggattacttaaagagcttttgaatggtgatgacgatctgatgggcttgttcgtagttgttgggtaa

SEQ ID NO: 100819 - DNA, 741 bp, Glycine max
  Peptide Sequence Number=SeqID_217597
atggagcttcttgaggtcagtcatgaggaggctacattcgagacccgacaggctggtgggcctcatgtccggttggggtggcttcgagacttgtatcaaagcccgtgcaggactagacgatgggttgtagcagcccgcctctacacggcagctgggcggttatattacacttctccagcgcatacatccgtcgttcatgatgcttatgatgagggaagcccacgggcctgcaggtggcttacgggtaaggcttatattacggggatcaagggagccccgtatcggagacgtttagatgccctgagtgtgactgacgtgtgctggatgccctatggtgagcaccgacgagtcagggcctttgacttgatatcgtcgtacaccggccagctcagatggggtcagattgtggtgtacgttcgacctgagcgggttcttcgacagtttggctaccttcagacggtccctcttccaccggtttgtgattctttgacgggtgatgatatagatgaccggtggctgaattttccagaccatttggtgccttcaggggagctctgtgtagttcctggacaggtggtggcagactacatggagtggttttttcggatatcgcacccattcgtcacgcggaccgaggagactgctgcgccgagacatccgcctccccctcatcatgaggagttcatcgagccacccatccccgaggttttagtcatgaccgatctccctacgcattcagtg

SEQ ID NO: 100820 - DNA, 301 bp, Glycine max
  Peptide Sequence Number=SeqID_217598
aacgttttttggagctgggttgcttcctccagctcgcctgggcgagcgaaggtcgcctgggcgagctgggcggcaacctcctccccctttttcctatgaaaaggctgaagggggctgttctaaggatcccggagccccctggctatgtatttcagctgttttgggtgaaaaaaattgtttccgtgaagaaaatccaagccgaggtgcttccgtaacgcttccgagatgtttccgtaagcaaatccgtgaaggttttcgtctgttcttcatcgttcttcatccgttcttcgttcttcaacgg

SEQ ID NO: 100821 - DNA, 228 bp, Glycine max
  Peptide Sequence Number=SeqID_217599
atgtcaggacatcgtgtccgacatcgtggatcctgcagcttcacttctgcacttgacttttatcttgcattgtacagcaactccagtattctcgggcaggatcaactccagtattctcgggcaggatgtcaggacattgtatccgacatcgtggatcctgcaacttcaattcttcatttgacattttatcttgccttgtgcattgtgcagcccgatttcattccttga

SEQ ID NO: 100822 - DNA, 353 bp, Glycine max
  Peptide Sequence Number=SeqID_217600
atgaggggagcaccaacagaagaaagtctctcgcctttccttgtgagggatctaggcgcgcaaagtctcaaggtgatacaaagagtccacaaggcgtggagaagtccgttgaggaaagacaaggagcttagaggcatccaaaatggcgtcatcggtggttatcatggatggctaagagttcacacaagagggttagattggctctccaaattgaaagttatcaatgaggagaacttcgaagctttggaggaagatgaagaagtacaagctctaaaattagagctagggaaggcgagactcgccaaggagaagttcaaatcaaccgctacacacatccggaaagagtgcaccga

SEQ ID NO: 100823 - DNA, 385 bp, Glycine max
  Peptide Sequence Number=SeqID_217601
atggctccggataggatgcaactacagaacatgggcaaaaaggggtcgccaatggagtcgccaactgtcgcaacctacccttcggcgggagggcgaagcgtgactcacgggcgcgtgttccaagaaaggaatacgcgcggagtcgccaccaacgagttgtttttacacacggggaaggtattagcactccaagcactccaacctttgcctttcaacaacgtggaggagcttgccgcccagtggtcaaacgaaggtcgcatgccgacaaacaatggtcaccagacaaaattaggggtagctggagatattcatttcaagttcagggttcaatttgaaaatataattcagctcacaaagggtgcaaaggatacaattataattacag

SEQ ID NO: 100824 - DNA, 497 bp, Glycine max
  Peptide Sequence Number=SeqID_217602
gcgaggctcgcgggtgtgtcttccaaaggaggaaaatgcgcggagtcaccaccaacgtttatctgtggaaaacgtcggaaaaaccgaaggaaaccggtcatgaagaatattccagattcgggagttgtatttatgtttaaggaaggtattagcacctctcacgacgaatcaagcgattctttttacttggaaggaggtccttttaaggcattggaccttaaaattacccatttttacttggtgagaaaaactgagggaaaagagggagaagcttgccacctagctcgccctggcgagctagcccgccttctggaggaacttcctggaaggcccaacatgttacagaacttcacggattgtgcaacaatgctttcttttgacttccggcctgtcacggaacttcacggattgcctaacgataggtgccaagtacctcgaagcggtgaagcaaaacgttgccatgctaatcaaaccaatggtccccggacgacattggg

SEQ ID NO: 100825 - DNA, 342 bp, Glycine max
  Peptide Sequence Number=SeqID_217603
atgagcatcaacaagctgctggtcgcgatgtccctggctctggccctggccgcctgctcgaagcaggaagctgcccaggacgccgctgcttcggccaacgaagccgccaccgaagcccaggctgctgccgaccaggccgccgctgctggcgcccagaccgccgacgctgcccagcaggccgctgacaccgccgccaccgctgctgacgcttcggttgacgctgctgccagcaccgctgctgccgcgaccgacgctgctgctggcgaagccaaggacgctgccaaggctgccgaagctaccgctgagcaggccaaggacgctgctgaagaagccaagaagtaa

SEQ ID NO: 100826 - DNA, 387 bp, Glycine max
  Peptide Sequence Number=SeqID_217604
atggcgatagccgttgcttcgccaccgccgatgcacagggtggcaatgccgcgcttgccaccgtgcgtgcgcagggcgttgaccaaggtcaccaccaggcgtgcaccggaggcgccgatcggatggcccagtgcgcaggcaccgccattcacgttgagcttgtcatgcgggatgcccagttcgcgcatcggcgccatcgccaccacggcaaaggcttcgttgatttcaaacagatcgacctggtccagcgaccagccggtcttgtccagcagcttgtgcagcgcgccgatcggggcggtggtgaaccactccggttcctgcgagtgggtggcgtggccgacgatgcgggccagcggggtgatgccacgtgcggctgcgtcttcctcg

SEQ ID NO: 100827 - DNA, 450 bp, Glycine max
  Peptide Sequence Number=SeqID_217605
atgtgcagcggcgtcaagtggcggcatccttggcatgtctgcggcgttcgcggtggcgtctgcggcctagtccagtgcatgcagggtatcggcggcggcctgctcggaagcggcagcggtcttgtcggcagcgttgcgggtggcttcggcggccttgtccacggcgtcacagacggcagcgccggcgctgtcggcggcctgctgcgcgtcctgctgagcctgttcggcttccggacccatgcaggcggccagggccagcagcagggaggcggccagcagcgtggtggtgatcgggcgaatcttcatggcggtctccgctactgcaatggatggggacgccagcctattcatgccgttgtgaagacggggtcgcgatccgaggtgcgcgcgcaggcagcaggccaaagaaaaagccgctggcgaaccagcggcttttccggaacagcctga

SEQ ID NO: 100828 - DNA, 300 bp, Glycine max
  Peptide Sequence Number=SeqID_217606
atgcatactccagcaaaatatatgataattgagcagatcatgagcacacttagtgtgccaaaacccaagatccagttcttgttttggaggggaagttgtgtcaaacttaccgatggcaaaggaaataatgcatggtccaatcccacctgcatgtgcccacagccagccaacacaggcctaaaattaagatgccaagttgagtacttgttggggaaatgcattgctggggagaagtgcaacttgggggatgaagttgtggcatccaggctgttagtgttagaatcaccattccctaattaa

SEQ ID NO: 100829 - DNA, 681 bp, Glycine max
  Peptide Sequence Number=SeqID_217607
atggctcattccaactcttctcgcctaggcttcccagctttaatcatagccttgtgcaggacaaggagagttggatctgatgctcttacttcttataggagcctgaggccggtcatcaacttggcctatattaaaaggaaatgttggaatgtgaatgaccaaatagttaattttctaggggcaaggaaaaccaggtccacagcagctggtgttcctttttcttttgcaccagcagctgacatcccttcatcttctactttagattctaagttgcagagtttgtttgagggacagatgctcattatgctaatcatgagtgttgagcagctcattgagcaggtggcctggcccggagctcgaccttcttttgttagagataatgtaagctctagagcccaagcacctcagcagcaaaagctagagccagaaaacgaccaatcctctgaagccactattcttggagcctttgatgtttcagaaggtagatcagagatgagatccgataaggctgcttatcctgagctagtaccagtaccagctgatccaccatctctagtggtggatccatcttttcccgcgccagaagtagctctcccatctacacctattattatatctaatgatcctacagtgcgaacacctgaatggattcctactcctccagccacacctgagctttag

SEQ ID NO: 100830 - DNA, 417 bp, Glycine max
  Peptide Sequence Number=SeqID_217608
atgacaagcagagaccaagtttggtcattctgcacccctgatacgcggagataccttacggttattcgcacccttttgccattcagacacagtcgggtccgatggcaagcagagaccaagtttggtcattctgcacccatgatacgcggagataccttacggttatccgcacccttttgtcatccagaggcggcgggcccgatgacaagcagagaccaagtttggtcattctgcacccatgatacgcggagataccttatggggctgacacagccttttgcaccttttgttcctccgggaacaacaaagtcatttacatgcggaaatttcatggtcgcccgcgactctcgtcaaccgagaggagcgaaattagtgccatacactgattttcggggacctttgcttgatgacatgtga

SEQ ID NO: 100831 - DNA, 150 bp, Glycine max
  Peptide Sequence Number=SeqID_217609
atggacaaggattttactcttcattttaaccaatggtcctctaatcttaaggaaggattagaccaaacatacctacgtgaggtggcgaaggagaagaagcacagacttctgacgatgctcgagtgcgacgaacacgatgctcgaccttag

SEQ ID NO: 100832 - DNA, 357 bp, Glycine max
  Peptide Sequence Number=SeqID_217610
atgggacaaaaaggattgatcgcgaaaaaagatttcttgttcttattagaagatcgtgattggatccacatatgtttgagtggcagtaagggtgacttatctgtcaacttttccactattacacccaaaaaaccaaactctgctttacgtaaagttgccagagtacgcttaacctctggatttgaaattactgcttatatacccggtattggccataatttacaagaacattctgtagtcttagtaagaggggggagggttaaagatttacccggtgtgagatatcacattgttcgaggaaccctagatgctgtcggagtaaaggatcgtcaacaagggcgttctagtgcgttgtag

SEQ ID NO: 100833 - DNA, 363 bp, Glycine max
  Peptide Sequence Number=SeqID_217611
atggaggaagctgctaaatctggaagcactaacactgtcattgatcctccatctcccatcatacgacacgtgaagtggaagatggcctgtaccgagaaaactgggcaaatgacttctcatgtagctaaggaaattgttgacaagattatttcttggaggagcaggtctcacagggttcctttgtcgcccatggacgtcaggatatacaaactgctgccattgggtgaccagaacaccctgatcatatgcatgttgctgggccggtgtcatgatcaagcaatacttaggaatggctccaagtacctccttcacgtcttcatccatggctctcgaagacctggagaagctaatgcaaaaaagtag

SEQ ID NO: 100834 - DNA, 225 bp, Glycine max
  Peptide Sequence Number=SeqID_217612
aaggttgctgcaactggtgtctcgctaagccaggcaaatgcgcttagcaagcggtatctgctaagcgagacatcagtgcgcttagcgagtcaagggaatctggaagagaatctgccatgcatgcacgcgcctagcgcgccatcagcttgcccaacgagtattttgtctcttcctgcgctcagcgcgcctggctcactaagccaaaaatcactaactcgcgcttag

SEQ ID NO: 100835 - DNA, 219 bp, Glycine max
  Peptide Sequence Number=SeqID_217613
atgttgctaaatgtttcagatgttgtcgacaagtatgaggtaatagttagagacaggacaaagcaggggaacaggcagagcatggatggagctatcaacacaatattgtcaagaaagttcaacttattagggcactacgaacatactctgggcattgaaaactggtttgtccctcgaacattttccgcaccatatggtcccacattcttagatgcctaa

SEQ ID NO: 100836 - DNA, 285 bp, Glycine max
  Peptide Sequence Number=SeqID_217614
atgaccactcttacacagatatggatgacgttgctacttagcaacattccacccgacgaccacaatgccgatctccctcctgcgaaagtatcagttggtctgtgccatcgtgacatagggatcacacccacaaggcacccagtggacccaaagaagtccaacagggccctggggtttccagctctggttacgggcctctgtcagtcctacagggcgcccgcccccccagcaagttcatgccatcgtgacataggtaagtatgcacatctctcaactgatttctga

SEQ ID NO: 100837 - DNA, 318 bp, Glycine max
  Peptide Sequence Number=SeqID_217615
atggagaacccaaagagacattgcaaggctattatctccaccatagagtgtgacatgagaggtgaagaagaagaagaggtaaaacaaagcaccatgctagaggaagagatgaaagcacaagccaacccttcaacccaagagatactacaaggcaagaaggaggaaccacctattgaaaaactcaaatggaacttgctatataaaaagcaaagcttcaagaattattttgatgatgccaaggaatttcaaagatcattcaagatgaatttcaaggatgaagaaagcaacatgtcaagcaaagcaaagatctcaagataa

SEQ ID NO: 100838 - DNA, 825 bp, Glycine max
  Peptide Sequence Number=SeqID_217616
atggagaatcacattgacctagccttggtcaaagagttctactcaaacctctatgacccagaggatcactcccccatgcaatggaaggtgcgggggaagatgatcaaatttgatgccgccattctaaacaccttcctggagacactggtggtactagatcctggggagagaaaggacctgactaccctcactcagacatggagtgtcctttcctactccaacctcgctcctacttctcatacctatgaccttaacatggacagagcaagtccctcagcccggccatcaatttggcatatatgctggaacccagaggatccttccatcacattccctgggtcccgcaaggccaaggcccgggctccttcagacgctctagttcctccacctcccacacctatttcagctccaaccggccccttcgtacctagcagtgctgctatcgtgcccatgctacaaagcattcatcacgaccttttcctggtcatgcagagtatgcagaatttatctcagcagcggctgatcatgagcatggaggacttcttggcacaggtagcttggtctggagtccagccttccttttgggggggtgaggctcttgtggcccaggagccacaaacacaggccgctgaagacactccagaggctggggaggctaaggataccccaaaggcagaggcagaggctcaggacacaccagtggaggctgctgaggaaggagtttcaggcgcagcaaaggcagatattgacgatgattatgtagtagccgtcactacggcacaggggacttgggatccatggctcactccagctcaggattattga

SEQ ID NO: 100839 - DNA, 2652 bp, Glycine max
  Peptide Sequence Number=SeqID_217617
atgcatgcaacattgcaggcaggaagaagagcagaaactatcattctccccttagaacttctaaggcatgtaaaaccttcagaattcagcgattccaatgagtaccacatgtggcaaaagaggcagctcagagttcttgaagtagggctcctcacacacccttcaatccctctagacaaagccaccacctttgccatgcgccttcgcgacatcatacgcagtggcgagtccaagattatagacaccagcaaaaactccgacaccttgagaaccctttccaactcggtggtttccttggcatggagaagttccaacagtacccccactgatgtttgccactgggctgatggattccctttgaacattcacctctactcttctcttcttcaagccattttcgacaatagggatgacacattagtccttgatgaggttgatgagcttcttgagctgatgaagaagacatggtccatattggggatcactaggcctattcacaatgtgtgctttacttgggtgttgtttcaacagtatgtggcaactgggcaaatagaacctgatcttctatgtgccacacaggccatgttgagtgaggtggctattgatgcaaagcgggaaagggaatcgttctatgtgaagctcttgacatcagtgctgagttcaattcagcgttgggctgagaagagactcattgattatcatgagcatttccagagagggaatattggccaaattgaaaatgttcttcctgtggtgttgtctgtcacaatgattctaggtgaagatctcgtaatatctgatggtggggaaggggttgagaagcgagatataactatagtggactcatctgggtataggattgactattatattcgatctaccataaaaaatgcatttgaaaaggtaattgaggcagcgaatgccaaggctggtgaattggaaataaagggagaattcagtgaatttctgcttcaattagctcaggagacagaagagttggcaatgaaggaaagagagaattttactccaatgctaaagaaatggcatccagcaccaggtgcagttgcagcattgatgttgcacagctgctatgggcatgtgctgaggcaatatttaggtgacgtgacctcactcactcatgagacagttgaggtgttgcatagggctgaaaaggtagaaaaggttttgctccaaatggtggttgaggaggactgtggtgagggtgaggataatgacaaaacagttatgagagagatggttccttatgaagttgattcaatcatattgaatctcatgagaaaatggataaatgaggcattgagcaatggaaaagagtgtttgcaaagagcaaaagaaactgaaacatggaatccaaagtccaaatcagagcaatatgcgccatcagccgcagagttagtgcaattggctaagacaactgtggaagaattctttcaaattcccgtaggaaaaactgaagatatagttcaagaacttgctgatggattggaaagtctcttccaggactacatgatgttcgttgcagcatgtggtacaaagcagagctatattccttcacttcccccgttgacaagatgcaaccgtgactcaaagttgatcaagttgtggaagaaagctagcccttgtggtgctaatatctcagagctagaacacatccatgaaggtcataatcctaggccatcaactagccgtggcacccagcgcctctatgttcgtctcaacaccttacactatctcctctctaacatcaacacccttgaaaaatcactctcccacacccctggtgtagtcccttcttcaagccgcaaacatagcggtccctatcttgaaatagtcaattcctccatcccagcagcatgtcaacatgtctcagaagttgcagcataccgtctcatattccttgactccaattcagtcttctatggcagcctctatgttggtgacgtagccaactctcgcattaggccagcgctgaggatcctcaagcaaaacatcacgctgatgactacacttgtggcagatagagctcaagcacttgcaatgaaggaagtgatgaaggcatcctttgatgcattcctcatggttttgcttgcaggtggaagctcaagggtgtttaacaggtctgatcatgtgatgatccaagaggacttcgagagcttgaatcgcgttttctgcacgtgtggggagggactaatagcagagaatttggttgagagagaggctgcggtggtagaaggtgtcattgcattgatggggcaatacactgaacagttggtggaagatttcagcattgccacatgtgaaacaagtgggattggagtcatgggtaatggcctcaaattgcctatgccacctaccacgggaaggtggaataggtcagatccaaacacaatactgagggtgctgtgcagtagaaatgacagagctgcaaatcatttcttgaagaggacattccagttagcaaagagaagagatatactattggcaatgatgcatattgttgccctgcaattcttgccttgtgacacggagggggagcagggttctatatttgaaagcacacaaagtggttgccaaatggagaaatatgggacgaagaaagcaatgcttatgtcattaagcattgaaacataa

SEQ ID NO: 100840 - DNA, 231 bp, Glycine max
  Peptide Sequence Number=SeqID_217618
atggtggtcagatctaagatttggaagatgacagggaagcatacagtagtaggagacaaagagcagatggtgccattagcagaagtccaagcacaaacagatcaaatacaagcaaagggggtacaaacagcaacaaacaagagaagaatggtgaggcctgcttaccttagtgacttcaggatcgtgcaggagcattgtgtgcaggatggaagattcgatgctggcttttaa

SEQ ID NO: 100841 - DNA, 462 bp, Glycine max
  Peptide Sequence Number=SeqID_217619
atgatgatcaattatatattcaaggaaataaaattttcaaggacaaaaactctcatagacaatttgtcaaacaactcgtgggaaaagaaagccttctacgacgttggttttatgatggttgtacaaaaatcgatgtcgtttggcggcaaagcaggaaatgcggctgtagttgatgaggatgaggttgttggagttggtgaaggcgacggggtggacttgaacgagttcaatggaggaaacgagaggagaatcagtgacgaagccgtagaagcagagattgagggaggaggaggtgttggggagagaggcgaagaggttgcaataagtgcttttgtgggcaatggaatctcgccaaggagcgcattagttgaagatgacggtggaggagagtgtgacgttgaaggagggaggactgaacttggaatacataaaagagctaatcaacttcatttcatcccttga

SEQ ID NO: 100842 - DNA, 183 bp, Glycine max
  Peptide Sequence Number=SeqID_217620
atgtggctgaaaggggtgcagactcctgtggttctgtttggaaatcgcgatgaacacgctaagcacgcctctaagcgccctactgcgctaagctcaactctctcactggacggcacagacaaactgatacttccgcagggggagatcaacattgtggtcgctggacggaatgttgctaagtag

SEQ ID NO: 100843 - DNA, 1725 bp, Glycine max
  Peptide Sequence Number=SeqID_217621
atggaaaaaaaagcaacactcgtctctgctgtttctcttattctcgtagtgggcgttgccctaggcgttgttgcttatgtctccaccaacaacagcggaagcgacaacagtgaaagcaacgacagcggtcaagtttcgacccatactaaagccgtgcaagccgtgtgccaaaactccgacgacaagaagttttgctccgacactttaagctccgtcaacacctcggacccaacggcttacgttaaaaccgttttgaaaaaaacgatggacggcgtcatcaaagccttcaacctcagcgacacactcaccgtcgaacacagcaagaccaactcctccgtcaagatggccctggaggactgcaaggacttgttagacttcgccatcgacgaattgcaagcctcgcaagtcctagtcaaagacaacaacgtcaacaacatcaacgacggcgtctccgacctcaaaaactggattggcgccgttgtcgcgtaccagcaatcgtgccttgacgggttcgacaccgacgccgagaaggaggtgcagtccaagctccaaaccgggggcttggactctatggggaagctaaccgcgttagcgctggacgttatttccagcttcgcagaattattatccggtttcaacttgaacttgacgacgtcggtaaaaccaccaacgtcgtcatctcgtcgtcttcttgacgtggatcaggatggatatccatcttggatatccatgcctgatcgcaagctcttggcggatgccaagaaaggcgattcggttcctcccaatgccgttgttgccaaggatgggagtggccaatataagactgttttggatgctattaactcctatcccaagaatcacaaaggcaggtatgttatttacgtcaaggctggtgtctacgacgagtacatcaccgttgacaagaagaagcccaatattttaatttacggtgatggccccaccaagaccattatcacaggtagtaaaaacatgaaggatggcgtgaagacaatgagaactgctaccttcgcgacggttgcagaagatttcatagcaaagtcaatggcatttgagaacactgctggtgcaagagggcaccaagcagtggcgcttcgcgtgcaaggtgaccgttcggccttcttcgactgtgccatacatggttaccaggacacactatacgcccacgctcatcgtcagttctaccgtaactgcgaaatctccggcacagtggacttcattttcggctacgggacaaccttgatccaaagctccaaactcatagtgaggaagcctgacccgaatcaacagaacatagtggtggccgatggcacggaccagaagaacatgccgacaggagtggtgcttcagaactgcgagatcataccggaggcggcgctggtccccgacaagatgaagttcagatcatacttggcgaggccatggaaggcatattcaagggccatcttgatggagaacaccattggtgattttattcagccagatgggtttcttccatggaatggcaacctgtatcttgacacgtgtttctttgccgagtatgccaacaccggcatgggtgccgatactcaacgtagggttaagtggagtcgtggagtccttaacaaggccgatgccaccaaatacactgctgaccaatggctccaagccaacacgtggttacccgccaccggcattcctttcgatcttggcctcactaaagcttga

SEQ ID NO: 100844 - DNA, 306 bp, Glycine max
  Peptide Sequence Number=SeqID_217622
atgcacataggaggcattgatcccaagagaagaaaacgggctaactcgacaatgtcatttggcaattctgttagagaagagaggggtctcaagcttcatcgttcatctcaccatgaagcttgctccaccactatggtgcctcttccgcaccaccaccaccgtcgtcgttcccgtggcggcctcacgtcacgacgccatgcatcaatggcgcctgagaggaacaccaccctccgtggtggcttctcctattgcgacaccatttggggagctaggtcatctagggttgtttcaaccctgatgccttaa

SEQ ID NO: 100845 - DNA, 1497 bp, Glycine max
  Peptide Sequence Number=SeqID_217623
atgactttgccggaaaattatctagagttcaccattgctaataatttgatcttgaagaagggacgcttttggttaccgcgggatcttctgataattcctgccctccttgagcagtatcatgctacgcctactggaggccacaaaggggttgcgaagacaattgctcgtctctccgagaacttccagtggccaggactccgggaagttgtcgccaaattcatagaaaattgcattgaatgccaatacaccaagtatgagaccaagaggcctgttggattgttgtgtcctttgcccgtgccttcgcgaccatgggaggatctctccctggattttattaccaacctattggtatatcatgggaagacagtaatcctcatcgttgtcgatagattttccaaaggtattcacttgggtctcctcccttcagctcatacgacacacatggtggcaactctattcgtagacatcgtcgtcaagcttcatggaatccctcagagtttagtctccgatagagacccattatttttcagtcacttctggcaagacctctttcagttgagtggcacaaagtggggaaagctgctactgtgggtcgaatggtcccacaatacctcgtggaacatggggactgggtcaacaccatacgaaattacttttggacgcaaaccttttaatttttcggaatacctcttgggttcttcaaacattgatgccgtcgacgatatgttgactcacagagacgaagtatttcacaacattcggaagaagcttcttaaagctcaagccactatgaagcatcaagctgacagcagacgcagggaagtcatatatcaacctggagactgggttcttctgaagctcaggccatatcgtcagcagtctgctaaagagaaacacaaagtttatggcaagttagttaaatgctactatgggcctttccagatactagagcgagtcggacctgtagcttgtcgtttgaagcttcctgaaggggcccttatccattcggtattccattgctctttgttgaagcctttccatgttcaaccggatgcagcaagtctgcctgaattccttgagcaatttttcaaggaccaacctgtaattttcccattagccgttttgaattaccgccaatcgtccacaactgaggatggacctcgggaagtattggttcaatggtgtggattatcaccagatgaaacatcttgggagaattgggatcaactgaagagggaccatcaccttgaggacaagcaagagctaaaagaagaatcacgaaaccttcatacctcagggactatatctgaggaagaaggcgctgagctagcaatagagatttgttggatatcattgtctgctgctaaggtcctaacagaaaggggaatattcctagtaatggcagacaagatcaagggctattcccttgatatccagctcaacaatatccaactcagcaggtaccaacagcaagcatcaacaggcactaatggctag

SEQ ID NO: 100846 - DNA, 1686 bp, Glycine max
  Peptide Sequence Number=SeqID_217624
atgaaaggtaaagtactaggatccactgtttctcttatcctagtggtgggtgtcgtaattggcgtggttgctgtagttcaaagtccaaagggcgtcaacaacagcaatggaggagaagtgaaaagcaccaacagggcagtgacagcgttgtgccaaggctcagacgacaagaaactgtgccacgatgttctgtcctcttcaaacagcacagacccaaaggaatacatcgcaaccgtggtgagaagctcgatggacagtgttatcaaagcattgaatatgagcgacaggctgacggtggaacacggcaacagcagcgccggaatgaagatggctctggaggattgcaaggacttgttgcagtccgcaatgcacgacctggaggcctcaggcgtcttggttaaagagagcagcctccaggacgtgcaccagcggaccgccgagctcaagaactggttgggagctgttgttgcctaccagcaatcttgcctcgacggcttcgacaccgacggcgagaagaaggttcaggagcagctacaatctggtagccttgacaacgttggaaagctcacaggcttggcactcgatgtcgtgtcagggattacacacattctccagtccttggacttggaccttgctctcaagcccgcctctcgtcgccttcttgacgttgatgatgatggcttccccacttgggtctcctctgctgatcgcaagctcttggccaacgatcctgttttgccccatgctactgttgctaaggatggtagtggtcaatttcatactgttttggacgctattaactcctaccccaagcatcaccagggtagatatgttatctacgttaaggctggtatctatgatgagtacatcaccgttgacaagaagaagcccaatcttctcatctacggtgatggcccctcaaagaccatcatcactggccgcaagaactttcacgagggtaccaagacaatgagaaccgccaccttctctactgttgctgaagatttcatggccaagtcaattgcattcgagaacaccgctggtgcagaaggacaccaagcagtggcactccgcgtgcaaggtgatcgttcagtgttctttgattgcgctatgcgtggttaccaagacacattgtatgcccacgcccatcgtcagttctaccgcaactgcgaaatctctggaacaattgacttcatcttcggctactccaccaccttgatccagaactcaaagatcttggtgaggaaacccatgccaaatcaacagaatatagtggtggctgatggcacaggccagaagaacatgcccactggagtagtcctccaaaactgcgagatcatgcctgacgcttccctcttcgctgaccgcatgatcgtgaagacttacttggccaggccatggaaggcattctcaagggcagtgttcatcgagaatgttatgggcgacttgattcagcccgagggttatattccatggaacccaattgagccaaacacacaggattgttacttcgccgagtttggcaacactggaccaggttccgttactcaagcaagagctaagtttgccaaaggtctcatcagcaagcaagaggctgcaaaattcactgctgagccttggctcacaactagcacttggttgccttccgctgccgttcccttcgatcctagcttcaccaaagcttaa

SEQ ID NO: 100847 - DNA, 675 bp, Glycine max
  Peptide Sequence Number=SeqID_217625
atgacccccacgctagtactagaggtgtccgtttccaccgtgaagggtcaacttcaggtgccggagatgttcatcaaaggaggggctgtaaataagaatattgtcgaagaagacgataacaaaatggcaaagataaggctggaatatgagattcatggtggcctgaaaggacgacgagccattacacagcccaaacgacatgaccttgaactcataatggccatggtggctttgagaagcattgtgcaccaccgagctcgtccaagagataagaaggctcagatcattgtcatcagaaataagaaagaaaaccctagcggggcacttgtggcctctgtggaacttttcgtcacaagtgaaacagagacccttctcgtggcgtatggcaatttcgtctggagaaaggcgtttcagggtgggagggttggtacggggttatggcggaagcaaggggggaaggttcgaagggttagggttgagggtggcagtggtggggtgaaaaggcgaaggagaagggtgcggtggaggtgtgcggtgacgcaaatgaggccgctggtcaagaaacttctcttcgtgcaggcgtgccagccttgcagcctgaaccatggtcactggttgttgcgcctggacctcacaacgaacatcgggagagagtccagaaataaagtagcttag

SEQ ID NO: 100848 - DNA, 558 bp, Glycine max
  Peptide Sequence Number=SeqID_217626
atgacgtcattgtcaatttgccacctcgtatcatctgtcaacaagaaaacatgcatgacactagcaggccttaagaaacattggagacatgtcagcgttcttggattgtgcaatgcacggttaccaatacacattacgagccagacgaacatggccacagggattgtgatccagaactgcgacatagtcccggaggaggctctgtaccgtgctaggtttaaagtgaaatcgtacttggggaggctgtggaagcgttactcaagaacagtcgttatggaatcgaacattggtgactttattcggccagaagggtggagtgcttgggatgggaaccagaatcttggcacgttgtactatgctgagtacgctaatgttggagcaggtgctaactttacagaaagagttaattggaagggttaccattgtaatattagtgtggatgaagctgcgaaattcactgctgagcaatttcttagagctggacctactggaagagctgattggttaaaagctacgggcattcctttattccctagtttcatcagcaccagaccttga

SEQ ID NO: 100849 - DNA, 405 bp, Glycine max
  Peptide Sequence Number=SeqID_217627
atgacacactttgatggcctctatctcttttcttcatatgttctagtgggaaagcataaaccaaagagggtggagagtgtcaatgctgatgcagaagcctttggtgatcactgggaaagttcagattgctctatgcattctgaagctgaagcactagaacatatgaagaaaagagatagaggccatcaaagtgtgtcattggagaataagacaggagattcaactgtgctgaagataggagattcggctaaagttgtgataaaacaagacatgaagggaggagagtataaatatgggtttaacaacaataaacgtgagaaggcagagaaggtaagggtggtggatgatgaaactggtgaacatgagctgtatgaagtcctaaggatgccatctagatgtgtatga

SEQ ID NO: 100850 - DNA, 204 bp, Glycine max
  Peptide Sequence Number=SeqID_217628
atgcggatcaatagggtcccaatctcccccgacccaacagtatgttctgagtcaggttcagcactgcttggttccaataactttgaccattatgtacaattgctgacaacactagaggcagaatcacctgtctgttttgcgttatcagattcagaatgtgctcattgttccatagcaaatgtgttgtttcagccacctgaataa

SEQ ID NO: 100851 - DNA, 642 bp, Glycine max
  Peptide Sequence Number=SeqID_217629
atgtcatctcaaggacactttgtgcagtttgatggtcattatgaccattggagcatgttgatagagaatttcctgcactctaaaaagtattggcatgttgttgaaagtggtgttgaaacacctaatgctgatgtagcacttacagaaacacaacaaaaggagttggagggaatgaagttgaaagatttaaaggcaaaaaattacttgttccaggccattgatcgctctatcttggaaacaattcttggcaaagaaacttccaaagatatttgggattcaatgaagaaaaaatatcaaggctctaatagaacaaagcgtgcacagcttcaagccttgagaaaggaattggaaatgttacacatgaagagtgatgaatcggtaaccaactattttgcaagaaccatgacaattgcaaataaaatgcaattccatggtgaaaacatggaagatgttgttatagctgagaagatcttaagttccatggcaccaaagtacaactatgttgtgtgttccattgaagaatccgaagatgttgatacactctcccttgacaagctccaaagttctttgttggttcatgagcagaagatgaatcaagatacaattacagaagagcaagctttgaaggcatctacctcttga

SEQ ID NO: 100852 - DNA, 929 bp, Glycine max
  Peptide Sequence Number=SeqID_217630
atgatatttttctttatgcaatgggtggaaactacactcttggaaacttcaaggaacgataccacttcaggaaacagacatgcagatgatgaaaaccttgttgttgttgcaggggacagtgaatcggatgttgttgaaggagaatcagtcacactcacacatggtcgagcggtttcaaagagtgcattgcatgttttgagtgatctaggaaacttgagagggaggcatagtgtaattgagattagagatgaagggtatgattccattagaaggacggtttcaatggaccattcgtttcaaaggggtagtggtttttcaattgttgatgttctgcatgtgaatgaagagcatgaagggtgttctaatggggttggtcctccaaagaattcaagaggttttcatgagtttgtgacggaggttcttatgttgagcctactgcacgattctaatcttgtcaagttaattggctactgcactgatggagatcaaaggcttttggtttacgaagttgtgtccataaaatggcgaagaccattgttcgacaatgagatagagatggcagtttcatttattcaaaaagtggaggggctcagaattacacctttgattagtgaccactgggtgtgggaacctgacccaactgggcagtactcggttaagagcgcatacaatgtgcttagacagcatgtacctgtggaggcccaggggaagaagcaaattgacctgcaggattacttatgtcccttttgtagaagtgtggaggagagcgcaacacatctattttttcactgccggaaaataattccggtttggtgggaatcgttgtcatgggtgaatttggtgaatgtcttcctatatcacccaagacaacattttattcagcatgtgtctcaaatcattgaaggaatggctgcgtctagatggaaagg

SEQ ID NO: 100853 - DNA, 147 bp, Glycine max
  Peptide Sequence Number=SeqID_217631
atggatgagaggaagggtgagaggaaggcaagtttgaagggagacatgaaaggatcagaaatcgacgacgggaatgagtgggtcgctgaagaagggaggccacagctacagcctacaagcatgtcaagatggagcacagtgtcgtag

SEQ ID NO: 100854 - DNA, 300 bp, Glycine max
  Peptide Sequence Number=SeqID_217632
atggagagcaggggaagcaggcaaactgcagagtgcaagcgccggcaatatgtccacactgagatgagaggagcaaactgggagacacgtggcattggccaacagggtttaaaatggaggggtgaaaagaccataaaactgggaaatgggccatgtgtcaaaagtttaggcatgggcaaaataggatgcacgacaatcgtagaatcggtaaatttcaacccacatattagatatttcctccttttgggagggtatgatagtaagcctgaatcagtgaggcacggatttggattagactga

SEQ ID NO: 100855 - DNA, 1803 bp, Glycine max
  Peptide Sequence Number=SeqID_217633
atggtgacaggacttcccccaattgcagccccttcccaactgtgtgagtattgtgttgttagcaaacaacattgttctcaatttcctaaaaacaagtcatggagagcaaaggatgttctggagttggtacattcagatatatgcgggccaataaacaaatctgaaacatttactgcattcaagttttttaaagctcatgttgaaaatgaggctggaaaaaatatcaagacccttcctacagatcgtggtggtgaatattgctcaaaggtttttgaaaacttttgtgcagagcatggcatacgaagggaactcacaacagcctatacaccacaacaaaacggtctatcagagaggaagaataggacaattctaaacatggtgaggagcttaatgacacgaggaagggttccaaagaatatttggccagaagtcgtaaattggagtgttcatattttgaatagaagcccaacatttgctattcaaaacatgactcctgaagaagcttggagtgggagaaaaccagatgtgaatcacttcaaaaaatttggatgcattgcctttgcccatgttccagatcagaaaagaaagaaacttgatggcaaagctgaaaaatgtgtgtttattggtaaaacacttgggattagaataggcaacaacctacctaagtatttcttgatgaaaatgatgagaaaggacaaacttcagcctctagtacatttgaaagaattgctccaacagttattgaaacttctccatcaaacagtgacaatgaagaagaactacctccccgtattagaaaaaggccagcttggatggatgactttctttgccatcaaagaagagaagtggcgaaaagcaatgaatgatgaaattgatgccattgaaagaaatgatacttgggagctgtgtgatcttcctaaagaacacaaaaccattggtgtaaaatgggttttaaaaacaaagtggaaggaaaatgttgcaagacatgacacaatcaaattgatgattgctttagcggcacaaaattcatggcccattttccaactagatgttaaatcagcattcttacatggatacttgaaggagcaagtctttattgaacaaccactgggttatgtcaagattggaagtgagtataaagtttacatattaaaaaaggccttgtacgagctgaaacaagccccacaggcatggtatagtcgcattgaagcttattttcttaaagctggtttcacaaaatatccttatgagcacacactctttgttaaaagtggagataaagactttaagaaatccatgatggatgagtttgaaatgacttatcttggtatgatgcattactttcttggaatagaagtgaatcaaacaactgatgaaatctttatttgtcaaaagaaatatatgggagaagttttggataggtttcagatgaaggattgcaatccagcaaacacaccatcagagtttagtttaaagcttcacaaggatcttgaaggaaataagggtgaaaaatccaatttattgggtttcattgacagtgattatgcaggagatcaagatgatagaaagagtacttctggttatatctttatgttgggaaccggtgtcatttcatggttatctaagaagcgaccaatagttactttgtcaagcacaaaagctgaatttgttgctgctacaacttgtgcttgtcaagccatttggttaaggagaattcttaaagaactaaagttcaaacaactagggaacgaagcaatgatggcaccattgatcaacagtattgtaaaagcaaggatcaaatag

SEQ ID NO: 100856 - DNA, 108 bp, Glycine max
  Peptide Sequence Number=SeqID_217634
gattgacattctcacccggggtcaaggtttatggtgagtcaggattttggctcaagacttgtagaatggataggcatggtacatgtcagggtttggtttggttcaagg

SEQ ID NO: 100857 - DNA, 260 bp, Glycine max
  Peptide Sequence Number=SeqID_217635
gatttacacgcaattctcctcaaatttcagtcagcccgcatcaattagaccttgcaccttacgcttcagagccctaccatgctcaatggaacgccccggggcttcttcgtgacaagcacacgttgcgttcgagtcgtattctcggagaaatggaggttgatgaaccttggctagggttatggctaccattgaattatcaagtagatatgggagcaagtggtgttcgtcattggaagtgcggtagacagactttgtggtag

SEQ ID NO: 100858 - DNA, 402 bp, Glycine max
  Peptide Sequence Number=SeqID_217636
atggaggccatgaaagagcaaatggccacaataatggaggccatgatgagcatgaagaagataatggaagccaatgcggttgcagttgccgctaccggcgttgttgctaaggtgaaccgatgcccccaggcgagccaggttgcttcctccagaagcaacagccttctggaggaatattctggaaggcccaacacctcacaaggaccaaagaaaggtcgcatgtcatcaagcaaaggtccccggacgaaattagggtatgacaggagtcaagaacttcgtcgatggctagccaaggccaaagcaatggcggacacctactccacccctgaggagatcaatggacttctcagctattgtcagcatatgattgatgcaattctatcccgtaagggcattgggtag

SEQ ID NO: 100859 - DNA, 543 bp, Glycine max
  Peptide Sequence Number=SeqID_217637
atgagcgttcacgtggcccagttgattgatgatgccatttatttgtttgcaagattggcgcctactaggcatcctttagacctagagaagtccaaaagggccctagggttttcggctctgatcagaggcctctgtcagtcctacggagttcctgtcacccccagcaaggtaattcgaccgccgatcacccgagccttcatcgggaagtactgcacgcctaggcaagtgcagggtgacgcacatcaggccacgggcgcatcgccaccacctcggcaggccgatccggctgggccactgggcgtggagcgttatctacaacatttggttcgccagcaggcagccaaccaccgtggacagggttccgccccttttgtatgccctaccccgaagcaatttggggctgaggtcacatggcctggagactggcccgatgcccaggcaggggaggaccctacaggatcccccggtaaggcggatgagtcccatatggatgaagatatgacgaacctgctcggtttcttgggagggagtggagccacatga

SEQ ID NO: 100860 - DNA, 165 bp, Glycine max
  Peptide Sequence Number=SeqID_217638
atgacaaacctgtggctaagcgagggctgtctcgctaagcccagtgttgctcgcgctaagcgccgtccccgtgggctaagtgctattcattgtggcatgcataaggccaagccagcgctgcttgctaagccattgtttgaaataaaagtgctccaagctaagtga

SEQ ID NO: 100861 - DNA, 246 bp, Glycine max
  Peptide Sequence Number=SeqID_217639
atggtggtccaggacacagaatctggttggggaatttcatcaaacactcggcgcgcggagtccaagttgccagccttggcatgcgcggagagaatggtgttccatgagaaggcgatgggcgtcagaggaggagccggttttgacgtagaggttgaggaggttgtttgtgaggaagacgccgaggtagcgaaggccgtgtttgatgattcgagcgtgaatgcatcttccgatgaatgggtctcgtga

SEQ ID NO: 100862 - DNA, 1236 bp, Glycine max
  Peptide Sequence Number=SeqID_217640
atgtatgcaaagtgtggtgattctgttatggcaaaggttgtttttgaccggatgaggctgaaggatacatctacttggaatactatgatttctatgcatatgcagttttgtcaatttgaccttgcacttgcactctttgatcaaatgactgacccggatattgtctcttggaattccatcatcactgggtactgtcatcagggatatgacatcagagccttggaaacattttcttttatgcttaagagttcgtctttgaagccagataagttcaccttgggaagtgttctgtcagcttgtgccaatcgggaaagcttgaaacttgggaaacaaatccatgcacatattgtaagagccgatgttgacatcgctggggcagtggggaatgccctgatctcaatgtatgcgaaatcgggtgctgttgaagttgctcataggattgtagaaataaccggtactccaagtcttaatgttatagcattcacgtcactgttggatggctatttcaaaattggggatatagaccctgcaagagccatatttgattcattgaagcaccgtgatgtagttgcctggactgccatgattgttggttatgcacagaatggcttaattagtgatgctttggtgctgtttaggttaatgattagagaaggtccaaagccaaacaactataccctggcagcggtattaagtgtcatttcaagtttggcttctctggatcacggtaagcagcttcatgcagttgccataagattggaagaagtatcatcagtttctgtgggtaatgctttgattaccatgtactcaagatctggtagcatcaaagatgctagaaaaatattcaatcacatatgctcctacagggatacattgacttggacttccatgattttatctctagctcaacatggtcttggaaatgaggccatagaactgtttgaaaagatgctgagaattaacctaaagcctgatcacattacttatgttggtgtgttgtctgcttgcacgcatgtgggattggtagaacaggatgttgtagcttggggttcgcttttgtcttcgtgtagggttcataaatatgttgatttggctaaagtggctgctgaaaaattgcttcttattgatcctaataatagtggggcttacttagcgcttgctaatacactttcagcctgtggtaaatgggaggatgctgctaaggttaggaagtcaatgaaggacaaaagcagttaa

SEQ ID NO: 100863 - DNA, 237 bp, Glycine max
  Peptide Sequence Number=SeqID_217641
ggatcgtgcccgcaagacacccagtggacccgaagaagtccaacagggtattggggtttccaactctgattacgggcctctgcaggcacagggcgagacaccacagcagcatggggatggccgacagcaggcaactgatgcaccgccgccacctccaaagcccctcagctcatctacaaaagttggagcgtttacgacccgtggccgaccagcaggcaaccaagtccaaagccaaag

SEQ ID NO: 100864 - DNA, 308 bp, Glycine max
  Peptide Sequence Number=SeqID_217642
gattactggtagaagaaacaggtggatttcatgtcttaaagggaatgagtggaagaatgattgagtcaatcaagcttgcaggaaagttgctctacaacaatcgtaagagcatttcgaggagcattgttacaatcaaagactcaacccgaagcaacacagagcatggtgagcaagaaataggaccaaacacagaaacaactcaggaagcagaattcaagctagaaacagggtcgagcaaggaaaaagcttcaaggccaaaaagggaaattgttaaacctcaatacctcaaggattttgtggaaaaatag

SEQ ID NO: 100865 - DNA, 378 bp, Glycine max
  Peptide Sequence Number=SeqID_217643
atgatgatttggaaacaacgtgcaaaattagtcatggctacagctaggtgggtactcaagcatccaatttatggcattgtgatactaaggcttgggatttacacaagacgacgttcctataggaaaaccctacaaggttctggaatttcaacaaacattatcgacgataacgaatccctcaagtcatggaaacaagataacatacaagtgttaaatgatggaacatacgaatttggggatcccacggtcatgtggctccgcatgccaccagactcttgggtcacggtaacaaatggtggggtgatcgacaaaagcagggcttttgctcctacgtatcctcaatttgtgatgaggaactcagacctacgtagttcttga

SEQ ID NO: 100866 - DNA, 696 bp, Glycine max
  Peptide Sequence Number=SeqID_217644
atgaagccccaaccattacaacaagacacaaagattaacagtgagatgacacaattgccaatggagcgcaacacgattgttctaaataatagtgtgttcaagtggtctgagacgatgaacactataaacgagtatgtcatcaaagaaaacgatcatgttccagtgaagcaaaggcctggaaatctcattcatggtggcttgaaaagtagttggggtaatacagagtccaaaagacatgactcgatattcagaatgaacatcatgggtatgaaaaaacattttatgcatatcctgaggctgcaacctaatctgatggaaaccggaagtgagatcgtgcttggagaaaaatcgcaccaagcccaactcatcaagcaacttcttcgcagtgggggaggaaatcaatctttcacagtcaaagcattcaatgcttggctaaatccaaccattttcaaggtgtttggatacctgattctcaatttcaaccttttggacatgcaggtgtttgtatggatgaacgttgacaagagcgaattgtggcagcatgggaatagtatggtcaatgagccttggtggaggcagttaagagggttcattaaacaagaatgtgaattcttagagaagttgtttaagcttgggaatggaaatcaaggatggggacgaggactttggtgttgcttcttcgaaaacgtgaagtag

SEQ ID NO: 100867 - DNA, 240 bp, Glycine max
  Peptide Sequence Number=SeqID_217645
atgctgtcgtgtccatgctcagcgtcgagaggatttccaccatctccagaccacgccacagcagcagcgaggcgtcggggtgattctgggtctgctgctcacaataacgccaggttgcggccaatcgctcacatgactgcggcgacctctggcgcgcgctcgttgataaacagcgccattgattcaagatgccccgtgtgcggaaacatatccaacatccgcacgcgcgcaagacgataa

SEQ ID NO: 100868 - DNA, 315 bp, Glycine max
  Peptide Sequence Number=SeqID_217646
atggataagggccttgagtttattctcattctagggcatgaagaagaatgcaagaaggtgtgggaaacccaggtactattcccaacctctttaaacactcaaaacatttgctttgcatgtccttaccgccttacactagactatgaagctattagcaattggtttcctatctacaagaatgaacaccctataattcataaagaaactattaggagtgactttctgaagcctgcatgctttggagtttccttgtggtctagttactttaaccttaatggacatagctgcgataattggcctcaaacctttgggtaa

SEQ ID NO: 100869 - DNA, 812 bp, Glycine max
  Peptide Sequence Number=SeqID_217647
gactgcacgtcctcaccttcagaggattgcacgtcctcacctttagagggctgcacgccctcgcctttagagggctacacgtcctcacctccaaagggctgcatgccctcgcctgtagaggactacacgtcctcacctccaaagggctgcatgccctcgcctgtagaggactacacgtcctcgccttcagaggattgcacaccctcgccttcagagggcgacacgtcctcaactttagtgggctacacgcccacgcctttaaaggactacacgtcctcgccatcagaggactacatgtcctcgccttcagaggacttcacgtcctcaccttcagagggctacacgccttcgccttcgtaggacttcatgtcctaaactttacagggctacatgccctcacctttagaggtctacacgtcctcattttcagaggacttcacgtcctcaccttaagagggctgcacgccctcaccttcagagggctacacgccttcgcattcataggactacatgccctctccttcaaaggacttcacgtccttacttttagtgggctacacgccctcaccttcagaggattgcacatcctcaccttcagaggactacacgtcctcacctttaaaggactgtacgtcctcaccttcagaggattgcacgtcctcacctttagagggctacacacgctcgccttcaaaggactacacgtcctcgccttcagaggactgcacatcctcaccttcagaggactacatgtcctcaccttcagaggactagatgtcctcgcctgcacgccctcgcctttagaggactag

SEQ ID NO: 100870 - DNA, 507 bp, Glycine max
  Peptide Sequence Number=SeqID_217648
atgaacttcacctttttttactgtttcttaagctcattcatttactttctaaatattcacggattggtgtttaacaccttccatggatcaagtagctgtggtgaagcaaaaagccctattagtaatatatcagcgcaagaacaaagcagccaggatcctgcgggttcagggggaaagacgaatgagaatgtgacaagaacttccaaagctgatcagggggagaatccatctaggaaacaccatccttcccagaaaacaatgggaagacacattgggacaaactcaatggaagacatgccttgtgtatttacaaaaggggatggtcctaatggaagaagaattgagggtattttgtacaaatatggtaagggggaggaagtgaggatcatgtgtgtgtgccatggaaacttcctctctccggcggagtttgttaagcatgctggtggcggcgatgttgcacacccccttaggcacattgttgtgaacccttctgctgctcccttttag

SEQ ID NO: 100871 - DNA, 390 bp, Glycine max
  Peptide Sequence Number=SeqID_217649
atggctgagaggagagttgtagcctcggcttcatgtatgagggggatccctgagttgcagctgatcaatgagctcacaaactcgaaggtcttcgaagccttccaaggttggggactgaatgctcgtccgtttgacccgcggggcggggacggaccaatttatttggtccgtgtaagaagcggggcagactggcccggtccgctgctaatgcgggcgagccttacgcggggcgggctggcccgcttacctactcctaataataataacatcttgggtcaccaccaacctagccaccgaccaccactggcgttgctagtcgcaccgccaccagccagtgctcacgccatcaccagccgccaccaccaacttcctccaactctcaaactctga

SEQ ID NO: 100872 - DNA, 814 bp, Glycine max
  Peptide Sequence Number=SeqID_217650
atggaggattataagaacaggcatagttatcagcaacagcaacagaaacaagaagaagaagaagaagagaaaaaagtagtgtgtgagaagatggagaggtaccctagggatttgcttcaaggattttccttgagtggtgttactactgttagggatggtaataataataacaacaacattaacaataacatgatgcatcaacatcatcatcatcatgttcttcatcaccatcatgagcaacagcaacagcagcatgaggtggatgatgaagaggttgagttgaaccttggtctttctctcggtggaagatttggggtggacaagaacgccaaaaaaaagaagcttttgcgttcttcttctgtggtggggacaatgcctcttttccgggaggacgatgcggtggcgccgtcggcggcggcgttcccggcgctcatgaggacttcgtctctgccgacggagactgaggaggagtggcggaggcggaaagagatgcagacgctgcgtcggatggaagcgaaaagacgccggtcggagaagcagaggggatcccgggaggtcgccggcgccggcgaggaggtggaggcagggaggagtgtggcaatgggattcaataagttcggttcttcggcggaggcggcggtgccgccgccgccggggtggggtgtgccaggaaagcaagttgttcttggtgatgtgatggggaagggaaaggggtttcaaggattgtttgggcaaccatcttctcacggctcagctgattctcaaggaggaagctcttcatcactttctgaaatggatagcaaggcttttcttg

SEQ ID NO: 100873 - DNA, 144 bp, Glycine max
  Peptide Sequence Number=SeqID_217651
atggatacctcagagccctacactggggcaatgaaaggcaccatgcataaacctcaagcgaacctagggttcatgatgaaagacaaggttgatacctcaaagccttacacttgggcaatgaggggcaccgagcatgagccttga

SEQ ID NO: 100874 - DNA, 798 bp, Glycine max
  Peptide Sequence Number=SeqID_217652
atggctaatttgcaaggagggcctgactttgacaaaatcttccacttcctctccatttgcatccttgctttcatcaatgaaggctcttcctccctctcaagtgcattcatgaacgagccatggtcatggggcataagcattcccattagtttgtacgtgaaatttgcacttgagatccacactcaccttggaatctgtgttggggttggagtaccctctttggtctattggggtgccacacgtggtgccattgattggtactgggaagcagcattgaagttcaaccatgagatcttcaaaacatgccttttcaatgttgttattgggttgctacacttgttggtgtcaaagcttgctcattacatcattgagtgggtgagggatcacaagccgatgaacaacaagggtttgttgtctcatttgctagtgcttgcaaacttggacttggaagcactctctaaacaccctttactgaggcctatttctttcaagactttgttcttgaagctcattgagttgcttgttgtgttcttctacaatgggaacattttgctattgagttggtgcttttcagggcaggtttatagttatgaggttggtaaggctatttcttgggttagcttgggaagttccatgtttgtgtggatcaagtctttggtcagggaactgggaggaacacaacaggaaccacttgaagagaagccatgcatgaaggtggcggaagaggataattgttctccaattcaaagtgtggagaccaaggatgatcaagcattaatctgctcatcagaatgttga

SEQ ID NO: 100875 - DNA, 462 bp, Glycine max
  Peptide Sequence Number=SeqID_217653
atggtactattggatcgtcctcgtgttgtatctgcagaagtaggacatgcttgggacctgccagcaaacacatttggtgctgcctatgctagattcatgggatcaaggaacttttcgccagatgatagagaccacctgttagccacgagggctcgtgaagtgcatgacttctggcacactctttttgagcttcctaccaacttggttggggagacagcactgaaggtgattgagcttgagcagatgcaccttcccatgtgcttgctgtctgttctaggaggcactgcaaggttcagtgataagcagaggaaactgttttatcagcactacttcccctgggctgttcgcgatggcatgcagtgcagtgatcttatgtgtgtgtattatgagtggcattttgatgaagacttggaagatattcgcagaatattaggaatttttcctgctcccgctgtttcttaa

SEQ ID NO: 100876 - DNA, 531 bp, Glycine max
  Peptide Sequence Number=SeqID_217654
atgccttcagtgccacggggaaacttctccaatcgccaaacccaattctccgagcggaggcagaagattatacaacagaggaagtctcttccgattacaccagttgagaaaaggctggttgaagaggttcggaagcacgatgtgttgattattgttggcgaaactggaagtggaaagactactcagattccgcagtttctgtttgatgctggattttgccgcgatggaagggttattgggataacgcaacctagacgtgtggctgctgtcactgtggcaaaacgtgttgctgaggagtgtggtgttgagttgggccagaaggtcgggtattcggttagatttgatgacgctacttccggttcaacaaggatcaaatatatgacagatgggttgcttttgagggaagcattgttggatccatatctttctaagtattctgttataattgttgatgaagcacatgagaggactgttcacactgatgtcttgatgggcttgctaaaaaatgtacaacttgctcggtcaagttct

SEQ ID NO: 100877 - DNA, 1890 bp, Glycine max
  Peptide Sequence Number=SeqID_217655
atggaaagctgtgccagcaataatcactggagagccgaggaagccattggtggcaacgctgaagctcttcaggcccttagagaactcatcatattccctcttcacttttctcaccaagcccaaaagcttggccttaagtggccaagaggattgctgctgtatggtccaccaggcactggaaagaataagaaaaagaaaatggaaatggaaataaggcaaggaggagatgcagtacagtggcaacaagagaagacaagtttggtacgagcagttgttcgggagtgtggggcacatttgaccgttatcagtccacactctgttcatagagcacatgctggtgaaagtgagagaattctccgcgaggcattttcagaggcatcatctcatgtagccttgggcaagccatcggttatctttatagatgaaatagatgcactctgtgctcgtcgagattccaaaagggagcaagatgtccgagttgcctcccaactctttactctgatggactcaaataaaccaaccttttctacaccaggtgtagttgtggttgcgtcaactaacagagtggatgcaattgaccctgcactaagaaggtctggacgttttgatgctgaaattgaagttactgtcccaaatgaagatgaccgctttcaaattctgaagttgtatacaaagatgattcccttggatcccgttcttgacttaaagtctattgctgcattgtgcaatggatatgttggagctgatttggaggctttgtgtcgtgaagctaccatgtatgcaatcaaaagatcttcaaatacaaaagatgctagtaatttcagtctaacaatggaagattggaagcatgcaaggtctgttgttggtccaagtataacaagaggtgttactgtggaaattcccaaagtgacttgggaagacattggtggattaaaagaattgaagaaaaaagtccagcaagctgttgaatggcctatcaagcattctgctgcattttcaagaatgggaatatcccctgtacgtggaattcttctccatgggcctccaggatgttccaaaactacccttgccaaagctgctgcacatgctgctcaagcatctttcttttccttaagtggtgcagaattgtattcaatgtatgttggagagggggaagctttgcttcgtaaaacatttcagagagcacgccttgcggcacctagtataatattctttgatgaggctgatgtggtagctgccaaacggggtgacagctctagcaatagtgctacagttggagagagacttttatccactctgctgactgagattgatggcttagaagaagctaaaggaattcttgttttggcagctacaaatcgcccctatgcaattgatgctgcactcatgcgtcctgggcgttttgatctggttctgtatgtaccaccacctgatttggaggctcggcatgagattctttgtgtacatacgcgtaagatgaaaacagggaatgatgttgatctcagaaggatagcagaagacacagagctcttcacaggtgctgaactggagggattatgcaaggaagctggaattgtagctctaagggaagacatatctgccgccgttgtttgtgaccgccatttccagattgcgaagagttctttaaaaccagcattaacaaagtcagaaattgactcgtactcatctttcatgaagacctcatctcgagctttgcctggccactttgaagcaggtttgaaaccagacaaaagcaaaaagaacaggttggatcctttttctttggtcaaaattggagttgtcagctgtttgttacttgctgctgctgctgctgcagctgaatactatatcatgtatggagaccaaattgtacatgatatagctacttga

SEQ ID NO: 100878 - DNA, 483 bp, Glycine max
  Peptide Sequence Number=SeqID_217656
atggagaggagtatgattgatgctgccagtcatggagctcttggtgatatgactcctgttgaggctaggaatctaattgagaagatggcgtccaactcccaacaattcagtgcaagaaatgatgttattgtccttagaggagtccatgatgtggccacagattcatcttcatctgctgaaaataagaagcttgagggaaaacttgatgccttggttaacctactatctggagtcaatgagcaacttgatgcccatgctgcaaacatttataatagactccctcagcaacaaaaccaacaacaacagaataattatgatctttcaaacaatagatacaatccaggttggaggaatcatccaaatctgagatggggaaaatcctccaaaacaacaacagcagcacaacaacagtctgtccctcccttccagaatgttgttggtccaagcaggccatatgttcctcctccaatgcagcagcaatag

SEQ ID NO: 100879 - DNA, 267 bp, Glycine max
  Peptide Sequence Number=SeqID_217657
atgagccatgggcgcatgtatcaacaaaggataaagaacgcgttcgacaagaaggtgcgcccgtgcaagttcaaagagagggaccttgtgctgaaaaacatatcccatgctattaaagataatcgagggaaatgggccccgaactatgaagggccatttgttgtgaaaagggctttttccggaggggctctggtgctcaccaacatggatggcgaggagctaccctcacccgtgaactccgatgttgtcaagcgatactacgcttag

SEQ ID NO: 100880 - DNA, 522 bp, Glycine max
  Peptide Sequence Number=SeqID_217658
atggtagatcgggaaggcaaagagttaggaagtgtgggcagtccccattttgtgcaagttcaaaacgagcatcccttcccgccttatggcttgcctccgaactatatgccacccaatgtggcgctcactcccgatgagaatgtcaataactccaatctcatactcgttgagaaccaacaacctcaatctgatcatgcacatgtctctcaatgcatgggggagacacatgaaataccctaccataatctagctgacttcgagcctcgccttggatacaccactaagggacaaatagttggtggtgtagccctgccaaacactttagagggctctcaatttcgcccacaacctcaacccttgcattgtatggcgggaagaatccttcctgctatggcagaaaagggaaagttggatcaatcttataaacttgatttctacatcacttgcatagcaactgtcttaaaatatctttttcattttaaaaattttaaaaaattgatgattctaagacaattttcttaa

SEQ ID NO: 100881 - DNA, 260 bp, Glycine max
  Peptide Sequence Number=SeqID_217659
ctgatcctatacttctcaaaaagcaacgatccattagcaagaaatctatcgatgtttctctatccgccatatttttgaggcagagcctcaactttggcgtgaggacgtcatggtgggtggagttatggactaacgctgccatgaataagctaaggaggaactcctcatcgtcatcgttgttgttgtcaacattgtcgtcgctagagaggtttttcaagatgcagcagagtaaggtcttggttgggtgtaagaatacataa

SEQ ID NO: 100882 - DNA, 339 bp, Glycine max
  Peptide Sequence Number=SeqID_217660
atgcgagttcctaacaactgttcttttgatacactcaagcgtagaatgcacaacacccttcaactaaccaacaatcaattactggatgaaatctactaccgacaaccattcatagatgcagaattattatgtaccattattagaacaccggatgctatactcaacctgcttcaatcaaccatcactcctacttatgatgcaattatgtattacaacgggaagtggaacataccacgtcaaggtgagtttttgggttactcctttactggaactaatccaataagatttggcattccttcgggatgtgacatggagaaactcaaggatttaatcaagtaa

SEQ ID NO: 100883 - DNA, 522 bp, Glycine max
  Peptide Sequence Number=SeqID_217661
ggaattgcactgcctctggagcctgaggttggtccctcagctgctcgtgtcatcacaaagggcagttgtgttgatccctcaacgaccgatgtagacacgggaagagtttatgagggatccacaatcattcacaacatctctttgttgcatgatcaagtgaaggttggagttaaggaggttaaagatgcagatgctcctattcctgtacccactgacgaggttatgtgggatgcttccctattcaggctgtttaattcaaacttccccttgtacataaagcatgaagatttgtctgaaatagcacatggtggtcaatgtctcagcatctctgttatacagttgtggattctgcatctgactgagacaagtatgcaattggggaattccgatgtgtatggattccttgagccacagtccatccagagatctgggcaatcacagtttgaatcagaaagttacatcaataactggatgcagagttcaaaacagggtgtctacttgggagcctacctgaatgggtaa

SEQ ID NO: 100884 - DNA, 441 bp, Glycine max
  Peptide Sequence Number=SeqID_217662
atggtcctaggcaaaccatggagtctcacaacttccctgaaaaagagttttgagatgtgggaagcatcatccaccttgtggcatggtataaagtgtgccatcttgctaaacctattgtcgcaacctacccttcggcgggagggcgacgcgagggctcacaggtgcgtcttccatgggaggaaaatgcgcagagtcgccaccaacgtttattcgaggaaaacgttgaaaaaaccgaaaaggtgtggtctacgaactttaagtgtgaaaggttcgggagttgtatttacgcacggggaaggagagaaacgtcaaggcgttggaccattaacgatctcatggggtggtcgacaaaagcggggattttgctcctacgtatcctcaattgcgatgaggaaatcagacctacgtagttcttgcaaaagcagtaaagttatgtgttga

SEQ ID NO: 100885 - DNA, 705 bp, Glycine max
  Peptide Sequence Number=SeqID_217663
atgatcaatgacctcgtgctggaaattcaagaatttagagagagtcttttagatttagggatcgaggttagatcaattttggcgcctattggacaagggagttcacaggtttcaggctcatctcaattatcatcaaaagatgcgtttctgtcaaagactgaagtaaaaaatatctctcagattaatgccagttcagaggagtttgtttgtgttactgtcgccaagattacaaccatagtgatggacaactattcatggtgctatccggcttgtggtcaatgttataaaaaagctgacatgcaaattgtgccattcacatgtccgtgtggcaaagagaatgatcaacctgtactgaggtatcgggttgaggtgatggatggggatgttgatttaaatgcctctcctcaagcactagataggctattgggttgtttccttgcattcaaagtgaaggtgcaaccaaggttcaggaattctgttgttcttaaatattcagatgaatcagagttgatcaatgttgtgctagatatgattcccgatagtgagcaatctctgtctattactattgatcatgatcggtcaatgcttggctcaagtgagcctacaaagtttgaatctaatttagcttactggtcaattaatattttatgcagcaatctgtgtctgttaccgaggatcatgaccctcttctcaggattccattga

SEQ ID NO: 100886 - DNA, 1194 bp, Glycine max
  Peptide Sequence Number=SeqID_217664
atggttagaggaactatatgtggagcaattagacataaattgataccgactcctcagaatttggtgacttcaactccattaacaactacttatgaatctttttttggattacatccattatctcaagttttggatcaaactaatccattgacccaaatagttcatgggagaaaattgagttatttgggccctggaggattgacggggcgaactgctagttttcggatacgagatatccaccctagtcactatggacgcatttgtccaattgacacgtcggaaggaatcaatgttggacttattggatctctagcaattcatgcgaggattggtagttgggggaaatctttggcacttaatcgagatattcaggaggaacagactgttccagcccgataccgtcaagaatttcttacgattgcatgggaacaggttcatcttcgaagtatttttcccttccaatatttttctattggagcttctctgattccttttattgaacataatgatgccaatcgagctttaatgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatatttttatttggtaatggagatactctaagcattccattaactatatatcaacgttccaacaaaaatacttgtatgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcag

SEQ ID NO: 100887 - DNA, 1673 bp, Glycine max
  Peptide Sequence Number=SeqID_217665
atgcttggaacggcgcaggcgcttggcgctggtgacgtcgccggacaggaacaccgacagccccaggcgcaggttgccgatcagccgctcgtgcagcccatccagttccgccaatccttccgccgagaaggcgcggcgcgcggcgtgcgacttggcgcccacgtcgccggccatgcgctcgatgatgtcgcccgcctgttccaggttaagcgccatttcgatgatctccgcccagcggcgcgagtcttcctcgcccagatcttccttctggatctgcgccagatacagcttgatggcggtgtacagcacgtcgacgtcatcgtcgaggcgccgcacttctttatccacgccttgcttgccgtgcagcacttcgcgctgcaggatcatcatgtgttccaccacgtcgcccatgcgcaacgtttcgcgcgccgcattggccaacgccagcgtcggcgtgtccagcgcgctggcgtccagatggcgcggccgcatgcgcggatcgtcggccgccacgtcgacgatcagccgctcgcacagcgtcgccatcggcccggccagcgggatcatcaccagacaacggatcaggttgtagaacacgtggaagtagatcaccagctcttcgctgccgcccggcagctgagccatcacatccgccagataggaaacgaacggcagcaccagcacacaggccaccagcttgaacagcaggctgccgagcgccacgcgccgcccggcggcgttctggccgctggcgttgatcatcgccaacaggccgctgccgaggttggcgccgatcaccaggcagagcgccaccttcagcgaaatcacgccggacgcggtcagggtgacggtcagcagcaccgccgccaggctggaatagctgacgatggcgaacagcgcgccggtcagggcgtccagcatcacgtcgccggtcagcgacgagaacagcactttcaccccggccgcctgggtgatcggcgtggcggcggccacgatcagctccagcgccagcacgatcagcccaaggccgatcaggacgcgcccgatctggccgatccgcatctgcttgcggctgaggaacaggaagacgccgatcaggatcagcagcggcgacagccaggaaagatcgaaggtcagcacgcgcgccatcagcgcggtgccgacgtcagcgccgagcatgatcaccagcgcaggcgccagccccaccagcccctgcgcaacgaaagaggtcaccagcagcgccgtggcgttgctgctctgtaccagcgcggtcacgccgatgccggaaacgaacgccagcggctttttctcaacgctgtcgctcaacacgcgccgcagattggcgccgtaaacccgcatgatcccggtgcgcacgatgtgggtgccccacaccaacagcgccacggaggaaagcaggtgaagaagggtcagcacggaagatacgctccattaacgcccggccaaaggaggctggtacccgatgcctgtcaggcggtgcggaaagacggaacggttctgttcgccttagccgcagccggtagaccaaaagatgacgggtacagcgcgcggtcccgcctgccgggcgtaggtctggcaggacagcgggcgggcggcagaccgcagaagagaagggttaatgcggcggcggaaaggccccggcgccgcgctgcgaa

SEQ ID NO: 100888 - DNA, 1311 bp, Glycine max
  Peptide Sequence Number=SeqID_217666
atgcgtaaggagaaccaactgtccggcaatatcgatctgggcgccggcagcagcgacagcaaggaaaaaaccggcggcagcctctccgtcggcggcgccttcgacatcgccaaggtgaatgagtccgcgaccgaacgccagggcgccacgctagcctcagacggcaaggtcaccctttccgccaacggcaaagacgatgacgcgctgcatctgcagggcgccaaggtcagcggcggcagcgccgcgctcgaggcgaaaaacggcggcatcctgctggagtccgccaagaacgagcagcacaaggacaactggagcctgggcatcaaagccaacgccaaaggcggccaaacgttcaacaaggacgccaacggcaaggtcgatccgaacaccggcaaagacacccatacgctgggcgccggtctgaaggtcggcgtggaacagcaggataaaaccacccacgccaacaccggcatcaccgcgggcgacgtggcgctcaacagcggcaaggatacccgcctcgccggggcgcgcgtcgatgccgacagcgtacagggcaaggtgggcggcgatctgcgcgttgaaagccgcaaggacgtcgagaaaggcgtgaaggtggaggtggatgccggcctgagccacagcaacgatccgggcagcagcatcacctccaagctgtcgaaggtgggcacgccgcgctacgccgggaaagtgaaagagaaactggacgccggggtgaataaagtggccgacgccaccaccgacaagtacaacagcgtggcgcgtcgtctcgatccgcagcaggacaccaccggcgcggtcagcttcagcaaggccgacggcaaagtgacgctgccggcaacgccggccggcgagaagccgcagggcccgctgtgggatcgcggtgcacgcaccgtcggcggcgcggtgaaagacagcatcaccgggccggcgggtcgccaagggcagctcaaggtcaatgccgacgtggtgaacaacaacgcggtcggcgagcagtcggcgattaccggtaagcacggcgtagcgctgcaggtcggcggccaaacccaactgaccggcggcgagatccgcagtcagcagggcaaggtggaactgggcggcagcaaggtcagccagcaggacgtcagcggccaacgctatcagggcggcggccgcgtcgatgcggcggccacggtaggcgggctgttaggcggcgcggcgaaacaaagcgtcgacggcaacgtgccgttcgtcagcggccatgcttcgactcagcaggcggacgccaaagccggcgtgttcagcggcaaataa

SEQ ID NO: 100889 - DNA, 642 bp, Glycine max
  Peptide Sequence Number=SeqID_217667
atgaagccggaaggactacatgtcctcgccatcagagggttgcacgccctcaccttcagaggactgcacatcctcgccgtcgtagggctacacaccctcacctttagagggctacacgccctcaccttcagcggactacacgtcctccccatcagagaactacacgccctcgccaatagagggctgcatgccctcaccttcagaggactacacgcccttgccttcagagggctgcatggcctcgcctacaaaggactacacgtcctcttcatcagagggttgcacaccctaacctttagaagactacgcgtcctcgccttcaaagggctacgcgccctcgccttcgtagggctacttgccctcaccttcagaggactacatgtccttgcctatagagggctacacgccctcgccatcagaggactccacgtcgtcatcgtcagagggctacgcgccctcgccttcatagggctacacgccctcgcctttgtagggctacacgccctcaccatcagaggactacacatcctcgcctttagtgcactacacgtccttgcctttagaggactacatgtcctccccaccagaggattagtgactggtgctgacaatttaattggcgatttttgttttgatagttag

SEQ ID NO: 100890 - DNA, 429 bp, Glycine max
  Peptide Sequence Number=SeqID_217668
atgaagaaggctatagctaaaggtagcaaggctgagcagaaagctaagaagaagcaagtggaagaagaggtttgtcaactttctgctaagcttaaggggaatcatgccaaagaactggttgcattaggctatagcagtggtaatggaaatgaaaagagcaatttggacagtctggtcaaggccatagttggagtatctgttactagtcaacctgaagatacaaaggtttaccagcaatccattggagctgtttgtatcctagattgggcaaaggaaacaatggttctacagtttgtatccattgaagtagatgcccaacagctcatgaaggcagaagtgcataacctagcttttactagtataaaacctggcttttatacagtttcatacagaggtgtccctaatgtaaaacctggcttttactattaa

SEQ ID NO: 100891 - DNA, 333 bp, Glycine max
  Peptide Sequence Number=SeqID_217669
atggagcacatggcctattggactatcaaattgaagcttctagagctcgaggagttgaggattcatgcttatgattcctccaagaacaacaaggaaagggtaaaggcataccatgataacaagttgatcatagggacttccatgctattgaagtccaagtggtcaaggttgttccttgttaaagaaggcaagccatatggggcagtagagctggtgaatccatttgcaactgagctagcaaggagttgggtggtcaatggccagaggttgaagtcctacctcagtggggagattgaaaggttgaccactctcattcatctcaaggacgcttga

SEQ ID NO: 100892 - DNA, 198 bp, Glycine max
  Peptide Sequence Number=SeqID_217670
atggatgataggatgaaaagtgagcaagcacgtgctaaccctcagaataatctagtggcttggttggctagtgcattgatcaactccaatcgcaatgtgcctagttatcaattaccagtgggttattgggtgcagaatggtcactggtcaaccagatggtgcttggacgaattatatgaacaagatcgcttagcttaa

SEQ ID NO: 100893 - DNA, 297 bp, Glycine max
  Peptide Sequence Number=SeqID_217671
atgtcattgtctagcgctgttcatgtgtcctccacctatgagtttggagccatgcgtagtgattccttagtgcaattctccaacctcgcctttttttcggagccccatgaatgtcattgcctagcgctgttcatgcatcctccaccaacgagtctggagccccacgaaggtattgcgtacaactgttcgccaattctccatttccactttttttcggagccccatgaatgtcattgtctagcgcttttcgtgtgtcctccacctatgagtctggagccccgcatatttattgcgtag

SEQ ID NO: 100894 - DNA, 141 bp, Glycine max
  Peptide Sequence Number=SeqID_217672
atggagaagcagattgtgggaaaggtaaaggaggggaaagagagggtaatgaaaacagtgttactagggagccccattgtcaatagctggagatggcaacctgttgatcaagtaaatgctggaaacaaaggcatgatctag

SEQ ID NO: 100895 - DNA, 468 bp, Glycine max
  Peptide Sequence Number=SeqID_217673
atgacatcattatttctaacttgttacctcctaatagatttccttcggagtccttactggtttgttaatcttttagatgaaacactacattttggccatgaggttgatacacggttggatatattttataagctaacaagttggtgccctaattttaaattgccaattggttggtgccacattgaaacttgtcacagttctaccatcactggtggtgacttgaaaagagagggattgtccattgagctaagagtggatttgactgctaatgaaacacaaaaggtatttgacaggatcttaacaaagttaggtcatactgccccaccagttcttggatttcgtatgcaaaaaggaggtaacaagctgcattttttataccatgcacttgcataccttaggtgtgtatggaggttttcgtttttgccatcagagaatgaaaaagaaagttattttacgtattattgttga

SEQ ID NO: 100896 - DNA, 444 bp, Glycine max
  Peptide Sequence Number=SeqID_217674
atggttgaagatcaaccacagagggtgactcttgaagattattctagctctatcgtgtcacagttctttacaagtattgcacggtcggaggtccaagctcacaacatcacatatcctcattccttgatccagttgatccaaggaaatttgtttcttggtttgccaaatgaagacccgtatgcacacttgacgacttatatagaaatctgtaacacagtaaaaattgcaggtgtgccgaaagatgcagtgaggctcagcttgttctcattttctttggctggagaagctaagagatggctgcactcgttcaagggaaacaacttaaagacttgggaagaggttgtagagaaatttcttaagaagtactttccagagtctaagacagctgaaggccaggcagctatctcctcatttcatcaatttccagatgaatccctgagtgaa

SEQ ID NO: 100897 - DNA, 216 bp, Glycine max
  Peptide Sequence Number=SeqID_217675
atgaaggttgtgtacttccttgttgccatcttggctttgacatcctctcttgtctctctgcttatgaccctagtcctcttcaagatttttgtgtggcagccaaagaaaaagatggtgcttgccaaacttgaagatttcttcttacatgtggaatccgggaacactgacaacacaaataatgcacaagttagtctgttgatcaactatcacgactaa

SEQ ID NO: 100898 - DNA, 1548 bp, Glycine max
  Peptide Sequence Number=SeqID_217676
atgctcgaccgctccgacgccgtttccaaggtcgcattcgaatccgtcggccgcttcttccaggaattcagctccaaacgcatgagcaagctcgccggcgacaaactcgtcgattccgaaaactccctcgcgatccgctccaactgggtctcttccatggtggacttcgtctggaggaagcgccgcgccctcatggcgcgctccttgatcctccccgttgagaatttccgcaccaccgtgttccccgtcgtgtactccgtcaaggccgtggcctccggtggcgtcgaggtcattcgaaaactctccaaggcggcttcttcctctgcatcatccaatgccgcgggtgctgaggttgattcccacgcggagaagcttgttggggtttcggatgtggtcactcacctggcgccgttccttgtttcgtcgttggagccagcgttgatctatgaggttgggatcaatatgctgtatctggctgatgtgcctggtgggaagcctgaatgggcctcgcaatcgatcattgcgattctgacgttgtgggatcggctggactttgcttctgctagggagagcattgttagggcggttgtcaccaatttgcatctccttgatcttcacatgcaggtatcactgttcaagaggttacttttaatggttaaaaacctgagagcagaatcagatcgaatgtatgctctagcatgtatatgtagaacggctctttgtgtacatctattcgccaaggaaagtgtacgaagagggcagaaacctcttcccggaacggatatagcttccctttttgaggatgccagagtgaatgatgatcttaatagcattacaagtaaaagtatatttagggaggagctagttgcatcgctggtggaaagttgctttcagctgtctcttccattgcctgaacaaaataacacgggcatggagagtagggtcattggagctttggcatatggaactggttatggtgcattaaactggactgaacctgctttggaagtagtggaagtttgtcggccttgtgttaaatgggattgcgacggccgcacctacgcggttgactgctacttgaagttgcttgttaggctatgttacatatatgatactcggggtggggtaaaaagagtcaaagatggagcttctcaggaccaaattttgaatgaaactagattgcaaaacttgcaacgtgaacttgtgaaggacttgcatgagcttaaaattccaaggaaaacccttcaactttaccttgcatcaactttcaactctgctgtactatctgcttgcatcgacgtcaccactgtaatgtccttgccgatcacacagtcgctgttcctacaaccactaatggatgcattgaagcaggagcaggataccaatgctccaagtcagatccacattgcgttgtgcctcggggaggcggtcgaggcagctccagacccagagcggaggcactcagggagttggctgctgcggcttgtggagttactgaagaacacatgcaaggctccgggaaatgtcttggctacagatgcgcattga

SEQ ID NO: 100899 - DNA, 342 bp, Glycine max
  Peptide Sequence Number=SeqID_217677
atggccggccaatctagagaaattgaccaaataggcatttcgccaaagaggctggcgaaacacggtcgggacgtgatatgtggcggattcgccaataccactagcgagacatggttccgtcaggttgactggcgatacagctggtacacgtggcagcaggcacagtgtatttcgccattacgaatgacaacatactttcggtacggaaaattaattaaacttgaaacggttgtaacttttgataagaatgtccgattcactatggcgagatgcaaattcattgtgatgagtcttcacactcttttacttgatctttggtcttggctcgttgtggcaagctga

SEQ ID NO: 100900 - DNA, 2341 bp, Glycine max
  Peptide Sequence Number=SeqID_217678
atgacggtgttctcggccaagcaggtgttcccggttaactacgaggccgaagtgtcgcagcgcctcctcgaagcctcccactccggcgatctccccttggcgttccgctgcattgccgatccctccgtcgacgtcaacttcgccggcgccgtcactctcaagaccgcctccaccgacctcctcctcctcccagagtcccccagccaactccgcctcgacttccaggaattcgtctccgacgtctcgccgcttttcctcgccgtccacgccgaccacgctgccctcgtcaagaagttactgagtgtgggagctgatgtaaaccagaagctcttcagaggctttgcaacaactgcagcagtgagggagggtcactttaacattcttgagatcttacttaaagcaggggcatcgcaaccagcatgtgaagaagctcttatagaggcaagttgtcatggccaagcaaggtgtgtggaactgctcatgaactctgatttgatccgacctcatgttgctgtacatgctctagtgactgcaagctgcagggggcttgttgatgtggtcgagacgctcataaagtgtggtgtggatgcaagtgcaacagaccgggtgcttttacagtcacttaagccttctctccacacaaatgtggattgtactgcacttgttgcttctgtaattcataggcaggtccctgttgttgatttgctattgcagaatggtgttaggttagactttcgggtgaggcttggagcatggtcatgggacacttctactggtgaagagcttcgtgttggtgctgggctgggagaatcttatggcataacctggtgtgcagtcgagtattttgagaaaaatggtgctatactacgtttgctcctgcaacatgtctcctccaaacctcaccgtggaaggacccttctacatcatgctatactctgtggcaatgttgaggctgtcaaggtgctcttagaatgtggtgcggatgtggaagccccagttaaaactaccagcaagactcatttcctgcctatacacatggcatcccggaaaggcttaccaacaattattcaagggcttattgattttggttgtgatttgaactccacaacagactctggtgagacagctttgatgatctgtgcaaaatataagcaagaggagtgtctcaaagtactaacaatggctggggctgattttggcttggtgaatactgctggtcaatctgcaagttcgatcgctgagtcaaacaagtggtcactgggtttccaacaagcagtgttggatacaatcaaaagaggcaagatacctgaatccagcaacactacttccttttcgcctttcatatttgtagctcaagtcggagatactgaagcattgaaaattgtcattgaatctggagaatttaatcttgactatcaagacgatagtggtttctctgcagttatgcatgctgcttcaaagggccatgtggactgttttcgattgctggtatatgcgggagctgatgtaaagttgtgcaataaatctggtgaaacagcaataaccctatctgaaatgaatcagaactgtgatttattcgaaaaggtcatgcttgagtttgagcttgaaaagggcaatatcaatgctggtggattctacgcattacatcgcgcagctcgtcgtggtgacttggatgctgttacattgcttaccagcaaaggttatgatgtcaatgcccctgatggagaggactacactccactcatgttagcagcaagggaaggccatgcatccatttgtgagcttctaatttcatatggtgctaattgtaatgccaaaaacgctcgaggggaaactgcgcttttactcgcaaggaaattcacaggagggaaaaactatgcagaggctgttatactagatgaactcgctcgtaaattggtattaggtggtgcctatgttctgaagcacactaaaggtggtaagggctctccccatgggaaacaaatgcaaatgttgggctctgccggtgtgctgtgttgggggaagtcaagccggagaaatgtggtttgctgtgaggcagagttggggccaagctcaacattacaccgaaataggtacaagaaaggtgatgcagatgaacctggaatgtttagggtgcttactggcaagagcagggaagtgcattttgtgtgtgatggagggttagaagttgctgagctttgggtgagagattttgatctctcaacggttgtacatccttttttggaggttagggaaactgaaaactggaaagcagtgttgcttctcttgcttgtaccggtaggtctcagtggatccaattcacttcagaaattagcatcag

SEQ ID NO: 100901 - DNA, 342 bp, Glycine max
  Peptide Sequence Number=SeqID_217679
atgaagaatttcttcaactctcctctctttgacacctctatgaagaatgtatttggccttgttccccttcatggtgaacccttaactatttctactccattactttgtttcccccacgagtcaactactgcagaactctctaaggttcaaaaggaggttcttgacgctcgtattccctctcctccattgttgttgaaccttttgcttggtcaacaaagactattcagaactccatggagaattgcctccatgcaacatgagcctccaccaccaccaagagcaaccagtatgccttcatttccctcatccttaacaaatctttctcctaacaagcatgattga

SEQ ID NO: 100902 - DNA, 237 bp, Glycine max
  Peptide Sequence Number=SeqID_217680
atgattcgatttcaatcttactacaaccatttccaccatgtgacctttgtctctttatccaaatgtcttgatcaaacatggggaaagaagtgggaagagtttgaagtccaagaagccttagaacatatttctaaggaagagaagaaagatgaagaagatcattatgagcctcagaatgaggtgataatagttgatgaaggtgaccaggttgctcaaaatgaggaagttggagcttag

SEQ ID NO: 100903 - DNA, 687 bp, Glycine max
  Peptide Sequence Number=SeqID_217681
atggctccccataagagaaaagtcatagcttcattgtcccaggccagttatgactcatccatatttgaatcaagggatgcttgggaccgttacgcagataacatcctcggccgaaacattcttccggagaggaatgtgaagctatacattaatgagtttgatgacttcagaagagaagtcaagaggaggaactggcacaaggagcttactaatttttctgaaggaagcataaatgtggcaattgttaaagaattctatgcaaacctatatgtccctgaggaaaaaaaaccaaagcaagttagggttcgagggcacctgattaagttcgatgcggactccctcaacaccttcttgaagactctagtggtcttggaggaaggggagagcttaccctcttattctaggttctgcaggttgaggccagaccctcaagagctggcatctcggctgtgtatccctggaaggggattttttcttaacgctgagggcttaccgtggaagctcttgaggaaggatcttacaactctggctcagacctggagtgttttatcttattctaacctacccctgacttcacatacctttgatcttaatcttgacatggctaagttagtttatgggctagtaatgaagatggacatgaacataggagcacttatagctggacagatctcgctcattgcttag

SEQ ID NO: 100904 - DNA, 255 bp, Glycine max
  Peptide Sequence Number=SeqID_217682
atgtttttatgcaacaataatgatcatgatgatggtgacgatgtcagtagcaacaatgacaataaaaatatcaatggtagtcgagtgacaaaggtgatagtggtgataatggtgatgtcgatggtggtgacaatgatgacgtggtgtggtagcggtgttagtgaagacaacaagtggtggcgatatggttgtgatgccaacgatggtagcaatgtaggtggtgacagtgacagtggtgggtggtggtggtggtga

SEQ ID NO: 100905 - DNA, 222 bp, Glycine max
  Peptide Sequence Number=SeqID_217683
atggagctgatcctggtggatatgaaggactttctgatggtgatatatgatgagaaaggctcaaaatctggtggtaatgaaaaagggaaatgtgatgctgattgtttaagtgtcccttggttattaacacccccttggattctgggtgtattagcagcatttgctaccttgaggaagttgcctcctgaaacttgtcatagtccatgcaaactaaatatgtaa

SEQ ID NO: 100906 - DNA, 1209 bp, Glycine max
  Peptide Sequence Number=SeqID_217684
atggaggtggaggacatacctatggtgggaaggaagttcacttggtatagggtgaatgatcattcaaaaagtaggctcgaccgagtgcttgtctcaagtgattggcctttcaatgtgttgcattgctggttccaagatcatgggtttctagagatggtgaaggatttgtgggactcttatcaagtgcaagggtgggcttcttttgtgcttaaggaaaggttgaaagacgtaattgatgaggcggaaggtctagatgaggtggagatgcaaaatagatggtcacttatgggtgagttttggagtgtgtctaggagaaatgaatcgcatcttcaccaaaaatctagggtggacgagagatgggaagacgaaccaataaagaaaaacttcatgagtatgatgaaggaattttgggagaatgctaggatgcctagaggcgcgaattcttcgtttattacatttattcccaagaaagaaaatgcccaaggtttggacgaagatagacctataacacttatctgttgtatttacaaggtcatctccaaggttttggcaaagcgagtgaagcgggggggtcatggttttcaaagtagacttccaaaagacatgactcagtgtcatgagattttcttgttatatgatgcagaggttgaggttggtcctttcaatgaattcatcctccaaagaggtctaggagtaaggagggtcgccacaaaggctttgaggtgttttgaaatggggtcaaggctaaagcatgctaaattgcaagttgacgatcatctcgcggctggggccaatcctagaagagttccaccgtgtgttgttaaaaggattattaagctccaaagaaactttctttggagaggtgaggagaataaaaggaagattgcttgggtcaaatgggaggagtggagacttgctttggatcaaagttctttgtgggcagtagtcctaaaatcaaaatatggaaaattcgggaatgctgaagttcaaaggtcatcaaggaatgattccttatggtggagagatttggttgaggtttgtcgtgtaggtaaaaataaagaatgttatgataagagtgtggcttggaaggagaaatgttcagatagtgagggtgcagtcgagatgcacattctgccaaacggaggaggaggatattacacatttgctattcaacacttagagagagtagagagagaagaggtaaaatga

SEQ ID NO: 100907 - DNA, 1563 bp, Glycine max
  Peptide Sequence Number=SeqID_217685
atggaaaccctccctctcctcctcactctagtagcaaccctatcagcctacttcctttggttccacctcctcgcccgaaccctaaccgggccaaagccctggccattagtggggagcctcccaggccttttcaggaaccgcgatcgagtccacgactggatcgcggataacctccgtggcaggggaggctccgcaacgtaccagacgtgcatcatcccattccctttcttggcacgcaagaaagggttctacacggtcacgtgccatccaaagaacctcgagcacatcctcaagacgcgcttcgacaactacccaaaaggccccaagtggcaaaccgcgttccatgatcttttgggccaaggaatcttcaacagcgatggcgagacatggctcatgcaacgtaaaaccgcggcattagagttcaccacgcgaacgttgaagcaagccatgtctcgttgggttaaccgatccattaagaaccggttgtggtgcatacttgacaaagcggcgaaagaacgcgtctcggtggatttgcaagaccttcttctgcggttaacctttgataatatttgtggactcacgttcggcaaagacccagagactctttctccggagctaccagaaaacccgttcgctgttgcttttgacactgccactgaagccaccatgcacaggttcctctacccgggactagtgtggagattccagaagcttttgtgcattggatcggagaaaaagttaaaggagagcctcaaagttgtggaaacctacatgaacgacgccgtggcggatcgcacagaagctccctccgacgacttgctctcgcgtttcatgaagaagcgcgacgccgccggcagctccttctccgccgcggtgcttcagcgcatcgtcctcaacttcgtcctcgccggcagggacacgtcatcggtggccctcacctggttcttctggctcctcacgaaccaccccgacgtggagcaaaaaatagtggctgagatcgcaaccgtcctggccgacacgcgcggcggagaccgacgccgctggacggaggaccctctcgacttcggcgaggctgacaggctcgtgtacctcaaggcggcgctggccgaaacgctgcgtttatacccgtccgttccgcaggacttcaagcaggccgtggccgacgacgtgctgccggacggcacggaggttccggcggggtcgacggtgacgtactcgatatactccgcggggagggtggaaacgatatgggggaaagattgcatggagtttaaaccggagcgatggctttcggttcgcggggaccggttcgaaccgccaaaagatgggttcaagttcgtggcttttaacgctggaccgagaacttgtttgggcaaggacttggcttacctacaaatgaagtccgtggctgctgctgtgcttctgcgttaccggctatcgctggttcccggtcaccgggtggaacagaagatgtctctcactttgttcatgaagaatgggctcagggtgttcttgcatccacgtaagctagaaagtgggcccggggttgccacctcaccttaa

SEQ ID NO: 100908 - DNA, 333 bp, Glycine max
  Peptide Sequence Number=SeqID_217686
atgggtcatgggaaagaggttaaaacttacaacatcagaattgtggacaaatatatgcacatatatctcttggaagaaagctatctgaaccaacttgcaagacatctttgtgaagttaacaatgactcatacagacctttggatccaaatctaccaagttcatcccaaaggccaagggatagttatcctagtgatagaataatacttcagaatactaatgaaggtcaaatccgaacagagatttatgttccagaacctgagtttcaaaaggtagaagatttggttgatgactattctgcattagaacgagactgggaagactacagtgcttaa

SEQ ID NO: 100909 - DNA, 1278 bp, Glycine max
  Peptide Sequence Number=SeqID_217687
atgaaatggagaaaagcatcgggggtgttatgtgatgcaaaggtaccgatcaagctaaagggaaagttttatcggactgcggtaagaccggcgattttgtacggaacagaatgttgggcggtcaagagccaacatgagaatagagtcggtgtagcggagatgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttataaaaaaggatctcgaaattaatggtttggatagaagtatgagagctgcaaatacaggttggggtcgtgaggaagacaaaccaaaatggggtcatgacaaatttgatggtcccaaaaaagaaagaagatctggcaacaatcaatcaaatcatattgcagaaactagagacagagattcattttctagggcccgcaacaatgatgctgaattagacaaccaacctaagagaagtgatagaaaagagatgacaaagcggtggcatgatgatgatgatgataaatttgagggaagagaaaataacagtagaagagaagaaaagagatcaagaaggcatgaagatgatgacaaatttgaggggagagaaaataacagtaaaagagaactgaatagatcaagaaggcatgaagatgatgacaaatttgatgggagagaaaataacagtagaagagaagaaaagagatcaagaaggcatgaagatgatgaatttgaacataagtttagagaatatcgatacaagagagaagaaaaaggatcaagaagggatgattatgatggtatgaagcttgagccaaaagatcatcacctaagggaagagaaaaggtcaataaagccagatgatgttgaagttgaaccaaagtcgagagattctgatataagggaagataaaagatcccggaggagggataatgatgatattgtaagcaagtcaagagaacctcatggatacagtgaagacaggaaatcacgaaagcacagtgaaggtgaatctgcaccaaagccaagagaagattatgataggaagcaagataaaagatcgtatagaaactatagcaatcaaacagagtcaaaagaaagatatgcttttgacaggagagaatag

SEQ ID NO: 100910 - DNA, 1401 bp, Glycine max
  Peptide Sequence Number=SeqID_217688
atggctgagatgaagaagaaagcagaactgatcttctttcccataccggagattggccacttagcttcattcctcgaattagcacaactcctaatcaaccatcataaccatctttccatcacattcctctgcatgaaactcccttacgctccctctttagatgcatacatcagatcagttatagcctcacaacctcaaattcaagtcattgatctccctcaagtagaaccacctccacaggaactattgagaccactatcacactacatctggtcctacttgcagaccctcaaaccccatgtcaaaggtatagtgcaaaacattttatcatctcattctaaccccattatcgggttgctcctagatgtcttttgttcacccttgattgatgtgggaaatgacttaggcatcccttcttatttgtataattcttcaaatgttggattttttagtctcatgctttcccttcagaagcgtcagattggttatgtgttcaatgattctgatcctgagtggttgattccggggctccctgatcctgttccttcaagtgttttccctgatgctctttttaacaaagatggatatgctacttattataaacatgctcagaggtccaaagactccaaagggattattgttaattctttttcagagttggagcagaatcttattgatgcattatgtgatgatcaaagccaaacacctcctatctatgctgttggtccattgattgatctcaaaggtaataaatctaacccaactttagatcaaggtcaacatgacagaatcttgaaatggctagatgagcagccagattcttctgttgtttttctatgttttgggagtaagggaagctttgatccatctcaaactagagaaatagcactagcgattcagcatagtggtgttaggttcttgtggagtatacattctccgccaaccacagacattgaagagagaatcttaccagaagggttcttagagtggatggagggtaggggaatgctatgtgagtgggcaccccaagtagagattctagcccacaaagccattggggggtttgtgtctcattgtggatggaactctattttggaaagcatttggtttggggtatcaatattgacatggcctatctatggagaacaaaagatgaatacttttaggatggtgagggaatttggattagcagtggagctgaaactggactatagaaggggtagtgatcttgttatggcagaggagatagagaaagggctgaaacaattgatggacagagacaatgtggtgcacaagaatgtgaaagagatgaaagacaaggcaaggaaagctgtccttactggtgggtcttcttacattgctgttggaaaactaattgataatatgttgggaagcaactga

SEQ ID NO: 100911 - DNA, 597 bp, Glycine max
  Peptide Sequence Number=SeqID_217689
atggaaatgcctgccagaagatccaactattcgctcctcagccaaattcccgacgaccagttctcctccgccgccgctccctcatcctccggcgacggcaaggccggccgtgccggaaagtccgaccgtgccgccttcgaatgggacctcgtcgctgatcaccgggccgccaaccggatcggaaacgtctactcctcgataggcctgcagcgccagtccagcgggagcagctacggcgagagctcgctctccggcggcggcgacttctacgctccgacgatctccacggcggcggccagcgacgtcgacgccttcggctacctccacgacgagcgaagcaagttctcggaggcggcgccggcgaggatcgccggctcctcctccgggaagagctgggcgcagcagacggaggagagctaccagctgcagctcgcgctcgctctgcggctctcgtccgacgccacgtgcgccgatgatcccaatttcctcgatccggtgccggacgacggcgcgctgcggctcttgtggtcggccgaggcagtttcgcataggttttggcttgtgagtggacataggtgtagtttgactctggtttag

SEQ ID NO: 100912 - DNA, 2154 bp, Glycine max
  Peptide Sequence Number=SeqID_217690
cttcatttctccttcctcttcacgttactcgctatgaacgaaacaacaccaaatatagagagttatctctatctccatccaagcgagaatccaacagtagctctcgtatcaccagctttagactcaaacaactatcactcatggagcaggtccatggtcacagcactaagcgccaagaacaaagtggagttcataaacgggaacgcaccagaacctctgagaattgatagaacttacagtgtgtggagtcgctgcaataatatggtagtatcgtggatagtgcattcggtatcggtcgcgatcaggcagagcatcttgtggatgaacaaagttgaagaaatatggaatgacttgaagtcacgatacgcgcaaggagacctcttgagagtctcggatcttcaacaagaagcttcatcaatgaaacaaggaactctttctatcacggagtacttcaccaagcttcgtatcatatgggatgaaatagagaacttcaggcccgaccctacttgttcctgcaccatcaagtgtacatgttcagtccttaccaccattgcacaacgaaaattagaagaccgagccatgcaattcctacgaggattaaacgagcagtacaacaatgtgagatcccacgtgttgctcatggagcccatgcccaccataccaaagatcttctcatatgtagcccagcaagaacgacaactatcagttggtcacaccgaaagtgtttgttacaagaaacatggggtacccatcagctatgaaggaagaagcaaaacctacagcagaaacgtgaaaacgtgcacccattgtggaaaaataggacacaccattgatgtgtgttataagaaacacggctaccccccaaggtacaagtttggcaacagcaaagtagtcaataacatcatggaaggaaaagctgcgagtgatcaagtgcaacgacaagagtctcatgatttggttcatttttcacccgaacagtatcaagctttgctagccttaatacaacagccatcttcaggaagctcagtccctacccaaccccaggttgcatccatatcctcatgtcccactaacacctcaccagatcacttccctctcttccctgatacttcagcatcaccacccacttctacttctatatcacctctacctttctctaataatcccgacagttttgcataccccactccacccaatgccaatctttcctcccaacatataccttccacttctatacgacgttccacgagacttaaaaaggcacctacttatcttcaagactatcaccatgcactcacttcacaagctgataccaatacgcatggagttaggtatcctctacactccgttttgtcctactcaagactttccccttcccataaacacttcgtgatgtctatctcggtaaacactgaacccaaatcttataatgaagcttcccaatttgactgttggattaaggctatgcagacggaaatacaagctctacaacaaaatcaaacatggacccttacaccactaccaccacacaagacagctatcggatgtcgttgggtctataagatcaaatacaaagcggatggtactgttgaacgatacaaggcacgtctcgtagccaaaggatacacacaactcgaaggattagacttccttgatacattttctcctgtagctaaactcaccactgtgagactgcttcttgctcttgcttcccttcacaattggcatctccgacaactcgacgtgaataatgcatttcttcacggcgaccttgacgaagaagtatacatgactcttcctccaggtcttcatgtgcatgatcataatctagtatgccgtctccaatgttcattatatggtttgaaacaagccagtcgtcaatggttcacacgactctcttctttcctcatctcccacgacttccgtcaatctacaacagatcattccctctttctccacttccataaccatgatatcactgctgttctcgtatacgttgatgatataatcctagcaggtaacaatctcgacaccatcacacatatcacaaaccttcttgatacagctttcagcattaaggaccttagcaccttaaagttctttctcggccttgaagttgctcgcaataacaaaggcattcacttatctcaatga

SEQ ID NO: 100913 - DNA, 255 bp, Glycine max
  Peptide Sequence Number=SeqID_217691
atggcgaagaatcccgtgaagggaaacgtggaccacgagaatgaaggcaagcacgggtgctggagcgcctcggtggcaagaatgacgcctagggcgaagaccttggtggcgacaaagaggttgccgtcggtgcagagaattgtcatcgttggagtagcgacaaccaaggacaacgtggagctcgtcgcgaaagtggatgatgctagtggccaaggcaagagtcaaaggaaatgcaagaggctgaaggggctctag

SEQ ID NO: 100914 - DNA, 294 bp, Glycine max
  Peptide Sequence Number=SeqID_217692
atggcggagcatcacgaacatgaggaagtgaagggtcagtccttgtcggagaagatttatgggaagatccacgaccatgattcctcgtcttcgttggtttccgacaatgacaaaaccaatgccactgattccctcaagtcaaatgtttttaggcttttcggcatacaaaagcccattcatcatgttcttggcggtggaaaacagaagtataagttgggaaagccaagccacttccactttttgaatcaaagtaaagtctatgaattagatggcataagcagtgctgaagagtaa

SEQ ID NO: 100915 - DNA, 423 bp, Glycine max
  Peptide Sequence Number=SeqID_217693
atgtatggcccctcaccttcgaagtctggagaagcgtctcatatcatcagtgcttgcattgagcaaatggcagatcctcaaccaaatgattttttcttcattgaattacgtgtgaccattccaagatctgagcagagatggactttagcaataaatttgttggcatttcattataatggccttttgattatacattatgttccagacgaacctattattgtgactcaaccgattgattttcacgcacaccttcctgaggtagagaggattgtaggatacactccctccaatccacaaggaagagtgaccacccatagttatcgtcgtctattaagagctttacgtgaaagaggtcgtgttagtggtcgtgaaggtagagatgcaactcgtgaggacgatgaaccttcaactacacctcattag

SEQ ID NO: 100916 - DNA, 213 bp, Glycine max
  Peptide Sequence Number=SeqID_217694
ctgctcaacaacataaaatcaattcgcgacaaggacatagatttaggagtaatcaacccaggagacatatattttagaagcagaaagtactacagatatgttggttctcttacaaatccaccttgcactgaaggtgttgtttggtcattcgtgaaggaggtgaaaacagtctcaatggagcagttaagtgccttgaaaggagctgttcatcat

SEQ ID NO: 100917 - DNA, 405 bp, Glycine max
  Peptide Sequence Number=SeqID_217695
atgatcctccccacctatctcaacttcttctctgtgctcctcctactgctcattctctatttctcttctgtccttgcatctgaagctgaatttagctacgctaaaggaactagcaatgggccagagaattggtggcatctcaacccaaaatggaaagtatgtcagtatggaaaactacaatctcccattgatctccgagacagatgggtgaaagttcttcctcaactgggtgaacttcaaaaagtttacaaaccagctcctgctgtcctaaagaatatgggtcattatatcacggttcgatggaacggggatgcaggccaacttcgtataaatggaaattactacaaactgattcaatttcattggcatacaccttcagagcacacattgaatggattaaagtga

SEQ ID NO: 100918 - DNA, 739 bp, Glycine max
  Peptide Sequence Number=SeqID_217696
gtactagctgacgccattgatttaccatgtcgaattgctaagggctgtaaatattgcaaaagggatgatgcttcatcttgtcttgttcgatttgggattgagagggagtatcttgttgatttaattggaaagccaggaaacttatccgagcctgattccttgctcaatggtccatcttccatctcattttcttcacccttgcgctttccacgacttaaaccagctgaaactaccattgatttcaggtcactggccaaacagtatttctcggactgtgtgtctcttgagcttgtctttgacaacaattctgcagctgttgctaatgtggattctggattctccatttcagaacagtttgatgggaagtgcaaagacaggaataaccctaggccaattttgactgacagcaatagaagttctcaccttcctctgcatcctcaagattctcatccaagctcacgggaacaaggttccgaaacatatcaatcatgtaaccctcctcagaacattgtagactcgactgtgggaaagtatccaccaccaataaagcataagcgtcctgctggtataccaaccccattagcacttacaaatactaatgatgacatgattgagggcaagaggtttgctgaaggaagtcaactgattcctagcaaacatgctcgagagcttaaccttgacatggaggatttggacataccatggtgcgatcttgttttaagagagaaaatagggtcag

SEQ ID NO: 100919 - DNA, 459 bp, Glycine max
  Peptide Sequence Number=SeqID_217697
atggaacaggattttcttgctgagcgcttcaaggaattcctaagggaggttgcaataatgaaacgtttacggcatccaaacattgttttgtttatgggggcagtcactcagcctcctaacttatcaattgtcacagaatatttatcaaggttgtactcctctacatgttcctcatctttttccctcaaagagggaagtttttcaaggctatggataataggatattttgaccttgagattctaagagttcttgacctaagtgcaggggtagcttatataggctgttgcataggtctggtgccaaagaagtattggatgagcggcgtaggcttggcaaaggggatgaattatcttcataaacgtaatccccccattgttcatagagatctgaaatctccaaaccttcttgttgacaagaaatatacagtgaaggtaggaatggagttttctttagtataa

SEQ ID NO: 100920 - DNA, 291 bp, Glycine max
  Peptide Sequence Number=SeqID_217698
atgcgagtatacaattgcacaggatatatcactggaggatcccatgtacaaaaacataacaagtgggcacatagtgaggctgccaatgctgattcccatgtcacaattgttgtccgtggcactgttggacacattgcactagagtacctctccaccggccaatcttctgacaaaacagatgtctttggatttgacattctcttgttagagcttataactggaatgacagcagtcgagtttgggaaaatagttaataaaaaaggtgctatgctagagtggattctgtgttga

SEQ ID NO: 100921 - DNA, 893 bp, Glycine max
  Peptide Sequence Number=SeqID_217699
atggcaccggttactcgaagaacctcgttccccaaggttctcatcgagagagactctgactccgaacagagttcatccgaagaagaagaaatacttgaagaagaagaagaagaagaagaagaagaagaagaagaagaagaagttggggtttctactgcaaatgagaaggccgaaaaactggacctgggttccgacgcaaacagaaaagggaaagcccccatcactattagtctcaaaaaagtttgcaaggtgtgtaagaagcctggtcatgaagcggggttcaagggtgccacgtatgttgattgccccatgaagccttgctttctgtgtaaaatgcctggacataccactttgacttgcccgcatcgcgtctctactgagcatggagttgttccagcaccccgcaggaaaacgtgtaaacctttggattatgtgtttgaacgccagctacgaccatcccttccttcaatcaagcccaaatatgtgatcccagaccaagtgaattgtgctgtcatcagatatcacagcagacgggtaacatgcttggagttccaccccacaaagaataacatcctcttatctggagataagaaagggcaacttggagtatgggattttggtaaagtatatgagaaagtggtctatgggaacatacattcttgtttagtgaacaatatgaggtttaatcctacaaatgattgtatggtctattctgcatcctctgatggaaccattagttgtactgacttggagactggaatatcatcttctccaatgaacctgaatcctgatggatggcagggtccaaacacttggaaaatgctcaacggcatggatattaacagtgagaaaggtctcgttcttgttgctgatagctttggttttcttcacat

SEQ ID NO: 100922 - DNA, 447 bp, Glycine max
  Peptide Sequence Number=SeqID_217700
atggatatagggagtggcaccattggacaaaaagaagtatcttttgggatcttccttattggaaagataatttattgtgacacaatcttgatgttatgtgtcgcaacgtgcccttcgcgggcgagcgagaggcgaggctcacgggtgcgctttccaaaggaggaaaggtgcgcggagtcgccaccaacgtttatttgtggaaaacgttgggaaaaccgaaggaaactggtcaaaatgagaattctaagttcgggagttgtatttacgcttgaggaagtttttgaggtcgacaaaagcggggcttttgctcctacgtaccctcctttggagaggaaatcagacctatgtagttcttccttatgcatggatcaagtgattctcttgaggggtgatcattttaaggcgttggaccttaagaatgatcctttttacttagcaagaaactaa

SEQ ID NO: 100923 - DNA, 825 bp, Glycine max
  Peptide Sequence Number=SeqID_217701
atggatgaacctaatggagaacagacgaatgaaagtgaggctatcaaaactattgttgaaaacgttaagcctttgttagacaagacagagttgtttgttgctgataatccagtcggcgtagaaccacgagtccaggaaatgattgaactattagaccaaatacaatcaaacggtgttctactactcgggatgtgggggatgggaggcattggtaaaacaactattgcaaaagccatttacaacaagattggccgcaattttgaggtaaaaagcttcctcgcaagtattagggaagtttgggggcaagatgctggtcaagtatatctacaagaacaacttatatttgatatcggaaaagaaacaaacacaaagatacgtaatgttgactcaggaaaagttatgttaaaagaacgacttcgcaataaaagggtactccttatacttgatgatgtaaataatttgcatcaattgaatgttttgtgtggaagtcgtgaatggtttggttcagggagtagaataataatcacaactagagatatgcatatacttagagggagaagagttgacaaagtgttcagaatgaaaggaatggatgaagacgaatctattgagctttttagttggcatgcatttaagcaagcaagtccaagagaagattttattgaactttctagaaatgtagttgcttattctgcgggattgccactagctcttgaagtccttgggaagtatttgtttgatatggaggtaacagagtggaaaaatgtattggagacactcaagaaaattcctaatgatgaaagaaaggaatatttcttgatatag

SEQ ID NO: 100924 - DNA, 278 bp, Glycine max
  Peptide Sequence Number=SeqID_217702
ggatcgtgcccgcaagacacccagtggacccgaaggagtccaacagagtcttagagttgccagctctgattacgggcctctgtcggttctatggagtgcatgtcgcccccagcaaggtcatcaggccccctactaatcgagctttcatcaagaagtattgcgcccccaggcaggcgcaggacgaaacaccacagcaacctggggatggccggcagcgggcaacagacgcaccgccaccacctctagagttcacctcagctcatccacaaaaaggttag

SEQ ID NO: 100925 - DNA, 4092 bp, Glycine max
  Peptide Sequence Number=SeqID_217703
atggcggcttccgatggaagtgagtacttcgaaatcggatcgttcgggagcgagagcttcgcgcgagcgtcgaacgccgatatggtgagggaggacgaggaggagttgcagtgggtggcgctgtcgaggttgccgtcgcagaagcgcatcaactatgctctcctccgcgcctcctcttcccgcccgcaacctccgacgcaaggcaccggcaccggcaccgagaacttaatggatgtcagaaaactcagccgctctagccgcgaacaagtcgttaagaaagcactcgccaccaacgaccaagacaactaccgcctcctcgccgccatcaaagaacgcttcgacagggttggattgaaggtgccgaagatcgaagtgaggtacaagaacttgagcgtcactgcggatgttcaaatcggatccagagctcttcctaccctgattaactacactcgcgatgtttttgagagtatcctaaccaagttgatgatatgccgacctaaacggcattcccttactatattgaacgatgtcagtggcgtcatcaagcctggaaggatgactttgctactaggacctcccggagcgggcaaaacctccttgcttctggcactcgcgggcaagcttgatagtaacttgaagacaactggtagtataacatacaatggccatgaattagatgagttttatgttcgacggacttctgcatacattagccaaacagatgatcacattgcagaactgacagtacgagaaactttggactttggtgctagatgtcaaggtgcaaaaggttttgcagcatatacggatgaactgggccgccgagagattgaaaggaacatacgacctagtccagaagttgacgcgtttatgaaggcatcttctgttggaggtaaaaaacacagcgtgaatacagattacattttgaaagttcttggtctcgatatatgttcggatacaatagttggcaacgatatgcttcgaggggtctctggcggtcaaaggaagagagttacaacaggagaaatgattgtgggcccaagaaaaacactatttatggatgaaatatcaactggtcttgatagctctactacgttcctgatagtaaaatgcataaggaattttgttcatcagatggaagctacagtactcatggctctccttcagccagctcctgaaacatttgagctctttgatgatctggtgcttctggcagaaggacacgtggtgtatgaaggacctcgagaagatgtactcgagttttttcagtcattaggttttcaactcccacctcgtaaggggatagcagactttctccaggaggtgacctctaaaaaggatcaagctcaatactgggctgatccttcaaaaccatatcagttcgtctcagttgctgagattgcacgagcctttagaaattccaaatttggaaggtatatggaatccttgcaaactcatccttatgataaatcagaatgtcatgatttggctttggctagaactaaatatgccgtggcaacatgggagctgcctcttatgataactcggcttccagtattttataagcaaagagataatttgttctatcctgcatgggcatggtctcttagcagttggattctccgtgtaccgtattccattattgaggctattatatggacagttgttgtatattacagtgttggatttgcgccatcagcgggaaggttttttcgctacatgcttatacttttcgtaatgcatcaaatggcattaggtctcttccggatgatggctgctattgcacgagatatggttcttgccaatacatatgggtcagcttcactgctggttgtattcttactgggaggatttattgtacctaaaggaatgataaaaccatggtggatttggggctactgggtgtcaccccttacctatggacaacgtgctattacagttaatgaatttaccgcttcaagatggatgaagaaatccgaaactgggaacagcacagttggctacaatatcctccactcaaacagcctaccaactggtgactactggtattggattggtattgcagttttaattggctatgcattttttttcaacaacatggtcactgtggccttgacctatctgaatccaattcaaaaagcacgaacagttatcccttctgatgatgactcggaaaacagttcttccagaaatgccagtaatcaggcctatgaattgagtacccgtaccagatccgcaagagaggacaataacaaaggaatgattcttccatttcaaccactgacaatgacattccataatgtcaattattttgttgatatgccaaaggaactaagcaagcaaggcatacctgaaactcggttgcagctcttgtcaagcgtgagcggagttttctcacctggtgttcttacagcattagttgggtctagtggggctggaaaaaccactttaatggacgtactggctggcaggaaaactggagggtacatagaaggggaaattaaaatttcgggtcacccaaaagagcaacgaacatttgccagaatatcaggatatgttgaacaaaatgatatacattctcctcaagtaacaattgaggagtcgcttttgttttcttcttctcttcgcctgccaaaggaagttggaacttctaaaagacatgaatttgttgaacaagtgatgaaactagtcgagcttgatactttgagacatgctttgattggtatgccaggtagctcaggcttatcaactgagcagagaaaacgattaaccatagcagtggagcttgtagcaaacccttccattattttcatggatgagcctacttctggacttgatgcacgtgcagcagctattgttatgcgagctgttcgaaatactgttgatacaggaagaactgtggtttgcaccatacatcaaccaagtattgatatatttgaagcatttgatgaattacttcttatgaaacgtgggggacgagtaatatatgggggaaagcttggcgtgcactcacggataatgatagactactttcaggttgagggaataaggggaattccccccattccaagtggctacaatccggctacctgggtgcttgaggttactacacctgctactgaagagagaattggtgaagattttgcagacatttacaagaattcggatcaatataggttggagagagatgatacggataaaacagtcttcttcgagaacgggaaaaaaaccatgatgggggtggaatattctgttttgcaatttggacatcctcctgcaggctctgaaccactgaatccagcatataatgccatgaggttatacttcaccacaataagtgctttgatatttggtaccatattttgggacattggttcaaaaagggaatcaactcaagagctgtttgtggtcatgggagctctttattctgcatgcatgtttcttggggtaaataacgcttcttctgtacagccaattgtttcaatagaaaggacagtgttttatagagagaaagctgctggaatgtactctccaatcgcttatgcggcagcccaggggcttatagagataccatacattgctgttcagacagtactatttggtgtaatcacatatttcatgatcaattttgaaaggacacccggaaagttttttctctatcttgtattcatgttcctaacgttcacctacttcaccttttacggcatgatggctgttggtcttacaccttcccaacatttagcagctgttatttcttcagcattttactctctgtggaatcttctttcaggttttctaatcccaaaatcgagtattcccgggtggtggatttggttctattatatctgcccgattgcatggacgttacgtggtatcatcacgtctcagcttggtgatgtggaaaccaaaattataggacctggattcgagggcactgtaaaagaatacttagttgttagtcttggattcgaaactaaaatcaacggattttcagctgtgggcctttcagtgattgtgcttcttggatttattattctgttctttggttctttcgctgtatcagtcaaactcttgaatttccaaaagagatga

SEQ ID NO: 100926 - DNA, 261 bp, Glycine max
  Peptide Sequence Number=SeqID_217704
gtctggctacttgaacttcacaaaataaagaatgtgaaagatgttgatttcctggaggagggggagatagtcaaaatacctgaagtgggagaaaggagtaaagataagggtgctttggaagcagaggttgaaggtggagtggttgatgacattggtgaggtgttaacaaagtatttctctaatctttttacctcttctctgcctcatggcatggcggaaattgcaagccttgtggaggggagaaattatggagagatgtga

SEQ ID NO: 100927 - DNA, 393 bp, Glycine max
  Peptide Sequence Number=SeqID_217705
atggcgaaggacgacatcgacttgacaaaagtgaacttcacgcattgtgaactaatttgtcaatatcaatgcacattggagatattgatagaaggtgtgtttgatgttgttagtgagccattagttgacaacacaaacaaacaagtgcttgatgaaagagttgtagtggcttacacatctgcaaaggttgtttatcctttgtatgatatttcacttgattatggcaatcttaatgagaccaatatgtggctgcataacaacctattgcaaagatgggggaggataatgatggagacctgggttgatgacattgaagaatcttttgatgatgatgatgatgaaagagatctaaattttgtcatcgatattttaggtgagtgtccacttttataa

SEQ ID NO: 100928 - DNA, 558 bp, Glycine max
  Peptide Sequence Number=SeqID_217706
atggacgaaaccgccgtaacgacgaagcctgattggctcaacaaccgcgcgagggtcgccggagagagaaccgaagaatttttctgtggcggcgacgacgaagaggaatgcgacgacgaggcttgggacatgttgactcggagcttctggcaggcgcagactgtgctggacgagaaccgtgcgctgatcgacgaagtgaacagcaaccacgagtcgaagattcctgacaacatggcgaagaacgttggcctcattactcagatccacggtaacatctccaaggttcgctctatttactccgatttatctgtaaatttccccaacattattcgccagcgcggcgtcgccgccgtcaaccaccgcaatcgcgacggcgacgtcgaagaggatgaagatgaggcggagaactcggaggagaattccgcggagcacgtgctggataaatcggaggaggtcctgtggaactgggaagtagggaagggaaaggggacaggacagggattgaacctgtgcgttgtgttcgccatggtaaagattgaaaccgcaagtgccctgtga

SEQ ID NO: 100929 - DNA, 450 bp, Glycine max
  Peptide Sequence Number=SeqID_217707
atggaagctatcaatctgaagggtctcaaaattgttgatgatgaggaagagctattcatccacactgaagtcacaaacgaggaacaaccaaacctatcgctttgtctggaagtggagatcccgaaggagatacctcttttcaaagtgccttctggattcaatactatgggggtagagcaaagcattgcgaactatgtcaaggagttcttggactatgaggaaaagaacaattctggtctatcccactcacaatcactcatgcgcactaagaagattcgtaagcaaggtggagaagcaaaagaagttttgttcaagtacgagaaacttggtgtcttctgctactactctggccttttgggccatatattgaagaccactgtgaaaggcttttttctgcaagcattgatgatggcactcgtctgtggagagaagggactagggctgaactga

SEQ ID NO: 100930 - DNA, 201 bp, Glycine max
  Peptide Sequence Number=SeqID_217708
atggtgcagcaagacaaagcaactggaagtacccacttctgcaggaagatgaaagctagaatccatggaaaggaagtggtctttttcctaaatttgagttggaatgctgatgacttggtaggtatgggttttaaacagagtaatccagtgggaattgttatggatgtcatggaggagtttgttgtttactgtctctggtaa

SEQ ID NO: 100931 - DNA, 1083 bp, Glycine max
  Peptide Sequence Number=SeqID_217709
atggcagattcgatttgcagaacactgagggatggagcgttggagggagagcttgcgcctactctcacaatcaaggactccctcgcttcacctttcgcctttcatgtattctctcacattctacttcaactctcgtcacacgtcatagcacaaaaatctcagtcacagggtatagtaattgttgcactttctcggagtccatcgtcttacacttctttgttaaagatgaatgggatggatgttgcttcttctaataaatggattcacattttggattgttatactgatcctcttggttggaaggataaggcaaggaaatctgcgaatgttacggatccttctcagcaaatttcgcttgctactagttcttataaaaccgtgaaggacgtggataagttgtttttggtaattgctgaacttggcagaggattggttggagaaaataaagcccgcttctgtgttgccatagactcgctaagtgaacttttgaggcatgcatctatgcagtcagttgcaggccttctaagcaatctgcgtagccatgatcaaatttcaagtatgtttggattattgcattctgaccttcatgaggagagggctgtggcagttcttgagtacatgtcctccatggtggccagtgtagacccgtatcatcattctgcagatggtcagaaaaggttcaaacgcagaaatgggcgagttagagtaacggtgatttctttcttcctgttttgtgaagaatttaaagttgagcctggaggaatcagcttctcacctgtttcatcagtagatggaaccgtcattgcaggcatagtgccaaaggtgcagttcaatctccagctgtcagagaaggagcgaattgataggtcaaatgttgtgcttccttttgaacaccagggaaatggtaaaccaatacaaatttatgatggtagaagatcccttgaagagagcaacagtgaggcaaatcccatttcaagtggtaaaaaggaggattctgccatgggtgaaattatatattttcgtgattcagatgatgagatgccagattctgatgaggacccggatgatgatttagatatatga

SEQ ID NO: 100932 - DNA, 213 bp, Glycine max
  Peptide Sequence Number=SeqID_217710
atgacggcacctctggaccttgcgatacacctcctcgtgaaggattggaggaaggcacatcgtgcggttcgtgatatctcagagggtgtagtcttaaaatccattgttgaagaggagatcagaaaagattttgaggtccttgtaattcattggaaggaagcacttcatgaggctgctggcatctcgaggtttgtagtcctaaatccaacgtaa

SEQ ID NO: 100933 - DNA, 192 bp, Glycine max
  Peptide Sequence Number=SeqID_217711
atgacttataggagaggcagcaacaagtgtagagacataacagacccagtaacatacctgctggcagcgatcggtgccatgtttgttagcaaacgatgcttgagcgttgagttttcaattcgtgccctcatcccggttgaggaatatcgagctccaatgagtttacagctggaggaggttgctgaaaattga

SEQ ID NO: 100934 - DNA, 1203 bp, Glycine max
  Peptide Sequence Number=SeqID_217712
atggccaccacatctagacacccctctcgtaataaaaccccaaaacagcacttcaaagtgtgtttttgtttcaggagaatgtttaggctcaaggggactgaacctcctgacgaaatcaacactgtttttgaagagtattcactggatggcatcatgagcatgcatgacctgggcaatttcttagttcactttcaaggagaagaggaaggtgattccatcaacaaacatgctcaaaccatttttgacagtctcaagcatcttaacatatttcataggaaaggcattcatgttgaagccttctttcgttatctcttaagtgaccttaatggtccccttgctgaggtgcaccatgacatgaagtttcccttggcgcattatttcttatacacaggccacaactcctacttaacaggaaatcaagttagcagtgctagcagtacttctgcgataataaaggcattgaagaaaggagtaagggtaattgagctagatttatggccaaattccagaggcgatgatgtgctggttcatcatggagggactctgacttcttccgtgaaactcaaagcttgtctaaaggccattaacgactatgcattttttgcctctccgtatcccgttgttataactttcgaagaccatataactcaatttcttcaagccaaagtggcccagatggtcgatgacatatttggagatatattgtttcgccctgaatattcacaacaaatgacacaattcccctccccagaacaattgaaggggaaaattctaatttcaactaaaccaccagagtctcctgaaagccaggaccagagggtacgagaagaagcacataggcttgagtacgatgatgatagaactagagtcaattacaaggatgatttagaggagcaagaagaggaagatgatactcttgaatatagagatttgatttccattcgtgcagggaagccaaaaggtaagttaagaaactggctgattgatcatgaacaagtcaggcgtcttagcttgagtgagcaagagcttgaagatatcgccaaaaatcatggaactgacattgtcagattcacccaaagaaatttgcttagaatatatccaaagggtactcgtctggactcgtctaattacgatcccatgattggatggatgcatggagctcaaatggtagcgtttaatatgcagggaaaggaagctacatga

SEQ ID NO: 100935 - DNA, 288 bp, Glycine max
  Peptide Sequence Number=SeqID_217713
atggttgacattgggaatcaatacttcatggtgaagtttgatcgtgaagaggatcaactcaaggtcatggagggtggaccttggatggtctttgaccattacttcactattcaacaatgtgggcatttgtatcgggtgaagtataaaggtttgcctagggtttgtggtacttgtgaatgttatggacatcttacaagggagtgcaagcagttcccaatgcaaattgctaaagatggtgtaggtgattctccgtcacaacctataacggcttcttcatcgatggtttga

SEQ ID NO: 100936 - DNA, 606 bp, Glycine max
  Peptide Sequence Number=SeqID_217714
atggaaaaatacggtgacaagttggaacctattgtgggttgcagcacctctgacgttatcctgcgaaaacaacaacaacaagaacatcaaaacataaaaatcaaatcacaaaacacaccaataagacacgttaaccgcaacggaagcagaaaaagtagtaccaacaggaagttccgacgaaggtgtttctggagcgctagcggtcgtcggggaagtttcgacgaaggtgtttctggagcgctagcggtcgccggtgtcgaacatgcaagcgaagacgccgaagttagcgagcttgaccttgtcgttatcatcgaggagaatattctcagccttgacatcgcggtgaatgtggccgtgtcggtggagatactccaacaccttgagagtccccttgaggatagatccgatggtggcctcttcgaatcccttgggataagcggccttcacgaggtgcaggcaggagccttcgcggtgaatcttaaggcttcagactcttggtcttctttggtttcttcagtcaccgcatcgctggttctgctcatttttcgaggtcgaggggttgtgcgtgtgaatgccaaaggacacagcgtgtggactgtgagataa

SEQ ID NO: 100937 - DNA, 984 bp, Glycine max
  Peptide Sequence Number=SeqID_217715
atggttggtgctaattttttaaatttggagcatctcttaaatgatcttgaaggcaagtcagatctcaagattcgagctttagaggttgtagaggaacttagaactaagagagcggacaagcagtctatgcttcttttagatgccttcaacaaagatagggcatctttgcctacacctctgccaaatccaccacctttggcacctcttcctgtagttgctcctgatgctcgaacacaggagatgataaatgaaaagctgaagaaggctgaggatcttggtgagcaaggaatggttgatgaggctcaaaaagcattggaagaggctgaagcacttaagaagcttcctgccaggcaggagccagtgttggattcttcaaagtatacagctgtggatgtgcggattactgatcagaagctacgtgtgtgcgacatttgtggagcatttttgagtgtttatgacagtgatcgccgtttagctgatcattttggaggcaaacttcatttagggtatatgcagattcgtgagaagttagccgaacttcaatgtatgaccataaggcaaaaggaacggacaaaagaaacagatggtggggttgactttgtttggtcaggggttgtgttttttgtcataggaaggatcttaaaccatgctgttttctggctcaggaagaaaggaacaagagccgaaagactgatcggcttgatgacaggagatcaaaagaacggagtagggatcgagacagggagtctagtagggaccgtgaacttggtgatagtcgtgaacgagggcgagaccatgatcgtaggagcagagatcatgataggcattatgatagagatcgtggatatgatcgagaccgtgacagagactcagaccgcacccgctcctatgactcaagaagtcgtcggaggtcacgctctagatcccgagagcgatctagagattatgatcgacataggtacagaattccttgactatccttga

SEQ ID NO: 100938 - DNA, 672 bp, Glycine max
  Peptide Sequence Number=SeqID_217716
atggcgaaggcatttcacgccccagcaacgaacgaaaaccagaaaataactgcacagcttaagcttgtattgtactgcatcgcaaagccccatgttggtggtcttcattttcgtcttccttttcttcatttttctatacaagttcctcaccgcttatggttgtttggattaccggtgctagccgtggaattgcttgcaagtttaggggccaagcttataatctctgcaaggaatgaagttgagctaaaccgagtaaggacacagctgaaaggtaaacatgcacctgatgaagtcaagattttaccattggatttatcgtctggagaggattctctttggatagctgttgagaaagcagaatccttttttccagattctggggttgattacatgatgcataatgcagcttttgagcgtcctaaaacatcaattttagatgtaactgaggaaggtcttaaggctacctttgatgtcaatgttctggggacaataactctcacaaagctcttggcacctttcatgttgaagagggggcatggtcattttgtggtgatgagtagtgcagcaggaaagacacctgccccaggtcaggctgtatactctgcttctaaatatgcgctcaatggttacttccataccttgcgttcagagctttgtcagaaaggaatccag

SEQ ID NO: 100939 - DNA, 1047 bp, Glycine max
  Peptide Sequence Number=SeqID_217717
atggcggaaaatgcttcgattgagctgaacaagtttgtgttcttttgtttgttggtgctaatacaagtggcagtttctgaaatcatttttgaagagcgttttgatgatggatggcgaggtaggtgggtgaagtcagactggaaaagcagtgaaggcaaagcaggttcattcaagcacacagctggaaaatgggccagtgatccagatgataaaggtattcaaacatccagtgatgccaaacactttgccatctctgcaaaaataccagaattcacaaacaagaacagaacattggtccttcagtattctgtaaaatttgagcaagagattgaatgtggtggagatttatgtggcacggatacaaagaagctccatgtgatactctcctaccacggtcaaaattaccccataaagaaggacctgcaatgtgaaactgacaggccagatgccacatacagtgtcctggttgacaatagagagagagattccggaagcatgtatacagattgggatattcttcctccacgaaaaatcaaagatgtcaaggccaaaaagcctaaagactgggaagaaagagaatacattgaagaccctaatgatgtcaaacctgagggatatgattcgatcccaagagaaattcctgacccaaatgctaaagagcctgaaaactgggatgaagaggaagatgggaaatggaaaccaccaaagataccaaatccagcatacaaaggaccatggaaaagaaagaaaatcaagaaccctaactacaaagggaaatggaaaactccatggatagataatccagaatttgaagacgaccctgatctttatgtgcttaagcctatcaagtatgtgggcattgaagtttggcaggttaaaggcggttcagtttttgacaatgttttgatttgtgatgaccctgattatgcaaaacaagttgttgaggaagtgtttgccaacagggaggtgagattttctcttgcatttgatttagctccacatctgacctataggtggcacatgggttacatattaaacaacaactaa

SEQ ID NO: 100940 - DNA, 423 bp, Glycine max
  Peptide Sequence Number=SeqID_217718
atgggtcaagtggcacaactatttgactctacactaaggggaagaaggttctggggggatgtggaggagctcagttggaaggttgttagaacgtatataagagtgcaagagacaaggattagtacatataagctgcaaaatggagaacaatccaaagccattgtagagattgaaggggaaaactcaaccactaaggacaacaatgacagagagacagatgtagaaagtgatgttgcaagaagagagtttgatttaattgaggaaatggtattggttgtgaagaaggaatcacggccaaaactgcttatccaagtcagcaagaacagatcagaggccaataaagcaaaaatttcaggaatttcgttgtcagaaagttcacaagcagaagtaatatgcttccaccttcagcaattgggaagatag

SEQ ID NO: 100941 - DNA, 801 bp, Glycine max
  Peptide Sequence Number=SeqID_217719
atggcatcctcgttggcacctgctaccaaagccgccactaatttgcgcctcacacactctctccgcttctctcctaaacccaacaacctacgctttgccaccaagcctggtaatacgctgttatgcgcaagggttaaggcccaattagatgaggttgcccttgatagttcctcaaatgctactcctcctatcaaagccaaatcaaaggaggaaccacccgcaaaacctttagctgaaccatcttcttcagtcttggcaactcaagaatcggtctctcagtttattactcaagttgcaagtcttgtcaagcttgttgattcgagagacattgtggagttgaagctgaagcagcatgatgttgaagtaacaattaggaaaaaggaggctatgcctcaaccaccacctcctcctcaacctgcggtggtgtattcatcccctccaccagtgttgccaccgccatccgtaccagcatctactccagcacctactctagctcgtgcaaccccttcaccaacttcagcccctgctgtgaagtcagctaaatcatcacttccgcctcttaaaagccccatggcagggacattctaccgaagtcctgcacccggtgaacctccctttgtgaaggttggagacaaagtaaagaaggggcaagttgtatgcatcattgaggcaatgaaattgatgaatgaaatagaaagtccagaatttgtaccacagaatgagatagtcaacccagtaggcgatgttttggatagaagaatatcattgaaaggaaagaagaggtatgaagaagaaggataa

SEQ ID NO: 100942 - DNA, 546 bp, Glycine max
  Peptide Sequence Number=SeqID_217720
atggatttcttcctttcatgtttgggtgctttggaaagtgcaccaactacaaaccaaacacacgctaagtggttagaaactacagcaggtggagcttgcaggcagatgtttatgactgcattgatgagtagtgcagcagcaaaggcacctgccccaggtcaggctgtatactctgcttctaaatatgcagtcaatggttacttccataccttgcgctcagagctctgtcagaaaggaatccaggtaactgtgatctgtcctggtccaatagcaacatcaaataacgctggatcaagggttccatctgagaagcgtgtgccatctgaaaggtgtgcagagctgactattattgctgtaacgcatggcttaaaggaagcttggatatcatatcagcctgtgcttactgtcatgtatctcgttcagtacatgccaactattggttattgggtcatggacaagattggcaaaagtcgagtagaagctgctgaacagaagggaaacacatattctttgagcttaatgcttggaaaaaagaaggccacttga

SEQ ID NO: 100943 - DNA, 775 bp, Glycine max
  Peptide Sequence Number=SeqID_217721
atgtcacagcgtgttggagagattagagaatcttctggtctacagctattggagcaagaacttggcaatttggaggagcaagcagctgatagctccttttgggacaatcggggcaaagctcaagagactctctcgaccttggctgatgtcaaagataagataaaattactcaatgatttcaaaacacaggttgaggatgcagaaacaatagttagcttgactgaggaaatggactccattgatagagggctttttgaggaggcttccaatcttattaaagaactgaataaatcaatagatcgatatgagctgactcaacttctatctggtccttatgataaagaaggtgctgttatctctattacagcaggtgctggtggtactgatgcacaggattgggccgacatgcttcttaggatgtacatgagatggggtgagaaacagaaatacaagaccagagtggttgagaaatcccccggagaagaagctggaattaaatctgctaccattgaagttgaaggtcgttatgcatatggatatttgtctggggagaaaggaacgcatcgcattgttcgtcaatcaccttttaatgccaaaggccttcgtcaggtcatgcctcttcttccagatgaatctatgaatgttgaaattcctgaggaggacctggaaattagtttttcaagagcaggtggaaagggaggtcagaatgtgaacaaggttgaaactgcagttcggatcactcacattccaactggtgtcactgttcgctgcacag

SEQ ID NO: 100944 - DNA, 1491 bp, Glycine max
  Peptide Sequence Number=SeqID_217722
atgcctcacatcctgcccgatttctcaaactcagtaaagctcaagtatgcgaaacttagctaccaatacctcgtgaatcacatcaaaaccctaaccctaatccccatcatgcttggcatctccatagagacacttcgcctaggcccagatgagatcctcaacctttggaactctctccacgttaaccttgtccaaatcttcttatccaccttcctcctcatcatcatagccaccatctacttcatgtcaaagccacgcacgatcttcctagtggactacgcgtgcttcaagccccccgtcacgtgccgcgtccctttcgccacattcatggaacactcaagactcatcctcaaaaacaatcccaaaagcgtggagttccaaatgagaattttagaacgatcgggcctcggagaagaaacgtgcctccccccagcaatccattacattccaccaaaaccaaccatggaagccgcgagaggcgaagcagaacacgtggtcttctcagcagtggactcgttgttcaagaaaacgggtctcaaaccaaaggacatagacattcttatagtgaattgcagcctcttttctccaacaccatctttatccgccatggtgatcaacaagtacaaactaagaagtaacatcaagagcttcaacctctctggaatggggtgcagcgcaggccttatttccatcgatttagcgcgcgatcttcttcaagttcatccaaactcaaatgccgtcattgtgagcacggagatcataaccccaaactattaccaaggaaacgagagggcaatgcttcttcctaactgcttgtttagaatgggtggcgccgccattctcttatcaaacagaaaacaagaacgcaagagggcaaagtacagattagtccacgtagttcgcacccacaagggctccaacgagaaagcattccgttgcgtgtttgaggaggaagacaaggagggcaaagtggggatttcactctccaaggaccttatggccatagctggagaagcattaaagtccaacataacttcaatggggcctctcgtgctccctgcttcggagcagttacttttccttttaaccctcattgggaggaaaatctttaaccctaggtggaagccctacatccctgacttcaaacaagcgtttgagcatttttgcatccacgctggtgggcgtgctgtcattgatgagttgcagaagaatcttcagctttccgcggagcacgtcgaggcttcgaggatgaccctgcaccggtttgggaacacctcttcttcttctttatggtatgagctgaactacattgagtccaaggggaggatgaagagaggagatagggtttggcagattgcgtttggaagtggattcaagtgcaacagtgctgtgtggaggtgtaatagaagcattcagacaccctttgatgggccttgggccgattgcattgatcgctaccctgttcacattcctgaaattgttaagctctag

SEQ ID NO: 100945 - DNA, 327 bp, Glycine max
  Peptide Sequence Number=SeqID_217723
atggtactcatgacagggaggcgagatgggatagaagatgaatccaggaagaataatggaggggaggggacagactcacaacacaatagggaaggaaagaaggcgttaatggtgttgtggtgcaacatgagggaaggaggcatgagtgaatggtatcagtcattctggatgccaaaaagaaatgtaagaaaaaacttaaagtgtaggaaacaacatcctcaaagatggtctattggaagcattctccacggtaggtgtgagcacaaaagccacactcgttggacaactgaggtacccaaagtcaaattgatagaagaaaatggttaa

SEQ ID NO: 100946 - DNA, 786 bp, Glycine max
  Peptide Sequence Number=SeqID_217724
atgtcttctttcctgttacgctttccgcctgaacggtatcaagaggacaacagaaactatgacgtgtttttgagtttcagaggggacgacacgcgtgcttctttcacttcacatctctataccgctcttcacaacgcgggaatctctgttttcaaggatgatgagacacttccaaggggaaataaaatttcaacctcgctggggttagcaattgaagagtctcgactttatgttgttgttttctctaaaaactatgcaggttcgctatggtgtttgcaagagttggagaaaataatggagtgtcacaaagcaacaggacaagtggtagtgccagtgttctatgatgtagatccctctgaagtacgtcatcaaacaggccactttggacaagcatttcgaaaccttgaggcgtatatcaatttaaaaatggaagaggaaatgcagccaggatggcaaaagatggttcatgagtgccctggcatctcagggccttctgttttccgagattgcaatggtcaaagtgagattttggaaaggatacatcgcctcgtggaggattggagggtgtcacttcgtaagattgttagcatctcccccggttcaggattcgggagaggaatgttgattgctgaacagttaatagatctccttgtgaagcattggaggacgacactgagaaaaataatggagatgcctagtaatatagatctgcttttgaagcattggagtgaggcactttggaaggctgctggcatctcggggggtgcagacctaatttccaagtaa

SEQ ID NO: 100947 - DNA, 1194 bp, Glycine max
  Peptide Sequence Number=SeqID_217725
atgccgacgccggtcagtgtagtgaggcaatgcttaaccgacgaggccgcgcgtgcactcgacgacgcagtcgccgtcgcgcgccgacgcagccacgctcagacgacgtcgctccacgccatctccgcgctcctggctctcccctcctccgccctgcgcgacgcgtgcggccgcgcgcgctccggcgccggcgccggcaccagcgccgcccgattctccgccgcatactccccgcgcctccagttccgcgccctggagctctccgtcggcgtgtccctcgaccggctcccttcgtcgaagtccacctccgccggcgaggaggagccgccggtgtcgaactctctcatggcggcgataaaacgctctcaggcgaaccagcggcggcacccggagagcttccacatgttccagcaaagccaacagggaacagcatcgacgtcgtttttgaaagtcgaactaaagcacttcgttttgtcgatcctcgatgaccctatcgtgagtcgcgtcttcgctgaagcagggtttcggagctgcgatataaaactcgccttgctccaaccgcctctgcctccggttcagcaccggttcaactggtcacctccggttttcctctgcaacctcgacccggcccagcccgacgaaaatattcgcaggatcatggaagttctcgcgagaaaaaacaagagaaaccctttacttatgggcgtttatgcaaagagtgctctaaagggtttcgttgagatggttcggaatggaaggggaggttcggcattaggttcggagttgagggtggttcgtttggagagggagattggggagtttgtgaaaaagggtgggagtggggaagagaaatttggtgttaggttgaaggaattggaacagcaatgtgagggttctggttctggggttgttgttagtttcggggagattgaggtttttgtaggggaagatgttgatgttgatgttgtaaggttcgttgtttcgggtttaacgaggttgttggagattcgtggtgagaaggtttcgttgctgggcgtggcggaaacttctcatgcttattccaagttcttgggattgtttcccaatgtagaaaatgattgggatcttcatttgctcactgtcacttctgccactccttccatggaaggactctactcaaaatccaggttcttgcacgttgattcgtgtaaataa

SEQ ID NO: 100948 - DNA, 2139 bp, Glycine max
  Peptide Sequence Number=SeqID_217726
atggggtcctttgttccatttggagggttcttttctacacctgaaatcagaagtccggtaagctgtgcaaacgggtcttttacacgttgtgacacatgcaataaaaaatgtgaacaagaagttgcagatcttctgaaggtagatccttcatctagttattcaacaagctcacactggttacaaaaggttgttaacatggacgcgcatagagggtcggacgtggcaaagaaagagctccatcatccagtgcagactaatgaagaaaacacaagtttgaatgataaaatcttgggatttcaaaagaaatggagtgatatttgtcagcgtcttcatcacacaagttcactacctcaatttgatatttctcaaacaaggtcccaagctccaacagttgaggttttacggtttggtctggcttttaaggaaagcagcaataaagacccatcacacagtgaattccaatattctagtcaaatttcctgcatgcccaaagagttgcatagtatttttccttcgaagcagttatctgttccattaccttctgatacagtctgcattaatactggaaccgatcatgttccaaaagtttcagagacactgcaaattcacatgaacaccccttgggttgccccttcccttatggccaataagagtgcacttgaccacagatcatcttcattccgtactcctgtgaccacagatttaggattgggaacgttatatacatcaactgctcaggatccagataccccaaaactacaagatcaaagaaagcatcttcagcacctgtcagattctgtttcaactgattgtgatggtatgaatgaaaatacttctcaccgaattgctagattttcctgctctggttcaaatttggaaggtaaatttgatttagcagatttcaagtctcttgatcgacttctcactgaaaaggttggctggcaggatcaagccatatgtgctatcagtcaaactttgtccctttgtaaatctggtgcaggaaagcgtagaggctcaaatggtagagcagacatatggttggctttccttggacccgatagacttggaaaaaggaaaattgcttcagttcttgcagagactatatttggaaaccctgaaagcctaatctctgtggatcttggcttccaggacagcttttacccattgaactcggtttttgaataccaaaaatcacgttgttatgatgtgcttaggaggaagacaattttggattatattgctggggagttgagtaaaaagccacattctgttgtctttcttgaaaatgtagataaagccgatgttttggtgcagaatagtttgttgcaggcagtaagaacaggcaaattttcatattcgcatggaagggtgattagcatcaataacacaatctttcttgtaacctcaactgtctgtaaaggtaatggctcttttgttttggaagagtctaagatgttttctgaggaaagaatccttgaagccaaaagatgccaaatgcaattattacttggacatgcttctgaggatgccggaagaattggtagcacaaatgttaaggttgtacccggaaaagggttttccaaatcatcatctctgaacaaaagaaagcaggctgatattagtgactccaaggagggggcaacaagcaagatgcagaaacaagacagtgaggcatctcgatcctatcttgatctaaatatgcctgtagaggatggtgaagagggtgtcaatgatgaccacgaaagtgaatccataacagaaaacacagatgcctggttaagtgatttctttgatcaaattgatgagaaagtggtgtttaagtcattcaattttgatgagcttgctgaggaagtattaaaaagaattggcatgctatttcaaaggacatttggttcagagcttcagctggaaattgattatgaggtaataacacacatacttgctgctgcttggttatcagacaagaaaaatgcagttgaggattgggttgaacatgttcttggcaaaggctttgttgaagctcagcagaagtaccttcctgcagctcaatatgtagtaaaactggttaattgtgaatccatttttgtggaagagcaagctcctgatgtgtgccttccagctagaattaacacggactaa

SEQ ID NO: 100949 - DNA, 171 bp, Glycine max
  Peptide Sequence Number=SeqID_217727
atggaatcaaaccattcatcaaaatactgctcatcgcggccgtccatactggccaacacaagcagtcagcagaacaagaacaaccaggtctttaaccgttccagacctgacttctacccagcaagtagtacattgcagcagattgcatatgactcattattttcctattaa

SEQ ID NO: 100950 - DNA, 207 bp, Glycine max
  Peptide Sequence Number=SeqID_217728
atgaagatcaatcttgaaaattcacccaagcttgaggttttagccaatgaatctttatcggagagtgtaagagatacatatgcagctagtaatgatgatgtggatgtgataaatggaatggaagcatggttggatctattagcttggtcatttggtggaagctcaatccttcatgaatcacatatttctatacttgatccttcttga

SEQ ID NO: 100951 - DNA, 201 bp, Glycine max
  Peptide Sequence Number=SeqID_217729
atgaaagctggctacactggttttcaatgggaagagtctgagaaactacttagtattgagggaatggagcaatggcagttttttatttttaaatcacaagttagacaagatcatatcgatgcaagtgaacagtgtgagctaggtttgtatgatggctatgataatgaggaattaagtttggtcactagctactactactag

SEQ ID NO: 100952 - DNA, 2073 bp, Glycine max
  Peptide Sequence Number=SeqID_217730
atgtgcggtgtttccaaggggaaaccttctcaatttggtttggtcatggaggagtatgcaaaagaagggatgcatcatataatttcagctttgcttgagttttctgcagcagatgatctggttagtttcaaagatgcggttgaaaaggagggtcatgatattgatggggtagggttttggtatggaaggtgtgttgcctcgaagaaaataggttatgaagagaggacacctctcatggttgcttccatgtttggaagccttggtgtatcaacctatatcctttcaacgggtagtgtcgatgttaattgggctagtaggtcagatggggctactgctcttcattgtgctgttgctgggggttctgccgcttccattgaggttgtcaagcttttgcttgatgcatctgctgatgttaatgctattgatgccaacggtaaccggccaattgacttgattggctcggtgaccaattctatcttcagtcaaaggtcaagggtgctacaggccctcctggagggtacaagtgatgctgatcaggcatgtcttgcacttccagaagtgattgaccaaattgaggaacaaaggcaagatatgactacgccccgtgtttcgaaagattatcccattgatctctcccttccagacataaagaatgggatatatggtactgatgagtttaggatgtatacattcaaagtgaagccttgttcgagggcgtattctcatgattggactgagtgcccctttgttcatccaggggaaaatgcaaggcggcgtgatccaaggaaatatcattacagctgtgtcccttgtcccgagttcaggaaggggtcttgcagcaagggcgatacctgtgagtatgcacatggtatttttgagtgctggcttcaccctgcccagtaccggacgcggctttgcaaggatgagagtggatgcacaagaagggtttgcttctttgctcacaagcctgaggagcttcgccccttgtatgcttctactggttccgctattccttctccaaggtcctattctgctagtgcttctgcattggagatgggttcagttagtccaattgcacttggttctccatctgtcttgatgccacctacctcaacaccacctttgactccatctggagcatcttctcccattgctggatccatgtggtctcaatctaatgtttctgtccctaccctgcagctgcccaaaagcagattgaagaccgcatcaactgcaagagacattgatttagatattgaactgcttggacttgaaacacatcggcgtagacagcagctaatgatggatgagatatctgctctttcctctcccaactggaaaaattccatgcctaatagtccatctttccatgttcctttgagtgatcacactgagttaaataggctttcaggggtgaagcctgctaaccttgaagatatgtttggatcactcgatccatcaattttgtctaaataccatggaatctcacttgatgttgcaggaactcagttgcaatctccaaccggaatccagatgcgccagaatgtgaaccagcagctaggaggctattcatccagcctttctacttcgaatgtgattgggtcacgctccttcaggcttgatcagtctggcgaagcagccacggttgccttgaatccaagagctgctgcctttgcaaagcggagccagagcttcattgagcgtagcgtggtgaaccatcattctgagattccttctccaaatccctctaccttctctaactggggctcacctggtggaaaattagattgggccataaatggagaagagctgaataagctgaggaaatctgcttcctttggatttcgaagcagcagtagtcctctaacaaaggcttcaaacaaaatttcagcaaatgttgatgatgagccagatgtgtcttgggttaactcacttgtgaaggatgctccaccagaatccggtgaatatagtgtggaagatcatcgaaagctactgcaatgccacaacggaacagatgcgattccagcatggctggagcaattgtacttggaccaggagcaaatggtggcgtga

SEQ ID NO: 100953 - DNA, 2178 bp, Glycine max
  Peptide Sequence Number=SeqID_217731
atgaatctgcgaacccaaaatcaccgtggaaggagcaccaggcttcttcttcttcttcttctgattctgtatggcatttgcgtagctgaaagcaatgaaggagtcgaacacgtcagaggaggccccgattctgtggtttgggtggttcagctttccgatcttcatttcagcgttcaccatccaaacagagccctcgatttcgctaaactcgtgggccccgctctttccgtcatcaacccctccctcgtcctcatcactggcgacctcacagatggtaaaagcaaggatttgctgacaatgaagcagaatgaggatgaatgggtggaataccggactgtactggacactgttattaagagaagtagactccataagagcttgttttttgacctcagaggcaaccatgacagttttggtgtaccggttgttggtggttcctttgatttcttttctaaatacagcatcaatgggcagttaggaagaaatgggagtatcaatagtgtcacccttgagactcaagaccggaaacatctctttgttgggtttgatagcacaatgttaactggcttacgaggtccaactaatctttttgggcatcccactgatcaattactaaaagatctagacttggaactctcaaagtgggattctcagtcagaaaaaccagttaccaaaatttcctttgggcattttccactttcattttctgcaccctcaagttctggaaggaccttggaagatgttttcctaaagcattccatatcagcttacctgtgtgggcatctccatactaaatttggtatgaacttaaagcggcaccatcagtggcagaaactttgtcagtttaatatacaccagagtgcttttgaaagtactgtaaattgttcgttgggagccccaccaattcaagagttttgggagtgggagatgggcgattggagaaagagtagagcctttcgtattttagccattgatagaggtcatgtttcatatgttgatgttgatttcaaatctgggaccaaacgtgcaattatattgcccacttttccattagactctcgcttcatgttaacatcttcatgccgtcacaactatgaatgtcaatctgtgtccccttcatcttatgaaacaattcgagctctggtattttctgtttctccaattgtatcagttgtagctagggtctatgattcacgatctggaaaccttgatttagttgtagaaacacatatgatcaagcatgctggtgataactccaggggggacctctatgttgctccatggaattacagagcatttgaggatgcttctcctgatagattttggcttcaaattgaagcaaatgacatcgcaggcagatcaactttgactgaattgatgccattttctatcaatggtcataacctcaagctttcttggagctggaaagagtttttggtcatgggatgtcaatgggcttccctttattacccattattttggtctgctctttactttttgttcatattccttcttcttccaaaagctctccttgtttttccaaagaagatatacacttacaagaatttcattgccaataaaggcttagtaaatggtgtattatggtttctccaggagctctgcaggatccccaaattatggtttggttggctaggatacctattttatcttacattgtttccctggtttatggggcaagtttttactgaagggaaaaatatggtatacatgacctatatgggttgggccatagagacttctaatggaaagggggaggttgagtatgttgggtctccagatattatggtggtggttcttccccatctattatttgtggttttgcctgcaattttggtcactggagctctgacggctgaaagagcaatttgccgggaacatatgttagcaattttggtaaagaaaaaagatgatcttcgtatagactctagaaaatctgtatggaatggcagcatggtatctaatgttcatcttagcaagcgatggattcggaagcttctttttgtggtgtgcttggcaatatgttggaaacattttatgaattgcagaactcttctaaaagcttacgagatgaacccagtactccatctcctaggctatggtatttcaattcccttgttgctggcatatgcaatcagcaaaaccagaagtgctgaatga

SEQ ID NO: 100954 - DNA, 1968 bp, Glycine max
  Peptide Sequence Number=SeqID_217732
atggcagcgcctacggagataatcgacgtcgacgccgaaaactctcctactcctactactatttctcctcaagattcgaaatcgaatcgcgccaaaaccaccacgcgaaagcgcaagaaggttccgtcggtgctgcaaagcctaaagagcgccgaggagaagcaagcgcacatcgaaaccctcgagaaggaactcgacgcgctgttccgctactacaaagaagccatggctcagaaagtgcgcgtcgagctgagcctgtgcggtggttcacgaaacgtcgtcgtcgcggcgctgatggaggagagcgaccttccgctgtcgaagctcgtggacgaaattaacgacaagttgaacggagaagtaagtaacggcgcaatcgtgctggcggagcctgtgacctacgcgacggtgaagagtagcgtgttgtttgtgggacagagagtgacctacggcgtgtccaatgctgatgctgatgtattggaggaccatgccgagtcgtgtctctggtgctgggagactagggatttgaaattgatgccaaaatctgttcgaggagagcttggtgttcgacgcacttgccggagaaggatccatgagaggattatggctgtctctgaaatgatagcagctctgaaaaagcaagagagtcaaccagattacaatgatggcttaattaaggcatcagcaaaggtcaataaagcttttcctgaggcagatatccgcttgttagtggatggcttgttgcagaaaaacagtgaagacatggacaagaaaagagcaagccaagaaaataaattgctaattaagcagttggagagaaatagaaaagaggctgagaaagagaaagagaaagaaagcatgcacaatgaactgcaaagagaaacactgctcaatgaatcaaatttaaaattgtcacaagatgaggcaagaaatgatgagaaagcttctgaaaagaagaaacagcaaaagaaacaggtagatgaggcagaaaaggatcaacggcgtaaagagaaagcagaagctgaattaaaaaagaagcgtagtttacaaaagcaagcttcaattatggagcgctttctgaaaagaagtaaaaacagtccctctccatctgagaaggacaaagtttcaactaaatcaactgcatctgatttgttaagatgcaagaataaaagtttgtttgagtcagctacactttcaatggattgtactcttgcatcaagtagtgatgttatgctagaagatattcgcaattggacatggagaaacatgtcaacagattgggagaaatgtagttctgatatcagttcatgcccaatgaatgaagatagttctcctcctgataccaagaagtacagtcgggcacgccatcctttaaggaaggatccaagtctggattatgaagtcagcagtgatgaggaatgggaagaggaggaacctggtgaaagtctttctgattgtgataaagatgaagaggaatgtcaagaggaatgtacaaagtctgatgaagaaagtgaagatgggttctttgtacctgatggatatctctccgaggatgagggtgcacaagtggacagaatgcaaatagatgatgacattgagggggctgatagctcccctagctgtaagaatgacattgagatcgaggagttttgtgctttacttcggcagcagaaatatctaaataatttgacagagcatgctcttcggaaaaatcaacccttgattatatcaaatttgattaatgacaaggacctttcgtctgaccacaatattagtggtactcctaagctggagcagatgtgtttgcaagtcttgagtatgtacgtaattcctggcatctcatgtatagaaatatctgaggacaaaatgcaagacgaggaccaagaagtctgcctctctactggtaaaggtgttgctagtctaatatctggtgtagctgtcatacctgactcagacctacccataatt

SEQ ID NO: 100955 - DNA, 438 bp, Glycine max
  Peptide Sequence Number=SeqID_217733
atgttctggaggaacactcaactcaaggattggaagatcattgtgtcaaaggttctaagaaaggagatggtgttgtccatggagtccattgcacaagttatagggtgtattagggaaaaaatcacataccaacatgactgggaaaagccctatgagagtcatgttcctaaagctctctatgggaaaaacatcaaggagatagataggaagaagaaggtctggttaaacatcactcagaagtgcttcatgcccaaagtaggcccgaaagactatgtgtctgacctacacaaatttatgcttttccatttgatggatgatattcctttccaccttccacacactatctacatcaatattttgagaaacatgaatacactgggagaagaggatgacatctactatgtcgccctcatcaacaaactcatcttggaatactag

SEQ ID NO: 100956 - DNA, 762 bp, Glycine max
  Peptide Sequence Number=SeqID_217734
atggccatgatcatactttgtccattaaggtggagtcactacctcatgttgttgtgggatgggtttcagatgtgggcattggacgatctcactcttcttgtagtagttatgttgatttcttgtaaagaaggcaacaggaaacttgctgtagaaccaagtattggaaacttggatgtgttgattggagagagagacttcttggactgcactagtggtagactagatggctgtgaagtaagagttggagttatttcattgtctggtgaagtagagtcatcggaggatggtatcttgatgggttcctttggagtcatgtacttatgtccagctcatatctttcttttctttggaaaggaggaggggatgattgttgatcaagcttctatttcttctggacaacatggctctcgtcctctgtttcacctaaatccctccgcttctaagccttggaggcttgctcaaagatctatatttgacttctcttgctggagtggtttgtatatgagtcttctgagatttgattggacaagagggtctagactcttcatgctttttcttcatccgttgctccttggtgacaatctcttcttcctcctcttgttgttaagcttgcttcctagtctggaccttgcccttctgctccttgagaatcctttttacctatttagcaaggccaaaggtttcttgagccttgtcttagtcagcaacagtcttggccatcttctcctagtttttctgttggatgtcatcttggtccactag

SEQ ID NO: 100957 - DNA, 1119 bp, Glycine max
  Peptide Sequence Number=SeqID_217735
atggccacaatcacaatgggaggaaaccacaattcctccatcactccacgccactacaacacccacaaggtgttccttttctgcaactacattctcttgggtgcagcttctagctgcatcttcctcaccctctctctgcgcctcattccctctctctgcggcttcttcttcatccttcttcaggtctttacgattgcgggcgcggtctccgggtgcgccgccgtggggactaacaggtggtactctgcacacatggtggccactgttctaacggctatctttcagggttctgtttcggtgttggtgtttacgaggaccggcgattttctgggtcaattgaagtcttatgttagggaggaggatggtgctgtgattctcaaattggctggtggactcaccattttgatcttttgcttggagtgggtggttttgacacttgcatttttcttgaagtattatgcttgtgttgaggggaatagtggggctgttgtgcctgtgaggagtgggaaggtgcagcaggatgaggacttgaaggattggccttggccttttcaaagagctatctatgactatgatcattttggagaagaggatccgaagaagggtactcatgaggtgccatttagtgctgacgatgacatgggaagaggaactgagtacaagttttcctgcactctggaggagttatatacagggaaaaccaagaacattaagatcactagagaaattgctgatgccaaaggtatgcaggtggaggagacgctgagaattaatgtgaagcctggttggaagaaaggtatgaagttcgtcttccaagagaaagaaccgcacagtgtcttcattcgtgatggaaatgatctaattgtcgtccaagaaatttctcttgatggccgttatgttattgtatctcacgtcactggatcgtggatcattgcattgtatatcaacgaagttattcgtcctgattacgagcaggtctttccaacacttggaatgcctttctgggaagatccaacaaagaatggaatgttgaggataaagtttaacatcatatttccaattcatcccactgcggaccagaaggcacaaatcaacaaagtcttatccctcccatcataa

SEQ ID NO: 100958 - DNA, 1038 bp, Glycine max
  Peptide Sequence Number=SeqID_217736
atggagtggtggtttgttgcaatgagagtgcgtagggtaagggatgaggggtatgtaaaggcgaggatcggggccaatgaggcgaaaggaatgatattggttgacgaggccttcagcattgatgatagtctcacatattatggatccaagaagtggggaagaaagggaaataaatgggtgaagagcagcacgctaacacagagtgttacagtcacctgtgttcgtcacagtcacagacaatggttccaatcaattcccgtaaattatagattctttgacgctgctcggaactctctatcatcacccaactccgcgatcttcaaatggaaaagaaaggccaattataaccgtcatagttctggaatggggaccttcaccactcgcgcgttggcgcagccgcttcagaacgccgacgaactcatcgactccgtcgagacatttatcttcgattgtgacgtggtaatggcgaaacctgcaccacttgtctcgcgtcccaaggctgtttcgccggtctgcatggcgagtcatgtgtttcaccggtttgcatggcggaatacttgtgataaattaatagacggagtgcctgaaacgcttgacatgcttcggtcaaagggcaaaagattagtttttgtcaccaataactcaacaaagtctaggaagcaatatggaaagaagtttgaaacacttggcctgaatgtcagcgaggaggagattttcgcatcatcctttgcagctgctgcatatctgaagtccattgatttcccaaaagataaaaaggtttatgtcatcggagaagatggcatcttgaaggagcttgagcttgctggataccagtaccttggtgggccggaagatggtgggaaaaaaatagaactgaagccaggatttttgatggagcatgatgaagatcagttgttgttgggtttgatcgctacttcaactactataaaatccagtaagatttcgaacactgacactgaaacattctacggacatgtgtatgcacccaagttagagacatatcagccttttgattga

SEQ ID NO: 100959 - DNA, 162 bp, Glycine max
  Peptide Sequence Number=SeqID_217737
atggggggtgcagtgaccttgttggatgtccctggtgggggaaatagagtgtttctcgtgaggaggaatacttgtactagggggcatgccactcggtttggaactcccttgagactcaggctgatcaccgtgggggaggggggagttgtctatgcacgatag

SEQ ID NO: 100960 - DNA, 3196 bp, Glycine max
  Peptide Sequence Number=SeqID_217738
tcaattgtatgaatgtgcagattccattctttttcctgaaataccaatcgcactccgtttgtccagccatcttctacttggtgtggtgaggatatattctaggaaggtgaattacctttttgatgactgcagtgaagccttgcttaagattaagcaagcttttcgttccacagcagttgatttgccacctgaagagtccactgcaccttaccattccatcaccttacctgagacttttgatcttgatgattttgagctaccagataatgacattcttcaaggtaactatgttgatcaccatgtcagtactagggagcagattacactgcaagattctatggagggtgtgatttacactacttcacagtttggcttggatgagcgctttggtgatggtgatgcttctcaaattgggttagaccttgatgaggttttgttaaatgacaaagctgctacttcggagcatgatggctttggtgctaatattcaaatgtctcatcaaaatgatgaaaagaaacaggagattgatgatttacccactgctgctgaactcagtgaatatgctgaaggtccatcaacccctggactggaagagccaaatttatttggaactcagatggatcagggcaataatgaagttgattatcataattcagcagatttaatatcattggaggccgcaccgaaagaatcgtcggatcaccaaagggagaatgatgtaattaattgctccttgcaaaataatgggaatcatatttcttttgatttgcatcatgaagataatgcctgcgatctggttgaaatgaatagcaaaaaagaggagcaggagcatttagcatgtcaggttgtgatgaaggatcaagaaaatttgatacctaatgatcattgcttaactttgttacccttggtggactcttccaataaagactacacagaatgtgaaggtgggatgatcaatgcttctgatgtagctgagaaggaggacttacaagatggagttttgatgaacaatgacccagtttctgctgctttggatcaaactattacaaattgtgttgtttctgctcctttgatgaacaatgaaaatgttgcttcttctggttgttctcatgttacttctgatcaagaggacctctcatgtaaaccgttgtctaacatggatggatcttggggtccaggatttgatggtcgtttggaggatggtaacacattatcaaagcatgaagttctgaatggcattgaaatttccaagagtgaggggcaattctgtccatttgacgatgctcgagtatccaatgttattagtcctctacgatcacctggtagacctgaagttgttgatgaggaagctcaggcctctcaagaactgaaggaagcagagactttaaaccatgtatctcttgaagctgtgcagcccgctgaatcaatccttcagccatgcacctcccatcttggccagccttctcggtcatttattgaagattttagcatttctttccgactaaatacaccaaggaactgcagcctgagaacacccccaaagccttttggcatctttcctattaccaaatcctctgaacatgccgggtcttctaaaggtgaaaaatgtcatgtaactgatgtttcaaatcctgctttaagttaccaagggactatagagccatctgtatttaaagaaacgcctgattcggggaaaacagatatgcaacttgagagtcagatatttagtgacaaagtagaaagtataaacaaatctgctgctgctgacatgccagagcctgaaaagttgctctcagcttaccagcatgatggtgaagcaaatcatttgctgatggcatctactcctgacaatcagggtgcaactgaaggccatacaggtgcggcaggagtaaaatgcatctctggtaaaaaacgtagctacacagaaagtactcttacagtgcagagtatggatttaattgaatcttacgggggagctcaatccaagagaactgctgagtctgttcctgatgatgatgatctattgtcatccatattagttggtagaaaatcttcagtcttgaaaatgaaacccagtcctgcagcccctgaaatagcatcaatgaagtgtgttcgttctgcttctgcaccacgtactagtgccttaaagaggaaggtgcatatggatgatatgatggtcttgcatggcgaaacagatactgaaattgatggagtggagggtaataatgaacctatggcagtccaactccaagaaaatgcagaagtacaacctacagaagtagtggagggtaataatgaacctatggcagtccaaccccaagaagatgcagaagtgcaacctactgaggtacctgttttgtctgagagtcatcagtctgaggttaacttgggatctcgtgatattgatgctcatgggcacatggatattatttctcatgtggaggagcttgacagttctcaaaatgttgaattgaacaatgtcagagcaaatattgaagtttctgaagcagggaattgctctgttggccctgggcatgaatcttcatccttaactgaagtcttcaaaaatgattttgccgcatcactgtctcgcgtggataaaaccaatgatcttgttgattctatccacacaaatatattgagcattccaaatgctgagaatttgaatacaatccctattctagaggatgactttgtggaggatcaaagtgataaaaatggagtaggtgctattgaatgtagcatggaaactggaacacaagttcaaacagatggcttggaagccaatgatttatatgcatccttggctattggttctaaagaaactgatgaatttactgatattcaagcttcctttaatggtgacctaccattagaggaaaatagaaacaacttgctagggcagttaaatgaggatcaaattgttgcttctggcatggagtgtgatggcaaggatgcaaggtctgactgcatatttattgaaaatgctaaagtagattgtttacaatctgaagcacttggtttagatgaaaaagagagttcattgaaagatgcagaaatcccagtctgtcaggaagctggactacaaattacaatgtgccctgaaattaggagtccttttgtggatcagaatgatgagtcgaaattgaattttgaaagtggtgttcttcatacatcattctttgcactttcttag

SEQ ID NO: 100961 - DNA, 1158 bp, Glycine max
  Peptide Sequence Number=SeqID_217739
atgtcgcagcaaggtcaaattccgataaaccccatggtccctccgcagaacccgatggccaccatgcaggtccctatgcccatgcacatgcagatgcagatgcagatgcagatgcccatgcccatgcacatgcctttacccatgcagatgcagatgcagatgcccctccccatgccgctccagattcccttctccgtccaggacaccgccccctcctccgggaagcgccgccgcgacgacgagaattccggcaccgcctccgcgccggagcagtcggcggcgaagcgtgccaagggacaggacgtgatattcaggatcgtcgtgccctcgcgccagatcggcaaggtcattgggaaggaaggtcatcgcatacagaagattcgagaagacaccaaagccaccatcaaaatcgctgacgctattgccagacatgaagagcgtgttatcattattagttctaaggacaatgatgaaaaggttactgatgcagagaaagctcttgagcaaatagcccatttaattttgaaggaagatgatagcagtcttgatgcgtcaaaagttactgcaggacatgtggctgccaatacgataagacttttgattgcagggtcccaggcaggtggattaattgggatgtctggtcaaaacattgagaagttgagggactcttctggtgcctctattactgttcttgcaccaaatcagttgcctttatgtgcttctgcccatgaatctgacagagtagtgcagttatcaggagatgttcctgcggtaatgaaggctttggaggagataggttgtcagctaagggaaaacccaccaagacaagtcatttcaattagcccaacatacaattatgctgcaattcgaccatcccaaccatatcttgacccaacttcagttgattatgttacattcgagatgctgatttcggaaacaatggttggtgggttgattggccggtgtggctcaaacatatcgagaatcagaaatgagtctggagcaatgattaaggtttatggtggtaagggtgaacagaagcacagacaaattcaatttggtggtagtgctcaacaggtagctttggcaaaacagagagttgatgaatatatatactctcagttgatacaacagactggcacccaacagtcagtgtaa

SEQ ID NO: 100962 - DNA, 100 bp, Glycine max
  Peptide Sequence Number=SeqID_217740
atgggtgctaagtgggtgtttagaaacatgttggacgaggcaggaaaggttgtgagaaacaaggcaagactggttgccaggtgtaactcacaacaggaag

SEQ ID NO: 100963 - DNA, 1191 bp, Glycine max
  Peptide Sequence Number=SeqID_217741
atgtacccgatcttagccagtgggataaggctagtgcctgtgttgttgaaaaccaattgtatgttcatttactatcatgaaaatctaaagaggatgcttcaaatttcagataatgaagaaccgatgatcgtacctggatcgatgtctgaattagcgtttaataaatataagcgatggcaatggtggtgtcttgtgacactcagcatagcctttcttatagttggccaatctgctgctgttatccttggaagattttattatgatcagggtggaaatagtaaatggatggctactctagttcaaactgctgccttcccgatcttgttcattccattatttacaattccttcacctccagaggcttcaacttctgcttcacctcccatcaaaattattcttttgatatattttggtcttggagtcttaattgctgctgacaatatgatgtactccactggactcttatacctctcggcttctacctattcgctgatttgtgcatcacagttagcttttaatgcagttttctcatattttatcaattctcaaaagttcactgccttgattataaactctacagtggttctcactttatctgctgcactccttgctgttaacgaagacacagatgaaccatctggtttctccaagggaaagtacattattggtttcctatgtacccttggagcttctgcagtgtactctcttttgctttccctcatgcagctgacctttgagaaggttctgaagaaggaaacattttctgttgttttggaaatgcaaatctacacatcattcgttgcctctggtgcttctgtcataggcctatttgcaagtggggaatggcgtactttgcatggagaaatggagggttttcagaaaggatatgttgcttatgttatgactttggtttggacttcaatagcctggcaggtatgctctgttggtgttgttggcttgatcttcctagtgtcttctctctactccaatgttataagcacagtttctttagccgtaactcctattgctgctgttatagtttttcatgataagatgaatggggtgaagataatttctatgcttttggctctatggggttttgcctcttatatttatcagaattatcttgatgattcaaagacaagacatgcacaagctgctactaagtcccaaaatgattcttcatgttga

SEQ ID NO: 100964 - DNA, 201 bp, Glycine max
  Peptide Sequence Number=SeqID_217742
atggcactgagggcagccgtgctccgccacgttcgtgtgccactccaagccgctccaaaactgcagccatggcgtgccatgtcatcacacggcgacgatcatctctccaaagaggaggtcgtcgaaagagtcctcgccgtcgtcaaagatttccccaaagtcgatccttccaggtgcacaaagggtcttctcaaaatttga

SEQ ID NO: 100965 - DNA, 1335 bp, Glycine max
  Peptide Sequence Number=SeqID_217743
atggacaggctgataaaagtagacccaacaaacacggtccctataagaatcgagccaggccaaaaatgccacggccaaataaccctacgcaacgtgatgtacaccatgcccgtggctttcaggcttcaatcgttgatcaaaacgcgttacacgttgaagccacaatctggtatcatatctcccttatccacagtaaccatagaaatcctctacaatcttccactgggctccaccctcccacactcttttccacactccgaagactctttcctcctccacagcgtcgttgttcccggtgccaccgtgaaagaaccctcctccatgttcgaatctgtaccctctgattggttcaccgcgaagaagaaacaagtgttcatcgacagcggcatcaagatcatcttcgtgggctcgttgatccttgcccagttagtccacaacgggtccatcgacgaaatcagagaagtgctggaacacagtgaacacacgtggaaagccgttgactccgttgaccaaaacggagacacgctcctccacgtggcgatctccaaaagcagacccgacatagtgcagctcctcctggagttcaacgccgacgtggaatcaaaaaaccgcaccggcgagactccgctggaatcagcgtgtgcctccggagaagaactaatcgttgagcttctcttagctcacaaggcaaacacagagagaacggaatcttcatctttaggagcgattcatttatcagcaagagaaggacgcagggaggttttacggttactgttgctgaaaggggctagcgttgactcgttgactaaagacggttacaccgcgttgcaccttgcggttagagaaggttcaagagactgcgcgaggctgttactagcgaacaacgcgagaactgatattagagattcacgagacggagacacgtgtctgcacgtggcggcaggggtgggagacgagagcatggtgaagctgttgttgaacaagggtgctaacaaggacgtgaggaactttaacggtaagactgcgtatgatgttgcggcggagaaggggcacgcgcgcgtgttcgacgcgctgcggctgggggatgggttgtgcgtggcggcgaggaagggggaggtgaggagcatccagaggctgatagaggggggagcggtggtggacgggagggaccagcacgggtggacggcgttgcacagggcgtgttttaaggggcgcgtggaggcggtgagggcgttgctggagagagggattgatgtggaggcgagggatgaggatgggtatacggcgctgcattgcgcggtggaggcggggcatgctgacgtggcggaggtgctg

SEQ ID NO: 100966 - DNA, 192 bp, Glycine max
  Peptide Sequence Number=SeqID_217744
atgcagcatgttgtagtgagtccagatgtacatttccagaaggatttgggtttggatagcttggacaatgtggaaattgtaatggcactagaagaggagttcaagctagagatcccagacaaggaagctgataaaattgactcttgtcatcttgctattgagtacatttctaaccatcccatggctggttaa

SEQ ID NO: 100967 - DNA, 1210 bp, Glycine max
  Peptide Sequence Number=SeqID_217745
atgaagctcttgacttcatcatcatcatcttattcatcaaccccatcatcttcatcctccctcagtttggacccatctttgtgcaactccaaaagtgtcactgcagggtgtctcacagccatcttgagaaggattctctgctctggaggccttccaacacacccatcagaccaaatcagagaacttgattcaatgtcaaagatgagtggcaaagttcaagaattgaagactaaacaaaacactgaatctaccaccaccgtcactttttctactactactactactactattactcgtgggatagtagaaaggttaatgggtttggaatcaatggtagagagagatacaaatacaaccaatgaagcaacatcaagttcttcacttccacgtagcaaatccatgaactctatggactacttgggggaatacaagcgaatggagggtctccataagcgtgctaagtcttcatcattccgtgaggttccaactttccacttgcatgaaaatgagaacttcttggtactcagcttcgaaagtggatgtgatggtggagaattcaggtcccaaaaagggataaaaaaagaaaaggcttcaaaagagagaagtgagttgaagaaaaacaagagagaaaaggtgcatgatgagaaggagaaggggaacttgtctgacatgtcttctgccaatgttggtaaacatggacttgaatttgccaacacttcagcactgttcatggcttgttctgaaaaggagtacgttggttctgaaactgagagattctcacaccccgtgaagcgcaaggaagtaaccaatgatgagaaagtgaagaggaaaaagaagggaacaacatgttatgctgaagagaaggtggacactgaatgcagctcagaagattcaagcccagtttctatctttgattttgagcgtcaagctcctggaacagaggtggattcttttggtgttgacacgagttggagaagaaaattgtcaccagagcttgaaaatgagcagcttgataacttgatgattgaggagatgaaggttaatacaattgaggacaacaaacatgaagggtcaaagaaaaatgagaagcaaagccaggagtgtgtagatatttggggagaaatttgtaggctagttgaaggtgaattgggatcaaataagttagaggaagggttgtggaaacaagacgatattgaaagtgtgtgtgcag

SEQ ID NO: 100968 - DNA, 1224 bp, Glycine max
  Peptide Sequence Number=SeqID_217746
atgtgggaagcactttctcaggtttcgtatttaaacctctctcgtaatcatatccatggtgagattgggactacattaaagaatccaatatctatccacgttattgatctaagctcaaatcacttgtgtggtaaattaccctatctttcaagagatgtgatttggttagatctttcgagcaattcattctctgaatccatgaatgactttttatgtaacgatcaggatgagccaatgcaattagaacttctgaatcttgcatcaaataatttgtcaggagagatacctgattgctggatgaattggacatctcttggggatgtaaatttacaaagcaaccattttgttgggaacttaccccaatccatgggttccttggcagacctgcagtctttacaaattagtaacaacacactctcaggaatatttccaaccagtttgaagaagaataaccaattgatatccttggaccttggggaaaataatctttcaggaactattccaacatgggttggagaaaacctcttaaatgtgaaaatcctccgccttcgatcaaacagttttgccggccacattccaaaggaaatatgtcagatgagtcttcttcaggttttagaccttgcacaaaacaatctatctggcaatataccgagctgtttcagtaacttgagttccatgacactaatgaaccaaagtacagatcctcgtatctcttctgtagctcttttgagcccatattactcttccagagttagtatagttagtgtgctactatggctaaaaggaagaggagatgagtacagaaacattctgggtttggtaacaagcattgatctgtcaagtaacaagttattaggggagataccaagagaaatcacatatctaaatggattgaattttttaaacttgtcccacaaccaattgattggtcatattccacgaggtataggtaatatgagatcattacagtccattgatttttcgaggaatcaactttctggtgaaatccctccaagcattgcaaatttgagctttctgagcatgctagacttgtcttacaatcatttgaagggaaatattccaacaggaactcaattggaaacctttgatgcctccagcttcatcggcaacaatctatgtggtccaccactgcccataaactgcagctccaatgggaaaacccatagttatgaaggaagtgatgggcatggagtgatttggtag

SEQ ID NO: 100969 - DNA, 1326 bp, Glycine max
  Peptide Sequence Number=SeqID_217747
atgaaaagtgaaagagaaaaacaggcagggcagcaagagagtgtgtgcatcccaagtgagcgtgagacacttatgaagattaagaataatctcatagatccttcaaataggctttggtcttggaatcataatcataccaactgttgccactggtatggagtcctctgccacaaccttacttcccatgttcttcagcttcacctcaacacttcatattatgctttcaagtatgactactataatggattctaccatagattcgatgaggaagcttatcggagatggagctttggtggagagataagtccttgtttggctgatttaaagcatttgaattacttggacttgagcggcaattatttccttggagaaggtatgtcaattccttctttccttgggacaatgacttccttgactcacctcaacctctctcagactgcattcagtgggaagattcctcctcagatcgggaatctctctaagcttcgatatcttgacttgagctacaatgattttgaaggtatggcaattccttctttcctttgtgcaatgacctccttgactcacctcgacctctcttatactccattcatggggaagattccatctcagattgggaatctctccaatttggtctatcttggccttggaggtagttatgatctgttagctgaaaatgtaggatgggtatcaagtatgtggaagcttgaatatctttatttgagtaatgcaaacctatccaaagcatttcattggctacacactctccaatctcttccttctttgacccacctatctttgtcaggatgcacactccctcactataatgaaccatccttgctcaacttctcatctctgcaaactctcgatctttccgatactgccatttcttttgtccccaagtggatattcaaattgaagaaacttgtttctcttcaattacagggaaatgaaattcaaggtccgattcctggtggtattcgaaacctctcacttcttctaattcttgacttgtctttcaattcattctcatcttctatacctgattgcttatacggtcttcatcgtctcaagtctttggacctaagttccagcaacttgcatgggactatttctgatgccttgggaaatttgacttctcttgttgaacttgatttatcaattaatcaacttgaaggaaacattccaacttgtttgggtaatttgacttctcttgttgaacttcatttatcacgtaatcaacttgaaggaaacattccaacttctttgggtaatctctgcaacttaagggtgatagatttatcatatctcaaactcaaccaacag

SEQ ID NO: 100970 - DNA, 324 bp, Glycine max
  Peptide Sequence Number=SeqID_217748
atgaagaccaacaagaagtgtgtctgccttattctcaaagacagggatgatcctgaccttggcttgaagattaacatgacaattgctgttgcacttctgcacttggatcctaaatcacctgaagctaaagcttttaatcaaattggtcagaaatccaatggtggttctattagtccttcgcccactacttctgctgaaggaagttcccagaatggtagaaaccaggggacagatgaaacggccacagctaagaagaatagcgcgtcttatatctggaagagattgttagaaagtttggttgcagttgcagggcttctaatttag

SEQ ID NO: 100971 - DNA, 336 bp, Glycine max
  Peptide Sequence Number=SeqID_217749
atgggttggtacaagggtccttgtggcagccatcatgcacaacaatgcaaattccctgacttggtaaaaaaggctaggaaggaattcgtaataaccactgaatcaaagtcttctgtaacatttggaaatatagggcaaagacactctcctatgcacacacgagacatggctgatcatcttttctctcaacaagaaaccggcacctgcaacatcatcccaaccatgaaggcacaaactaccacacctcgatctgttactcatggaaccagaaactcacaatcacacactttatctgcagcaatcaaaaccatcatcccattggaacgatcaacttag

SEQ ID NO: 100972 - DNA, 459 bp, Glycine max
  Peptide Sequence Number=SeqID_217750
atggcatattttgttgggagggttgaaagaaggcactacgaggataccatggctgaacagagagccttatgcttactggaaagaggactgattccagtgcaccactattggcccataaaggacgatgacaagtgcagatccattaagtttgctgtggattggggaaataatcacaagcaaagggcacaacaaattggcaaggtggcgagtgatttcaattcattcaagaagagatacaaaccctccataagtgctaatgctacagaactatgtgtggagtcaatggtttgtggagcagaaggatcagtaaagaaatttatgatggaatcattggtcaaggttcctgcaaataccgacctttgcaccatgcctgtcccttttgatcctccaactttgtatgcaacattacagagaaaggaaagctcaattcaacaagttgaatcatgggagaaaagttag

SEQ ID NO: 100973 - DNA, 264 bp, Glycine max
  Peptide Sequence Number=SeqID_217751
atgaacccacttaagctaaggtccaagtatctcagactctccaatgagcctaggaagcttggtattggaggaacccctggccatgtacagcaatccgatttgtcagaccatgatgaaagcctgtttgaagggtctgctagtccatgcttgaagctgtggagtgcattcctttccttctcactgcaagtcatattgagccttgctgccttgcttgcactgaagtggagagttgttgcagtggacaatatcaagagaagaacatga

SEQ ID NO: 100974 - DNA, 246 bp, Glycine max
  Peptide Sequence Number=SeqID_217752
atgtggttcttctgggtcagtgccaatgggaactacatatcaaagagaccggtgagagtggagttccaagcgaccattttctgcccagctttctttccttttgtgaaagcatatgacatagttaaagaaaaagaagagaatgcaagcggaacttcatccgtaagcggtgttggaggactagcaattgaatcagctgttgatgcaataaaagctgtgatcctaggagctgcacatgatggggaatag

SEQ ID NO: 100975 - DNA, 2916 bp, Glycine max
  Peptide Sequence Number=SeqID_217753
atggagaagaacctcattattctacccagtaaaccatggcatcctctgttaatcccttctcacagttccacccaattggagtggcatggctcaacaagggcccttgctaactccaacagtgtctctatgacccaaaggtcacacccaaaactggtagatacccagttgaaccagttatgtgccaatggttccctgagtgaggctgtggcaattcttgattctctggctcagcaagggtccaaggtgagacccattaccttcatgaacctgcttcaggcttgcattgataaagactgcattttggtgggtagggaattgcatactaggattgggttggtgagaaaggtgaacccttttgtggagaccaagttggtcagcatgtatgctaagtgtgggcatttggatgaggcacggaaggtctttgatgaaatgcgtgagaggaatttgttcacttggtctgctatgattggtgcctgctccagagaccttaagtgggaggaagttgtggagcttttttatgatatgatgcaacatggggttttgcctgatgattttttgctcccaaaggttttgaaagcctgtgggaagttcagggatattgagactgggaggttgatccattcgttggtgattcggggcggaatgtgctcttctttgcatgtgaacaattcaattctagctgtgtatgctaagtgtggagagatgagttgtgcagagaagatttttaggagaatggatgagaggaattgtgtttcctggaatgtgattataaccgggtattgccagaggggtgagattgaacaagctcagaagtattttgatgcaatgcaggaggagggaatggaaccaggactggtaacttggaacattttgattgccagttatagtcagttagggcattgtgatattgctatggatttaatgaggaagatggagagttttgggattactccagatgtttatacttggacttctatgatttctgggtttactcaaaagggaagaataaatgaagcttttgatttgttgcgggatatgcttatagtaggggttgagccaaacagtattacaattgctagtgcagcctcggcatgtgcatcagtaaaatcactaagtatgggatcagaaatccattctattgctgttaagactagtatggttgatgatattctaattggtaattcactgattgacatgtatgccaagggtggtgatctggaggctgctcaaagcatttttgatgtgatgttagaaagagatgtatattcttggaactcaattattggaggatattgccaagctggtttctgtggcaaagcccatgagttattcatgaaaatgcaggagtctgattcaccacctaatgttgttacatggaatgtgatgatcacaggatttatgcagaatggtgatgaggatgaggcgttgaatctttttctaagaattgagaaagatgggaaaataaagcccaatgtagcatcatggaactcgttaatttctggtttccttcagaatagacaaaaggacaaggccttgcagatatttcggcagatgcagttttccaacatggctcccaacttagttacagttctgactatccttcctgcctgtacaaacttagtggctgcaaagaaagtgaaagaaattcattgctgtgcaacacgtagaaatttagtgtctgaactttctgtatcaaatacattcattgacagttatgctaagtcaggaaatataatgtattccagaaaagtatttgatggattgtctccaaaagatatcatcagttggaactctctgctatctggttatgttttacatggctgttcagagtctgcacttgatctttttgatcagatgaggaaggatggacttcatccaagtagagttactcttacaagtattatctcagcttatagtcatgctgaaatggtggatgaggggaagcatgcgttttcaaacatcagtgaagaatatcagattagattagatctggaacattattctgctatggtttatttgcttggtcgttcaggtaagcttgccaaagcactggagtttattcaaaacatgcctgttgagcctaattcctctgtatgggctgccttgttgactgcctgcagaattcataagaattttggaatggcaatctttgcaggagaacatatgcttgagttggatcctgaaaatataataactcagcatttactttcacaggcatattctgtatgtgggaaatcttgggaagctcaaaaaatgacaaagctggagaaagaaaagtttgttaaaatgcctgttgggcaaagctggattgaaatgaataacatggtccatacttttgttgttggtgatgatcagtcaataccatatttggacaagatacattcttggctaaaacgggtaggtgaaaatgtcaaggcacatatttctgacaatggacttcgcattgaggaagaggagaaggaaaatattggtagtgtacatagtgaaaaacttgcatttgcatttggtttaatagattttcatcatacacctcaaattttacggatagtgaagaatttgagaatgtgtagagattgccacgacacagctaaatacatatcgttggcatatggccatgatggtgaggtagaagaatcatcacctctctgtgcttgtgttcgttggcagcttctctctgtgacagtgggaggctcagctagaaagagttttgaggattccacaaagaaacatcagtcagttggaccatggggaggcaatgaagggtcccgttgggatgatgggatatactcaggagtaaggcaattggtgatggttcatggggcagggattgactccattcaaattgaatatgataagaaaggaagctctatttggtcagagaggcatggtggaagtggaggccgtaaaactgacaag

SEQ ID NO: 100976 - DNA, 294 bp, Glycine max
  Peptide Sequence Number=SeqID_217754
atgccaccagaatttcattcagacgactgtacattcaattggttcttgagaatcaggattcaggagactcttccaccaagagcaaaagttgatttcttcaaggagaatctagccaagattgtttatgaggatgacaaccctctaaagccaatgatacacattgatgaatcggtctatgaaggcttatatgcaccatgggaagttgcattggtgatcaagcttctggggaagaatgttggttttcagacaatgtgtgattcactcagggtcgtgtacagacattttgggacttaa

SEQ ID NO: 100977 - DNA, 765 bp, Glycine max
  Peptide Sequence Number=SeqID_217755
atggagggcaacgcggctgcggtcaccactacgaatgccgctattgaggtagacccgactcacccatcgggcctcaatcaagtaaatcctccagtctcagatatggtaggcttgcctcccaactatacaccacccaatgtggcacacacttccgataataatgtcaataactccactctcatactcattaagagccaacaaccccaatctgatcatgcacatgtctctcaacgcatgggggagacacatgaagcgcctcgagaccacactctagccaactccaagccttaccccggatatgctactgaggggcaagcatttggtgccatacccatgctaaacactttggagggccctcagttttgcccacaacctcaacccttgcattttgcagtgggaagagtccatcttgccatggtggaaagggaaaaattcaatcatatagaggaaaggctgagggccattgaaggaggcgaagatcatgcttttgttgacatgccagaactgtgtctagtgcctgacatggtgattcctctaaagttcaaggtgccgaactttgataagtacaaggagactacttgccctaagaatcacctgaaaatgtacaacaggaaaatgggagcatactcaaaatatgaaaaattattgatgcatttcttccaggaaagtcttactggggcagccatcacctggtatactaatctggaaccttcccgagtccattcttggaaggaactaatgtttgccttcattaggcagtattag

SEQ ID NO: 100978 - DNA, 234 bp, Glycine max
  Peptide Sequence Number=SeqID_217756
atgaatgatgctatggaggagaatcccgaagaggatccggatgagggatcctgtgtggaatcatctcagggatcttcttatgggacttctttggctgaattcagctgcttgacaccagctgctgcgcaatccgaaaggtcttttgacgtttcggaaaagaacatggaaaatacccaaaagggagggcaaaaaggtcatttggaagctttttctaacccctgggccaccaaataa

SEQ ID NO: 100979 - DNA, 1011 bp, Glycine max
  Peptide Sequence Number=SeqID_217757
atgactcaccatcgtgcagttgagattcttaatagcatggctaaaggaattatgggctttgatgaaacaaagctgagagaggcctcagtttacgagtccttattagaagcgtccaaaagtggaattgcagagttcataatcaagttgactcaggctaatcctgatctttattgggtttttgatgaaaatcaaagaggcattttttcttatgccattttgtatcgtagagaaaacattttcaacctcataaatggcttgaaaggacaaggaaaggtgattatttctcgcacagatatatttggtaacaatatgttgcatttgatagggacttcagtgcccacggccgagcttgatcgcaaatctggtccagctttgcaaatgcaaagagaacttcaatggtttaaggcggtgaaaagaattttgcatccaaagtttcaacaagctataaatggagatggcatgaagcctaaagaattatttactaagaaacatgaagaactgttgaaggacgcagagaaatgggcaaaggagacggcaacatccttcacaatagtggggactcttataataaccattgtgtttgcagcagccttcactcttcctggaggaaatgatcaaaatactggtattcctatgtttttgcacaaaagaatgttcacaacttatatggtggctgatgctatctcactcttttcttcctccactgctgtgatgacttttattggaattctcacatctcgttatgctgaaagagatttccttaaatccttgccactcaagttgatgtttggccttttcacactcatatgttctatcttggccatgatggttgcattttgctctgccttttctttgatgcttgaggattcgggtcattccaagatggtaaaatttgtcatttccattgcaagcttatctgtggtcatattcttacctatgcaacttcgtctcctacttgagatttttaattccacctttagatcagaggtgttgaatatcaagaaagtataa

SEQ ID NO: 100980 - DNA, 189 bp, Glycine max
  Peptide Sequence Number=SeqID_217758
atggcggtgcgtctgtttcccgctgccgaccatcccaatgctgctgtggtgtttcgccctgcgcctgtctggggcgcagtacttcttgatgaaagctcgattagtagggggcctgatgcccttgctggaggactgatagaggcccgtaaccagagctggaaaccccagggccctgttggacttttccgg

SEQ ID NO: 100981 - DNA, 619 bp, Glycine max
  Peptide Sequence Number=SeqID_217759
atggcaggtcttccattactacacagatgtgtacaaagaggtgattgggacactgcacgcacttttgtgaacaacaatcgtaaggcaatgtatgaaacttcaaaactgggcaagacggttgttcatgttgcagttctcacaggacaagaagacatggtggaaaagttagtaaacaaagtgcccaaacggcttttgttggaacgtgacacaagagggtacacggcactggctcttgctgcagagttgagtgacaccatctccgtggccaaatgcatggttgatagaaacagagacttgttaacaatcaagactaatgaggggctgataccacttgttttggctgctgttaaaggcaacaaaaacatggccaaatatctctatcacaacactcctaagcaagtgttcaatgaggacaatggctacaccagtgctttgcttcttaccagatgcatcactagcgagatctttgacgttgcattgaatctgctcaatcgtaatccaagaatacctctcaccatgaaatttgatggtgttagccctttatttgcattggctcaacaaccttctgcattccccagcgtaaatccgcctaaattatggctacagtgggtgtataaaa

SEQ ID NO: 100982 - DNA, 1518 bp, Glycine max
  Peptide Sequence Number=SeqID_217760
gggaaggagtggttgattatggagattgtgaaagaagggaacaaagaaaggtgcgctgaagaggaagaggttgggggattaatcgaggagggaaaggattctaagaagtgcttgcaagaggaattttggaggctagtaatgtacaacaaatcattacttagacaaaagacaagatcaaaatggttaagaggccttaatgtcaacgaatcttgggtcgaagagcctattgaggtcaaggaggaagtttcaaaagcattgggacccaatggtatggatttcaagttcttaaaagagttttggcatgtgatgaaaggggatattatgactttcatggacaacttccataggtttgacatcttaaataaaggtgctaaggcttctttcatcaccgttacctctaaatgtaatgatccacaaggtctaggtgattttagaccaatttctttggtaaggtgcatgtataaagtgataacaaaactcttggcctcaagattacaaaaggctttgcacaaagtcattgatcaacgacaaagtgctttcttgagtgggagaaatattttgcatagtgtgcttattgctaacgaagtgatggataaggctaggaggaagaatagaaattgcacgaccttcaaagtagactttgaaaaagtgtatgatttagtgtgttgggattttttgttatatgtgatgggtcaattaggctttgatgcacaatggatcaagtggattcatggttgcttgatttctagttcggtttctatccttgtaaatggaagcccaactaaggaatttatgttggaaagatggcttagacaaggggacccattgacaccgtttttattccttattgttgtggagggattgagtggcttgatgagggagacaactttaaggaacatgttcttggggtataaggtgggtgctagtgatgttgaagtgaatctcttgcaatacacgatatggaggtttggggttgtggaagaaggaaacattgagagatttgcaaggccaaaagaccacagagagttggggattaaagacctaggcttcttcaatgttgcacctttggccaaatggagatggaacatcttccatcaaagtggggctctttgggtgcggattttagaagcaaaatacaatgggttcaagggacttgtggatggagtggaaaaaatgagtaattctatttggtggagagatttaaagattatttgtggtgatgagcaagaaacatggtttgataacttagttgagtggtctattgatgacgggtcatcaattagattttgggatgatagggaatggtttgagtgggaaaggaacgatgttgaggaattttacaaattgctggaaaatataaatactaaaggctatggcaaggatttttcgatttggaatatggatccttcaaacaacttcacagtacgatcaacttatttggctttgttcaacctgcggggtagaagccaattggaggatacatttaaattaccgtggagcatcaaaattcccggaaag

SEQ ID NO: 100983 - DNA, 153 bp, Glycine max
  Peptide Sequence Number=SeqID_217761
atggatgcaccaaataaagacttcaaaggtgacatggatttggatgtgagaaaaagggatgagaatttctacaaaggagtcaacaggactggaggaaaaaacgtggatatatgggacatgtgtgggctattggactatgatagtggagcctaa

SEQ ID NO: 100984 - DNA, 447 bp, Glycine max
  Peptide Sequence Number=SeqID_217762
acagacaaggtcaatgtagtgcgtgaagctgtcagttatgtgaaacaacttcaagaacgtgtgaaagagctagaaaatcaaaagagaaaggaaagtatgaattcaataatactcaacaagcacaggccactctccataaatgatcaagccactcatggatttgtggatgtgaatgaagaactcctcgaggtgaaagtcactgttttagacaaggaagtgctcattggaatttattgtgagaaacagaggcagagattgctcaaaatattgtcattgcttgataatctccatctttctatcacccataccagcgtattgccatttggaacttccactcttaaaattaccatcatcgctcagatgaataacgaatataacatgacaattgatgatctagtaaaaacactgcggcaacgcatattgaagtcacaggatatgcaaaaatga

SEQ ID NO: 100985 - DNA, 147 bp, Glycine max
  Peptide Sequence Number=SeqID_217763
atgtctcagccccacagaccacctcttgctacagattatcctttcaacaactcccttggtcgtacgtgcccaaatcccctttatgctaataatggaggattcaaggatggacttgctttctcaatgggtaaagacactcatgattaa

SEQ ID NO: 100986 - DNA, 339 bp, Glycine max
  Peptide Sequence Number=SeqID_217764
atggcgtccttcgatgaagctcctcccggaaactccaagaacggcgagaagatcttcaaaaccaagtgcgctcagtgccacaccgtcgacaaaggtgccggccacaaacaagatctacgattccgatgctacttttacatcagcttttacttaaatctcgatacttcatgctctaaggttcgagagttactctgtattgatgttgagggaaacattatgcttgttgaggaaaagaagataggaaagaaaaatgaaataagcttctcccgtgtgagagtagataaaagaaaagacatgggagtgaaaatatgggtgtgcaaatggactctcaccaactaa

SEQ ID NO: 100987 - DNA, 168 bp, Glycine max
  Peptide Sequence Number=SeqID_217765
atgaaaagtggatatcaccattatatcaattatttggacttgtggttgttgttttgggtgggttatggtggtggtgatggagttggtgtggcctgggtggtggcacggcggtgcgatggtggcacattgtttggggaacgggttgacgtgcccaaatctggtagatag

SEQ ID NO: 100988 - DNA, 189 bp, Glycine max
  Peptide Sequence Number=SeqID_217766
atgccttgcttcgcatccatgagttcttcctttagtggtggcgctggtggtggagacggagactccagcatgtccacgattggcgacagcgtctctgaggggattggaagtcctatgacaaggtccaagattaagaggaaacgaatttacaagacaataaacattcatagatcgttaatattggactga

SEQ ID NO: 100989 - DNA, 254 bp, Glycine max
  Peptide Sequence Number=SeqID_217767
gaggaggagcggatggcggtggtgttcgagatatcgacgcacgcgttccagaggcggtagctgagcttccaaatctgaagcttcaacaagttcggaaacggaacgagttgactcagctgagccaagcactgccggagatcggaggcagcagtctccggcgggggtttgtcggcggagcgagcttcgagctgtttaacgattgcttcaacttcagagaggctacggttgttagccaccgtgtctcggtggagtga

SEQ ID NO: 100990 - DNA, 814 bp, Glycine max
  Peptide Sequence Number=SeqID_217768
atggagggactcaaggtatccaaagcgaacttaactgcatacattcacccttccaaaaccaaccaagtttcccaacccattctccgccaactcagctccttgcttttcaagttcagcgaaatcttccacggcgtcgttttggcctacgatctcaactcgctccacacgtgcgccaagatcctccccggcgttcacccttacttcggcgtcaaactcaaggtcaatctgttgctcttttctcccaaaccaaacatgctcttagaagggaaggtggttaaggttacgcaagagtccattcacgttgttgtgcttggcttttcctctgcgattataactgagaaagatatcagggaagagttcgtgtgcaaaacgaaacgagggcaagaggtttatgccagcaggtctcacaagcagcatgtgataaaggtcgggaccatgatacggtttttagtcaagagttttgatgaagaaatacttcatgtttatggatctctggttcccgatcacacaggcagcatttattggttggataagaacttggaagctgattcccatgagcaaaaagaagagaagaattgtgccagaacgaataatgctagagcaagatgctgtggatggggaactgtcaaccttggacattgtccaaaagagcaaaaaatcaaagaagcaaaagcaccaggaggaatcttgaatgggatgcttcagcacttagatgtcgaaaggattctccatgttgctttggagataggatgtttttctggttggcgtggcaaggctaaaatgccttggtgcattttcagtttaggaattacag

SEQ ID NO: 100991 - DNA, 2169 bp, Glycine max
  Peptide Sequence Number=SeqID_217769
atgcaaaccttcttcttgtaccttttccttttcttcttgttatgtgcacttcaacaactagcctcatcccaacccttcttcctcaatagaaggatcctccatgaaccctttgttcctttaaccagtactcttccaccttctgaggcaccaaagccacaacctcttcatgcttctccttcaagccaaaaacaaaaaccaaatccaaaatatccatcatctaccattcccacaacctctaccactgccacagcagtaccaacaccaacaacagctacaactacaacacaatcaccatttttcccattatacccttcttcccctccacctccttctccaatcacctttgcttccttccctgccaacatttcctctctcattctccctcactctcccaaacccaattcttcctccaacaaactcctccctgttgctctctccgccgtcgccgctgcggtcctcgctataatcatctccgccgtcgtctgttaccgccgtcgccggaaccatcccctcgccgccgaaggcaaacttatccgatccgacaccgacctccgcctgctccggcacaatgccgaaaccgccgtcgaaactcgcaagctccggcacacgtcttccgccagctccgagtttctatatctaggaacagtagttaactcgcacgtaactgacgatagcgccgacgtctccgacgcccgcggcgaccggaaaatgaaatcgccggagctccggccacttccgccgctcgcgcgacaagcttccttgccgccgccgccgccgtgcgaggaggcggggttcaccaccgcggaggaggagggtgaggacgatgaggagttttactcgccgagaggctcctcgttaggaggctccggcggaaccggatcgggttcccggcgaattttcgccgctggaggaagaagcgtcatctctagttcgtgctcttcctcttcttccgcctcgccggaaaggtcacactctatcgcgaattcgccgtcggcgagttcgagttcccggagaacacagccaaagtctcctgaaaattacaaccaccaacacgtacaatcttcttcttctccttcgttgggctcaacaccagaaagggtttttactgaacataattcaaatgaagcattaagtgcatgtacacatgcacatgcatcatcatcatcatcatcattacatgaaggaacgttggagaaaaatgaaaatgcattatcatcatcactaccaccaccaccaccaccaccgagactatctaatgcttcttcgtcttcttcggctttttctcttccctcttcgccggagaaggtgacacgtaataacactttcgatcagtctccaagaatgtcgagtgtctccgacggactaatgttaccgggtttgtcatcggtgcctttgtcacccgccctattgtcatcaccggaaaccgaaaggggaacttttaatggatggagaacaagttcttttggtgcggctgcgccgcagaggaaacaatggaatcttccggtgctatcactaacaccaccctttgatgaaattggaacggttccggctcctccacctttgccacagaggaagcactgggagattccgggttctggtccgccaccgccgccaccattgccacggcaaaggaagcagtggggagtgccagcgcttgcactggggtcctcgacaccgatttcgaggccgccagaattgttgcctccttcgagaccttttgtgttgcaaaaccaaggaagcaatgtcgagttgccggcgagtttgggggaaattgaagagactagtaaaccaaaattgaagcccctgcattgggacaaagtaagaaccacctctgatcgtcaaatggtgtgggatcagatgaagtcccgctcgtttaaattgaatgagaaaatgattgaaacattgtttgtagtgaacacaccaaacccaaactcagtttttcaccagccgaatcaggaggaaagagtactcgatcctaaaaagtctcagaatatttcaatcttgctgaaagcacttaatgtcactatagaagaagtgtgtgaagcactcttagaagttattgattggtatattggccctgtaattaaactaccccttgtacacattgggacattatttaaggaaaaagagaagtatttcagtagtcaattcattattaagaacttttga

SEQ ID NO: 100992 - DNA, 513 bp, Glycine max
  Peptide Sequence Number=SeqID_217770
atgtttgagaaggaagtggcgcaggtcgagttcgctgaggatgggaatgaggatgagtttgtgaacaaggtgttggggaggttcaaggacgcgccaaacactgttatatgtgttttggacagtaattctttgaaagttgctgagttactattcaagaatggtttcacagagacctatgcaatcagaggtggagttagaggccagcaaggttggatggctatacaggattcccttttgcccccttctgtgcatataaggaaaagggtaaaagcttcaaagaaacttgacacaaatggaaatggagccatccagcaaaatgatagtaacaataagagttccttatcccaagatatatcttctgttgaaaaccaaacaacagactttggtcatgtgaaaagctctgtagagtccattccagaagtgaaaactggttctgtagcatcctcctctccttatcccaattacccggatttgaagccaccatcatctccaactccgtcaaagcctcaatag

SEQ ID NO: 100993 - DNA, 2007 bp, Glycine max
  Peptide Sequence Number=SeqID_217771
atggcgttcgggaaacgtgctttgtcgagcgacggcggcggcgaggatgcgaatggcgaggcactggagagttgcgagaagggattcggtgtggcgcgaacaagggaagagaaggtggagatccgagggttgagttggaaagtgcttaggtttatcgctgtgattcatttgcagaaggaggagtttgagagtgtgattaagtgtgtgaaggttttgagagagagcgctgatgacggtgatgagcatccgagtctttcggtgctggcgatgaaggcgtggttagggttgggaaggcatggagaggcggagaaggagttgagggggatggtgattgacaaagggattccggagggggtttgggtgtcggcggtggaggcctatttcgcggcggcggggacggcaggggtggagaccgtgaagggggtgttcttggggttgttgggaaggtgccatggtggttgggtgaggggtaaggtggttgctgagtttgtgtctgatgagagggtggtggccctctttgcagggcaggaggctgctaaggataggcttcagaaacttcttctgattaatgtcaagtcacaaattcaaacatattctagtaggaccggagtatttatagtggagtcagaagcagtgttgacagagccttggacaatctctagtagaacagaatacttcgagccaagggctttagttttgtgtctctgccaccttggtctcctgcagctggatcgtgctcaagaatacatcaacggggctgaaaagttcaaaatttatctccaaaagaatgaccaccaaggtgctattaatcaaattgaagcgatgacaacatgccttgactttcaaccagattttctctcactttcagcacatgaagctgttacatgccatgctctacctgttgctgttgcttctctatcaagtctgctaaacttctatgcttcaggaaagtccatgcccacagcagaagtaacagttgtgcgcaccttgctgatagtcctctctcaagaaccgggtaacgaacagcaagttgttaaattcttaaaacatgcccttacacgagcatcggagattggtcctgattgcttctttggaaaagaggaggttggaagacgggaatggaattggtttgctgtgactttatggaactttggtacaaaaacggggcaggataagaactatgaattatcagctgagttctttagactggcatcggatttttatgctctagttgaggggtctgataatgagaacaattccatggtttgtaaatcgttagtgctttctgtatcaccaatgatatgtttagaatttgaaaggaagacttcgatgtcagaaactgaagtcaagcaggctttacacttgctagatagagcagggcagatgctaaaatcaatttcggccaggaactctgttaacagtgaccaaattaataccattgagcctgaacggtttttcatatacactttctgtgcttatgatatacaaggcaggctgaataacttaggatcacaacttctcaatgtgaaaagttttgctagttccaaggcttgcaaaccccacctcctccttcaaataggtctcgctgcctcacagggaccacggttgaatcacgaagtagcctcctttgctttaaatgaatgcctctcatctttcctttcatcagcagctccagattatcaaaatgttgctcttgttatgcgcaagcttatatctattgccagcattcacaagggtgatacagatgatgatcttgtatatagcatgtacaagcaagcctataggataatggttagtttgaaggaagatgagtatccaattgaagaaggaaagtggcttggcatgtctgcatggaaccgagcagcagtgccagtaaggttgggtcagattgaagtggggaagaaatggatgactgtgggattagacattgcaaagcttgttccaggcatggaagcttacaaggcatgcatggaagaagtcctaggcaatttgaagaaagaactttga

SEQ ID NO: 100994 - DNA, 273 bp, Glycine max
  Peptide Sequence Number=SeqID_217772
atggagaatgcggcatacacacaccacccttttggccttgaaaaaaacgatacaaaaaccaaagagtcaaacgaaacagcaacaatccgctactttgatcacttatttcacttatactctcacatgaaactggcagcggcgaattataatcctctgtttcctggtctctctgagtcctttgctctcattggtccacgctggtacttcgtgcgtaatatcccacgtggcacgcgggcgtggttttgggaaggtggttctgtccgcaggctataa

SEQ ID NO: 100995 - DNA, 801 bp, Glycine max
  Peptide Sequence Number=SeqID_217773
atggccatacatgaaatccacaattacatacacattccttcatggctagaggaacaccttatgcaacgttctcatgtacccaaatttggcaattgggatagtggagagaatgttccttatacagcatattttgacaaggcgcggaaaggtcgaactggggcaaggataataaatccaaatgaccctgaggaaaatgctgatttaagtctggataatccatcatctgatcacctacctcctaccagacccagagctaattcagaggatcaatccggaaaaggatcattgcctttggaagatgatcctaagcattttgtcgactctccagctcgtcatgacaatgtaagcagtaggagtggcagtagaagccacggagtaggttctgctgaaaaccgtagaagacattcgacacaaagtactggttccgagtacagtattgaacgttcaccacttcatcgccaggctagagcccctggcagagacagtccccagtgggaaccaaagaattcatatgacaacagccagggaacacctgggagatctcggttaagaccggttaatcgaggagatgaaacaccggataaaggtgcagctgttccaaagtttggtgactgggatgtgaataacccatcatcagcagatggctttactcacattttcaacaaagtgagggaggagagacagggtgtcccaggacaagtgccgggaacgcctaatgagagaccacaagctattaggggccaatctaacgatgacaaagtccaggctctctctccaagcgggaagacatcgatgaagtaa

SEQ ID NO: 100996 - DNA, 978 bp, Glycine max
  Peptide Sequence Number=SeqID_217774
atgttgggtacatcagcaatgttgttggatgcatctagcaacacccctcttgttcagaagaaaggaataccctggtcgttattattcgtgggttttaataaaacaattaattggtcaaagacatctttaaacagacttttagataggctcctaggtcaagccagactcttattgaaattcgcgtttggttggctcacaaaggcccgattacccactgctggtttacgagggagaggatcttgggtttggtctcaaaaaatcccagagaatatcaagtgcaattcaagtgaagaatctatagtgcacatgctgcggattgtcctaaagtggtgggagtttggagtgccttgcggttggacaaataaagaggtcattcagaacgcatcaacaaatacttgggtagttcttcaccaaatccacaatttgtttgatgatgtttctcgagccttcaagtacaacaccatgactaggactacatctcagatcagatggacacctcccccagaaggtacctccaagttgaatgcggatgggagctctcttggcaccctggggtcttgggtttcggtggagttatccaagatcattggggtcgatggaagattgttttccaaggctatttttaatggtctcaatataacttggttggaggaaattacttctctaatctgtgagtcggactctctatcaaccatcaacatgattcacgacgacgttgggatctatcatcctttgtaccctctggttaacaagatcagaagcttcaggcatttgcattggtctcttaccttcaggcatttgcagtggtctcttaccttcaggcattacccgaaagaaggtaatcaagtggcggatggcctagccaagaaaggttcttcagatggtgttccctttaaagtctggcatcaatgtcctgcgggtctcagcccaaagctcatggctgttcctctttgtatttctgtgtcttttattttctga

SEQ ID NO: 100997 - DNA, 255 bp, Glycine max
  Peptide Sequence Number=SeqID_217775
atggttagggttaatggcatattgaagcaccgtggccctgactggagtgggctccatcaacatggtgactgctttttggcacatcaacggttagccatagttgatcctgcttctggggatcaacctctctttaacgaggacaaatccgtcattgttacggtaaatggagagatttacaaccatgaagagctcaggaaacagctgcctaatcacaacttccgaactggaagtgattgtgatgttattgcacacctg

SEQ ID NO: 100998 - DNA, 411 bp, Glycine max
  Peptide Sequence Number=SeqID_217776
atgaatcttagctatgagcagaggctccaggttgtcgccagactcattctcgacgaagactcacgccccggagacgcgccgctttaccaggaggagcttgggctgagggtgaccctcaagccgcaccaggtggaaggggtttcgtggctcatacggaggtacaaactcggtgtcaacgtcgtcctcgtgtttggtgaggaggaactttttattgtgcaatgccatattctgatgcttgaatacaataaggcaatgttgctgtttagttgtttcgcatttctttgtaacaatgggagtggcctagggcatgaggttttgacttggtggggtttagggagggtgtatatacgctgccttacccttgtgatgaggtacactcttcaattctgtgacagagcttatgtaaattga

SEQ ID NO: 100999 - DNA, 1362 bp, Glycine max
  Peptide Sequence Number=SeqID_217777
atggtgcactgtgtgatcttaccatatccagctcaaggccacattaaccccattcatcagttctccaaactcttgcaacgagaaggggtgagaataacacttgtcaccaccctttcctactgcaagaacttgcagaatgcacctgcttctattgcacttgaaaccatttctgatggttttgacaatggtggtgttgctgaggcagggaactggaaggtctacatggaacgtttttggcaagtagggccaaagacccttgctgagcttcttgagaaacttgatagatcaggtgaccctgttgattgtgttatttatgactcattcttcccttgggttcttgaggttgcaaagggttttgggatagttggagttgtttttctcactcaaaatatgtccgttaatagtatatactaccatgtccagcaagggaagttgcgtgttcccctcacagaaaatgagatttcccttcctttcttacccaaacttcaccataaggacatgccctcgttcttcttccccacagatgtggataattcagttttgcttgatttggtagtgggtcagttctccaatatcgacaaagctgattggatcatgtgcaattcattctacgagttggaaaaagaggtaactgattggacggagatgatttggcccaaatttagggccataggaccatgcataacctctatgattttaaacaagggacttacagatgatgaagatgatggcgttacacaatttaagagtgaagaatgcatgaaatggttagatgataaaccaaaacagtctgttgtttatgtttcttttgggtctatggcaatactcaacgaagagcaaataaaggaattagcttatggtttgagtgacagcgaaatttactttttgtgggtgctcagagcctcagaagaaactaagcttcccaaagattttgaaaaaaagtcagagaagggtttagtagtagggtggtgctcacaactaaaagttttagctcatgaagctatagggtgttttgtaacgcattgtggctggaactccacattggaagccatgagtttaggagttccaatggttgcaatgccatattggtccgaccaaagtacaaatgctaagcaaattgttgatgtcttgaaaattggaatcagaaccacagttgatgagaaaaagattgtgagaggagaagtattaaagtgttgcataatggaaataatgaagagtgagagaggcaaagaggtgaaaagcaatatggagcgatggaaggctttggctgcacgagctgttagcgaggaaggaagttctcgtaaaaacattgcagaatttgtcaatagcttgttcaatttacaacagggaattgcaaattaa

SEQ ID NO: 101000 - DNA, 1125 bp, Glycine max
  Peptide Sequence Number=SeqID_217778
atggtgcactgtgtggtcttagcatatccagctcaaggccacattaaccctatgcatcatttctccaagctcttgcaacaacaaggggtgaaagtaacactagtcaccaccttttcctactgcaagagcttgcaaaacataccttcttctattgcacttaaatccatttctgatgggtttgacaacagtgggcttgctgaagcagggaactggaaggtctacttggaacgtttctggcaagtagggccaaagactcttgctgagcttcttgagaaacatgatagatcaggtaaccctgttcattgtgttgtttataattcattcttcccttgggttcttgaggttgctaagagatttgcgatagctggggcttctttcctcactcaaaatatgtccgttaatataggaccatgcataacctccatgattttaaatacgcgacttgcagatgatgatgatgaagaagatgatggtcttacacaatttaataatgaagaatgcatgaaatggttagatgataaaccaaaacaatctgttgtttatgtttcttttggatccatggcagtactcgacgaggagcaaataagggaaatagcatatgttttgagagatagtgatcaaagttactttttgtgggtggtgaaggcctcagaagaaactaagcttcccaaagattttgaaaagaagtcagagaagggtttagtagtagggtggtgctcccaactaaaagtcttagctcatgaagctgtagggtgttttgtaacacattggggttggaactccacattggaagccttgagtttaggggttccaatggttgcaatgccatattggtttgatcaaagtataaatgctaagctaattgtagatgtctggaaaatgggaattagagctacagttgatgaacaaaagattgtgagaggagaagtgttgaagtattgcataatggaaaaaatgaatagtgagaaaggcaaagaggtgaaaggcaacatggtgcaatggaaggctttggctgcacgatttgttagtaaggaagggagttctcataaaaacattgcagaatttgtgaatagtttgttcaatttacaagcagcgtgcagggaattgcaaaataattcttgttaa

SEQ ID NO: 101001 - DNA, 1215 bp, Glycine max
  Peptide Sequence Number=SeqID_217779
atgcaacagcctcctggcttttcctcccaagataaatctcttgtttgcaaactggataaggcactctatgggcttaaacaagcccccaggcaatggtttgaaaggcttcaaagcaccttactgcattatggttttcacaccagcaaatgtgacccctctctctttatcctcaaaaaggacagaaatgtggtgtatcttttagtgtacgttgatgatatcaacatcattggaagctccaattatctcatcaagtctctggtcagtcatctgaattccacctttgctctaaaacaacttggtcaactagattactttcttggcatagaagttcatcatacacctactggttctgtgttactcactcaaagcaaatatattcatgatctactgcacaaaactgacatggctgaagcaaaacccatttcttctcctatggtgactaacttgaagctctctaaaactggtaatgatcttcctcccagatccactatgtacaggtcagtggtgggggcccttcaatatgccactatcaccagacctgagattagcttttctgtgaacaaagtctgtcagttcatgtccaaacccttggagtcccactggactgcagtaaagcaaatcctcaaatatctgaaaggtactctgcacgttggacatagatttgtaccagcctctcttcatcagcctctcagtctgcatgctttctgtgatgctgactgggcagctgatcttgatggccaaagatccacctcagatgatattgttattacaggagatgaccacaggggtgtccgggatcttaaaaatcatttgtctcagcactttcagactaaggatttgggtcagctaaaatacttgctggggattgaacctgttgacactcccatggatccaaataccaaacttataccagatcagggggagcccttctctgatccaggaagatatcgaagattggttgggaagctgatttatctcaccatgattagacctgacaacctttgcagtcaatgttggtctcccggaaaatggatagtttatgagaacagaggccaccttgatatagttgcatatactgatgcggattgggctggttcaccgagtggtcgcaggtcaacctcgggatattgtgtcctaattggtggtaatctcatttcttggaagagcaagaagcagaataatgtggcaaggttttgtgcggaggctgaatattga

SEQ ID NO: 101002 - DNA, 387 bp, Glycine max
  Peptide Sequence Number=SeqID_217780
atggccttggaatcaaagctgaacaacatcagtccatatcaacaatgcgttggtggaagtcacaacagaggaagcggaagtagggtggaaggaaggcatgagaaatgtaggagtcaaacaaggccaaacaacactaaatggggccgaacaacaccaaattgtggtcaaacaacaccaaatggagccaaacagaagaagttgagcctaagtgtcaaacacgagcctaacgggtccaagcaagcgtgtgagtttcaagtgctagagtgcgacgatgtatggggactgaacatcaacaaggtcgacgatgttgggttcatcggaggtaggaggtttacgatattattatcgaagatcacattaaggctccaggcttacttaactctgtag

SEQ ID NO: 101003 - DNA, 1308 bp, Glycine max
  Peptide Sequence Number=SeqID_217781
atgaagcttggtggtgagttgctgaaccagaacattggaggtacgagtaataatattgtcatctacataaacaagaatgtagatgatatgtcctttgtctttataaacaaacaaagaagggtcacactggctaagagagatgagagagaagggaagagagagaaacagggagtgggtgagagagagatcccgtctaaactacgcaaggaatgggccagtggtaaactgcttattctggaccaacttcttcagaagttgcattactctggacaccgggttctcctttttgctcaaatgacccatacacttgacattttgcaagattttctggagttgcgaaagtattcttatgaacgtcttgatggatcgattagggctgaggagcgctttgctgctataagaagtttcagtagctcatcagctaatatgggcttgaattctgaagctgaccaaaatgaagcatttgtttttataatctcaacaagagcagggggagttggtttgaatcttgtggctgctgatactgttatattctacgagcaagattggaaccctcaggtggacaagcaagctttgcagagagcacacagaattggccagatgaaccatgtattgtgtataaaccttgttacagagcggacagtggaggaagtaattatgcgcagggcagagagaaaattgctgctgagcctcaatgttataggtgataacattctcaaagatgacaataaagaaccatctgaagttggaagtggtgatttgaaatccatcatatttgggttacatatgtttgatcccactgagatcaatgatggaaatcataggaatatgaacataccagaaatttgtgctatggctgacagggtgcttgctatgcgtgatgaacaaatacttgataatgatgaaaggaaatttgaggtcaatccaacaaacattttaaaaggggatgctgttaaggaaagagattctgcttctctctcttgtgatcttggtcttgatgaggcttcatatctttcttgggttaaaaaatttgaggaagtgtctaaatcaagttgtgactcaatcacagacttgaggagcagaagaaatgtagatgaggaaaagagtctaaaaattgagtctgcaaggaagaaggcagaggaaaagaagctagctaggtgggaagctcttggatatcaatcattgaatgtaaaagacgctatcagcccaacgggcaatgacatcgcttcagcttctgggtctgttcattttgtgtatggagattcttttgctctgatgcaccaagcttttgctcatctgaaccaatga

SEQ ID NO: 101004 - DNA, 1239 bp, Glycine max
  Peptide Sequence Number=SeqID_217782
atggcttctgcatatcctagtgctactcatgttaacatcgacacaagtgttgttccaaccgatgaagctccaactggcaagattccagcgaacattagagcaagacatgaatctagagagttgtaccaactttcaccgccagtgacctgtgtctccactatctctccagaacttgctcatcagcatctcaatcatcctagtcttgacaaactacgccctttaactcccaattttgcacatgaaattcatgatcaatttggggtttccattgagactttacgcactgataatgcccatgaatatttatcttcccatgtctttggttccacttgttatgtccatgatcttacaccaagtaaagataagcttcctactaggtccttaaagtgtcttttccttggttactctcgtcttcaaaaagcatcatctgttgctccaaacatccctccaccagcactgcttgtaccaaaccttccaattgcttatagaaaagaggatacactcagatttttggtcttgactacaaggacaccttttcccaggtggccaaaatcacttttgtgcgtctctttcttgttatggctgccattcaacattgacctcttcactagttggacatcaaaaatgccttacatgagttgcaagaagtttatatggatcaacatccagattttacagtttaagtttggcatgacccattgtgagcctgatctgtcagtgtttttcatccattttccatttggtcattgcatctatcttgttgtctatattgatgacattgtcattgctcgcaatgattctaaggctattctttgccttaaatctcatctccatagtcaatttcaaactactaaggacatgggtatgcacgattgtcgccctagtgatactcctatggagctaatacagccaatgctaaagttgtttgttactctgatgctcattggaggaaacttgatctcttggagaagcaagaagcaaaaaactgttgctagatccaatgttgaagctgagtatcatgccatggcagcagctccatctgagagatcacatggcttaggctgctctccacattgcttcaagcctggtcggtctttcatgagtgaacaaaacacaaagattgattatcactttgtgcaagacaacatattctcaagagaaatcaccatcgagtttgtcaactccaaaagatcaactagcagacatgctcacaaaatccctcaagggctctcgtgttga

SEQ ID NO: 101005 - DNA, 717 bp, Glycine max
  Peptide Sequence Number=SeqID_217783
atgaaaatcttgttagtgtggataatatgtatattagacccatgcacaccagaacacttccttctgcggcgggttgcttcctcctcttacgagcctttccattcactccatcgattcggtgggtgcgggtgctgcgaaaccgagctagaccctgatcggtgtcggcacaccgccggagaacaagatgatcgtctgcgtcgccgtcgtcggtcaccaggtgagtctccttcacttcccgctcccgatttcaacgtcaggcgaaaatcgccgaacaatccgctgtacattcagagcttcacggaggccgacgatgctcttaagctccaccacatcgtccattgctcgctcgatgtggtcgacgagcgagtgaacaatcctaaaaagtctggaccgatgcttaatgagacgtttttgggactgctttatcctattgaaaactacaaagtatatggatatctgactaatacgaaggtgaaatttatcttggtgaccacggatctggatgttaaagatgcggatgtaaggaataactatgcttttttccttagaccagttcctttgtcttcctgggtgcaatttttcaggaggttccattctgcatatgtagatgccgtttcaaacccattccatgtaccaggcaaaaagataacctccagaacttttgcagaaagagtgagcacaattgtcaagtcatttggcttgagttctgctgggtga

SEQ ID NO: 101006 - DNA, 396 bp, Glycine max
  Peptide Sequence Number=SeqID_217784
atgcttttgcaaagaggtagcataaggacactagcagtttacatcttcccatcgttgctacatctgtccatcataggcaccttccatacctttgatgctcttcatgtagaccaagtcgaggagttgttagttgacttgcttgaagtcagttcacaagaagcaagagatgagacatttcaatgtcatgggacatatgttcagctatcctggctacgagacatttatcgtaacaaatgtgacgtaggacaatgggttgtagcaactcaagcatatcttttgcatctagtaggttgcgcactctttgctaacaagagtgccatacacatgcatgtgtgttggatctatgagcattttcctattgtggcctctgttattgttgttgaagattatcattaa

SEQ ID NO: 101007 - DNA, 831 bp, Glycine max
  Peptide Sequence Number=SeqID_217785
atggtgttgttgttgtggcacgccggccgggatccggatccgaaatccggatccggagcccgaaccagccgaattgaatccgttgttgttcttgtagagcttgttgaggctcctggtgttggatccgggggcgtttttgaattcctcgtacagatcgtcgtcgtcgacgtcgtcatcgtggaaattgttgttgatgttaaggttgttgtcggcgtgaggtttgtggttggggcctttttccatggagtccatggatttgaagtggagccaggaggaaggggaattggtgctggcgttgttgaggcggggaagggggaggttgcggaggcgttggatttcggtgcggtaccgtttgcggagcttctccatcttgtggcggcactgcacgggggttttggccgtgggggaggcgttggggcactgcgccgtgacggagtcggccacctcttgccaatgggtggccttgaggttggtgcggccgagggagtaccatttgtcgcggtaggcgtcgatgagggcggaggtttcctcgggggtccagcagggaggagggagacggcgggaggaggtggagggagggggagggatagggagggggagggcagagggagggttggagtcggtgggggaagaaggggaggccatgggtggagagagaaaagaaaggttacccaccgccaaggctgggtgactgagtttgccaacaacaacatttttaatggtgtggtggcaaggaggagagggacaaaaggtgctgctattattagtggtggacagactcagagagacccaataaaacaaggacagtgggcgcggaatatatcttcttaa

SEQ ID NO: 101008 - DNA, 258 bp, Glycine max
  Peptide Sequence Number=SeqID_217786
atggcgactctagatttcgacgttcctatggttcctaccggcgagccctcaagtaacgtcggtccttcttccaagaagcccaagcacttcgagatcaagaagtggaacgtcgtcactctctgggcttgggacatcgttgtcgataactgtgctatatgttggaaccacatcatggatctctgttgttattgggctatggtggctgccattgtctccgtgatcttgttgagtaaggcaaatggggtgattcactattag

SEQ ID NO: 101009 - DNA, 315 bp, Glycine max
  Peptide Sequence Number=SeqID_217787
atggggtcatttttgaacaatttctgccatggtgctgttttctacgtggtctgcatgcaaaatgcatgcaaaacacaagctccattggcgacttcgtgggcattggacacgtggaaggccaacccgccactactactggcgacttcacgtggaagcgcgtcccgccagggctacgaggctagggtgcaggacgcacggaagccattttcgagggagctgcagactgaagttgcagagcagggaatcgccaacagcacctgcgattttggtgaggtccttaaaccgccaacagcaccagcgatttggtttcgttaa

SEQ ID NO: 101010 - DNA, 387 bp, Glycine max
  Peptide Sequence Number=SeqID_217788
atgggtcgtcgccaaaacgactcagatttcggtagattcgcgattctcgtcctcttcttgataggcgcaatctcctgctccgtgatctaccttttccttacggtggtcttcagtcccagccctgaatctcttccttcagtggatgatcatgtggtgggggttgcagaagaggagcaatgctgcagagggattgaacatttggagctttggggtgatgctgtgaaatggggctctgaatttaggttgaattcctcggaggaatgttgcatggcttgtaagcgaatgtgtagcggtgatggaggaccttgtatgtgtaattcctgggtgtattgtggagatagagaggcttgtggacctagatttggtgaggacattcagcagtgttga

SEQ ID NO: 101011 - DNA, 2120 bp, Glycine max
  Peptide Sequence Number=SeqID_217789
acaatgaagaggagattaaggagtctatagatgaatatgaaaaagatgaacacttagattttgaggataattatcctgagtatgaagcagaggaatatggtggtgttgactatgatgagaaggaaattgaacaagatgaaggtcaggaggagggagatgaagtcgaggaagatcccgaagagattgtaggtgaagaagagggtgatacaggtgatgaagaagttgaatatgtttatgaagaagttgaggatgatgatgatgagcatgctggtgaggagcatgagcatgcacagatgcctgatgtggagcaagaggaacaccgtgaagtggtaaaggagaggcgaaagcggaaggaatttgaagtatttgttggtggcctagataaggatgctactgagcatgatctgaaaaaggttttcggtaaagttggggtagttactgaagtccggctgatgataaatccccagacaaaaaggaacaagggatttgcattcttgcgttttgaaacggttgagcaagcgagaagagctgtggtggagctaaaaaatcctgtgattaatggcaaacgatgtggtgttactccaagtcaggacagtgatactctctacttaggtaacatatgcaagacatggaaaaaggaagctttaaaggagaaacttaaacattatggagtagaagatgtggaggatttgactttaatagaagatgataccaatgaggggatgaaccgaggatttgcatttttggagttttcttctcgttcagatgctaaggaagcctataagcgactgcagaagagagatgttgcatttggagttgataagcctgcaaaggtttcctttgccgactcttttattgatctgggtgatgaaattatggcacaggttaaaactgtatttattgattcgctgcctccttcatggaatgaagattatgtccgagatcttcttaagaaatatggagagattgaaaaagttgagcttgctaaggacatgccagctgctcggaggaagaattatggatttgttacatttagtacacatgttgctgctgtggaatgtgctgatagcattactagtgcagggttaggtgaaggtgacaaaaaggcaaaagttagggctagattgtcacggcctctttcaaaacctcttcagagaggccgtggaaaatatgttaatcatggggacttccgctctggccgcaattctggaagattggtaaggtcttcacggagtcaacctgcaccacgtagtcttcctgcccatgtggtgagaggagttggaagtcgtgttccgccagttagacctattagtgtgagaaatagacgtcctgtcacacccatgctagtaagagccaggccagtggctcctccagctagaagctatgacaggagattggctgctcctgcttatcccaaaagtggcatgaaaagagattatagtcgacgtgtggatctaccacctccaagaagtagagttgctacagattatggctctagagtagcctctcagaggcattcatcttacagggattatcctgcccgtggttctgactaccctgagctgcatagaagaagtacatctcgtggtgcaccaaagagaggttatgttgatgatggctatggccaaagatttgagagggctcctccttctcctcctcccccccatctaagttaccatgaaggacggccacgtgattatgattctctatctggctcaaaacgtccttatactgctatagatgatgttcctcctcggtatgatactggtgctcgccagtcaaggtctcgtttagattatgactatggaggtagtgcttcacagtatggagatgcttatggtgacagacttggaagatctagtcttggatacagtggcagcagaaattctatttctaatcaagatttacatgggacttatggcagtcgacaaggcatgagttatggcggaggttcttttggtggtagtgatggtggtatgtactcatcaagttatggtggtgattatgcatcccgtggaagtgatgttggtggccgttcatattcatctatgtattctggtagaggtgtgggtggtagcagcaattatatgggtagtggtggatctgggtcttattattga

SEQ ID NO: 101012 - DNA, 711 bp, Glycine max
  Peptide Sequence Number=SeqID_217790
atggcgctttatcttttctgtcttcttcttgctatcaccttcattttcatgcaaactctggcagatacttcatgcactgattttggtgcatgtgggtttggttcctttggtgctacagtcaatggtggagatgtatcagctgcatcttctctttatcgaaatggtgttggttgtggtgcctgttaccaggtgaggtgtaccaacagtgtatattgctcagaaaatggtgtgactgcagttataaccgaccaaggttcaagtgataacactgatttcattcttagcaaacatgcctttagccggatggctcaaaccactgatgcagctgcttctctattagcccttggcgtggttgatattgaatatagacgtgttgcatgcagctacccagataaaaacataacaatcaagatagatgagagcagcaacaacccatattacttggcttttgtcatttggtatcaacaaggaaggagagacataactgctgtgcagctctgtgagactcaaaactttgtgtgccagttactggataggagccatggggcagtgtggactactacctctccaccgagtggacccttgtctttaaggatgttatttagtgatgaagaagagggagaagaaacatgggttgttcctgttaataacatacccggagactggaaggctggtgaaacatacgattcaggggtacaagtgaaccaatag

SEQ ID NO: 101013 - DNA, 344 bp, Glycine max
  Peptide Sequence Number=SeqID_217791
gccgccaaactttcctgaacacatcaaagtggattgaagaggtgcgcagtgagagaggcagtgatgttattattgttcttgttgggaacaaaactgaccttgtcgataagaggcaagtctctacagaggaaggggaagctaagtctcgtgaactaaacgtcatgtttattgaagctagtgccaaagctgggtttaatataaaggccctctttcgaaaaattgctgctgcattacctggaatggaaacactatcctccacaaaacaagaagatatggttgacgtgaacctaagatcttctggtggctatcaatctcaacctcagtccggcggatgtgcttgctga

SEQ ID NO: 101014 - DNA, 1110 bp, Glycine max
  Peptide Sequence Number=SeqID_217792
atggaagcttttactcaaaggtttatatctagatggtccgttacactttacgctcgttactctgatactcctcagaagaagtctaagcttgctcctttgcaggagagaagaatgatggaccagtgtaagatatttgcaaaagcaggtgatggaggtaatggttgttctagcttgcgcaagggaagaccttatgacccttgggatattcccggagcacttgttgatgattttcctaaccctggcaatggttctacctccggtgttactagtggggaagtcaaagcaatgcattctactggctgctcctcatcacaagatgaagaaacagatgttaagaaatctgaaaaatcaagacaagttgcattaacaaatgtattttctcaactctccacttctaatggagctcctgaatttggaacagaggatataggagggaaacaagagatactatacaatgttgctgagttaacagaagaaggtcaacaaattgtcattgctcgtggaggagagggtggtctgggcaacatgcttgtttcaaagattcaaggaagcctaactcaaaagagtattgctgatgtgagctttgtgggaatgcctaatgctggtaaaagcactttacttggggctatatcaagggctaagcctgctgttggtgactatgccttcactactctcaggccaaatttggggaatctaaactatgatgatctctcaataactgtggctgatattcctggacttataaaaggcgcacaccaaaatcgtggactcggacatgcatttctgcgccacatagaacgcacaaaggttcttgcttatgtggtagacttggctgctactttaaatggaagaaagggaattccaccatgggaacagctgagagacttaattctagagctagagtaccatcaagacggtttatccaaacgaccatccttgatagttgcaaataagactgatgaggaaggtgcagaagaagtgtataaagagttaaagagaagggtccagggtgttcccatctttcctgtgtgtttctctctctacctatctttcgttgtccacaaagaaacagtcaagcctgttgtgtttcagagcaacaagggcagttga

SEQ ID NO: 101015 - DNA, 111 bp, Glycine max
  Peptide Sequence Number=SeqID_217793
atggcgcctcttggaaaagtacaagctggtgttcttgggagatcagtaatgacaaatttgacaacacttatcagggcaaagaaaatgacaacaaatgctgcaccgcactga

SEQ ID NO: 101016 - DNA, 645 bp, Glycine max
  Peptide Sequence Number=SeqID_217794
atggtgcaagatatgaagcagcaagacaatggagaatctaagaagaaggagcgtcacattgtgacttggactcaagaggaggatgatatactaagagaacagattggtattcatggaactgaaaattgggcaattattgcatcaaagttcaaagataaaacgacaagacagtgcagaagaagatggtacacttacttgaattctgatttcaagaaaggtggatggtcagctgaggaagacatgctcttatgtgaggctcaaaaggtatttggtaatagatggacagaaatagcaaaggtggtctcaggcagaacggataatgctgtgaaaaatcgtttctccacactctgcaggaagaaacagaaatatgcagctttagcaaaagagaacagcacttcatacatcaattcaaataacaagaggatgatgctccaacattgtaataatatggatacaacatcagaatctggagtacctattaagaatttgaggtactgtatactgtatgtatcaaaatacacaaattctacaaagagaagtgctaacatattatcctattggaatataggagggccgatattgctgatgatgcagaaaagatcaaatttgaggaccgatcacatttacgaaatggaactccaataa

SEQ ID NO: 101017 - DNA, 591 bp, Glycine max
  Peptide Sequence Number=SeqID_217795
gttcttcaagagtttctgaaccgatccaaagaatcagatatccctggacaaaaggttccagatgtacggcttgtagatcttaaagatatgattgaggagttgaagagtggtaatgaggaaggccgggttcttcaagagcttctgaaccgaaccaaagaatcagatagtactgggcataaaattccagatttacggcctgcagattttaaagatatggttgaggactcaaagagtggtaatgaggaaggccaggtacttcaggagtttctgaaccgaaccaacaaatcagatatccctgaacataagattccaaatttacagcttgtagatcttaaagatatgattgaggacttgaagagtggtaatgaggaaggccaggcttgttggaggtactttaagttctttaaagctattacatcacttgtggcctctgtgaaatgtctaataatttctgaatatgttctaggaaaatggactgttatgaaaactctccaggcagttctggatacagtacaggatcaattctcatctgtcagtcagctagtgataatttggagcactcattgcatcaggatattggaaccgaaatga

SEQ ID NO: 101018 - DNA, 171 bp, Glycine max
  Peptide Sequence Number=SeqID_217796
atggcgtcagtgtcagctcttgcaaagtacaagctggtgttcttgggtgatcagtctgtgggaaaaactagcatcatcactcgcttcatgtatgacaaatttgacaacacttatcagggaaataaaatgacgacaaatgctgcactgctaaccattatgaatcatgattga

SEQ ID NO: 101019 - DNA, 742 bp, Glycine max
  Peptide Sequence Number=SeqID_217797
atggagttcagagctcgaaaatcaacgcagaaccagctttcatctttctttttaaccaaaagcatcggtgaggagaatgagctatggctcaacttgattaatccgaccctgagcgtgtcctcaacctggtggaggaagaagagtaggggtttggaaaatggaagaatattgttggaggagagaagtgatggtcgggatcgagtgagtgagggaaggtctaatagaggtgcatcttcaacactagtaggtgcatctgccttaagtgcaatcgaggcagaaggagttggtcctaatgaaatgttggtaaaggagtgggaggtttgggatgggtgtcttcgtcctccgcaatcaacaagaagatatgcaccttacaatggtggtggattggctaatatgagggacggaggtggaggtaatattagcagggcgggtgatgggatttggtgtggggtgggtactttagacggtagctctgacgatggtcttcgagtttatcctcctagttgtccaggacgtaaggaagtcgctcctgaacatccattggaactagctcaacaccggaccatccatgtagaacaatgcgatggtgatggttatggtgattatgggagggtgtgggtggtggtggtgatggttgaatcgattgaagctgaagggagtggagttgcattggtgaaggtgacttggttttgggtgagccgcagcacgtcatcttccagtcaatctgtgactatctttgaac

SEQ ID NO: 101020 - DNA, 222 bp, Glycine max
  Peptide Sequence Number=SeqID_217798
atgtcgttgttacaagttgcggtgagcaatgacacaatactcccatgtcccattgtgacatactataatgcattgacaatgcaattccgtcatctgggtacctcaattgcacttaaggcagatgcacctaccagtcctgaagatgcttttccccatcaagttaagagtcttctcctaacccaattcgcttctactttctatcatattgtgatcaacccataa

SEQ ID NO: 101021 - DNA, 240 bp, Glycine max
  Peptide Sequence Number=SeqID_217799
atgacgggattgtttctacctcatcaagattggagttcagctcccctcttcaagcaatccctacctaatattgatgatgcacctaaaaaagaggtaaatgaagaagaagatgaacctgtttgtaatcaagaaaggaacttcttaaggaaaacactaggaatggaatctccatccatcaacccaagtgccaactcatcacaaccgccaccctgcaaaagagccctactacctagtctataa

SEQ ID NO: 101022 - DNA, 261 bp, Glycine max
  Peptide Sequence Number=SeqID_217800
atgatgattggccaattctttctcaatgaatccaaatgtttgttcacccaacgctgcctggagtatttgggtcacatagtgtcaggcaacggagttgcccctgaaccttctaagatccaagctatggttgattggcccatgcctaccacaatcaaatcccttcatggatttttgggtttgacaggcttctacagaaagttgattcgcgttactctagaaggacaacttccattggagcaatgcaactcaacaagcatttga

SEQ ID NO: 101023 - DNA, 591 bp, Glycine max
  Peptide Sequence Number=SeqID_217801
atgtctctttttcaagggtttttcaaaggaaatgtaaaaacatccaataatggttcccaacaagcaaaggcgactcgtggtggtcaccggtggtcagtggtggtggaggaggagcctccaacacatgcccaggcgaaatttggctcgcttgggcgagttgatccaactcaaattttattgcttcgattaaaaactcatatctcattctcaagatgctatattgaaaatcccaacggtcagaatgtgaaaagtggggttgcaagccgaaaggcgttacacccaccacctctactagacctttcctcacccacccgatcccgaccatcacttctctcctccaccaatattcctccattttccagacccctacccttcttactccaccctgaaacatcacatatcaaatacacctactcctctaaagttgcttcactattcatggaaatggtttgcaaacttgatgactttccatgtagtttggtgtccaatcatgacccgatttttatcagtcggttttggcaagaagtatgcaaaatgaatggtacaaaactccgtatgagtacctcataccacctgaaaaccgatggctag

SEQ ID NO: 101024 - DNA, 300 bp, Glycine max
  Peptide Sequence Number=SeqID_217802
atgaagggattgatggtagaggagcggagggcttatccttacaaccaacaacttttaggtactgatgctaaggacactaagccatttgcagacttagcatttcttgtagagagagtcaacatggtcgtgcacaataatgcagattacgtgatacacctgtcatactcgagtctaccttgtgctagtagaaactccaaattgagtgctcgttaccatagaccaccattaacctgctatgtcccatggagatttacatctcactcagttgttatgaggactttcatgcgtatcttggactag

SEQ ID NO: 101025 - DNA, 378 bp, Glycine max
  Peptide Sequence Number=SeqID_217803
atggggccagctcatgaatttggcaccgtttctccaccacctcctccctcttcaactcacaatattgataccaagaggaacaaaaaggatgaaaaggcaagcatagctgaaaacggtgcagaattagcaaacgatgcattcaacactcaacagaagggcgaaaaggcaccagaatgcgagaaacttggcacgcattttaggtccttctgtccaaccgaatggctgagagtgctgagcaacaaattagaaattgcagaatgggataaattaaagaaagagaagaggggatattccctgcagagtatagtgatgcataataatagtatagtgatgcatccgcctcgcacatcttataacttgtgttttgatccacgttga

SEQ ID NO: 101026 - DNA, 1156 bp, Glycine max
  Peptide Sequence Number=SeqID_217804
atggatgagcgttttccaatgttgggtgtggctgcttctgtcaagttgttcgggatggacatgtctttgatcttgcaagctaagtctgacatgtcaagtgtgtgcggcgcatgcatagtactcttgcatacatgtcactccttgagtggatacgtattggagacatggttcgtgtgtaagtggggctgcattgcagtgcaaaattttagggcacaacttcaactcccaccagttaccgaagagtcatttccattggtagtttcctcctcgaaggatactcatcgtggtgcctccgacaacaagtcatcctcctcagagaaggagcctgccctagttattgtgatcttccccccttatacttctaggggagtgaggagaggtagtggcggtggagatgtcaaggcatctcaccccaggcgacgtagccattgcgctgggtcgccatcgtccgcacttatgaagttgacaagccttgaggattcctacaagatagtcatccaggcttgcgggagtgatggctttcctttcttgagggcagcgccaggtagtccgcccttcttctttatgtataggtgcttgtttgaggtcttgggacttgctctccccttgaccatcttccaatgtgctttggttgagcacttaaattgtgttgggcttcttgtatttcttccaaatgaaattgacggaaaagattggttggatctccttgaacgtgtgtccaataagtttttcgattttgactcaaacgtcttttttcatttcaaggatggtttcttcaaggtcctggacatgggtgttgtggtcgactgtttgccactgatgcttaacaaggatggggagcctcgcttctcgttctattggcaggctgatcccatcaagtttaagtgttttgatgaagatttgttgacctttatggagagggtgaataaggccatcatggagcagttgtcgacctcgttggatgcacgagccattctgtctctttcctcgatgagcgatcccctcgctgccttcgacaataaatgttctgccatgtcttgctttcttatgccactcatgaagaaggtcggacctacaagtgggactataccaccatttgctactgctctcgttgaagggcgtcatcctgttattgaggttggccctattgttgttg

SEQ ID NO: 101027 - DNA, 177 bp, Glycine max
  Peptide Sequence Number=SeqID_217805
atgtttaacaactgctccacagctttgaagttaagggacatcgaggagcccaatgaggagcaggaccaaataagcaaagaaaaagagaagcttaccttcacgaatacattcacaaatacttgcaagtcgcgacaactgaagggcacaagaccgaggtcgcggtggtgcgagagttaa

SEQ ID NO: 101028 - DNA, 565 bp, Glycine max
  Peptide Sequence Number=SeqID_217806
ccacgagcttttggaggacagtttatgttccatgttaccagcacataggcggatgactgtagctgatattttgctaattgaaaactttagaaaagttgggataaggcctcctccaattcttggggcatttgcgaacagttcaggtggatatgataagattggatgcaatgatgaactacttgaagaattgcttgctgattatgatgtacccaaatttgaagaattatggatgcatatgctgaatcagtttgagttgcaagaaaacaagtggatgaaagagttgtatgagaagaaaaagatggaaattgaagctgattttgattctgactatggtgttgttactctacaaagtggtttgcactcattggagaggtcagcttctaaggtattcacgaagacgatatttcatatgtttaggtgtatgttgataagagcaccaacagtgatgaggttggcagaagttgcacatcggcatgatgatgactataatcacattgtagatttgcttgctgctgaactgaaaaagttgcgagtaaaacatgggaaccaatctgttgctgaataa

SEQ ID NO: 101029 - DNA, 192 bp, Glycine max
  Peptide Sequence Number=SeqID_217807
atgataccattgacgaaaacattgaagatcctagtgctgttagaacaaagggttgtggtacagcaagcaatggtggatcaagcagaagcaagagaaacaaccgttgtcgcaaatttgcaagtagagactgtacacggttcagccaatggtgcagtggaagacaatgttcaggcaacatcattgggacagtga

SEQ ID NO: 101030 - DNA, 1464 bp, Glycine max
  Peptide Sequence Number=SeqID_217808
atgacaatactactagctgttcgtgattttccggatggatgtggaggatttccgaaatgtgttggtacaattgttgagcttgaggatacgaataagaatgctcaacatttagcaagaaggtatcttcctccaagaaaagcttcagctgtcagagacttccttcctttatttggaggatgcaatgacaatgggaagaaagtgggtctacaaaacccctctgtagatgacaatccattgaaaaatgtagcagcagcagctgatgatgtgaaagaagttaagagtaacattcaagatgactatggtcgcaagagaaagcttgtggacatctatcaaactgattctgaaaagaatgttgctgagagagtgaagaagctgcatgcatttgaagaaccatcttcttctcagatgaaaatagtgctaggtttgatggctaaatcagcatgtccttggagttctggcaaaggttcttccaacttgaagttgggagatgctaaaaatggagacgagagtaagaaagtgttttcttttgctttgcctgacaggtctagaagagctatcaagactaaaggtcttttagggcagaagcctttgaaaaagaagggaaacgcttctgcttctcaaggtacgggtgaactagaaatttgggaaaaggaggatcgtcttgaccccggtgaaattagtgaagaccttcagatttttctgaaatcacacaagttcggtgtaaatgttactccctcttctcattctaatttcattggtaatgagaatgaccggaaaaaagtgagggaaacattacagttgtttcaagttgtttctaggaaacttttagaggaaggagaatcgaagtcaaatgagctaggaaaaagaaagagggttgatttaattgctgcaaggattcttaaggacaatgggaatcatgttaactcaggcaagaagatactgggccctgtccccggggttgaagtaggtgatgaatttcaatatagggtggagcttaatataattggccttcatcgtcagattcagggtggcatagactatgtgaagcacaatggtaagatccttgcgactagcattgttgcttcaggtggctatgctgattatttggtcaattcagatatattggtatatacagggcagggtgggaatgtgatgagcaatgacagaaaacctgaagatcagaagcttgagcggggcaatcttgctttgaagaacagtagtgaggaaaagaatcctgttagggtgattcgcggctcggaagcaatggatgacaaatacaagacatatgtttatgatggattgtatgtggttgagacatattggcaggacaggggatctcatgggaagctggtttataggtttcgccttcaaagaattcctggtcaaaagcttgctttgaaggaagtgaagaaatctaaatatttcaaaacaaatttccatatgtgctgtgaacaccatagatga

SEQ ID NO: 101031 - DNA, 633 bp, Glycine max
  Peptide Sequence Number=SeqID_217809
atgtcaccctattatcttggaggctcaggtctattgatcaagggcgtctttggtataaccataacaaaccttgcctgctaccttggatgcagatcttctgaagacacgaacaaatgtcatgcaaaggctaagtttgatgttgtggttgcaaacggtgcagataggatcaagattccccgagacttctttaggaaatggggtaaaaagctacataaaaaagttattatagacgatggttgtgggaatttttcctctgccgatattgtcgttgaaaatcacaaagccaaaaaagcggcattcttcgtcaacggagttaaagatatcgtgcaaatatactacaaacatggaagctgcttggtatactctcaaaggcaaaactcggcaaaaggtccatcaacaacgcacccattaccaggaccacttaaaggtgcaaccacaattattggatgggaaaaattaatgacttatgccattgtgaattcaagccaagctttgcatattccagctgacagacggaacgaagaattttatcctcatcctcgtaaggtggaggtacaaaagctggtagaaggtgatgttgttcagtttatgaaggcaaggaatgaagatgaaatttgtgtttctgtgacataa

SEQ ID NO: 101032 - DNA, 249 bp, Glycine max
  Peptide Sequence Number=SeqID_217810
atggtgcaagcgatagaggaaagttttgaaccggagtcaaaggtggaagttggagaagtcgttgttgtgcgtggaagtagtggaggcctggtggaagcaaaggcaaagttgttgggttttggaagaggtgtggtgttctttgacaactgcttaagattggtggtggcgacgctgacacaggtggagcgtgtggtggtgattctagactgcgagattgcttttatggcgccaatagtgaaggcgtggtaa

SEQ ID NO: 101033 - DNA, 822 bp, Glycine max
  Peptide Sequence Number=SeqID_217811
atggaggtggtgatgcagtttgtggtaatgcattggaacctctggtgctgcattcttttgggatatcttcagatatcttgtatttctcttagttcaggacatcacttgaataggagtactggcttagaaaattggttgggttattctgggtcacttgtgggagatgattctctactctatgattctgcatttgtcgaaacatcaacttcgtcattcccattgaatgagtcagtctcttgtgaggacttggaaggtgtaggatcttttaataccacgtgcttgctaagctcaactcattatttaaaatctgatatttacatttatggtgttggaaacctggagatactctctgatgtgtcacttttatgtcccatggaagggtgtatgataacagtcaatgtatccggcaacgttaaacttggtcaagatgcatccattgtttctggctctgtggttttatctgcagccaatctgacaatgggatacaattcttatatagactcatcatctttaggagggtctccaccttccctaactagtggcacacctggggcaacgatggagctggtggagggcatgacaaactggggtggtgatgtttatgcttggtctacattgtctgaaccatggagttacgggagcaagggtggtggaaaatctactaaaaaacaatacggagggaatggtggggggcgtgttaagcttctagtgaaggacactttatatgtaaacggatctattactgctaaaggaggagatggagggtctgatgggggaggtggctctggtggaagtatattggttcatgctgtaaagctgtga

SEQ ID NO: 101034 - DNA, 267 bp, Glycine max
  Peptide Sequence Number=SeqID_217812
atggacattcctcagcacattgttccatacctcaagaaggcttatgatgatcttcaagaacctttgactaagtttttgagagatgcaaacctgattggatcatatgcaactttgcaccacatgtttcgatatgtagaaaccctgaagggtgctcaagtgtttgctccaaaaagctgcatggagattgaatgtgagtctctcaaattgcttgaaagtatatgtgggaaactagtgatttcggttgggttattgccaccttcattgtaa

SEQ ID NO: 101035 - DNA, 1149 bp, Glycine max
  Peptide Sequence Number=SeqID_217813
atggaggtgaatatgtcagctctagagaacgaagtagcaacgttgaagctcaccttggcggagatgaaggctcaagaagcgacagaccaagagcgattggtctccctgcttacccaaacaaagaacgacacccacagtgagaaattagtcaagaaggatggagcggaggacgatactggaagtagtgactcgatcgtggtcaagcagttgcttcagaagcttcagggcaacaccctcgatgagttcaggcaattggtcaaaaaggtggagctcccaatgttcaatggggacaatccaactggttggattgcgcgtgcagaggtgtatttccgtgtccaagggacgcaagaggagcttaaagtaagtctggcccagttgtgcatggatggccctaccatctatttcttcaagggcttcacggatgacgatgagaacatgccatgggagaagttgaaggacgctctattagaacgatatggcggtctcggcgatgtgagtgtgttcgagcagctatcagtgttgcatcaggaggggagtgtcgaggagtacattcaagagttcgagaggctggtggctcaagtaccttggctacctgacgagcagtacttggggcacttcatccatggactacgtgaggggattcgtggaagggtcctcggctacttgggagtcatgggtcaggaaactagagcgttcacaacagggctagtgcgacttcaggtaatgggtcacaccacacgggtcactccaaccatagtgattgggtctatgtcaggggcgctagagaaagtccgaataagggagtttagggccaagggacggtggcgtcaagcacctctcctaccagcaacttatggagagacaaaagaagggcctgtgttactgttcgctctctcgacaagtgtaccaatttgcacaagtagtataaaacgcgcgagaagagacaacatccttgctgggcaggctggctgcgtgctgggcgagcacatctctggcttatcctcttctagggtttctgatgtaagctcaattggtgcttgtaggcctaggatcttcttcatcaaaggattactttgcttcttggaagatgaatggcagcggaatggagaaggaagagagagaggaaatgccacttcaaggagaagatga

SEQ ID NO: 101036 - DNA, 234 bp, Glycine max
  Peptide Sequence Number=SeqID_217814
atgtctgaagaagttgatatgaatgaacaaaataaaaatgaagctggtgtgaatgaaaaacatgttgattattctgatgcgttcaatacttctcaggtgcttgctgctcgtgatgatgttctgtattgggttcgatctgttgcttatgaaattggttttgtagcagcgattatgagatcagacaaaaatagtggtattagaggaaggacctcatttgttttaactggttattaa

SEQ ID NO: 101037 - DNA, 141 bp, Glycine max
  Peptide Sequence Number=SeqID_217815
atgaaggaagggcatattccttttgagctgggtgctatgtttggtcataacactagtaacgcagttgatgaaggaagtagacaagatgggccaacaccaagaggagaatcatcattagatagtaattttcttgcaacttga

SEQ ID NO: 101038 - DNA, 225 bp, Glycine max
  Peptide Sequence Number=SeqID_217816
atggcttgtgacattttgcttcaggaaacaatggaacactttgcaactattgatttgattgaacagtgcaaagaagccaaagtggatatcatctccaatgatttctcagctgagttaccctttagattgaagcaacctatggttaaagcagctgttcaggttaccgatctccctaatgacaataccatcgtagtggaagagcattacaacgaaattgcttgctag

SEQ ID NO: 101039 - DNA, 179 bp, Glycine max
  Peptide Sequence Number=SeqID_217817
tttcttgaaattcttcaagcttttcctctggttgctctactaggattttcaagcattagagagaagaagaatggattggtgcctcaatttcagtgtctctgtgcgaggaacatatctctggctatagatattatttcaaaaatcttaacggtgggaatgtgcggaaccgagttccgaag

SEQ ID NO: 101040 - DNA, 846 bp, Glycine max
  Peptide Sequence Number=SeqID_217818
atggcggaatcgtttgagcttccgaatcggttagcaatccttcctttcaggaacaaagtccttttgcctggcgccatcatccgaattcgctgcacttcccccatcagtgtaaagttggtggaacaagaactttggcagcgagaagagaaggggttgattggcatcttaccagtacgtgatgctgctgctgaaattcagcccgcgggtccagttatatctcacggcaaaggtaccgattctctagaccaaaactcaaaagttcaaggtggttcatcagattctcaaaagcttgatgtgaaaaatcagcatgatgttgttcattggcataacaggggggtagctgctcgagcactacacttatcaaggggagtggagaaacctagtgggagagtcacatatattgttgttcttgaaggtctgtgcagatttagtgtccaggaactaagcacgagaggaacataccatactgcaaggatatcatccctggagatgactaagactgagatggaacaggtggaacaagacccagatttcataacattatctcgccaatttaaagcaactgccatggagcttatttctgttctggagcagactgttccagttcacaagttggctgatatatttgttgctagctttgagataagttttgaagagcagctatcaatgttggattcagttgaccctaaagtgaggctttcaaaagcaacagaattggttgataggcacttacagtcaatacttgtagctgagaaaattacacaaaaggttgaaggacaattgtcaaaatctcaaaaagaatttcttcttcgacagcaggttagctttcttgcaccatccttttga

SEQ ID NO: 101041 - DNA, 363 bp, Glycine max
  misc_feature (309)..(309): n is a, c, g, or t
  Peptide Sequence Number=SeqID_217819
atgaagtgggggagggaagatctttgcagttgcaattctgggaagtggtggggcccagtttggaccgaacagcacatgtccctctcttgcttgtcaaattgcggggtgaaaggaaagtcttgggacccaaactcgcgcagtgcgcgtaagagtaacggtcaatcacaccgcctaatatattcatctttccctggagcttcctctctttcgggaggccccggtggcaaggactacgactcctctccctccaccatcattaacgtaaccatgaccctcgacaccaactacctccgcgacaccatggatgcngaggaagatgtcgatctcgttctcaactcggagggtgcagaggaagaagaataa

SEQ ID NO: 101042 - DNA, 450 bp, Glycine max
  Peptide Sequence Number=SeqID_217820
atggccggtggttctatcaagagacattgtttctccgaagaggacgatgtggagcctgggtattctgggcacaaccacttccatcattaccaacacggttttatttctaggacattgggttatggcactttctacaaccgacgtgtgaggagccattcgattttctcgccgagatctgggagattttatgatgccagattcgaagaccaccaaccccactttcttcaagcttgttctctttgcaagaaacctctcggggataatagagacatcttcatgtacagcgaagagtgtagacaagagcaaatagagagagacgaagcaaaggagaagaacaagaacctttcatcctcgatgaaggctttgagaaaaaaggagcaaagaaattctgtctccccaaacaagacccaggattactcctttcgtgcagggacggttgctgccgcttag

SEQ ID NO: 101043 - DNA, 507 bp, Glycine max
  Peptide Sequence Number=SeqID_217821
atgggttttgggaggctaggagatggaaaactacatacccgtcctcaccccgctgccatgtctaagttagacaaaattatacatatgttagaaattgatgaggttgaaactagtaaaagggaaaatcaaattggcactttgaaacccgttagggatacttttggaggatcccatttctcttttattcgtaacttgaaaaatatgtatggtacaactagtaagccaattgatgataagctctctgatgaggagcaattgttgttgttgttggcctcactagcaaggtccttcaaagctttggttcaaacgttgcttataggaagatcaactttgaatttggatgaggtgaacgtcattcttagagaaaaagagagaatgatgagaactgaaaatgttgatgatgaacaccatgtaataattgtggtggagtctgagcgagagaggaatcattcaaggagacatgatggtccaagaggaagatcaaaatcacaatcacgcccgcaatga

SEQ ID NO: 101044 - DNA, 282 bp, Glycine max
  Peptide Sequence Number=SeqID_217822
atgagtgagcaagcaaacaaaagttacatctgtccgttgaaaccacgtgccagaaaatcaacagttacgagtgccagcatcgtgtcaccacgtgttgcaacggtagcagcggatgaaggcccaaagtgttggtggggccaacgtgcttcgaggttagcgaaacgggatccgtttgggtttgtggaagaaaacgacgaaagaatctgggaaaaagttaagggcattggtgacgttggggaactggagttagaagcaaggttcagggaaaaagcggaaccatga

SEQ ID NO: 101045 - DNA, 560 bp, Glycine max
  Peptide Sequence Number=SeqID_217823
gtatctccgcgtatcatgggtgcagaatgaccaaacttggtctctgcgtgctatcggacacgactgtgtctgaatggcaaaggggtgcggataaccgtaaggtatctccgcgtatcatgggtatctccgcgtatcatgggtgcagaatgaccaaacttggtctctgcgtgccatcggacacgactgtgtctgaatggcaaaggggtgcggataaccgtaaggtatctccgcgtatcatgggtatctccgcgtatcatgggtgcagaatgaccaaacttggtctctgcgtgccatcggacacaactgtgtctgaatggcaaaggggtgcggataaccgtaaggtatctccgcgtatcatgggtatctccgcgtatcatgggtgcagaatgaccaaacttggtctctgcgtgccatcggacacgactgtgtctgaatggcaaaggggtgcggataaccgtaagggtcagtatgacaaagattatggggcggccgacaaaagcaaagctcttgctcctacgtatcctccaatgaggaactcagacctacgtagttctggataa

SEQ ID NO: 101046 - DNA, 553 bp, Glycine max
  Peptide Sequence Number=SeqID_217824
ctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcttatgatgttattgctaaggagtatcttgctgcaaggttggaagccacaaaagccaaggaaaaaagggacaagaaccgtcaggagcaggccggccatattatccggaaactgaagcaagagttgtctgctctaggattatcagatgacagtttggccttagaacatgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagg

SEQ ID NO: 101047 - DNA, 777 bp, Glycine max
  Peptide Sequence Number=SeqID_217825
atgaagcacttcactgacaccctcatcagtgccaacataggaacaaaagctggtaccgggccccccctcgaggtcgacggtatcgataagcttgattctgaccatatatttgtgaggaacagcggcttatgccagagagatactctaggacaatactatggccttggatctgaaacacgaggaacagctacggatgttcctgatccttttgggatagttgtaggtgatcctgcagaaattccagagggatatgaggagaagtggatggttaatatccacgccattgatacgcgcggcgtggtggataggatggggtgcactgagtgtaggtgtgacctttacaatgttacaaagaaagaacatggggagcctctaagttcagactataaaggaggttattattgttgttatgatcaaacccagtgcaggttgagggaaggctttgagggcccaaagaggagcctctacctaagatacacagtgaagtgggttgaatggaacaagttcatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 101048 - DNA, 288 bp, Glycine max
  Peptide Sequence Number=SeqID_217826
atgtcttcatcattgcatgccttcaaaggtgacaatgtttcacacatttcgaagaagacaatgtcttcagtcattgcatgcctccaaaaggtgacaatgaccctcatttacattttgaagataacaatgtcttcagtcatagcatgccttcaaaggcgacaatgtcctcatctacatttcaaagacaacaatgccttcagtcattgcatgccttcaaagggcgacaatgtcttcatttacatttcaaagatgacaatgtcttcagtcattgcatgccttgaaaggtga

SEQ ID NO: 101049 - DNA, 240 bp, Glycine max
  Peptide Sequence Number=SeqID_217827
atggcggacccagatgcattagtttccacaatgaaaggaaaaaagaaatcaagggatgtgaacactggcgccttcgtcattgcttgctttaagttgtcaaacattcaacagcgtttgaagcaccacttcgaggtgggtgatatgtgtagaagcaagcttcatgatgatgaaccaagcaattttaatgatgccaaaagcccaagtgatggattcaagattgattcaagacttcaagattaa

SEQ ID NO: 101050 - DNA, 1107 bp, Glycine max
  Peptide Sequence Number=SeqID_217828
ataggtcccaactttccatcgtggattcagtcacaaaacaaacttcgatatgttggactgtctaacacagggattttagattctattcccacttggttctgggaagcacattctcaggacaagccaatgcaattagaatttctcaatcttgcatcaaataatctgtcaggagaaatacctgattgttggattaattggccatttctagtggacgtgaatttacaaagcaaccattttgttgggaacttccccccatccatgggttccttggctgagctgcagtcattagaaattcgtaacaacttgctctcgggaatatttcctaccagtctgaagaagactagccaattgatatccttggatcttggagaaaataatctttcaggatgtattccaacatgggttggagaaaagctctcaaatatgaaaatcctccgccttcgatcaaacagtttttccggtcacattccaaatgaaatatgtcagatgagtcttcttcaggttttagaccttgcaaaaaataatttgtctggcaatatacccagctgtttccgtaacttgagtgccatgacactagtgaaccggagtacagatccccaaatctattctcaagcaccaaataatacacgatactcttcggtatcaggtatagttagtgtgctactatggctaaaaggaagaggagatgagtatggaaacattctgggtttggtaacaagtattgatctgtcaagtaacaaattattaggagaaattcctagagaaatcacagatctaaatggattgaactttttgaacttgtcccacaaccaattgattggtcctattccagaaggtattggtaatatgggatcgttacaaaccattgatttttcgaggaatcaaatttctggtgaaattcctccaaccatttctaatttgagctttctgagcatgctagacgtgtcttataatcatttgaagggaaaaattccaacaggaactcaattgcaaacctttgatgcctccagattcattggcaacaatctatgtggtccaccactgcccataaactgcagctccaatgggaaactcatagttatgaaggaagtcatgggcatggagtga

SEQ ID NO: 101051 - DNA, 798 bp, Glycine max
  Peptide Sequence Number=SeqID_217829
atggaagttactaaaactttcatcaacggttggaagttactaaaacttccatcaatggttggaagttacatggaagttactaaaacttccatcaaccgccaaaaatcacctgataaagttaaaatcatttggaaaccaactgccgaaaaagaaccaacaccccaagctaatccaaaatttaatccagcagatgaagaatcatctttaagttcaacagaagatgaacacgaagtccaaggtaataaaggattgaactcctcaacccatgcactcagtaaaaaaactcctcccaaagaggcaagcaaagatcagaactcaactgagtcctctcttgagaaagatcatatcaatgttgaaagcaacaaaatcaacaacatcaaaggtgtttcaaagtacacccctaaggacattgacgattgcctgaaaaatcttgatgatgatccattcgcactgttgggcttcatgtcaagagatgtttcaatgtcatctaagcagtcggaaaccagtgttcaacagtcttcgacgactgaaacattagcctctgcattggatgaacttcgaaaacttgcattctctcaatcaatgctggagaatattggtaaggttgagtacagagaaggaggaggatttggagaagttgcaaagccaaaaattgaagacattgagaagcgtcaaaaagaggggaaggaagcaattaagaaactccaggaggtcaagccgaaacatgatgctgattttgaagccttgaaagaaccttacaagaagatgaagcccaatcctcctttttctattttctag

SEQ ID NO: 101052 - DNA, 486 bp, Glycine max
  Peptide Sequence Number=SeqID_217830
atggaaactgtttggttggctaaggaaaatggtgatgatttgacctcttttccttcttcttctagtggcaccattaatatcatagccttccctttgaaagaaacttgtgtgatgtccccaattttcgatggaagattccttgttggtggagtgggaaagaagataaggggcactttcacaatgacgatctcaatgcgtgggatagcaagtcaagtaactcgtggtggtaagtctctgtcaaggtatattgaagacttgaagcgatctgttggaagcacacgaaggacaagcatcaaagagggagaggctcgatttcatactgtggaagccgctgattgtggtgactttgacatacaactgcacttttcaggcgtatttcttgaactagttgggtcacgtgctactgttggtgtaccgctagtggtggacatgaacactgctgccattgatggagatggtggtagtacgggagaagacgagaaatga

SEQ ID NO: 101053 - DNA, 423 bp, Glycine max
  Peptide Sequence Number=SeqID_217831
atgccattattccgtctcactgaaagggaaaatgaggcatcacttgcggtcctacctgatttgttgatggagcttgatagtatggatgaggtggatgattttgatgcctttaaacaaagaatgttaggaattggggacaagaaaccacccccatatagaagagatttactttttgtggacaatgcagggtacgtttcaacgtcgttgctaaggtcgacaacatctttgaacgttatatatttctacgtcgtgtcatcaaagcccgaccttaatagcatacgtttcaacatcactgttgacgtcgacaacgtcttcaaaggcgaagcttcaactacggccatgacggcagccccatcgcaagaatcatgtccttctaaaacggtgattagtgaccgtcatagattggtcggaggtctacaatga

SEQ ID NO: 101054 - DNA, 132 bp, Glycine max
  Peptide Sequence Number=SeqID_217832
atgtgtaggggaaaggacaatgccaagtgtagcgaaggagtacccaaaattggtaaacatcaatactcaaggcagtatggtcacgaaggaaatgttgttggaggcatcccacattcagttcttccaaaataa

SEQ ID NO: 101055 - DNA, 276 bp, Glycine max
  Peptide Sequence Number=SeqID_217833
atgtctccaagtacacgagatgaaagcgggtggatgtattcatgcaatgcattcaactatgcactcagagaacaaagtgaaataaacaacaaattagagaagcaggacaacaccacaggccctataaaagaaggtttggctttgttgctcattggctattttactacaatccatcaagagaatgaattgaaaaatgatattcatacactggttgggtgccaactgcctagtgtatctgtaacgatccgcctcgtcgctacggtacccacactctaa

SEQ ID NO: 101056 - DNA, 252 bp, Glycine max
  Peptide Sequence Number=SeqID_217834
atggaggccaatacattcctgccaccagccacaaagtcccaggccaagtactctgatgacaaagagatcaaaaacgggaagacaaataccaagtggctctctgtacctagccaggaagcatcttttggaaagggctcttcttttgctggtgcctctatggtgttgtcatcggcggctgctgctttgattattctggagaacttgaggggcttcgagcgggagaaggagaggcgcggcgttacacgagactga

SEQ ID NO: 101057 - DNA, 177 bp, Glycine max
  Peptide Sequence Number=SeqID_217835
atggagcagtatgaaattcttgaacacattggaagaggttcctttgcttcagctctacttgtcagacacaggcacgaaaacaaaaggtatgtccttaagaagatacgtcttgcccgccagactaacataactcatagatttgcttaccaggaggcaccgatgtatgaatatgtttag

SEQ ID NO: 101058 - DNA, 637 bp, Glycine max
  Peptide Sequence Number=SeqID_217836
atggagagcacaggtaaaacaacattagtaaaagaagtgggtaaggagcttaagaaatcaaaaaagtttgatcaagtcattgatacttcagtatcatatactcctgacagaaaaaagattcaagatgatattgcaggaccattaggattaacgtcattgaaggattgcactgaatcagagagacctacaaggttgtggagaagattgaccaatgattatcaacctatgattccttactactctcagaacatagaaccacgacctcacacaagaactcagaataccgaggaagacgggaaactcactcgtggaactcacacgagaaagaatagtcccaagggactgagtaaatgggaagagtaccatatacgttgttcgtccgatgaaaacaacgtagaggatggcaaggaggaagaaattggtgctggcggtgctctagtggctccgagatgtggtgttcctattgccgcagcggaggtggatgaacccttgcgcttcttggatgattcttccatttggagatatggcaaattgaagattggggaagagaatgcgctatcgagggaaaaaattgcgaaaatgaagctgttgaagattcttatttataggaagggacgtttggtaatcgattacaagg

SEQ ID NO: 101059 - DNA, 135 bp, Glycine max
  Peptide Sequence Number=SeqID_217837
atgaccaatcatcaaaagagtgcctcaaacaacttaatcagaggggctaacattctagttgatcctaatggtgaaatcaagctgacagactttggaatggctaaacatgtaagtttatttgcttttagagaatga

SEQ ID NO: 101060 - DNA, 621 bp, Glycine max
  Peptide Sequence Number=SeqID_217838
atggtatatgaaatgaatggggaagttttacagaagattggtacaaatgaaacagcatcaacagacactcattcggtggtatgtgattctgctcgtataaatcctaaagaagagaattcaagtaacatcaataagtcctctataaccactaaggaaagagaagaaactggttttatcaaagagaagccaaccactaaggaaaaggaagtggaggaagaaagaaacgcttctggtgttgctacaaatgaagcaatgtctatgattacaaggttacaggaggagaaagcaacactacagatggaggctcttcaatattttagaatgatggagaagcaaccagaatatgatactgatgaattggagaaagtgaatggtctactcatagaaaaggaaaaagagatacaagatttggaagttgagctggaattttatagatcaaacatggcagatgatgagcctatggggtcaggaccctacagcaatggcttgaagcctattgtgtgccccttctattgttcttactctggttatcaagctactaagaacccaatgtacctaaactgcattaaggttaatggacagacccttggggctgcaaattataacaatacctttggatga

SEQ ID NO: 101061 - DNA, 675 bp, Glycine max
  Peptide Sequence Number=SeqID_217839
atgaggatgcatgatatgcttgatgaacagattatcattgcaatcaaagacatgcttgatcatcacaatcactatgctcaaaagtttcgaatggcaagggacaaattgcattctgctgcagttccagacctgaagatgaaactcattagtcaaagacaaacagacggaaggttgtataacttaccaactaccactgaagttgctgccttgattgttggtggagaagatggttacagactaaatatacctcacaaagatcatgccaatatacatgctgcaaagaggaaacaagtcacattgcgcgaatatttttcttaccgcctacagtcaagaactgatgaagcacagactatacttcattccagaagattatttcagcaatggattgttgatggatattgtatgattgagtctcaaaaactaaactatgtcagacaatatcaacaacaactcagggttgacaaatacatcaatttaattggctctaatgatcatcctcaaacacttggtagggacagaggaaagagaatcatactgccaagtagttttgtcggtggtcaaagatatatagagcaactgtattttgatggtatggcaatttgtggacatcttggatttccagacttattcttaacaatgacatgtaatccaacatggccagaaatacgacgcaag

SEQ ID NO: 101062 - DNA, 459 bp, Glycine max
  Peptide Sequence Number=SeqID_217840
acttggttccctgctcttatcaccgctttaggtcagtccagaggggttgcttctgatagcctagtgttcgaacgcctgagtctggggctaggagagcgaggacaaggccagctgaggccccttccacatctacagctcctcctccagcatatggtggaacctccagactctattccttcagtagagcagtttaatgagtggatggaggatgagtcatccgagactaccactccagagcccttggtcagaaggaagaaaacagatcaaacacaagaagctgcagccacttctgagaaatctcttgaggccacttatgagccttcagaaccagtggcagatacagcttcagttcagcagacagtagaccctttcactcctgaggatcatactagaccagtcctgtctctgagcacctctcatacagctacccttgtgcttcacttaacagacgaggaggat

SEQ ID NO: 101063 - DNA, 171 bp, Glycine max
  Peptide Sequence Number=SeqID_217841
atggcagtggttgtggccactacaacaacaactattgtggaggcgttggcggaaaagtttgagaaaggtagtatatcaatgaaagcaccatttaataggcttaaagagactattcttccccctactcctaaattctacaattcaagctacaaagaagagtcaatgaaataa

SEQ ID NO: 101064 - DNA, 375 bp, Glycine max
  Peptide Sequence Number=SeqID_217842
atgtgggacaatgtgggtgtcgatggagtagtttccgacagatttcagacgggaggagaaagagaagagcgatttcaagcaggaggagaaagagaagagcgagtgcaagactcttctagtggcctatggcatgcctcaaattttggggagggtgtgattgtgggtgttattgacattggtgtgtggctagagagtgaaggcttcaaagatcatggaatgaccaagaaaattccaaacaaatggaaagggagttgtgaggaagtacaagacttcaacacttccatgtgcaacttcaaattgattggaactacatatttcaacaagggtgtcattgcagcaaattccaaggttacatactacatgttaaggaactaa

SEQ ID NO: 101065 - DNA, 453 bp, Glycine max
  Peptide Sequence Number=SeqID_217843
atgactaatgcaaactgtctggaagaatcattgcattcagtctcaaacgggaatctaagagttattcagtccaaaactgatgggaagttggttgagttgaacactcagtgtgcacatgcagacaatggatgtggaagttgcagcagtgaagataatgccatgaatgaggctatacttaatagcaaacttgaagctgtaatctgttcagaaggctatattcttaaacaccagaagattcagtccaagattgacagatggtgtgtttctgcaaagacaagtaaatttgaaagcatgaataagctgcaaaaccaattggagaaagtggagtctcttactcaagatcttgaagaagggcttgagtttctatttaggcatttaataaacactaggggcattgttagatcctgtggctgtcctataaattctagtgtagatcctgtggcaacaacataa

SEQ ID NO: 101066 - DNA, 360 bp, Glycine max
  Peptide Sequence Number=SeqID_217844
atgaaagcccgaagatccctaagctcggtgagaacatcattcagtaaggaagataatgaatcctattgcgatggtgggaagggtgtgcgttcatcaagaattggaggtggaaggtcttgtttatgcacccattggccatccacatcctttcggtatccaaaggaggcaacaacaccaacaccaatagcaaatgaacgtttgaccttaacaaagatttacaacctcttaaggaatgcaaaatcccttatgtatttgataaataaaagcaaagttgaatccatgcccttgcagtggaattcaagatcaaggagtgctctacttgctttaattcgaacttggcacaatgcctttatgccctga

SEQ ID NO: 101067 - DNA, 270 bp, Glycine max
  Peptide Sequence Number=SeqID_217845
atggagcatttgggtcagtatgatttaaattgtgaccttaaaaatggagtcaacatgtgttgtgatgaagagtcttttgtcaaagagatcaatacaacttccattgaatatgctgtcaaagtcttgctgatggatctaggggaagacatcaacagggaaggcattataaagacaccacatcgtgttgcaaaggccctctttgaaggaacaagagaagtaattactcctcatggtataagtaactactatcaatcctcatggtataattga

SEQ ID NO: 101068 - DNA, 627 bp, Glycine max
  Peptide Sequence Number=SeqID_217846
atgagggagaacatggcagagatcctggtgagcaaaacaacatggagaatggtgtggtggcgacctcatttggatgtcctatttctcttgtttgtgcttcttggcctcaatctccttatcatggtgctgctactggaaatgccatttggggccaaatttgaggcacaagagggcttgccgtcggagatgtcatcgttggtggaggaaatttgttgttgtgaagggtctgagaaaggatcagatacggggagtgaggcgcttgcaagagaaagagaaagagaaaggaaaagagaagaaggagaaaacaaagtgtcttgtttttggtggataagcatatgccacagaggaactttcagtagcagcactgtgacaaggaggccaaggccaagaagcgcgaacaagagaaaaaggaggtccaaggaggtcaacactacacccttctccacaccatctcgctcttctgagatctttgtcattatctccttgatcgcctccttcttctacctccttgacttcttcggcatcaacttcttctccaaggctgggtttggtgggttgctttggtttggggtcttctatgatagtcattattgttgctccaaggtcgagggaggccaagagaagtag

SEQ ID NO: 101069 - DNA, 1212 bp, Glycine max
  Peptide Sequence Number=SeqID_217847
atggctattcatattaagaaaatggaaaagccatgcacttttacatgttacaagcaaagtgcgaaggaaattgtggaaggtgcattattccctgaagctggtgtagacagcacaaaagttggtcatgcaggtgaacttgtgattgtgagagaccttgaattttattcctattgtgagtcttgcatgctaccattttatttcaagtgtcatgtgggttatgtcccttctggtcaaagagttttgggtttaagcaagctctctcgtgtgaccaatgtgtttgcaaaacgattccaagagcctcagcgtcttgcaaatgaggtgtgttctgctttgcatcaaggaatagaaccagcgggtgttgctgtcgtgctccaatgcacacacatcaacattccagacacagaatcaaacttttttgactcaaatcacaaagggttggtggagacactagtttcttcagggtctggtgtttttgaaaacaacgatgcagacacctggggtgatgtttttggtcttctcaaggttagaggaatagataaggacaaagtacatgttaagagatcattagaccaacattggtgtccttctttgtcatccaagattggagaaatcaaccctattatgattactgccgtatcttcaatcctcaaatctttaggtgaggatccaataaggaaggagttagtagggactccaagtagatatgcgaaatggttgatgaacttccaatattgcaatgacatttatgtgaagctgaatggttctcttagaagtggggtagatgattctttgcacactaacggggaggtaagctttgatgataaagaattacactctgacttgaacttgcccttttggtcacaatgtgagcatcatttacttccatttcatggtgttgttcacataggatacttcattcccaaagggtttcaccccgttgaaaaatcccttttacagtcaatagtgcatttttatggctttaagctccaggttcaagaaaggctcacaaagcagatagcagaaactgtttctccactcctaggaggaaatgtgatagtggtggtggaagcaagtcacacgtgtatgatttctagggggattgagaagtttggaagcaatacatctaccattgctgtgttaggacgcttttctactgaccttgctgcaagaacctcgtttctagagagtattccaaatgctacatctctttga

SEQ ID NO: 101070 - DNA, 249 bp, Glycine max
  Peptide Sequence Number=SeqID_217848
atggtgaccattacgacttcaatgagggtaatggaagtcaggatgtcgggattccaaaagaaaattcttctgacacggaagacaaaggccaaagacaacaatcactttggggttcttaattcatcatatttttccaacattaattgtgatcatcctgaccaagagataaattttcttggcttggatgtacctagttcgtggaagattgatcgtgagttctacataggattacattttcattcagaatag

SEQ ID NO: 101071 - DNA, 1578 bp, Glycine max
  Peptide Sequence Number=SeqID_217849
atgtcatcagcacctatgaccgacaacaacaaggttcaaaacaaaggccttttatcttcttcttcttcttcttcttctgtgaggatagaggaagagatcatgaagcagggcatcataaccattttgaactcaaacacaaacacaaacacaccttcttcttcttcttcttcttctctgcgaagaactctctccgcagacatgtcctcaaagaactacttgcatgcaaaaaccattgctgactcagaaaaagaagaagaagatgatgaagatgaagctgagagagagaggctggagatttggagctccatccaacggaacaagaaggaggagcaagagaaatcaggagcctttgatatgtggagctcaatcgtatctctcaagggcaaagatgaaatctccaaatcaatgcctattacaccttatgttcaccctcttgtcaaaaggtccaagagttgtttgagtggcaagagcctcgaaatctgcactgagagtctcggctccgagactggctctgatgccctgttgttatcttctcactcttcttcttctgagacaggggatgcaacagagcaagaacaagacaaagaacaagttaacgaagaagaagaagaagagttatgcaattatgcttcagtggtggctacaaagaaggcttcggcttcggcttcggcttcggcttcaccaccacgcgctttccctccaccacttccttcactctctcatcaccaagcaagttcttcagtaactcacatgcgttcccaccgcgacaatggaaggttggttctccaagctgtttctgttccttctcacaacaatttcagcattcagcgccaagatggtcgccttgtcctcactttctccaatcaccaagaggaggaggaggaggaggaagaagaagaagaagagaatggtgatcatgtggaggagttgggagaagagtgctttggagggtttgagtttggagaagaggaggattattatgacgagggtgaagatgaagaggaagaggaatactttcttggcacgaagccacaggtatcctctattgaacccaattctgttctgatggggtacgagagtgtgatagagaaagcgccgctattgcctagtggggtgacaagtagtgttcatgagttggctttgatgatgaatattaagaataagccaattggggtagtgaataggaatccaaagtggtcggagaagttcaatgagatgaccaattttgatgatgttaatgtggcagcacaatcactgcctccaaggccaagggtggcaaggttgattccatcagcaccagctgcttctttcaatttcaatgcttatgaatactattggaggaccaagtctgcatcatcaaaaggtactagtgttaaccttaaccaacttgaccaagagaaactgaagagcaaggttgttgtgtccggggacatgaacaaggtggtctcaagggagcaacagcagttgctggttcttagagggaagaatggtgattacttggttcacaatttgaagagttgcaaggattctagaaggtcgtttctgttctgggaaccctattgcattgccacctcctga

SEQ ID NO: 101072 - DNA, 258 bp, Glycine max
  Peptide Sequence Number=SeqID_217850
atgacggctgtgacacaaccaaataacatcatacttggagtgtatggatcaagcaatgtgagaaaggacaacgtggtggagcaaatcaccagaaaagttgagagggacatgtttgatgtgattgtgatggcaagtgtcatgaaaaagaataatacatggtgtctgcggtggaacaaatcaccagatgtgagaagaattcggaacttgggaacaagttgggataaagatggaggagaagatccttatcatcttgcatga

SEQ ID NO: 101073 - DNA, 324 bp, Glycine max
  Peptide Sequence Number=SeqID_217851
atggggacaaatcaaaacgacaaaaggttttatcaagtcaaggttaaaagtctagatgtcaccagcctcaaggaattgggacgattgatgggacctctccaaaggcaagcctttcgcaaagtgtacggaaagattctagatttgaccgcggcggaggtatttacggaagctgtcgtatccctcgcccaatactatgaccagccgttgaggtgcttcacgtttggggacttccaaatggtaccgactattgaagagtttgaggagatactaggatgtcctcttggggggtggtcggggattcggcaagagagttggatcgcatga

SEQ ID NO: 101074 - DNA, 387 bp, Glycine max
  Peptide Sequence Number=SeqID_217852
atggccataatgatggaggccatgatgagcatgaagaagataatggaagccaatgcggttgtagttgccgctaccagtgccgttgctaaggtgaacccgacgcccccatctggcctcaaccaaatgaatcatccacgaggactgcacaccctcaccttcagaggactacacatcctctccttcagagggctgcacgccctcaccttcagaggactagacatccttgcctttaaagggctagacgccctcgccttcagaggactacacgtcctcgccaacagagggctgcacaccctcaccttaagaggactacacgtccttgccatcagagcacttcacgtccttgccattagagggttgcacgccctcgcctttagaggactacat

SEQ ID NO: 101075 - DNA, 198 bp, Glycine max
  Peptide Sequence Number=SeqID_217853
atggaagatcaaatagagaaaatgcgtgagacaattactaaattgaattctaagcttttggaaaagacaaataaggagaggatacttgagtctatcatgtcagctcctagtccattgactaccacagtggatgaaactgaccaccatgttgacgatgctcaggttgatcgttctcattacatgtcaaaggatcattga

SEQ ID NO: 101076 - DNA, 489 bp, Glycine max
  Peptide Sequence Number=SeqID_217854
atgaacgcttgggctgcccacaagccagttatccctgtggtaacttttctgacacctctagcttcaaatttccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 101077 - DNA, 890 bp, Glycine max
  Peptide Sequence Number=SeqID_217855
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcaaaccctaggccactcctacgtcgtctcgcgccacttccactccctcatcccgctggtcaaaaaatttgtcgttcgtgtcatctccgacgacaactcttcctcctcctttgccacctccgacaagtctcgcagccctttctggaacctcctccgccttcagaagctaactatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 101078 - DNA, 655 bp, Glycine max
  Peptide Sequence Number=SeqID_217856
atgacaagtatggagatttttgtttctaaattagaagtgagttttcaaactcctaaacttaggggagccatttcatgttctagtgtaggtcagggggttgatgcttcaaagtcctattttcaagggccgagccggaacaacagtgattccagatctcaggctcatggagaagatatggatgttgggtatgaaggaaatcatttatcacaatcttttgaaggtcttgagcagaattttcatgatgacattattaaactcaccaaagaacagaatgacgctgaagatgcagaatatgccagacacagagagaaaggtgccaaaaggaagaaatgcatttatgctcaattctgtagtcttgtttcctctgtaagagtaaagcttgcttctcttcgtaagaattgggtttcactttggcacaagaccttatgggatttgttcaacagcttgtttgtttttgaagatgttaaagatacttttgaagcggtaaaactttttatagctgttacaaaaataaatgcaatcaatgctcagtatgaggaaaaactggcagcactccgagctcagcatagcagccgcagagctgaatttcttcaaagggaatcacatgctaggcaacagcagtaccagcaaatcataagggatccttaccccagtg

SEQ ID NO: 101079 - DNA, 165 bp, Glycine max
  Peptide Sequence Number=SeqID_217857
atgtcaatggtaaagttagagtgggtgttgggatgtgtacttttgctaaatgctaactatcgtggtttcaatataactatacctatcttgcataagggactttgggatcaaatatgcattccacatggtgggaccctactctctgaagatgacactgaagaatga

SEQ ID NO: 101080 - DNA, 243 bp, Glycine max
  Peptide Sequence Number=SeqID_217858
atgactgtcagtccaactcattcaaatactgcatcagctaaagggactagtccgtcctttgcttctttgcatgctaaaacaccatcaccactattgtccaatccagtttccataaccagcactgctctcataactagtattgctgggtaccgagctcgaattcgtaatcatggtcatagctgtttcctgtgtgaaattgttatccgctcacaattccacacaacatacgagccggaagcataa

SEQ ID NO: 101081 - DNA, 588 bp, Glycine max
  Peptide Sequence Number=SeqID_217859
atggaaattctatcaacatttagacacaaccatggcttcgtaatagatccttatgtttccacatgttcacctctcggacttgaagatatcattgaccaaattctcaacgaggatgataagcaagttgttatatctcatgccctattccaagtttctgaaaatgatgaggacaagcttgttaggcatctaacaagctctggtgagtacacagtcaaattttacacgagcagaagcatgctcgaaaatcccaatcaacctactccacacacccctaaacatgctcccaactggagggaaccacaaattgacttttggaaatgtaatgttaacgctacaatcttcacctcaagaacaactttggtgttggcctatgcttgcgtgatcaccatgcatgcagttgggtatgtgagtggagagcagtactacggagcaaaggctagcataaacgtgtgggcaccccgagtggaaaatcaagatgaattcagcttgtcccaaatgtgggtcatctctggctcatttggggatgatctcaacaccattgaggctggttggcaggcaagtttcaattcagccattgctgtatcttaa

SEQ ID NO: 101082 - DNA, 201 bp, Glycine max
  Peptide Sequence Number=SeqID_217860
atgaagatgtgcaaagcagcaaagaggacccctaaggctcacccaagcgagctggagctcgcccaggtgagtagttgcttcaacctaagtaaccttgctcacccaagaaagctggttacttcacccctaagctatttgggggcccaagcgagccagaggctagcctgggtgagccaggggtcagaaaaagcattaaaatga

SEQ ID NO: 101083 - DNA, 426 bp, Glycine max
  Peptide Sequence Number=SeqID_217861
atgtcacgttacagaggacctcgtttcaaaaaaatacgtcgtctggggtctttaccaggactaactagtaaaaggccaacagtcaaaagcgaacttagaaatcaatcgcgctccaaacgacaattgcttaaatacgttcgtatcgccggaaaagctaaaggatcaactggtcaggttttattacaactacttgaaatgcgcttggataacatactttttcggttgggtatggctgcgactattcctcaagcacgccaattaattaaccatagacatgttttagttaatggtcatatagtggatataccaagttatcgttgcaaacctcaagatattattacagcgaaggatgaacaaaaatcgaaagactctggattcaaaattatcttgattcagccccccgtgagaaattgccaaatcatttga

SEQ ID NO: 101084 - DNA, 249 bp, Glycine max
  Peptide Sequence Number=SeqID_217862
atggcgtttttccttagctacttggactacaaggctcaaaacgcacaagtgagcaatgctctcaggaacggaaacgtcacgcatactccagacatcttctcaaagatcccaacgctgcaaaccaaccttcgagaagatccaacggttaacgaagtatgggcagcgtttttaccgagacagcttcatgtagcttccttgagaagcttcattaagaggcttcctcaagaagcttcctcgtggcttctttga

SEQ ID NO: 101085 - DNA, 696 bp, Glycine max
  Peptide Sequence Number=SeqID_217863
atgggatcaagtcaaaagccttcgcttaaaaagaggttttatcaagtcaaaatcaagagcttagaggtcaccagtttacgaaagttggggcaattaatgggtcaacttcaacggcaagccttccgcaaagcctatggtaagatttgggacctagctagggtagaagtctccatggaaccaattgcctccctcgcccagtattatgatcagccgttgaggtgcttcatctttggggacttccagctatcaccaatgggttctacccctcattggccaaatctcggcgcaggaattagaccgccaaaggcaagtcgaaaatggggtggtcggaataccgagaaaatatttggagcgatcgacgtttttctcgcctatcatgaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttactgctcgtgcgtcgaaaaaggaaaggcgaattgggaccaactcttggctagcatgggggggcgtctgttaattggttccctcgctagaaggaaggaagaatcaagattctatcttcatgcgaaggatgtccaaatgttcccttga

SEQ ID NO: 101086 - DNA, 421 bp, Glycine max
  Peptide Sequence Number=SeqID_217864
atggtggaaccatcaaagaagcgcaaaggttcttcgagtagaagccaacgacattccgaggctcaggatactccaattccttcctccatttcctcatcctcattgttctcatcagaagaacaacatatacagtacacaaacctcttctcctctcgttctatcatagaccctaagtttatagatatggatttcttttctgatgagagtttcgaatgcattcaagaatttcaaaactcaaatcccattccctttatgtctctaaaattgcctgtgtattctgaattggtaaaagctttttattctaatcttgaaattcaagaaagtaccttgatttcagagttttatgggataaagattgtcattgaccaatccctcttctatgatttgactcaattgtctagcgaaggtgtaccatttgaag

SEQ ID NO: 101087 - DNA, 210 bp, Glycine max
  Peptide Sequence Number=SeqID_217865
atgtgtcgtaggcaatactctaacctttctgtggatgagctgaggggctctggagccatccccaggctgttgtggtgtctcaccctctgcctgcctgggggcgcaatacttcttgatgaaagctcggttagtaggaggcctgatgaccttgctgggggtgacgggcactccgtagaactgacaaaggcccgtaatccagggatcctctag

SEQ ID NO: 101088 - DNA, 168 bp, Glycine max
  Peptide Sequence Number=SeqID_217866
atgactaacttttgtcttctcgctaagccaatctaccggcttagcgagccatccaccgagcgcaccactcttgcggctgagctcaccactcctgcagttgagcgcaaggaagaatctggaagaaggatgatctggacacacgcgctaagcgagggctcgtcccgctaa

SEQ ID NO: 101089 - DNA, 297 bp, Glycine max
  Peptide Sequence Number=SeqID_217867
atgtcattgtctagcgctgttcatgtgtcctccacctatgagtttggagccatgggtagtgattccttagtgcaattctccaacctcgcctttttttcggagccccatgaatgtcattgcctagcgctgttcatgcatcctccaccaacgagtctggagccccacgaaggtattgcgtacaactgttcgccaattctccatttccactttttttcggagccccatgaatgtcattgtctagcgctgttcgtgtgtcctccacctatgagtctggagccccgcaaatttattgcgtag

SEQ ID NO: 101090 - DNA, 771 bp, Glycine max
  Peptide Sequence Number=SeqID_217868
ttgggcaccgtaaccagcttccggttcatcccgcatcgcagtctgcttaccaaaaatggccacttggagctctcgattccatggcgcggctcaacagagcagccgcaccgtcctacctatttaaaggaaacttcggagggaaccagctactagacggttcgattagtctttcgcccctatacccaagtcagacgaacgatttgcacgtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttccgcccgattggggctgcattcccaaacaaaccgactcgccgacagcgcctcgtggtgcgacagg

SEQ ID NO: 101091 - DNA, 762 bp, Glycine max
  Peptide Sequence Number=SeqID_217869
atgagcaaacctgaacaagtttgggaccaaacttggcattggatggctgatgacatggtctataatcataaaaaatcatcaacaagtccagcattgcagcttgatgatagaacttttcaaaatttggtcttgcttcaaattgaagaactgctgcaagcaaatcaaagatcgctaagagactatcattcaatgccatatctagagaatgtgaattgtccagcttatctagacaatagccttatattagctgaactgaactacaacaatgaagaacttagatcagagtttgaacatctattttcttacatgacagatgaacaagcttcaatttacaaccagattgttgaagttgttaataaagatgaaggtggtatgttttttctctatggatatggaggtacaagaaaaacatacatttggaaaacacttgcaagttcactgagagctgacaataaaattataataatggtatcctctagcggcatagcttctttgctattgcctggaggtagaactacacattcaaaatttaaaattccagttccagtttttgaagacttaacttgcaatatccatcaaggaactcaattagctgaactattaaatcagacaagtctaatcatttgggatgaagcacccatggctcacaaattcttttttgaggcacttgatcacagtcttagagatatcatcaaacataactcaaaggacaataaaatctttggagatcctgccagtcattccaagaggcagccgctctga

SEQ ID NO: 101092 - DNA, 495 bp, Glycine max
  Peptide Sequence Number=SeqID_217870
atggcatctacatctactcttcttctttggaaacaacaccttcatagatttggagaagtaacaaatgatgtaatccaatcatatgctcagacaatgccctctccagatcccaaaattgaacatttgctagttcaagctgggtttttagatgttgcaaagctcagacaagttaaaattgatggcgctttagtgactgctttggttgaaagaccagttactggcccaacatattatgattggaaacaaacgtgtgtagaatatataagtgttgttcccccagagaatgcactggtggggtcaacacttaaactaaagtggttaaaagaacacatgctgactctcccagtagaactcacaccacaacaactagcagactattgtagggcatacattttagggcagattggtggggtgtcagtgccagataagtcagggaacaaagttcatctaatgtatctacccctgttagcatattttgataaggctggcaagtaa

SEQ ID NO: 101093 - DNA, 495 bp, Glycine max
  Peptide Sequence Number=SeqID_217871
atgggtgaactagaagaggtgcaagagcagatgaaggccgacatggaggccatgaaagagaaaatgaccacaatgatggaggccatgatgagcatgaagaagataatggaagccaatgcggttgcaattgccgctaccagcgctgttgctaaggtgaaaccaatgcccccatttggcctcaaccaaatgaataatccaacctcagatatggtaggcaaagatttgggaagtacgggcggcccccattatgcgcaaattcaaaacaagcacgccttcccaccatatgaagtcccaactatacaccacccaatgtggcatacactcctagtgagaatgtcaataactccactcccatactcattgagagccgacaaccccaaactgatcatgcacatgtctctcaaaccgtgggggagacacatgaaattccccaccacaatcttgccgacttcgagccttgcctcagatatgccactgaagggcaagcaagtggtg

SEQ ID NO: 101094 - DNA, 231 bp, Glycine max
  Peptide Sequence Number=SeqID_217872
atgcctccgagaatagtgaagagaggtgctgcggcgaagagggcatcgaggggatcctcaaaggctgctcctgagaatcaacctgagcctgaaactgcggaagtggtcgtgaaaaataatgaagaaaatcctgttgttgatgctgtggtggaagaaaagcccgttgatgtggagcaagaacatgaggaagtgccaaatgggtcggctaaggtggaaaggtgttatttgtga

SEQ ID NO: 101095 - DNA, 321 bp, Glycine max
  Peptide Sequence Number=SeqID_217873
atggctgatacacaccttttaatggtagctgatataactcactcactacaacagcctgctggaaagaagttggatggaggaggtgtggcaagtggaggtcttcgagaactgataccttgcattgcaaggacagcagttgccgttggagtggatgggatcttcatggaggtgcatgatgatccactgaaagcacctgttgatggcccaacacagtggccgttgcgccactttaaggagctacttgaagagcttgtagccattgctaggataagcaaagggaagcaacggttcaacattgatctcacaccatttcgtgaataa

SEQ ID NO: 101096 - DNA, 465 bp, Glycine max
  Peptide Sequence Number=SeqID_217874
atgtcgtcagagttggaggtagcatctgtataccttacggcagggcctagaaaaatcttatctatgggtcaaatgtcacctcttgcagtgccaaaagaaaaagatactatactaatactaatactcgagaaggttaaaatagcttatgacattcctatagtgacagatgtgcatgagtctatccagtgtgaagcagttggcagagtagcagatatcattcagattccagcattcttgtgtcgccaaacagatcttctagttgcagcagccaaaactgggaaaattatcaacattaagaagggccagttctgcgctccttctgtgatgacaaattcagctgaaaaggtccggttagctggaaatcctaatgtgatggtttgtgagagaggaacaatgtttggatacaatgatttgattgttgatccacgtaacttggagtggatgagagaagccaattgtcccatt

SEQ ID NO: 101097 - DNA, 867 bp, Glycine max
  Peptide Sequence Number=SeqID_217875
atggaaaacgagagggttttaggaggagagaagagaaaacgaaaccgagagaaagagaaaccgcaaagactactcctagatgaaagattaaacctgccaagtgaagtgcggagtgatgcacatttcaggggtaagcaggttgctactaggggtaacaatggtactggtggaggaaacaagcctggtggtaggggtaagagggttgaacataactttttgaatgtcagtggtagttttttggtgtcactcagtttgcctaaagatgatattgaagatgagtatgttagtgaacagttgagcaattatgattcagatgaagatgttttcaagaaaaagtatgaaagattcaataacgagttgctttgcaaggaatttaaatggaggttgggattggagtttgcttctttgattacgagcaagagcaagggtattataaaagatgtactaccaagatttggtaatttctatatttgcttagaaggtccaaaaactgctttcaaaaaggactgcagacccttgattaatgtagatggatgtcatctgaaatcaaagtttggaggacaactattgattgttgttgataaagatcccaatgaccagtacatgcctattgcttttgctgttgtagaaacagagacccaggaaacatggagatggtttttgaatttgttgtttgaagatattggtagtgttgaaaccaacaaatgggtgttcattagtgatcaacaaaagggattacaacaagtttttctgaaatttttgacctcgatagagcatgggttctacttgcaacatctttacaacaattttaagaaaaaaaattggtggtgggataatgatgaaagatctgatgatgggggctgctaa

SEQ ID NO: 101098 - DNA, 288 bp, Glycine max
  Peptide Sequence Number=SeqID_217876
atgtcatcgtcatcgacggtggtggctcaaggaccagcggtagttgtgcgagtgagcaacggtggtggctcgaggggcgacgacagttgcactaaaaagtgggtcgtggttacgcaagggagcaatgttggtggctcaacaggcgacggtgaaggatgtggtcgcgaaacgaagaagaaggaaaatgagaaagaagaagaagccaaaggaataaaaaatgacagtaggggacaaaatggaaaaagaagaagaagtaatgagaaaatgaaggtggtgggtggtgaatga

SEQ ID NO: 101099 - DNA, 276 bp, Glycine max
  Peptide Sequence Number=SeqID_217877
atggagaagggagtgtactcaaaccaaagttttcttctaccaccaaaggagactcaccgaccaatcatgcaatgtgaactagtgtacaagccagtgaagcttggagaagaaaattcagaggtagtgacaacgacaacagtcatgacagtggtggcggcgacagttgatgaaggtggtggtaatgacaacgaaaattatggtagtagctgtaacgatagtcatggtggtggtagtgatgatgatgaaggtcatgacaacaacggtggtgacaattga

SEQ ID NO: 101100 - DNA, 306 bp, Glycine max
  Peptide Sequence Number=SeqID_217878
atgcatttgggattttggaaccctaaggctaaatttcaaactctaacagaggctattcggttgatgggtgaaaggatgaatggaaagggtggatcatcatcattgtcgtcatcatctcttgcaatggttaagttcaaatgtgacttatccgctattatgttcacgtcgcgtagtgtgaaccatccgaggaaaaggaatccagttcttgcatattttttccatgggttgatgatactaaggctgctaataatgtgtccgcagaagggagtgagttggtccgatatgttcatgaaaatgaagagctga

SEQ ID NO: 101101 - DNA, 927 bp, Glycine max
  Peptide Sequence Number=SeqID_217879
atgtggctttcttgtgcacaggcattactttttcataaattaggtagatcatggagaaaacctattgacaagccaccagataaagaatatattgatgtcttgcaactttttggtgattccgaggcttctgccttttctatccacaatcttcttcaagctggtaaaggttatggccttgctgttgggtcatgggtgggaccatatgccatgtgtcgcacatgggaagttctagcccgtaagaaaaatgaccttggagaactgccacttccaatggctatttatgttgtttctggagatgaagatggggagcgtggtggagcaccagttgtctgcattgaagatgcctccaaacgctgttttgagttttcaagtggcttagctgcttggacacctctacttttattggttcctttggttcttggacttgataaagtcaatccaaggtatattccattattgcgctcaacttttaaatttccccaaagccttggcatcatgggtggcaaaccaggtgcttcaacatacattattggtgctcagaatgaaaaagcattctaccttgatccccatgatgttcagcaggttgttaatatcagtggggatactcaagagcctactagtacttcgtcataccattgcaatattatgaggcacatacccctagattcaattgatccatccttagctattggattttactgccgagacaaagatgattttgatgatttctgctcccaagcttcgaagctcgcagaagaatcaaatggtgcaccattgttcactgtaactcagtctcggagtttctcaaagcaagtcaccagtaatgatgtgtcaggtgacaacactggattccaagaggaagatttccctggcatggaccgtggcaatgatacaggaaccaatgaggatgattggcaactcttataa

SEQ ID NO: 101102 - DNA, 1308 bp, Glycine max
  Peptide Sequence Number=SeqID_217880
atgactgcttcagcccgatcttcccttaagaagatgtcatgggctaggggtcaatcctctggttggacagcttttgatctcaagcagagaaagaataacaattttgaatctgaagatgacaaggaccctttcccagctataggcactaccgatcctatggtcgggaagaaccatgttcctgcaaagcctttctcttcagtacttctcccaactagaaacttcccccctttcaaagagggtgggaatagcaaaaaggcaatggtaggttctgattctgatggaaaatattgcggggctactgctcaggaagatgttaatttagctatcaaaaagcttagagagcagcatctttgggctgaacatagcttgatagatgatattttctctgctgttaataacaatattgacaaggccacagctttattggaaactatggaccctgcagcgaattttgaagaatccaaagtatccagcaatcctagatcaactacttcagatgatactccttgtaaggataagactgacgatagtcttacttcagaaaaggttgaggatgacattcccttcgattctaatcttgttgataatctccaggataatgataaggacttggaggatagaaatgctccctcaggtcaaaagctttctgatgttgattacttgagatgcaaaatgaaactcttgaattccattcctgttgagcctgaatgggaggatgatgatatttacattagcaatcgaaaggatgcattgaggacaatgcggtcagcatcacgacattctagggcagcttctagtgcttttcttagaggtgatcatttttctgctcaacatcattcaatgaaagctcgggcggaacggcatactgctgaagaacttaattctgatgcagccaaaaaaattttaagcgtcaggaataatgaaaatgatatctggaaacttgatttgcatggtcttcatgcaactgaagctattcaagcattgcaagaacatctctacagaattgaaagccaaggcttctcaaagagttcagccacttcaaatggcgtgaaggaaaacgggcttggacattctacacttggatctctcaatttcatggacagggaagcaccattacggctcagaccattagctttgcatgtcataacaggtgtcggtaatcacagtcggggacaagccgctcttcctacagctgtcagaagtttcctcaatgaaaacaggtcgaaaatctcccaatgcagtatgtcatctatactgcttccttccctccctcccattacctttgttgaggatattcaaaacgaataa

SEQ ID NO: 101103 - DNA, 984 bp, Glycine max
  Peptide Sequence Number=SeqID_217881
atgtacccatcttactattatccttctagtttctgtggggcatatgcaacaaacttctccaatttgtggttcaatagaagaggtacctcaattgagccattctctgatcctccaaagtccacttcaagtgttatggcaaactttggaactacacatagaacacccaccactaccactacaccttcaccaccctccttagacccttatgaaccaaaagcgcctcatgaaaagttatacactgatttcaaaatctactggcccttcaccacgcccttgacttcagaagctgcagcaattcgtgtcatcagaaacttggagaatcttggcttgtactacacactctttgtgtggatcatactcttcatagtcctcattcctcatcttctaagggcacaccccaaatctgttttccttcatagaaccatagataaaaagtttgtgttggctttgctagtgtttgcgacatttgtgcagctgattttgactgaggcagggattcagcttgctgtgactttggcttgtgctgtgccttttcttttggtgcatgcagttttttgggttagtcatcatggctttgagattgaggatgattctgataccaaagaaatggctcctcttgttggccataatagatgtacatgtggagccaaggaaacgaaagcttcgatcctcccaccccgaacccaccaaacccgtcgagccacaacaacacgaccgaaagttgaactcgaacaacaacaacaacagcaacccatcccagaaccaaccctaaccctaaaagaccctaacatcatggtcgtcgaggaaccaaaacatgaacaagaggaagaaccgcaaaatgctgaaagcgaagaagaagaggaagaggaggatctcactctcgaagaagagcccgtggagaagcttctggaaatgttcacgaaggagcagctccactctctcgccgtaggtcgtggatatgttcccctgatttatttattttga

SEQ ID NO: 101104 - DNA, 591 bp, Glycine max
  Peptide Sequence Number=SeqID_217882
atggcaaattatggaaccacacagagaataccctcctcctcaacaccaccatccactgcagacaattatgaaccagaaccaaaagcaccccaagaaaaattctacagtgatttcagaatctactgccccattaacattccctccacatcagaagctgcaggagtgcgcatcatgagaaacatgtgcaattttgggttgtactacacactctttgtgtggatcatactcttcataaccctcatccctcagcgcaaggtgtcattgattctgtttgtgaccatgacctatgtgacaaccctttatattttactcttgagggtatttccaaactctgttgtgcttcacagaatcatagacaaaagggttgtgttggctttgcttgcaattgcaactgcggtgcagctgattttgactgaggcaggcattcatcttgcagtgactttggctagtagtgtgcctgtgcttctggttcatgctgttttgtgggctagctatgatgcctttgaggttgaggatgcttctgcaaaaggagaactggctccacttgcaggccatagtgaaaatgttgatgacaatactgatgctgcttaa

SEQ ID NO: 101105 - DNA, 687 bp, Glycine max
  Peptide Sequence Number=SeqID_217883
atggaaggagagagaggtggcgcacccaattatgagcttcaagtttcgttcaccaacaccccacaggccatacacgaattgggttttgttcaatatgaagaaaaccaggtccttggcttcttgtcaccctcttcacaatctcaatcttctcccctctctcaatccttaaagagtgataccctcgtcgtcgctactgccaccactgcaatcgccgctgcagcaaccatcggattcgtgagtcatagcgaacttgccatcaaaacttggaataacgaccaggaggtggtaggaactctggatccaaagcctgtcgaagaagaaaattgcactggaaatggtagtgatcaaggcaacaacaacgcttggtggaggagcgcagcaacagaaaagaacaagttgaaaataaggaggaagcttagagaaccaaggttttgtttccaaacaagaagtgatgtagatgtgcttgatgatggttacaaatggaggaaatatggccagaaagttgtcaagaatagccttcatccaagaaaatgttcgtggttgagtacactggcaataccagaggcattatacccggggggaatgaagctacattatcatgaaaggttttacataagttttatcctgaataagaaaaggggaaagagttattgtcatgtgcctcaatgctactacggtaaaagctaa

SEQ ID NO: 101106 - DNA, 375 bp, Glycine max
  Peptide Sequence Number=SeqID_217884
atgcctgacaaaatattgtcttacaataaagcctatattgacgaggaagatgaagaagagtggagctcacaaagcgacgaggaaaagggcaaacaaggaatatgctatatcttcttcctcttcccatgtgatagatatcaagacactttcaaaactttagaacgtggaagccaaggattaagaaaaaatgattctcacatagaacatcgtgctgcattagcagttaagttatacggagttcaagcagcacttttatctgctttgggcaacccttttgagaacctatcccagtccaaaagctcaagtttgtggcaagcctctggcgggttcttaccagcaatgatatggactggaatgttcccagtgagtctatga

SEQ ID NO: 101107 - DNA, 2460 bp, Glycine max
  Peptide Sequence Number=SeqID_217885
atggaaaactctgtttcatctctctcactatgtttccctccaaaccccaaaacccacattttccaagctttcagctttagaccctccccacgatccccaccaccaacctccaaaacccaccacacaaaacctcccagattcaccacccccagaaagcacagaaccaaaaagccaaaacccttcaccgaaaaagacgcgtttccgagctccctacccctccacaacaaaaacccaatcttcatcttcaaagacatcaaacgcttcgctcgccagaacaagctcaaggaggctctcaccatcttggactacgttgaccagcgcggcatccccgtcgacgccaccactttctcttctgtcgtcgccgcgtgcattcgtgccaagtcactgccacaaggaagggaagttcacacccacatcagaatcaatggactcgaaaacaactctttcttgcggacaaagcttgttcacatgtacaccgcatgtgggtcgttggaagatgcgcagaagctgtttgatggattgccctgcgagagcgtgtacccgtggaacgctttgctcagagggactgtggtttctgggaagagacagtacattgatgtgctcaagacttatactgagatgagggcattgggggttgagttgaatgtgtatagtttctctaatgtgattaagagtttcgctggcgcgagagcattttcgcaaggattgaagactcatggacttttgattaaaaatggattggtggataactacattcttaggaccagtttgattgatatgtacttcaagtgtgggaaggttaggctcgcgtgccgggtgtttgaggaaattcccgagagggatgttgttgtgtggggggcgatgcttgctgggtttgcgcacaataggttgcagagggaggtgttggagtatgtgaggtggatggtggaggagggagtgaagccaaattcggttgtgatgacgattgttattcctgtgatcggggaggtttgtgcgaggaggttgggtcaggagtttcatgcttatgttgtgaaaactaaatcgtactctaagctggtgcccgttcagtcttctttgattgatatgtattgcaagtgtggggatatgatttcggcgagacgggttttttatggttcaaaggagaggaatgtggtttgttggactgctctgatgtcggggtatgctgcgaatgggaaactagagcaggcgctgaggtccacgatttggatgcagcaagaagggttcaggcctgatgtggtgacacttgccactgttcttccggtttgtgcacagttgagggctttggaacaagggaagcagattcatgcgtatgctttgaaacattggtttctgcctaatgtgtctgtagcttcttcattgatgacgatgtactccaagtgtggtgttgttgagtattctagaaggttatttgataatatggaacaaaggaatgtgatttcatggaccgccatgattgattcgtatattgaaaatgggtatctgtgtgaagcacttggtgtgattaggtcaatgcaattgtcaaagcacaggccagactctgttgctattggaaggatgttgagtgtttgtggtgaacgaaaacttgtgaagcttgggaaggagattcatgggcagatattgaaaagggactttacatcagtccattttgtttctgcagaacttatcaatatgtatggtttctttggagatattaataaggccaatttggtgtttaatgcagttccagttaaaggttctatgacatggactgctcttattagggcctatggatataatgaattgtatcaagatgcagttaacctttttgatcaaatgagatattctccaaaccactttacctttgaagccattctatctatatgtgacaaagctggatttgttgatgatgcttgtagaatcttcaattcaatgcctagatataaaattgaagcatctaaggaacacttcgctattatggtgacccttattcctatacgccgtcgtttctctgtttcgactttgaagccctatctgccgcaacgcgacgcgacttcctccgacgacgcgagccgagttgcaaggcgtttatcaagattattcagacattcaggtttcacgcctgaacccttcaataatggccatcatcaaatgcagaagcttcagcaatgcagaggcataagagtgaaggtcataggtgggaacttggaagcagcattgggattgatgcagcgtaagatgcaatcaagtgggattgagaggatgataaagcaagagcaaagattccatatcaaaaactctgagaagcgtgttttagcccaaaagaacttggagcggaagattcgatctgaagatcttgctaggaaacttaaggccattatgatcaagaaagtcagtcaagatgttgaatgttctttagttgtgatggaagcagttttcaagcagcagttggatgcaggatga

SEQ ID NO: 101108 - DNA, 555 bp, Glycine max
  Peptide Sequence Number=SeqID_217886
atggtcttgaagggtctatgtgagaggattgtttcttcaaaatgctcttctaaaagctccaccgagactgtagataatacacaggtgcccgtttattcaaaagcaggatctagtaacagtaagtttcccaaggcttccttatggtcaaacatctttacatctggtttttcagtggttgaaacatatagtgaatcatcagcttccgaaaagaaagcagttcattctcgaagtagcgggtgggcagctgctgtgaggaaagttgtaactggaggctcaatgaggagatttcaggagcgtgtactaggatcaagcaggactgacatttcaagttctgatggtgatatatggcttctaggtgtatgtcataaaatttcacagcaagaatcatctggaggtgtagataatagtaatggattggcatcatttgaacaagatttttcatcaaaaatcctagttacatatcggaaaggctttgatgctattggagatacaaagtataccagtgatgttcattggggttgtatgcttcgaagcagtcagatgcttgttgcacag

SEQ ID NO: 101109 - DNA, 807 bp, Glycine max
  Peptide Sequence Number=SeqID_217887
atgaataaagcaagcttggtgggtgacactatgattgaaactgagcaagtggctaccataatgattaaagcaaagaccactcttccctcggctgagtttgtgacaggatcaacagcatggcttggcagaggtctgtcctgtgtctgtgcacagagaagagaaagtgatgcccgaccctcttttgatttaactccagcccaggaggagtgcttgcagagactacaaagtcgcattgatattccatacgatggttctgtccctgagcaccaggatgccctaagagatttatggaatgcagcatttcccgaagaagaactccatggtttgatttctgagcagtggaaggacatgggctggcaagggaaggatccatcaacagattttaggggtggtggtttcatatcattggagaatttgttgttttttgctaggaatttcccgaaatcctttcaagatcttttacggaagcaggaaggagatcggtcagtgtgggaatatccatttgctgttgctggtgttaacatcacattcatgcttattcagatgctggatcttgaagcagtcaaacctcggacactggtgggagcaactttcctaaaatttcttgcagaaaatgattcagcttttgatcttctctattgcataacattcaagatgatggatcaacaatggctttctatgcgtgcttcatacatggattttaatacagtaatgaaatctacacgccgtcagctggagaaagagcttctacttgaagacataatgcggctagaagatgtaccctcatacaaacttctcacacgatag

SEQ ID NO: 101110 - DNA, 408 bp, Glycine max
  Peptide Sequence Number=SeqID_217888
atggagatggaatggaatgtctttcaacgggttgggatccaggggctgaagctgcccacgaccaggaacgcgcacatgctgaacacgcgcgtggacaagctgcatacgaaagttctgttcatgcaagagttggggtttttgtacgagaaagcactcagagcttgtgctaggttacccgcaattttcggatatgacgtggagaacaatctgtggcccaagtttgtgtatcttgtgaaggaaatggagagagatttggaggagctgaataggtttcctcaatactttgggttcagtttgaaggagaggattgtgccaaggcacttgcatttgaaggagaggggtgttaggattcccttaaacagaatgttgatgtggggtaatgaaaagttctacgccaagtggaagtaa

SEQ ID NO: 101111 - DNA, 417 bp, Glycine max
  Peptide Sequence Number=SeqID_217889
atgactagaggatgtcacaaattttgccaaatatcgccggttattccaaaaggtaaaagacaagaagtggttcatgcaacgataaactcttcctatctttggaatttctgtgaagtcatgacattcactaaaaatatgagactccaaattggcaattcagattctaatgttagtgaaagaaaagaattttcagattggattttgggcattggcattggaactattggacatagcaatgatgtcgatataaatgttcctattccagatgatttggttcttcaaagcaaagataacatgaatgttggtgcattctttcaagatagtgtcattttaacacctagaaatgacattgttgacttgatcaatcaatacatgttgtcattattgcctagggatgaaaaatcttacaggggatga

SEQ ID NO: 101112 - DNA, 1872 bp, Glycine max
  Peptide Sequence Number=SeqID_217890
ttgttgttggttcctccaaaccaacacgttacaaattcaaagaaactcaaagccatggcatgttcttcattcacatttgccaatccatcatcaattcctagactgagaaattcactttcttcttcttctataagcccgagagctatggccaaagagctttacttcaaccacgacggttcagccacgaaaaagctgttggcaggagtggacatggtggctgagctgcttggtgtgacattgggtccaaaggggagaaatgttgtgctgccaaataagtatggaccacccaagatagtaaatgatggagaaactgttctcaaggagattgaattggaagatccgttggaaaatgttggagttaaattggtgagacaagctggtgctaaaacgaatgaccaagctggtgatggctcaactacatctgttgttcttgctcgtggcttaatcagagaggggacaaaggttattgcagctggaatgaatcctgttcaaattgctcgtgggattgagaagacagcagcggcacttgtttctgaactcagattgatgtcaagagaagttgaggatcatgaacttgcagatgttgctgcagtcagtgctgggaatgattattcagttggaaacatgatttctgaggctctgcataaagtaggtagaatgggagtagtgacaattgaaaccggaaggagtactgagaattgtctagagattgtggaagggatgcaattcgatcgtggatatctgtcaccatactttgtcaacaatagaagaaagatgacagttgaactccacaactgcaagttgcttttggttgacaagaaaatcacaaaaacaaaggaattgatcaacatattgaacaattctgcaaaagaaaagtatcctgttttgatagttgcagaaggcattgaacaagaagctcttgctccagtcatcaaaaataaacttcggggtgctcttaaggtagctgccattaaggctcctgcctttggtgaacgcaagacacattacttggaagatattgccatcttgactggaggtactgtaatcagagaagatatgggtttcaccctagaaaaggctcacaagaatgatctgggttctgctactaaggttgtcataacaaagaattctaccttaatagttactgatgggagtactcgagaagctgttgagaagagggttcatcaacttaggaggcttgttgagaatactgtagaaaatttccaaaagaatatattgaatgaaaggatagcaaggttatctgggggcattgctattcttcaggtaggagcacaaacacaagtagagttgaaggataaacagttaagagtagaagatgctctaaatgcaaccaaggctgcaatcgaggaaggtgtagtggtcggtggtggctgtagccttttaagactatctcaaaaggtggatggcataaaaaaactactggacaatgaagaacaacagattggtgctgaaatcttcaggagagcattgagctatcctacaagaatgatagcgaagaatgctggtttaaacggcaatgtcatcatagataaggttttatcagacaataacatgaattttggttacaatgctgctagagacagttacgaggatctcatgaaggctgggatcatggatccaacaaagcattcagcttctgtggccaaggcatttctaacatctaatgcagtagtcgttgagcgcaaggaattagagccaataccgatgccacgaagaaagtctatgcccatgcccacctcaggtaatgaattagagccaatgtccataccacgaagaaagcccatgtccatgcccatggctaccccaggtaatgaaatcttgctaggtcaaacggttaactcattcatttga

SEQ ID NO: 101113 - DNA, 222 bp, Glycine max
  Peptide Sequence Number=SeqID_217891
atggaagcaatgaagattaggaggaagaggaccaagaaagaatgtaagaatcagaagagaacgtggatgtctctgaacggtggtgacagaaccgaaacagaggaaacgcgaggagacattgacagagacatcggagtttatcgattgtgttttgtcggtccaccctcgttgacctcgtcccaacgagtgaatgtgaattcacgtgtgaaaattagtaaatga

SEQ ID NO: 101114 - DNA, 280 bp, Glycine max
  Peptide Sequence Number=SeqID_217892
tttactggaggctctagatgttgatgttatgcacgaaggggtgcagaacctggtgataccaatacaaaaccagtttgaatctgtgaactccaacaacgtgcaccacaatgacaacaccacctactgttggctaactcaagaggacgtgttccgctacctcctcaactcaattggtgtgttttccccaacatcggggaaccccatcaacaccttaggcgtcattgacacacaaaaccttttgaagagagagaaagaaagagaatcacaagaaagagagtaa

SEQ ID NO: 101115 - DNA, 396 bp, Glycine max
  Peptide Sequence Number=SeqID_217893
atgaaattccaattcttagtggagaacaccatgaacaataccttaggaactgtatcgaagttttgtccaagtgttagtatgtatttttgcattgttgctaagatttctcgctattgtgcatatagaattgtcattaatatggttgttggtgggaaagtggtaactctaaaaagcatagaagaaagtagtcatattgtcatgcaagaaacgcctatgcaacgcgcatccaccactaagcgcatcttcagcgcgcttagcatgacaagggaatctgaaagagcacaagaatcaaggccatgtgctaagtgcgagatcaagtcgctaagcgagacgtttgtcatttgccaggctcaatgcacgactggcgccaagtccaaatccacttactcgcactaa

SEQ ID NO: 101116 - DNA, 198 bp, Glycine max
  Peptide Sequence Number=SeqID_217894
atggggggtgcattgaccttgttggatgtccctgtgaccttgttggatgtccctagtgagggaaatagagtggttaaagagttccaagcatctctggacggggatggcttagaatctataattatccatggtcaaagaattgatggtgcccatgtttcatacgttgtatgttgtgtatgtacatggggggtgaagtaa

SEQ ID NO: 101117 - DNA, 161 bp, Glycine max
  Peptide Sequence Number=SeqID_217895
aaatctaccctgaggttcatgagaaccctaaggccttcttcaacagctctagctcaatcctcttggagcctcttgctcgtggctctagtgactggtcccttcctagggaggattgcatcaaccccgatgccaaaatacatgaaggaagaaagcttccttga

SEQ ID NO: 101118 - DNA, 420 bp, Glycine max
  Peptide Sequence Number=SeqID_217896
atggttcagcccactaatccaagatcaagtcaagattctccactaagtgtgcttaggttgcatgaggcatgctcatacttagcccatgagcccaaaatctaccctaaggctcatgagaaccctagggccttctcttgcatctctatcccaatcttcttggagtcttctatccattgtccttgcggggtaggattgcatcacatacctcttgagcttgagtttattcctcaagatcaaggggttcccacagactctaagagaataaaggtcattcctgagtggcccactccaccaagtgtcgagggaagaagcccagagtttcaagaacctatggatttgaggtccaatcattttcaagggggaggagatgatgcaacctatcccccaagggcattggatagaagagtccaagaagattag

SEQ ID NO: 101119 - DNA, 1171 bp, Glycine max
  Peptide Sequence Number=SeqID_217897
cgttattggtgttcggagtcgtcctctttccaaacgtggatgggctagtagatctagcagcgattgatgtttttcttccttatcacaacagcaaggaaagtccagtcgttgctatgttggtagatgcctatgacacatttgaccagagatgcgagaagagaggagcaaggattgtctgttgcacacccgctctttatgtatggctggtttctcacattttccgccatgaaagtagactcacctgtcccctacaaggtcactgcatgtgtgccgagaaagggaaagcaaattgggagcaactcttggctgggttcctgaacgtccccttgatgggaacgaggggttgcatcaattataatcttatacttgtcataagacaacttggctaccccatgagaggagcaccatcagaagagagtattgcgcctttcatcacacgaggcttcggtgaccccaattcaagaatgcttcaaagcgctgaggtccccgaggagagcaaagaggtgcaacccttaatggaactggaaagaacccaaatagtcaaggaaaagttcaagatggcagccatcaaagtcagaaaggaatgtgacgagctgagggatgtcaacacagctacagccgcagcattggaacgagaaacaaagacggcccgaaaagaggaacgaggccgaaacaagttccgaggggctttatggggtagcaacaacaaactcaagttccgaagggccaagagggaccaaccgagaatcgaagggatgatattagaagacaagttaaaggcttatcaaaggtcaaagagaatcttatccaaacaattgagtaggacagaagagaacatgtgggctatcattgagcagtataaagaaaagttaaatctagctgcaacccatgagcaaaggctagaggacaagtatgcaaaagtatctgtcctgcaagcggaaagggaagcaagggagagagtgatagattcattacacagagaagctatgatgtggatggataggttcactttcactttgaataggagtcaagagcttccgcggctgttagccaaagccaaggcgatggcggacttgtactcggctcccgaggaaatagaagatgtgcaagagcaaatgaaggccgatatcgaggccttgaaggatcgaatggcctccatgatggaggacat

SEQ ID NO: 101120 - DNA, 296 bp, Glycine max
  Peptide Sequence Number=SeqID_217898
ctccttcgttccatggcttattccctagtggatggtgccttccctctcctcttctccttggtcttccgctgcatctccatggtgaaaaatcgccattgaaggacctcattgaagctcaaaatccagcctccatagaagttccacaagcaagcttccatcatgaagggttcacaaacatcccattgatgggaacaaggggttgtatcaattataatcccgtccttgccataagacaacttggctatcccatgagaggagcaccatcagaagaaagtatcgcgcctttcattgcgtga

SEQ ID NO: 101121 - DNA, 363 bp, Glycine max
  Peptide Sequence Number=SeqID_217899
atgcgggccgccgttttgtctcgccatggggtttgtcaccatgctgctcggtgcgctgctgctggtggcggggatgacgctgtttcctgcggcctggcaaagccactggtcgctgtacgtgattccggtggcgatctcggtggccggcctggccttcaccgtcgggccggccaccagctatgcgctggagccgtatcagcagcaggcgggtgtggcggcggcgctgcagggatttattcagatggcgggcggtgcgggtggcagcctggcgatggtggcgctgccggtggcagagaaatcagcgtgagcgctgatgatgctggtgggtgcagcgctggcgctgatcgcctggcgctgcagtaa

SEQ ID NO: 101122 - DNA, 583 bp, Glycine max
  Peptide Sequence Number=SeqID_217900
atggtgataccagttaattatgcttttcgcgatgaggggcttatgcgcgtagtcattctgggtagtggtgtcgtaggggtagccagtgcgtggtatctggcgcaggcggggcatgacgtcaccgtaatcgatcgccagcccggcgcggcgttggaaaccagtgccggcaatgccgggcagatttcgcccggctatgcggcaccctgggcggcgcccggtgtaccgctcaaggcggtaaagtggatgtttcagaaacacgcaccgctggcggtgcgacttgatggcagcaagttccagctggagtggatgtggaatatgctgcgcaactgcgacatgcgtcactaccaggaaaacaagggccgtatggtgcgcatcgccgaatacagccgcgactgcctgaaggcactgcgcagcagcaccggcatcgcctatgaagggcgccagggcggcactttgcagctgttccgcacgcagcaacagtttgacagcgccagcaaagacatcgcggtgctgcgtgaagcgggtgtgccttatgagctgctggaagcgcatcagctgcacagcgtagagccggcgctggcgg

SEQ ID NO: 101123 - DNA, 318 bp, Glycine max
  Peptide Sequence Number=SeqID_217901
atgttgagtttaaaaaaaatctttctctcattagctcacttcgaacccattctctctctctctctcaaaaccccctcttctccctcttcaacaccattcgttctttctgtgctaccctcacacattactcctctgccacagaagaagcaacctcctcctacttcgccgtccaccactgggaagtcttcttctcacaagtactcattctctcgctcgttcgttgcttacttggtacaatcctacccccgaagggcattagatagaagacttcaagaagattgggccagagatacaggagaagccctagggttctcatga

SEQ ID NO: 101124 - DNA, 3144 bp, Glycine max
  Peptide Sequence Number=SeqID_217902
gcccaactcaatttacactccctcactggacctttggcacctgagaccttgcgtttctccggacttattgttgaccatcaggtgctcatccttgtagatggggggagcacccacaatttcattcaggactccatggttgccgaattgggcctcacaccttgtcctactacacccctgaaggttatggtcggtaatgggcaattcctcaattgccaacaagtttgtcaagcggtgaccctgacaattcagaacattgctttcatcattgatcttcacgtgttgcctctctgtggtgcacacgtcgtgttgggagttcaatggcttcgctccctcggccccgttttaacagactacacctccctctcaatgcaattcctccataatggacgtatcattagctttaagggtgaggatacttccaccctccaaccccttacttcgactcaactccggcgtctggttcgtactaccggagacacagcctacttccacctttctgtcacccctcttgactcatcccctcctgatacacacagtccttcttatccttccgatattcagtccctcttaaccaaatttgcctctctatttcacccccccactgcccttcctccatcccgaccgaccgaccaccatattcacctgaacccaaactcacaaaccgttaatgtacgtccatatagatatccacattatcagaaagcggagattgaatctcaagttgcctccatgttgcagagagggcttattcgcccgagtacgagccctttttcttctccggtcctccttgtccggaaacacgacggcacctggcgattctgtatagattacagagccctcaatgccctcactatcaaggatcgctttccgatacccacgatagacgagtcattggacaaattagggggtgcttcctggttctctaaattagacttattacaaggctatcatcagattctcatgtctgaggaagacatctacaaaactgccttccgtacgcaccatgggcattttgagttcagggagcaattcgtcctcaagctctcgaaatgcacctttgcccaacctcaggttgaatacttgggtcatcttgtatccgcgcagggtgttgaaccggtattggctaaagtccaggttatccagcaatggccggaaccgcagtcagggcgagcactcaagagcttcttgggtctggctggtttttatagatgtttcattcgtggctatgcaacgattgcagctcccctgactaaattggtcacggcggatccatttcagtggaccgaggaagctcgtgctgccttcgttcaccttaaggaaatgttgacttctactccggtgttgcggttgccggatttttccctcactttcacagtggaaaccgatgcgtcgggaacaggcatgggagctgtgttgactcagcgaggtcatcccattgcgtattttagcaaagtttttcccccgaaactaatgggtgcctccacctatgttcgagagttgttcgcgattactgccgccgttaagaagtggcgtcagtacctcctcggccgtcgttttcacatcttaactgatcatcgcagtttgaaggaattactcactcaggtgattcaaacacctgagcagcagatgtatcttgctcgcttgatgggctatgattataccatcatgtatcgttctggtagctctaataaggttgctgatgccctctcccgaacactgaatttgttcaattccgtcaatccatcttggatcaccgatcaccgcgaattttcagttactaatgatttgatacttcataaagggcgtatttggcttcctcaagctctccccttcacatccaccttgctctctgaataccattcaactccgaccggcgggcacatgggcatcactaagacattggcacgattgacggagaacttttattggaaggggattcgtcaagatgtggagcgtttcatagcttcttgtgttgattgccaacacacgaagtacgagactcgcaaaccggcgggattgctttcccccttgccggtaccatcacggccatgggaggacttgtcccttgatttcattacagggcttccggcgttccacggacatacagtaattcttgtaatcgtcgatcgattctcaaagggcattcatctcgaaatgttacccacgcagcacacggcttacacagtggccgttctcttcatggacctcgtcggaaaactccatggcatgcccaggagcttagtttccgatcgcgaccccttatttctcagcaaattttggcaagagcttttccgagtaatagagcaatatctccgtgcttttgttcataagaagccgtcatcctggggtaagttactcaggtgggtcgaatggtcatataacacttcttggaattccagttctggtctcaccccttatgagattacctttggaaagaagcctgttaattttccaagatacttagaaggggattccaccattgttgccgttgaggacctattgtctgaacgacaagctactttcgaggcaattaagaagaaactagagaaggcccaaagccgtatgaaacattttgctgatgctcgaagacgcgatgctcactttaatgtaggagacttggttctggtcaaactcagaccccatcgtcagaagtcagcaacgggtcaacctggtgggttttctaaacttgacaaacggttttatgggccgtttcgggtcactgagcgcattgggcccgcagcttataaactcaagttaccagataattcccgtatacaccctgtctttcacatttcactcctcaagctctttcgttctccagaacctgttaatgaccaatattgcagtacattgcctcctcactatgagcatgatcaactcgtgattactccactagccatcctcagtacacgatattctgcggattccaaactcgaagtacttgttcaatggcaaggcttatcgccggacgatactacttgggaagattgggataagttacgtgaagcttatcaccttgaggacaaggtgattccggaaggggtgaaggatgatagcaatatagcagcaaccagaaacaatatagcagaaaccagacccagaaggaagaagaagataccagcatacctcagagattgcgtttga

SEQ ID NO: 101125 - DNA, 609 bp, Glycine max
  Peptide Sequence Number=SeqID_217903
atgaagatggacttccctatggggctgcacttcatgcatcattggccactagcatatgcagctgccaagtttgctggtgcatgcctctgtggcttaaaaggagaagttggggtcaccgagggaagtaatagatctagttccattccaaaggttctttttcaaatgtatagaaggtttgaaaaattctatttacttcttgtcttggctactggagaggattattccatggaacctgctgagagcaggaggccattttgtgctctccttgacgttggtcttattaggactacaactggtaaccatgtgtttggtgcccttaagggagctctggatgggggtttggatattcctcacagtgacaagaggtttgttgggttttataaggagaagaaggagcttgatgcagagaatggtattgaggcactgtataagaaggttcatgctgccatccaggctgatcctactctcaagaaatctgataagcagcccccgaaggagcacaagaggtacaacttgaagaagctgacctatgaggacaggaaggctaagtttatttcacgcgtggcgactctcaactctactgccgataacaatgaagatgatgagtga

SEQ ID NO: 101126 - DNA, 184 bp, Glycine max
  Peptide Sequence Number=SeqID_217904
atggtgaacaacattttcacaccatctagatacaaagaaatcatcatggtgcagcccaaaccaagtgctggcctaaaggggaaacctcaccaacatgctctcattttcatgccttcttgcattcaacaatcaaaggcttgggtccctaggcctaagtcatattttggcatttaccctaaccccc

SEQ ID NO: 101127 - DNA, 135 bp, Glycine max
  Peptide Sequence Number=SeqID_217905
atgggttctcatacttggtgtgacattactctgaacatgaacgattttatatttgaaggtgggacatacagtgggactcatgtcttgccgatgttaagatgttatggcagatttttcaaacccatttttccgtga

SEQ ID NO: 101128 - DNA, 1143 bp, Glycine max
  Peptide Sequence Number=SeqID_217906
atggctctaacacttcgctcttcaatttcccttgtcaaccagaaagaaaccaaactcccaaaagccaaagacgaggttcccaccaaagtgttttactttggaaaaaccaacccatctttccgtctcagagcaaagagttccatgcaacaaacacacgtcacaccaaacaacagctttaactccgaagtaacgatgataaacgagaaaagggagaaggttcacgctccatcggttgcacatagccacaatgattcaatgagagtgcccgtgtttgtgatgctgccattggacactgtaactatgggagggactttgaataagccgagagcaatgaatgctagtttgatggccctgaagagtgcaggagtggaaggagtgatggtggatgcttggtggggtttggtggaaaaagagggacccttgaagtataattgggaagcctatgctgaacttgtgcagatggtgcaaaggcatggcttgaagcttcaggttgtcatgtctttccatcaatgtggaggaaatgttggagactcctgcagcattcctctacctccatgggtgttggaagaaatcagcaagaaccctgagctggtttacacagacagatcaggaaggaggaatcctgagtacatctccttgggctgtgattcaatgcctgttctgcgcggaaggacgccccttcaagtgtactctgattacatgaggagcttccgttacagattcagagactatttgggcagtgttatcattgaaattcaagtggggatgggtccttgtggggagctgagatatccatcttatccagaaagcaatggaacatggaggtttcctggaattggagaatttcagtgctatgacaagtatatgagagcttccttggaagcatcaactgaggccattgggaagaaagagtggggaaaaaatggaccacatgactcaggccaatacaaccaatttcctgaggacactggttttttccagagggaaggaacatggaacacagaatatggacgattcttccttgactggctactacaacacgcggtttcgcgatggatacctaccaatagcacaaatgctggcaaaacatggagttgtgctcaatttcacctgcatggaaatgagggacagagagcaacctga

SEQ ID NO: 101129 - DNA, 192 bp, Glycine max
  Peptide Sequence Number=SeqID_217907
atgtctgaaggtggaaaaagacaaaggcttccagaatctgattcttgtgggactcatctttacgttggacacatcacaggaattcagaagcagcaagaacaagctcaagaggttgctctttggcatttcagcatccaattcctagctaaacaatctttaagcaaaaagcaaggacaatatattacttactag

SEQ ID NO: 101130 - DNA, 2819 bp, Glycine max
  Peptide Sequence Number=SeqID_217908
atgagttctcaacttcggagagaaagaagggactggtccagggttccaccacaaggtgctactcgtcaagaatgggtccccagaggggctgctgctgcgtccagcaatgttgctcagccatcaaatttgcattcaaacaacaatgctgatgctggttcttccaatcaaggggtggccgtcgctgctccgtcgtcggtgagtcgcgctagaagcaacaatcatgggaatgattccggttcttccaatcaaggggtggccgttgctgttgtgtcggttagtcacggtagaagcaacaatcatgggactgatgctgccggttcttccaatcaaggggtggccattgctgctctgtcggtgagtcgcggtagaagcaacattcatgggaatgatgctggttcttccaatcaaggggtggccgttgctgctctgccagccagtcgcggtagaagcaacaatcatgggactgatgctgccggttcttccaatcaaggggtggccattgctgctctgtcagtgagttgcggtagaagcaacattcatgggcatgatgctggttcttccaatcaaggggtggccgttgctgctccaccagccagtcgcggtagaagcaacaatcccaggaatgatgctggttcttccaatcaaggtttggccgttgctccgccggtgaatcgtggtagaagcaacaatcaagggaaagattctggtccttccagtcaaggggtggctgttgctgcactggcgagtcgtggtagaagcaacaatcatgggactcataggatggaaaaggaaaaggataaggggaacaagagtgggagtcaggtggagaagggattgggagtgggagtcagatactctagtttgcctcaactggtgcaagagattcaggagaagctcatgaaaggtactgtggagtgcatgatttgctatgagatggtccagaggtctgcggcggtttggtcttgctccagctgttactctatctttcacctgaactgcatcaagaagtgggctagggcaccaatttcaagtgatttgtccttgtctgtggagaagaatcatgagcttaattggcggtgtcctggttgccagtctgtgaaatttacctcttcaaaggagattaggtatgtttgcttttgtgggaagaggatagaccctccatctgatttgtatctgacacctcactcgtgtggagaaccatgtgggaagcctcttcagaaggtgttggttgctggagggaatagggatgatctttgccctcatgcttgtgtcttgcaatgccatccaggaccatgccctccctgtaaagcatttgctcctcctcggttgtgcccttgtgggaagaaaaatattaccacccgttgctctgatcggcagtctgttcttacctgtggacaatgctgtgataaacttcttgaatgtgggcggcatcgctgtgaacacatttgtcatgtgggtccatgcaatcctttgagatttgccatccaggaagctgtggggaatgtgaatttttacctagccgggttaagacatgctgttgtgggaaaacaaggttggagaatgaacgccagagttgtttggatccgatacctacctgctctaaagacttcaatacctcctcctctaccgtgtggcacaccgcctccctcatgtcagcttccgtgctcagttcctcagccatgtggtcattcagtctcacacagttgccattttggagactgccctccttgttcagttcctgtagcaaaagaatgtattggcgggcatgtagttcttagaaacataccttgtggttcaaaggatatcagatgcaatcatccctgtgggaagaccaggcagtgtggtttacatgcatgtggtagaacatgtcaccccccaccttgtgatagtcaatctggtgttgtgcaaggtttcaaagcaccatgtggccaaacatgtggtgctccaagaagaagctgccggcacacatgtatggctccttgtcacccttcatctccatgcccagatataaggtgtgaattccctgttacaatcacttgctcttgtggccgtgtaaccgcaaatgttccttgtgatggtggtggtagcagtagcaattataatgctgatgccatacatgaagcttccattattcaaacattgcctgcaccacttcaaccagttgatgcaaatggcaagaaagttcccctaggacaaagaaaactgatatgtgatgatgaatgtgctaagctggaacgcaaaagggttctcgcagatgcttttgacattactgctccaaatctggactctcttcattttagtgataactctctttcttctgaattgctttctgatttttttaggcgtgagccaaaatgggttttagctgttgaggagagatgcaaaattttagttcttggcaagagtagaggaataggaactgcacatggtttaaaagtccacatcttttgtcccatgctgaaggaaaaaagagatgcagtgagattgattgctgatagatggaagcttgcagtcaatgctgctggctgggagccaaagcgatttattgtaatttctgttaccccaaaatcaaaggccccagctcgtgtgataggggttaagggtactacaactttaaatgtgcctcttcctcctgcatttgatccattggttgatatggacccgcgacttgttgtctcgtttccagacttaccaagggatactgaaattaattccttggtgttgaggtttggtggcgagtgtgagcttgtttggttgaatgacaagaatgctttggctgtttttcatgatcctgcccgagctgcaactgcaatgaggag

SEQ ID NO: 101131 - DNA, 261 bp, Glycine max
  Peptide Sequence Number=SeqID_217909
atggagaacatgaagatgaacaacgatgaaaggtttgcacaaaagggtgtcccagttcatagccaggttatgaagatcaagcaagagtcagagaaaattgttgattggtcccctggcaagccagagataagatctgttcttcgcgaaataagccggcaaatttcccgatcgccgttggggatctccggccaaccgatttcagttgctttagttttctggtttgatatgttctatcaagttgggtggggcttggggaattga

SEQ ID NO: 101132 - DNA, 198 bp, Glycine max
  Peptide Sequence Number=SeqID_217910
atggagttcgatgtaggaaagggactaagcaagtttactaacattactattttattcttcgaaccagaggttaggaacattatcactttaaagagcattcttaaagttttcgaactagcctctagtttgaaggctaagttctttaacaatgagtttggtggttttgcttgggaggatcattcacatgacttttgctga

SEQ ID NO: 101133 - DNA, 240 bp, Glycine max
  Peptide Sequence Number=SeqID_217911
atggaggcagccaaagaggccaaaactaaggcaggtcagggtgatcacaaacaattaaggcaactttccaacacaccctcacatgtagtagggctatgggttcggagtggtaatgcagtcggtgtgggactagacacactctgcataatgaagccagaggctgcaatgaagatgatggagagggacatagaagaggaggttaccgtacaggcattctgctctaatgaaataatgaactaa

SEQ ID NO: 101134 - DNA, 213 bp, Glycine max
  Peptide Sequence Number=SeqID_217912
atgcatataaaaccaacagccaacctccttcaggctccaatttcatactccaacattttcttgattcctgcacaatgtcaaatacaagctgagattcgtcctcagtgttgtctagcatgggcaaagctcttggttgaaaccagaccacacattgagatgaaggatgcaagtgacatcttggtggccaaactaaataaatggctcattctatga

SEQ ID NO: 101135 - DNA, 994 bp, Glycine max
  Peptide Sequence Number=SeqID_217913
catcgccaaaccctccgccggcgacaccatcgcctccgccgacctggagaagctcgccgtcctcggccacggcaacggcggcaccgtctacaaggtccgccacaagaccacctccgccacctacgcgctgaaaatcatccactccgacgctgacgccaccacgcgccgccgcgccttctcggaaacatccatcctccgccgcgccaccgactgtccccacgtcgtccgcttccacggctccttcgagaatccctccggcgacgtggcgatcctcatggagtacatggacggcggcaccctcgagaccgccctcgccaccggcggcacgttctcggaagagcgactcgccaaggtggcgcgtgacgttctcgaggggctcgcgtacctccacgcgcgcaacatcgcgcaccgcgacataaagcccgccaacatcctagtaaactccgaaggagaagttaagattgcagacttcggagttagcaaactcatgtgccgcacgcttgaagcgtgcaactcttatgtcggcacgtgcgcgtacatgagtcccgaccggttcgacccggaagcatatggcgggaactataacggttttgctgcagatatttggagtttgggtttaaccctatttgagctctatgtgggtcattttccatttcttcaagcgggtcaaagacccgattgggctacccttatgtgtgccatttgcttcagcgacccaccgagcctccccgagaccgcatcgccggagtttcacgattttgtcgagtgctgcctcaagaaggagtccggggagaggtggacggcggctcagctcttgacccacccgtttaaattatttggattgatgatgaaagcaacgggcaatggatttgctggaatgaatggagtgggagatgaaaacgatgaggtaggtgagtggaaggtggaagcttggaaggaatgcatgaacgtggaacaatccatattagttttgcgtcaagttgatgagcaatga

SEQ ID NO: 101136 - DNA, 1140 bp, Glycine max
  Peptide Sequence Number=SeqID_217914
atgacctggcctcgaggcccaaatgtaaatgctgaaagggcattaacgtcatttctcaatgttagggttttgtctttgtctctcgctcgcccatttttgcataatagtagagaaccttcagaaaccctaatttctcaaacattcagagggcacccggcaacaccaaaaccaccaccgcctctcctacctcccggagccatggccgccaccgactcctccgctgcttcgtcacgccagctttcgcagagggagacggacatccagatgatgctcgccgccgacgttcacctcggcaccaaaaactgcgactttcagatggaacgctacgtcttcaagcgccgcaccgatggtatttacataattaaccttggaaagacatgggagaagcttcagcttgctgctaggattatagtcgccattgagaacccacaggatatcatcgttcagtccgccaggccttatggccagagggcagttctaaagtttgctcaatacactggagctcatgcaattgcaggaaggcacactcccggaacattcactaatcagatgcagcaatcctacaatgagcctcgtcttctgattctaactgatccaagaacagatcatcagcctatcaaggaaggtgctcttggaaatattccaactattgctttttgtgacactgattctccaatgcggtatgttgatgtcgggatccctgccaataataaggggaagcatagcattggttgtctcttttggctattagcaaggatggtactgcagatgcggggcactattcgtccagggcacaagtgggatgtaatggtggatttattcttctatagagaacctgaagaggccaagcaacaagaggaagatgaagcaccacctgcccaagattatgccatttcagacttcaatgctgctggcattggcagcttccctgctactgatggccaatggcctgctgcagtcgaacaaccctggactgaagaagctccacaaccaatctcagcagctcctactaactggacaccagaagcagctgctgcaggagattggggtgaggctgttccagctcctgctccagctccagttccacaagctggtgcgcctccagctcaagcttttcctcctgctactggctgggactag

SEQ ID NO: 101137 - DNA, 522 bp, Glycine max
  Peptide Sequence Number=SeqID_217915
atggcatccttagatattcattcactgcttttattctctgccattttccgtgttattttgattgtgtatggagagtggcaagatgctcatatggaggttagatacactgatgttgactaccttgtcttttctgatgctgctgctttaatggctgtgggcgattccccttataagagaaccacttatcgctattctcctttgcttgcctttcttctcattccaaattcgttcatccatcgctcctggggaaagtttcttttctcggcttcagatctacttgtgggatatttcatctattatattttaaagctacggaaggttcctgaaaatttgtgcaactattctgtcatgacttggctctttaatccatttaccttcaccattgggacacgtgggaactgtgaacctattgtttgtgctgtggtattgtggattattatttgtcttatgaaagataaagtcgaaagcactttcgggaagaaattttacaatctctattgcagtgtactagagagaatttaa

SEQ ID NO: 101138 - DNA, 459 bp, Glycine max
  Peptide Sequence Number=SeqID_217916
atggcccttattcgtcgccgccaccccaacctccgcctccctatcttagagcccactgagcgcaaaccccacttctcccttcccttagtaccccccaccaccaaacccaccaccaatgatgatatcaccattgatgaccttgagaagctcgttgttctaggccatggaaatggcggaaccatctacaaggtctaccataaaaccacctccaccacttgcgcgttgaagatcatccatggtggcactgacgtcaccacacaccgtcgtgccctcgtggaagcatcaattcttcgtcgtgccactaattgcccccatgtggttaacttttatagctctttcgagatgcccaccggcgatgtggcaatcctcatggagtacatggatggtggctcccttgagactgcccttgccgtcaacggcacattctctgaagagcgacttgtcacagtggcgcgtgat

SEQ ID NO: 101139 - DNA, 486 bp, Glycine max
  Peptide Sequence Number=SeqID_217917
atgcccgtgatagggtacactcagaagacatggaaactcagctctggagagcctatgcatgctgagagtggatactggcgtcctaaacctgatggcactattgaagttgtgattgctcaaagcaatggtcttgtggaagttcagaaaggaacatacagcgctgaagagaaagtgatacagcttcagagtgaaatagtggggaacgcttctaaggaaataatttctctgccatacttatctctataccctatggtaaaacaatttagatatccacttcagattaaggaaacaaccttactaccaaccttacaaccttactaccagctttactacaatattgagatatcatttctcgctctttctgtggttaaagagataagaagatgtttccagctggttgatgggaatctttgttatgacgttcagatggctaccaataaaataactcttcaaccacacttgaaagcgtcactgaagaagctctaa

SEQ ID NO: 101140 - DNA, 1929 bp, Glycine max
  Peptide Sequence Number=SeqID_217918
atggatcaaaagctgaaacccaaaccaaagaaagttgagtacatggaaaggaatgttccagttttggaagacacccagatcaggaaaacgtccccttctggactctgtagtcagatagaaaagttggttgtgtgtaataggcaccgggaggcaatggagttgtttgaaattttggaacttgaacatgatggttatggtgtgggtgctagcacttatgatgctttggtgagtgcttgtgtcggtttgagatcgattagaggtgttaagagggtgttcaattacatgattaatagtggatttgagcctgatttgtatgtgatgaacagggttttgttcatgcatgtgaaatgtggtctcatgcttgatgcgcgcaagctgtttgatgaaatgccggagaaagacgtggcttcgtggatgactatggttggtgggcttgtggacactgggaatttctcagaagcttttaggttgtttttgtgtatgtggaaggagtttaatgatggaaggtctcgtacattcgccaccatgattcgggcatcggctggattgggtcttgttcaggtgggaaagcaaattcattcgtgtgctttgaaaagaggggtcggcgatgatcattttgtgtcttgtgcactgattgatatgtacagcaagtgcggtagcattgaagatgctcattgtgtatttgatcaaatgccggagaagacaactgtaggatggaattccattattgctagctatgcactccatggttatagtgaggaagctcttagtttatactttgaaatgcgcgatagtggcactacagtagatcattttacaatttcaatagtgatacgaatttgtgctagattggcatcattagaacatgcaaaacaagctcatgctgctctggttcgtcacggttttgccactgatatagtggcgaacacagcacttgtagacttctatagcaaatggggtagaatggaagatgcccggcatgttttcaacaggatgcgccacaagaatgttatatcttggaatgcattgattgctggatatggcaaccatggtcagggacaagaggctgtagaaatgtttgagcagatgcttcaagaaggggtgactcctacccatgtcacttttcttgctgtcttatctgcttgtagctattcaggattatcacaaagaggttgggagattttttactctatgaagagagatcacaaggttaagcccagagcaatgcattatgcgtgtatgattgaactattaggtcgtgagagcttattagatgaggcttatgcactaataagaactgctcctttcaaaccaacagcaaacatgtgggcagcattgctaacagcgtgcagaatgcacaagaatttagagctggggaagttagcagccgaaaaactttacgggatggagcctgaaaagctgtgtaattatatagtgcttctgaatctatacaacagttctggtaaattgaaggaagctgctggcattttacagaccttgaagaagaaaggtttgagaatgcttccagcatgtagctgggttgaagtcaagaaacagccatatgccttcctttgtggcgacaaatctcactcccaaacaaaagaaatatatcaaaaagtggacaacctgatggttgagatatgtaagcatggttatgctgaggagaatgaaactttgcttcctgatgtggatgaagaggaacagcgcattctaaaataccatagtgaaaagctggccatagcttttggactcatcaacactccacattggacccctctgcaaattactcagggccatcgtgtgtgtggtgattgccacagtgcaattaaacttatagccatggttacaggacgagaaattgtggtaagagatgctagtagatttcaccattttagaaacggtagttgttcttgtggtgattattggtga

SEQ ID NO: 101141 - DNA, 672 bp, Glycine max
  Peptide Sequence Number=SeqID_217919
atgggttgcacaaaaatctcatctttgacgcaaaacaacaccccaaagaggaaagattcccgggaaaggaagaacccagaagagaggagttctgcaaatctgtcaacccaatcttcccaatggtggaaagacttacaaaaagcaatcaaccctccaaatgctttgtctggtttcgaagattgcatcacaaggaagttgggaaatggccagaataccttatttggggaacattcatggtgtgatcggcaaccgctgtatagacaatatcaaaggctctatcaagtagccaacaacaaggaagccaaagtagcagaggttatccaaccaaacatcaatagaatttcttgcagatgggtttggcgcctccaattatttttgtgggaagaagagctattgctgcagccggaaagtgaacttcgctcaacattgcaattcagcattgatgaggatggttgggtatggaagccgagtgggaatcaatctactgtggcttctgcattcaaccatttacaagccaccgtgttggaagaggagcaccaggagatatgtcacattttaaagaaattttgggtgtgtgaaacaccaaccaaagtgttgacattctcttggagactattgtggaacaagctgccaacttgcgatcaattgcaaaggagaaacatccacatttag

SEQ ID NO: 101142 - DNA, 234 bp, Glycine max
  Peptide Sequence Number=SeqID_217920
atgttgtggaaaccagtcagagttccaaaaatagagctcgtgataatttcaacagttgaggatgaggaaattctaaaggtagaggtcgaggaaattttaatcaaggaagagatagtaattttgaaccatccaaccaaggaaaaggtgaaaatacttttggtgcgactaattgaggaagaggtcgaggagctcacctgggtaaaaggttcacatttgcttcagttaccaaattaa

SEQ ID NO: 101143 - DNA, 315 bp, Glycine max
  Peptide Sequence Number=SeqID_217921
atgaagcacaaaaacaagcatagaagcaaagagattgtggaatttgtgatcacacaacataagcatatatatagaaagatgtcaggggcacaaggagcacaaccaaaggagtcaaaaacagcaacaacatatgagtcagtagaaggaggagagaaccgaacaaggactgacttgctttcaagggaggatcaaggctgcattcaagtggaaaaacttcaggagaaggtccatgatcctgctggcaaaggtggtcctgtctttggtgctggcaaagatgaagacaaacaagaccttggagttactggcacaggctaa

SEQ ID NO: 101144 - DNA, 1716 bp, Glycine max
  Peptide Sequence Number=SeqID_217922
atggagcacaagttgtcagaaggggcacaccctagtgctcatagtagctgttcaaattcaggaaacaactcaccaactcatcccaagaatgtgaaccaagaaccaaaagacaccagcacaacaacaacaacaacaaatgtccacaactcaggaaatgaaactggacatgtggaccaggcttccaaaactgatcaagcaaaattggaaggtaaatccagaccccagaagttaattccaccaagcaggaacatatctgatttcaaccctcaacaacatcaaagtccaagcacaaataagcctaattcaaattctgatcatcctcctcatgcaaaggcaatgtctgtgtctacccctcaaacaaagactagtagtacgaataatcttcaaggtcaaggaagtggtgctagttctcgcagtgacagcttagagagcacaagtgcacccattaggccacacactggtggtgatgtgaggtgggaagctattaacatgatttcaagggttggccctctcaatctcagccatttcaggcttctcaagcgaatcggttatggagacattggaagtgtgtaccttgtggaacttaagggaacaaggacctactttgctatgaaagttatggacaaggcagctcttataagcagaaataagcttctgagggcacagacagaaagggagattcttggactccttgatcaccccttcctcccaactttgtattcttattttgaaactcgtaagttctattgtttggtcatggaattctgtagtgggggtgatcttcattctcttagacagaagcaacctaataagtgtttcactgaagaagctgcaagattttatgcttcagaggttttgttagctctggaatacttgcacatgcttggcattgtatacagagacttaaagccagagaatcttctagtcagagacgaagggcacatcatgctctcagattttgatttatcccttcgctgctccgtcaaccctacactagtcaagtcttcttctgcccatgcaagcaacagtagtagtggcagcaacaacgatgttggcagcatattaaccgatgaccaagcagtgcaaagcactactcaggtatcaagttttttcccacgcattttgccttcgaagaagaaccgcaaggcaaagtcagattttggcatactggttggcggaggacgccttcctgagctgatggcagaacccaccaatgtgcgttcgatgtcatttgtagggacacatgagtaccttgctcctgagattatcaaaggagagggtcatggtagtgcagtagactggtggacttttgggatcttcttgtatgagttgttgcatggaacaacccctttcaagggttcaggatataaagccacacttttcaatgttgttggacaaccacttagattcccagaaactccccaagtcagtgccgtggctcgtgaccttattagagggttgttggtgaaagagcctcagaagagaattgcatacaagagaggagctacagagataaaacaacatccattttttgagggcatgaactgggctctggttagaagtgccacccctccccacataccagaggttatagatttctcaaagtatgctagcaaagacacagcacccccaccagacaagaagatggcagatattgctaatgataaacacagcaacagtgctactgattcttacatagaatttgagtatttttag

SEQ ID NO: 101145 - DNA, 483 bp, Glycine max
  Peptide Sequence Number=SeqID_217923
atgatcttgctgactcaacaagtgcacccacttctcaccttttcctctacctataagtctaattctccattgcacccccatgttcaactcaaggttggggttggtgtggttaccccattttcccaagtgcccattatgcccttttgcaaaggaaggccttacaggaggaggaggaaggggagcaggtgttcctcttctgctgcagcacaggctccgttgccacctgacccagataaggaaaatagggaagacagtgatggtgtagttgttgcacagggtgagagtcctgatctgcagactcttttcagaaggttctggaaggtggcagctccttactggacttcagatgacaagggaccggcaaggttgcagcttgctgctgcttttgttaatattaggataaaccaaagttcctcgttgactagtgatgaggccaaaatagtgtatataaatgagggtagccctcatcccacaagccggtaa

SEQ ID NO: 101146 - DNA, 183 bp, Glycine max
  Peptide Sequence Number=SeqID_217924
atggtacttgacacagtgacttataattctcttgttgatggtttgtgcaaatctgggagaatcccttatgtttggaatcttattgatgagatgcagaggtcaaccaacaaatgtgttgaagttgctgatattttcctagaggccattgagactatcaagccttacctcgttattgcttgctga

SEQ ID NO: 101147 - DNA, 1182 bp, Glycine max
  Peptide Sequence Number=SeqID_217925
atggggtttcagaagataagggtgggcaaccccatcgtcgaaatggatggggatgaaatgacccgagtgatttggaaactgataaaagataagcttattttcccttatttggagctggatattaagtattttgaccttggccttcctcatcgcgatgccactaatgatagagttactattgaaagcgctgaagctacactcaagtataatgtagctatcaaatgtgctactataactccagatgaagctcgtgtcaaggagtttaacttaaaacaaatgtggagaagtccaaatgggacgatccgaaacattttaaatggtacagtttttagagagccaattatctgtaagaacattcctcgtcttgtttcaggatggacaaagccaatatgcattggaagacatgcttttggagaccaatatcgggcaactgatacagttataaaaggcccaggaaagctaaaattggtttttgcacccagtggaaatgaaggcattaaagagctagaggtctataactttactggtgctggaggcatagctttgtccatgtataatactgatgagtccattcgagcttttgctgaggcttcaatgaactttgcttaccagaagaaatggcctctctatcttagcactaaaaataccattttaaagaaatatgatggaaggtatgaacaccgtcttatagatgatatggttgcttatgctctcaaaagtgatggaggttatgtatgggcctgcaagaattatgatggtgatgtgcagagtgatttcttagctcaaggatttggttcacttggcttgatgacgtcagtactggtttgcccagatgggaaaaccattgaagcagaggcagcccatggcactgttacccgtcattatcgggttcatcagaagggaggtgaaaccagcacaaacagtattgcttcaatttttgcctggtcgcgaggtcttgcacatagggcaaaattggatggaaatgctagattgttggacttcacagagaaactggaagcagcttgcattggaacagttgaattgggaaagatgacaaaggatcttgcacttcttgttcatggacctaaggtttctagatcccagtatttgaatactgaagagttcattgatgccgtagccgaggagctgcgaacaagattatcttcacaatcgaagctgtaa

SEQ ID NO: 101148 - DNA, 1749 bp, Glycine max
  Peptide Sequence Number=SeqID_217926
atgttgatttttgtgttgagagattatgcaagagaaactctttctttgagatggagatcttggatgacaagatattacattgatcgctatctgaagaatcaaactttctataaaattcagtcacaatcaatcattgataatccagaccaacgaattgttgatgatctaagttctttcactgggacatcccttgctttctccctgactctctttaatgctgctgtagacttaatctcatttagtaatatcttgtatgggatctatcctccactctttgttgttcttatcgtatactcgattggtgggacagctatcagtgttttccttggaagaggactggtgaatttaaatttcttgcaagagaaaaaggaagcagactttcgttatggacttgtgcgggttcgggaaaatgctgaatcaattgctttctacagtggtgaagaaagtgaaatgcaacttcttctgcagcgctttaaaagtgcttttgaaaatctgactcaattgttgattgcttccagaaatctggatttcttcaccagtggctaccgctatctaattcaagttcttcctgctgctgttgttgcccccctgtatttctcaggaaaaatcgagtttggtgtaatcaatcagtcactttctgcttttaatcatatccttggcgacttttccctcattgtgtaccagtttcaagctataagtgctttttctgctgttattaatcggttaggtgaatttgatgatgttttggacagaagtagctctaattctctcactgatactgtggaagacatacaaattacatacaaagattttagtagttcatctgcattggaatctaatggatccactccaccagaaaaatacgcgacattactggagatagaagatttgattttgaaaacaccaagtgaatctacacttattagagacttgtcattgacgatcaaggaaaaggatagtttactggtaatgggaccaagtggaagtggcaagacttctttgttaagagctatggctggtctatggaaaactggaactggaaagatcacatactatgtaaaaggtggagaatatcctgagcaatccatttgttcagatgtgaatactccagtaaataatgctaatgacacatatgaagcacgtggaaaatgcttaagcagaaaatctggaatttttttccttccgcaaagaccgtatatggttttgggtacccttcgtgaacaattaatgtatccaacttggacagatgacgtagttcctatgtcagacagtactaaagaaaaaaatgcacttcctttcttgacaaacttgccaaacttggataatgcaaatgataagcctatgaagccaacaacagacgagctgataaaggtcttagaggatgtccgccttggatatttattggctcgtttcagtttggattcaatacatgaatggtctagtgttctttctctgggagagcagcaacgccttgcatttgctcgtcttttgctttcaaagcctcaattggctttactggatgagtctacaagtgcacttgatgaagtcaatgaggtacatttgtaccaaaagattggagcagctaacataacatatgtcagcattggccatcggtcatccttatgtgcttaccacgacaagatcttaagcatatccacatttaattctgacagtgaacagctaaattggtgcattgaacccattgaacccactagacccgagtcctctttaaaatttacaaatctttga

SEQ ID NO: 101149 - DNA, 387 bp, Glycine max
  Peptide Sequence Number=SeqID_217927
atggctgaagatagagcaatttggccaagttctgtggctacaaggttgagttccatcaaggtttcggatacaacagcgaaactgctcaagaaagaagccaagaagggaaacacaccgaatcgccaacaacgtttcgctgattttaatgttgtcaccacgtccattttcaaacaagtgaggaacacgcaatatgtagtgcctattttggacaacgtatttagaaacagggattgtcttaccggaaagagggctcccaatatttcttcatggcgccctaagaatgttggccccaacagaatgccagccttgaatgcttacgatgacgcagcagatgaatttgggtgtattgataggcctgaggacataatgaagggctttagagagtaa

SEQ ID NO: 101150 - DNA, 1125 bp, Glycine max
  Peptide Sequence Number=SeqID_217928
atgaccacagtcagacttgtattatccctagctgcttctcaaggttggcatcttcatcaacttgatgttaacattgcttttttacatggtgatttacatgaggaggtctatatgaaggtatcaccaggcctgatagttgctaatccagctctagtttgcaagctgcagagatctctatatggtttaaaacaggctagcaggcagtggaatgccaagcttacttccaccttacttgattcaggtttccaacaatccaaggcagattattttcttttcactaaaaggtctcctactggcctcactattgtgcttgtttatgttgatgatttggtgcttattggcactgatcttgttgaaatccaacaactcaagcagtccttggatgccaaatttggtattaaggatcttggaatactcaagtacttcctgggttttgaagtagctcgatccaccttaggtattgtcttgcatcaaagaaaatactgtcttgatcttcttcaagacattggtttgcttgcggccaaaccttgctccttacctatggatcctaccctgaaattacacaaagcttctggtgttactctttctgattccattgtttacaggaggcttatagggtgcctcttgtatcttactcacacaaggcctgatatctgctatgttgttggcaaattgagccagtatttgcaatctcccacaaacattcacatgcaagctgcccaccatgttctaagatatctcaaaggcacggctggcagaagcttgttcttttcttcttcagcttccacttctttaataggattcagtgactcggattggggagcttgtcttgacactcgaaggtccatctcaggtatgtgcttcttcttaggaacctccctaatttcttggaagagtaagaagcaatctattgtgtctagatattcttcagaagctgaatatcggacccttgcccaagcatcttgtgaagcacaatggttgttgttcctgctaaaggatcttcatattgaccatcccaaaccagttgttctatattgtgacaatcaagctgccttgcacatagttgcaaatcctgttttccatgaacgaaccaaacatattgaaatcgattgtcatgtggtttga

SEQ ID NO: 101151 - DNA, 618 bp, Glycine max
  Peptide Sequence Number=SeqID_217929
atgtggatggagaatgctttgaatatttggaatactctcaagaaacgctattatcaaggtgatgtgtttcgcattagtgacttacaagaagagttgtatctgcttaaacaacgtgatgctactatcacttcttactttacaaaattgaaaggtttaatccaagaattagacaattttcgccctattccttcctacacatgtgttgttgtttgtgatcttattcctgttattaagagttacagagaaggtgattatgtggttagattcttaaggggcctcaatgaacaatactccacagttagatccaacatcatgatgatggaccccctccctgatttagacaaagttttttctattctcattcaacaagagagatgccaaatggatactagtcaagcttcttatggcagaggtcgaggtcgtggaagccattcattaggtggaagaggtcggggaagaggatccaagatttgttcttactgtaacaaaacaggccatatggtagacacctgttacaagaaacatggttactcccctcacttgcaaagagggggtgctatcaaccaatactctttggatgatcaagaaattgaagatgatttgcaatcccttggatag

SEQ ID NO: 101152 - DNA, 885 bp, Glycine max
  Peptide Sequence Number=SeqID_217930
atggtcattgaccaatcccttttccatgacttaacccaattgtccagtgacggtgtaccatttgaaggtacactgaatgacgattggaagtttgatttttctgcacatgatgcccgccagttggtttgcaccaacaatgcggatatgaccgaatgccttcttgccggttcattggcttttgaaagccgcatcctacattatctgattgtgcggattttgcttccacgatcttccaatcttgcccaagtttctgaggaagatcttgttatcatgtgggcctttcataccggccgtcaacttgagtgggcacatcttgtaagatatcgcatgcataaggcattgcgattaaatgcacctttgccatatccacatcttgtcacactctttttccgccattttcaaattcctcttgattctgaaccttatgttccaatcaagagatcttttttaattggtgctgctgtgattgcttcttttggttaccgcaaagagcatgatggctcttgggtcaaaaagggcgctcaatccgctgatgaagaaggcaacctaccagttgaagataattccactcttcttcgaaggcttatggacaagtttgatggacttcagacttttgtaggtgacaagtttgatgccatggaattgcaagtcgacatgcggttcgatgccatggaatcaaggatcaccaaagttgaagaagatgtctccttcatccgtacttgctttgatccaccaccaccgcctccatcattgatgcaagctccattggagcttgtaggcctaggatcttcttcatcaatggattcctttgcttcttggaagatgaatggcagcggaatggagaaagggagagagagaggagacgccacttcaaggagaagatga

SEQ ID NO: 101153 - DNA, 651 bp, Glycine max
  Peptide Sequence Number=SeqID_217931
atggcctcgttttctcctctgactaatttctcaaccgcaccttcaccgtattccaaaatcggtttcttccacaaccccttcatcactctcagatccagcaatgctttgcttcgcctctctcccttgaaggtttcagctgacaatgaggttgcaacctcagcttcagcttttgaggaaccaagatggattggagggacttgggacttaaaacagtttcagataaatggcaacactgactgggatgctgttattgatgctggtcaggttaagagaagaaaatggcttggggacaatccggaatcatctactaatgataaccctgtagtttttaacaccgccattattccttggtgggcatggataaaaaggttccatcttcctgaagctgaactacttaatggtcgtgctgcaatgataggattttttatggcctatgtggttgatagcttgactggagtaggtgtagttgaccaaatgagcaatttcttctgcaaaactcttctgttcacagcagtgagtggaatacttctggtccgaaagaatgaggacattgaaactcttaagaagctatgggaagagattacattttatgacaagcaatggcaagcaacttggcaggatgaaaactcaagtactcccaaaaaagattag

SEQ ID NO: 101154 - DNA, 216 bp, Glycine max
  Peptide Sequence Number=SeqID_217932
atggaggagagggtgtgtattctcttgggtagctcttgggtgagaaagggtgatgtaatcaaagaagggcaagtcatagggtatttggatcagtttggcactggacttcctatcaggtctgatgtggctggagaagtgttgaagctacttgttgaggatggagggcttctggggacagaacgagtgatgatagccgtgctgttcatccaaaattga

SEQ ID NO: 101155 - DNA, 443 bp, Glycine max
  Peptide Sequence Number=SeqID_217933
gggctaggagggcgagggcgaggccatctgatcttccttccacatctgtagctcatactccagcatccacttcagtggtggcgcctgcaggatccattccttccattgagcagtttctggagagggatgcctcatctgaggccactataccagagccattcattgtaaaggaggagactagtgagacacgggttagacaggaagctactgctactcttgagaggtcacgagaggtcacatcaaatccacccacatcagtggtggacttatcctcacctcagcatgcaacagacccctctactcctatactcgagataccagaggacccaaccacaccagtcctgactctgaacacttcttctccagctactctagtacttcatctaacagatgaggaggatgttaagacacaggacactcaggaccagtcacaggaattctaa

SEQ ID NO: 101156 - DNA, 255 bp, Glycine max
  Peptide Sequence Number=SeqID_217934
atggaaaagaaaggaatcgtagagaagggacacgtagaagagtatcttactaaaattgttgcttggttgttgggtccatatgtcgttacttggctgattgattccgaacacgtggtggagtcgatgcgaggaagggagacatattggaattatgaagcttgcacaaaggatggttctttagatagcaataatgatcatgtctcttttgcactatctaattttaagtgctttgtcacccattggtgtggagagtga

SEQ ID NO: 101157 - DNA, 3246 bp, Glycine max
  Peptide Sequence Number=SeqID_217935
atggcagcaccagtcagtaatggtcattctgaagaaggaagaaatgagaagtcattgatggaaaatggggaatacactttcttcgctaggtccatgtataagcggcggaaagtctctgctgttcgtgatttcccagatggatgtggaccatttgctttgaggattgatccagtgttaaacgtaaatattgtgggttgtggttcaactaatggtacaattattgaggataagaatggtgaacatttaggggatgatactgttaaaacttccaactgtgaaaatgatggcagtcattctgaagtaaaagattcacttctcactgaaactcttggtcaaacaactgacagtggtttgaatatggaaaaccctgtagtctcatctcctcaagtgaatgggtctactgcagaacatgaacctgcaaaagtgactattggccaaacaattgagtctggtttgaataaggaaaaccctgttgtctcatctcataaaatggatggacttactgcagaagaggaagctgcaaaagtgactgttgaacaaacaattgaccgtgttttgaacaaggaaaaccccgtggtctcatctcatcaagtggatgggcctactgcagaagacgagtctgtcaaagtgccattagtggacatagaaattctgaatgcagagtttgcaagaactgcaaacactgtaaaatgtgactcctcttatatgttgaagtcatcttctcaagtgggtgaagtggttatgtcaggtggtttaaaacccttattgcccaatgtcaatatatctggttctagtgcttgcatggtggagcctgtaactagaaggtatcttcctcgaagaaaagtttcagctctcagagacttcccagctttatgtggacgcaatgctccacatctcagtaaggacaaggatgtgtgtctagaggggatctcttctttaaataacaagaaagcgtgtcaacagaacctggccttagatgacaacaatccattgaaagaagtaggagccatggctgtagatccattgaaagaagtaggacccgctgatgtaaaagaaattaaaagtaacatccaagatgaatatggttacaagagaaagcttgtggacatcgtccaaactgattctgaaagtaatgctgcaaagagagtgaagaagccactggaaatcaagagagacaagcactttacacttcctgaagaaagtaatcatcatgttaaaataaattccaaggcagaggtaaaagagcaaaatagggaagagacaaagcctttggatctatctcattctaagcataagttgaaagggaatttcaatggatcccgggtctcatcagagaggaaagtagtactaggtttgatggctgaatcagaatgtccttggaggtctgacaaaggttcctcaaaatttaagttcggtgatgctaaaaatgaaggcaagaaaaagaaagtaactgttgcattgcctgacaggtctaaaacagctatcaagagtaaaggtgcacaaaattattctaggcagaagcctttcaaaaagaaaaaaggaaatgctacttctgaaggtatgagtgaattagtaatttgcgaaaagaaggatagtctcgattcatatgaaaataatgaagaccttcaaattgttctgaaatcacatgagttcaatgtaaatgttactccttctcattctaatttcactggtgatgaggacgactcaaatgtgacccggaaaaaagtgaggaaaactttacggttgtttcaagtggttttcagaaagcttttacaggaagtagaatcaaagttaagtgagcgagcaaatagtaaaagagttgatttaattgctgcaaagatccttaaggagaatggacattatgttaactcaggcaagcagatactgggtgatgtccccggggttgaagttggtgatgaatttcaatacagggtggagcttaatatagttggccttcatcgtcagattcagggtggcatagattatgtgaagcaaaatggtaagattcttgcaactagtattgttgcgtcaggggcttatgctgatgatttggataattcagatggcttgatatatacagggcagggtgggaatgtgatgaacactgataaagaacctgaagaccagaagcttgagcggggcaatcttgctctgaagaacagtattgaggaaaagaacagtgttagggtgatacgtggctctgaatcaatggatggaaagtgcaggatatatgtttatgatggactgtatgtggttgagtcttgttggcaggatgtgggaccacatgggaagctggtttataagtttcgactgcgaagaatccttggtcaaccagagcttgctttgaaggaagtgaagaaatctaaaaagttcaaaacaagagaaggtgtatgtgttgatgatatttcttatggaaaagaacgtattccgatatgtgctgtgaacaccatagatgatgaaaacccccctccgtttaattacataactagcatgatataccccaattgccatgtccttcctgcagaaggatgtgattgtactaatggatgctccgatttggagaaatgttcatgtgtagtgaaaaatgggggagagattccattcaatcacaatgaggctattgtacaagcaaagcctctggtctatgagtgtggacctacctgtaaatgtccttcaacatgccataatagagtcagccaacttggcataaagtttcaacttgaaatatttaaaaccgatacaaggggatggggtgtgagatccctgaattcaatcccatcaggaagttttatatgtgaatatataggggagcttcttgaagacaaggaagctgaacaaagaaccggtaatgatgagtatctttttgatattggaaataactatagcaacagtactctttgggatgatctttcgactctcacgactctcatgcctgatgcacactcagcttcttgtgaagttgtgaaggatggtggtttcaccattgacgctgctcagtttggtaatttggggagattcatcaaccatagctgctcccctaatcttattgctcagaatgtcctttatgatcaccatgacaccaggatgcctcacataatgttctttgctgctgataacattcctcccttgcaagagctgacttatgattacaattatgaaatagatcaagttcgtgattctgatggcaatataaaaaagaagtattgctattgtggttctgtggattgtactggcaggatgtattga

SEQ ID NO: 101158 - DNA, 735 bp, Glycine max
  Peptide Sequence Number=SeqID_217936
atgatgatgatgatgatgaatcaggttaggtgcaaaataccacaattctgcgatgagaatggagcatacgtggtggttacagattatggcgagggagacagaacagactttattatgagtccacgtgcctactcaagattggggagaaatgcagatgcatctgcagaactattcaaatacggtgtgatggatgtagaatacagaagggtaccctgtagatacggtggctataacctcttggttaaggtccatgaacacagcagaaaccctcactacttagccattgtcattctctatcttggtggaacttacgacgtaactgctgttgaattgtggcaggaagattgccaagagtggaggcgaatgcgcagggcatttgggactgtgtttgacgctgagaaccctccaaggggtgacataaagttgaggttccaattgagtggtaatgcagagaatgacagtagaaatatcaatagtgattacggtggtagtggtgatgatagtgaaagtgacattagtggtagtggtaatgattttgatagtaatggcggaggtgctattagtggtgatgatgataataatgtcaatgacaatagtaatgacagtgacaacgatgaaatagtgatgttgttagtagatgcaagtaatgatggtgtgataatggtagtaacaatgtcagtagtaatgttggttgcaacaattgtgatactaagtggtgatgattgtaacaagtga

SEQ ID NO: 101159 - DNA, 339 bp, Glycine max
  Peptide Sequence Number=SeqID_217937
atggatgctttccgcgctatgcttcttcacatacacataagcacattcagctacttcactccaccgccatgcacacctatggcgttgtttttaagtcatggtgccacatggcactgtcgtattccctctaaaccttccagaacagtaaaatcccacgcaggttcagagaactacaacttagtgttgaagaaagataagtgcttaggggatgaagagtgtgtcagcgaggttggaagtgggaccacaattgcagccgtcgtaacttccatgggaggcccacctgccgccgttggaatagttcgactttcgagacctggggcagtgtccattgtaggctga

SEQ ID NO: 101160 - DNA, 810 bp, Glycine max
  Peptide Sequence Number=SeqID_217938
atgtcgatgaagctgttattagcttccctatccatttcggtgtggcttttcatggcaacattatcccttgcccaatccaacaaccgctacgtctttgacacacatggcgaccctcttgaaactgacgatgaatattacatcaggccggccataacagacaacggagggcgtttcacattgatcaacagaaacaggtcgtgccctttgtacgtcggtctcgaaaacaccgacacgccgcagggctacccgatgaaattcaccccttttgccaacaaggacgacgacgataacttgagggtgaacacggacttgaaagtgacactggtgcaagtttccacaacgtgtgtgcaatccaccgaatggaagttgggtgagaatgacacgaggagtggaaggaggctcatcgtcactgggcgagataatgggatacaaaaaagtgttggtatttataacatccggtggtgccctacggaagcatgccccacttgcagattcatttgtgggaccggtggtattctgcgtgagaatggaaggattttgtttgccttggatgggaataaagtagaggaagttccgggtggcggagaggaggaggaagaggaggagggggaaggggtggcggaggagggtgaggaggaagacgaggaggaggaggagggcgtagttgaagaggaagtaggtcaggttgtgggcgaggcgcgtggtggtttccgagatggaggatgggaggctgagggaggaggggtcaaggaacacgcgccaggggcgccgcgtcgacaccacgctttgacttgcttcctttatgtttga

SEQ ID NO: 101161 - DNA, 1404 bp, Glycine max
  Peptide Sequence Number=SeqID_217939
atggaccaccagagaagccagtactatgcaatgcatgtgggtctcgatggaggacaaagggaactcttgcgaaatatacccctttacatgctcgagcagaaactgatgattatgatgatcaaagggtttccaggtttggttaatttaggtcctgctcagtcagtggtctgggatgccatggtgccttcaagaaagaggacatgtgttggtcgtccaaagccttcttctgttgagaagctaacaaaagatttatgtactattcttcatgaacaacagtcatatttttcggtatcttctgaagaagatcttctttttgaaagtgatacaccaatggtctctgttgagataggacatggaagcattctcattaggcatcctagctatatagctcgtgaagaagagtctgaggctagctctctttcggttgataataaacaatgcccaatgagtgaggcatattctttttctggtgccattgcaatgcataatgattccagtcgcttgaagtcatcatctctggaagttgaaaagattgggaactctactggccaaggaatgcagcaggaacaacttaaaaggcatgcttttgtacactgtgacaagtctcaacttgaaagagtacaaatcctaggcaatcatgaatccccattgtgctcaatagatttaaatgatgttgtaaactatgaagagtttttgagaatcttgacaaatgaagagcaacaacaattactgaagttacttcctgtggttgatactgctaaactccctgatagccttgaagtcatgttcagtagctctcaattcaaggagaacttaacttactttcagcagcttcttgcggaaggagtctttgatatctctttgttgggcgcaaaatctgaagactgcaagattttgaaaagacttgcattatccaatctgtcaaagtcaaaatgggtagcgcaccataattttctcaagaaatgtaaaaacaaagctggaaaatctaatactatgggatctactggtacaacatcaactaatgttttgaacaacagggcgtcaactgatgttgcaaacatcaagagaatgcgtgacagcagaaatcaaaacttaccagaaataaagacaataatgagaagccccaaaagaacgatcgcaaaggcgagctgtgagggcaaagaagctgtagaagatggtgcttgctatagtccaaaacacctatttgctttgcctcctgatgctagttttctcttgctggattccttaaactttgttcaggagagtagtgatcaggatctgctgctagaggtgtcatctaacacttcttttccacaggcagagctcttgcagccaactttaagccttggtgctcaagccagcactagtagcagctcaatctactcaaatcttgttcaccattaa

SEQ ID NO: 101162 - DNA, 387 bp, Glycine max
  Peptide Sequence Number=SeqID_217940
atggcatctttgagcatgacccagatcagaactgggaattgtgcatctgggtttggcttgaattgtgctgggaaggttaaggttggtcccagcagagttgggtttaaggtgtttgcttcagagactcaggctacagagcctgatcttagtgtcactgttaatgggttgcacatgcctaacccctttgttattgggtcaggtccaccagggaccaattacactgtcatgaagagggcatttgatgaaggttggggtgctgtgattgctaaaactgaatgggtttgtgttatagtaaatacagatacctggagctgtgttgtgatttgggaattaaggctgaaaactgaagagtttggagttctgtggtctaaaatgccaatcttttga

SEQ ID NO: 101163 - DNA, 576 bp, Glycine max
  Peptide Sequence Number=SeqID_217941
atgggtgctgctgttgggcaagatgtgctcttctggaagagcctgtctttcacgattaccatgttaataactttgttgatgcgtctgcttatagccagcaagggttgctctaagttcaggatgtactcaactcctgggggttattctgcaaaggcagtccatcccatagcacttgggaaggtgatgagcattgcaaagatgatgaagtcagagtttgatagtgagaactatacactttctgccattggtggcgttgagacaggtggtgatgctgctgagtttatccttctcggggcaaacactgttcaggtgtgcactggggttatgatgcatggctatggtcttgtgaagaaactatgtcttgagcttcaagactttatgaaaaagcacaatttcacatccatagaagatttcagaggggtttctcttgagtactttactactcacactgacttggtaagaaggcagaaggaagcagttcagaagaggaaagccataaagaaagggttgcagtcagacaaagactggacaggagatggttttgtgcaagaaactgaaagcatggtttcaaactga

SEQ ID NO: 101164 - DNA, 155 bp, Glycine max
  Peptide Sequence Number=SeqID_217942
catatgaagctttgaagatgcatggtgttagtacttgttcttttcaggttggtgacatttccaacttggagagggagctgaagatagatcagatgcaagcaacggagaagcaaaacttgggcatgttcagccaatctgagcttgatctcttcatg

SEQ ID NO: 101165 - DNA, 357 bp, Glycine max
  Peptide Sequence Number=SeqID_217943
atggtggttcttgagacttgtatggccctggcggtggttgtggtaccctttctgaccggagtactggacgcaatggcggtggccctagcagaggccgtagtggtggccgatttgctaacttccagtgccaaatttttcttaaatatgggcacactgttaatgtttgtcatttcaagactgataacctccaacacctgggttaatcccaattctaagtccactggtctaggccatagtcaacctagtgccttgctcacgaactcgtcctcttatgggactggtctagctaactctacttggatactagattctggagccagttttcatgttacgggagattctcaaaatatcaagtag

SEQ ID NO: 101166 - DNA, 1974 bp, Glycine max
  Peptide Sequence Number=SeqID_217944
atgaagtatgtgttggtgactggtggtgttgtgagtggacttgggaaaggagtcactgccagtagtattgggttaatcctcaaggcctgtggtcttagagttacctctatcaagattgacccctatttgaacactgatgcgggaacaatgtctccttttgagcatggagaggttttcgtcttggatgatggtggtgaggttgaccttgatcttggaaactatgagcgtttcttggatatcaaattaactcgtgacaataatattacgactggaaaaatatatcagtctgttattgagaaggagagaagaggagattatcttggaaagactgtacaggttgttccacacataacagatgctatccaagagtggatagaacgtgtagcaaagataccagttgatgggaaagaagggccagctgatgtttgtgtcattgaattgggtggaactataggggatattgagtccatgccttttattgaagcacttggccaattttcataccgtgtaggccctggcaacttctgtttggttcatgtcagcctggttcctattctccatgttgttggtgaaccgaaaacaaagccaactcagcacagtgttcgtcaacttagaggattaggtttgacccctaatcttcttgcttgtcgcagttctaaggaacttgatgacaatgtcaaggcaaagcttggtcaattttgtcatgtgccgctgtcaaacatacttactctccatgacgttccaaatatttggcacattcctttgctattgaaagaccagaaggcacatgaggcgatcctgaaagcattaaacttgctaggtgttgctgcagagcctaatttgaaggagtggactgcaagaacaaaagtttatgacagatgtcatgaaattgttagaattgcaatggtgggaaaatacactggcctttcagatgcatatctttctgttctgaaggcacttttacatgcttctgttgctcgaaaccgtaaacttattgtggactgggttccagctggggatcttgaagaagctacttataatgaggatcctgaggcgcataaagctgcttggagtcttttaaagggtgctaatggggttctagttccaggaggttttggtgatagaggagtgcaagggaaaattcttgctgctaagtatgctcgagaacataatgttccatttcttggcatttgcctggggatgcaaattgctgttattgagtttgcacgatctgttctcggtctgcatgatgctactagcacagaattcaatcctgaaaccaagaccccttgtgtcatatttatgccagaaggctccaagactcatatgggaggaactatgcgtcttggttcaagaagaacttactttgaagttgctgactgcaaatctgcaaaattgtatggcaatgctagctttgttgatgagcgacatcggcatagatatgaggttaatcctgacatgatatcacagctagagaatgctggtctatctttcgttgggaaagatgaaactgggaggcgcatggaaatagttgaattgcctagccatcctttttttattggcgttcagtttcaccctgagttcaagtctagaccagggaaaccttctccactcttctcaggattaatagcagcagcaagtgaacaaaggagtacaatcatggtgccaagtagtaatggtcatgccaagttaactaacggaaatggaatgtacaatggacactcgccgaaacttaaagcacaccaaaagggaaatggcttcaaggcatccaatggttccttaaatgttgttagtcctcatatcaagtgtttggtgcatgctaataatcgtggtataactatatccaagggcattcttcttgtgctcggttgcttgtacagttattgcagccaccattggtttcactctttggtcaaatattggccaaaacttcacttgatcatgccaaatatttgggctttggtggctttttaa

SEQ ID NO: 101167 - DNA, 198 bp, Glycine max
  Peptide Sequence Number=SeqID_217945
atggaatctgagaggcctagcagcactattaatgagacctacaaacaacaacaagaaccagaagaagaagatgatgatgattatcataatgaagaagaagaagaagaagaagaagaaaacaatgagatcctcaagagaagaatctccaaccaccctctctatggactgctggttgaagctcacttggactgtttgaag

SEQ ID NO: 101168 - DNA, 327 bp, Glycine max
  Peptide Sequence Number=SeqID_217946
atggaaatgccgatgacattctcatccacatttgagattatttactttattctcaccggactcggttggaaccgagtcagagcgacccagcccaacccgcaagtaaaggaatgggttgaaaaccctgggtgcattagcaacaccttcacaacgcaacaacggagcggcatctccatggaggaggcatggcccttgactccactaggcacagggcctagcggcgcggggttgccacaaggtcacaatgatggtagtggcggcacgatagtgcgacgcgacttcactggagttggccagaaaaaaacatggcaagaagaaggaagatga

SEQ ID NO: 101169 - DNA, 321 bp, Glycine max
  Peptide Sequence Number=SeqID_217947
atgtcctacccaattcctctccatcaccaatcgccccaaaaatgccgctcccaagatccagatccgaaaaattccgtcgcgagtcatgattgtgagcgcctcaaattcgggcttctgtgggattcttttcggcggtgcctcttcgtggcacatggtctgtcagtggaggatctcgatggtgcgggggcaaatctcgagggagacggagatccggcgagatcggagaagagtgcgacgactaggaagcagaagtcgtactctgtgtgcggcagcggcaaacgtgggagaaccccgtggcggagtaaggcgttgcatcaatga

SEQ ID NO: 101170 - DNA, 264 bp, Glycine max
  Peptide Sequence Number=SeqID_217948
atgcctgaccaagcgagaagaagatacacgatttgtggcggtttgcctgccccagtgagagtggatccgatgacccaattattaacccgagatttggtgagggacaggggtttgtactgtaaggagttgcttgagaagaatgggtggtctggtgttgcggaagtggtggagacgaaggatgaggaccatgtttttcatttgttcaaaccgaattgtgagaatgctcaggttttgatcgaccagattgtttcctttctcaaatag

SEQ ID NO: 101171 - DNA, 450 bp, Glycine max
  Peptide Sequence Number=SeqID_217949
atggcgaagacagatgaccaaaaggatattgctgatctaattccgcctctaatctacaaggttggacctagaagaccaaacaaattaagaagagagtcagatgaagagacaataccaactaaactgagaagagaaaatactaaaaacaaatgcacgagatgccttcaatatggacacaacactcgaacctgcaaagagcgacctgtggcaactagtggatttgaggcacaagttgttggatttgaaattccgacaataggaaacactgcacaagctgttggatctaaaattccaacaatagaaaacaatgttggagatgctggatctatgatgggaggacttggatatgtaattccaatagaaaacactcttgcaacaacttttgaatttgatattccaacgcaagcatctcaagttgggacatccaacccaagtgggagtaaagtctaa

SEQ ID NO: 101172 - DNA, 1311 bp, Glycine max
  Peptide Sequence Number=SeqID_217950
atggctcaagttcttgagaaccccaccattgacgcggcggcttccggcgcgaacccctcgctgacgaccatctcgttgtacgtcggggatcttcaccacgacgtcaacgatccgcagctgtatgatctcttcaaccaggttgcccaagtcgtttccgttcgaatttgcagggacgtggccacccaacaatcccttggttacggctacgtcaatttcagcaacgctcacgatgccgcaaaagcaattgatgtgctgaatttcactccactgaacggcaaaatcattaggataatgtactctattcgggaccctagtgctcggaagagtggtgcagctaatgttttcataaagaatttggacaaggcgattgatcacaaggctttgtacgatacattttcggcttttgggaatattctatcttgcaaggttgcgacagatgcttctggccagtctaaaggccatggttttgtgcagtttgagagtgaagaatctgcacaaaatgcaattgacaagttaaacggcatgctgatcaatgataagcaggtctttgtgggtcctttcctgcggaagcaggatagagagagtgctctcagtggcacaaagtttaataacgttttcgtgaaaaacctgttggattcaatgactgaggctgacttggagagaatttttggagaatatggagctattactagcgctgtagtgatgagagatgtagatggtaaatcaaaaggttttggttttgtcaattttgcaaatgtagacgatgctgctaaagctgtggaggctcttaatggaaagaattttgatggtaaggagtggtatgttggaaaagcccagaaaaagtctgaaagggagcttgaactgaaagggcaacatgaacagattacaaaggagactgttgataaatatcatggtacaaacttgtatatcaagaacttggatgatagtgttggtgatgaagaactcatggaactgttctctgagtttggtacgataacctcatgcaaggttatgcgagatccaaatggaattagtagaggatctggatttgtttcattttcaattgctgagggagcaactcgggctcttggtgagatgaatggtaaaatggttgctggcaaacctctctatgttgcccttgcacagagaaaagaagatagaagagcaaggttacaggcacaattttcacaatcgaggcctgctgcaataacccctaatgtttcacctcgaatgcctctataccctctaggggctcctgcgataggacaacaatttttgtatgggcaagcagctccagccacgatacctcaa

SEQ ID NO: 101173 - DNA, 1338 bp, Glycine max
  Peptide Sequence Number=SeqID_217951
atggattttgcaaggtatgctttgagtcataagtgtgcagttgatatttatgtggcgtttggggtgagtgattatgaagaagttactgaggataaagttaggggtgaacttactaggggtaaggagttgttcaatgaccaacaaattgtagtgtttgacgatgtgaaaagcaaagtcagcaacaaaggaaaacagaaggcttctggatatgaagatccttttgttgaaaatcctggtcagtgtgatgaagacccaaataggatggatgatgacaatatgtctaacccaccccatgaagaaccttatacaaattttaaagagatgcatgatttggagattggctatgaaactgaggagttgtatagtgatgttgaatatgaggatgacattacgaagcctggaaaaaaattttggatgtttaggaaagaaactatgtccaaggctttcaagcggacattaggaatgcaatttacatgtttgcaagattttaaggaaggcatgatggagtgtcctgtattgaatgcatatgtatctaaggttggtgagaccactacctttcaactgaaaacactagaattgatcacacatgtgccaaagttttttacaataaaaatgtcaatcccaaagtgggttgcaaaagtgctacttgacaagttcagaacatctaaaagattcacattgccacagatcgtgcaggagatgaaatccacttatgttgtgggaattaccagatcttgtgcaatttttgctaggaagctagcactgcataaaattgaaggtgatgcaattaaacaatacacattgcttagatgctacaatagtgaactcatatccataaatgcaaacaacacctttaagatccatgtgaacagacatgttcctactttgccaccacggtttgggtctttttacatgtgtatggatgcttgcaaaagtgattttgtagatagttgcaaaccttttattggagtagatgattgtcaccttaagacacgatatggagggcagagtcttgtagttgtgatcagagatgctaatgaccaatactatcctttagcatttgttgttgttgagactgagaacaaagagagttggaaatggttcttaaatgggttgttgactaacattggagatcctgaaacctacaaatgggttttaatttctgacaggcaaaagggacttgtaatttcatttcatgagctggatgatagaattgaacatagattcatggacttagtgatagctgcttcaaaagcaacttatttggaggcatataaagagaaaatgaatcaaatcaaagagatcaacaacaaggcttatgacaacaagagaaaatga

SEQ ID NO: 101174 - DNA, 624 bp, Glycine max
  Peptide Sequence Number=SeqID_217952
atgggcgcgtggggtgctaataccttccgtatgcgcaaactcccaaacccttcattgcaagtagtgactatcatgtccacgcaacttagcaaaaaagaaaatgaagtagtgactgtcattggtcttgatgttgaaaaagataattcctcttatgtaagtgatgtgggtcttgctctaggctttgtagtgtctgaatgcaatgaagatgaatatcatgatctagttttagacgaagaagttgaaggggtttgtgtggtgggttttgtcaatgatgggatagaaggtcaaattagagaaggaagtatgggaaggggtagggctaagcatctcgattttggtcagattcaggttgctagatggcggatgttcttagacgatgatgatgcaatcctcccaaggaggggatccatcaccagagccatggctaggagactccaagaagattggaccaaagatgcaggaaaagaccctagggttctcatgagccttaggtggcgtctccaatcatctttcttcattctccattccgctgccattgatcttcaagaagcaaaggactccattgatgaagaagatccaaggcctacaagctccacatggagctacatcagatgggatgagtga

SEQ ID NO: 101175 - DNA, 722 bp, Glycine max
  Peptide Sequence Number=SeqID_217953
atgtttctgaagaagactataagtctctaccagctggttcagctgatccacgagatgaggaggtaattccaatggccattcaaggcattccttatagcaacttcattgaagtttttttagccttacatgttgtgacatacactaaaacttgctccatactgtactgggttcttaattccttgcaggtgcctattgcaatctcggttacgctttatgaagccatatgcttgtgcaatggaactagagtgattgcatcaaagggaaaggaaaatacagattggatgaagcttcacaagatctgcctttactgttcctgtggaataatagctggtatagttagtggattgctaggtctaggtggtggcttcattttgggaccactctttctagagttgggaattcctcctcaggttgctagtgctacatcaacttttgctatggttttctcttcctccatgtcagtggtgcaatattaccttctagaacgcttcccagtaccctatgcttcttactttattttggttgcaaccatagctgcattaactggccagcatgtggtgagaaagataattgctatcttcggtcgagcatccatcatcatctttgtactagcattcaccatttttttgagcgcgatcagtttaggtggagtgggaattgagaacatggttgagaagatggaaaataatgagtatatgggatttgcaaatatctgccattaa

SEQ ID NO: 101176 - DNA, 1245 bp, Glycine max
  Peptide Sequence Number=SeqID_217954
atgaaactcttcctgtcacgttttgtttttgccttgtcttatcctgtttctgatgatgagacctctcagaaacaccagagcaacatcaaggaacgatggaggagaccttctgacaatggagcaagtgatggagtagatggaagatacgaggaggcaaatagcacagatggaggacataaggagggagaacatgataagggcaaagacaagttaaagaagagagacccatccccaccaccaacctccaagaccacaacaccaacccaccaacatccttcacccaacatcacattcacggatgcggatttcaatggtgtctctccacacgataacaacccggttgtcattttcgtaatcttaatgggattcaatgttcaattcattttggtcgacaaagacaactcaatgaacatgatgtattgggatgccttcattggtctcaaggttccaaaagattcaatgttgcctcgtcccaaggtgttggttggatttgcagaagccgaggctgaggttcgaggccaagagggggctctacgaaccaacaaaacaatatggagtccacttcatggaactagatccctgaaggaaattcatggatcgatgtctgatgctggtggaggaggtagtgaccacacaacgttcgatatactttgtgagccagttcttgtgagtattgatcctagctcgaaagttgagacattacttccaaagcttcccgatcattgtttgaacggaccaacctattcatcacatcctggcagtcaaagggaaagccctcatagatttcatggtggaacttacatagtggtatccttatctctatggatactatttgtcaacaacacgatgaacagtgcaagcaatggagcaggaattgtgtttgaaggtctcgatgtagtcatcattgaaaaatccttaaagttcaactttagccttacccacaaccaagccaaatataaggcattacatgccagcatgtggctcactagggaaacaagagttaaagatctggtggcaaagggcgactccaaggtggtaatgctacaagcgaagggtgaatatcaagtagaagaacttcaattagccaaatacttaaagaaagtcaaagagttagctcaatctttcacaagattcaagcttggccacctgctcggggatggtaatgatagaggtgacatattgtcaaaattaggaagtgcgaagaagcatggcaatcaagcgatcattctagagactttggattga

SEQ ID NO: 101177 - DNA, 588 bp, Glycine max
  Peptide Sequence Number=SeqID_217955
atgttccaacttacaaccaatacttatccattcaactctatcatgcaacagctctatgttccagctgaaaagcttgatgattcaaaccaccttcactggaaacagaaaattgagcctgtgattaagtcacacaagcttcagcgatttgttgagaaccctacgattcctccttgttttctctccgatgaagatcgtgacgtcagaaatgtgaatccagcttatgaggcgtgggaagttcaagatcagatgctacttacctggcttcaattgacacttttgaagtcgattttatcttgtgttcttgtatcgatccactcgtatcaggtgtgggataagattcacaaacatttcttcactcagacaaaagctcgtgctcgcaaaaccctatgcgagttcttgagtcagatcaagaacatcgctgatgagctcgccaacatcggaagtccaattcagcatgaagaatatgttgatgcaatattggtaggactaccacaagactatgctccggtagtctcagttatcgagagcaagtttgagactcctacaattgtggaggtcgaagtgttgttactcgcacatgagtcgtga

SEQ ID NO: 101178 - DNA, 1989 bp, Glycine max
  Peptide Sequence Number=SeqID_217956
atggaaaaccacatctacgccgcctcttacagcccttccaccaactacagatccttccgtgacccccccgccgacaccatgttcctctcccaccatctccaccaccatcgcaccgacgcctcctccgccgccgccctccgcttcccctcctcggccctctctgccgtcgaagccgccgatattgccccgcctggcgtcacctcccgaatcgcctcctcctccgccgccgccgccgccgcgaatttcctctccacctggccccctgccgccgccgccgcgccctccgccctcgacctcaaacgctcttccgaggctctctaccatccaaccattttgggtacaattgggcaaagtgaagcttggtattctacaaacccactggccaagcgccctagatatgaaagtgcttccaatatgactatatatccacagaggccaggcgagaaggattgtgcccactatatgctcacaagaacctgtaagtttggagatagctgcaaatttgaccatcctgtttgggttccagagggtggaatcccggattggaaagagagtttggacttagaagggaggcccaaagtttggagagtgtatgtgaggagagagaggggtgagaatagtaagggtgaggtggcaaaggctgtagcaaaattgccaaacgtgatgtgtgcagtggtgacgggatcagcagatgccactaaagaagatggaagccaaggtccaggggactcattcagatgtgaaggtgaatttggcttaggtgtgaatggatgttgggttgattgtacgcacaaaggtatatttctaggtccaggggactcattcagatgtgaaggtgaatttggctcagttctgaatgaatggagggttctttggttgttttgtgcatggattgaaggaagggaagttgggctgggattcggacaccaacagagtgtggaggcaatggattgggttaggcaaaccgggtctgaatatggtatgaccccttccaatagggatataaatgcaagaaatgggtttaaacccgaacccaacgtagatccatccaacggcgatctaggaatatggtgtgcgtcctctttcatacacctagctgaccgaacggaagagaaagggtttgtgttacaagtgtggaggtcctttccacaccaatcgccaccaatgtcccaaccaccagttgagggcgatgttggtcgaggaacgagaagaagagaatggagaggtgaacttcgtggcgagtgccgcatgttgtttctgggtagcacagtcaatgatcagaagccacatacaatggatcaatggtgttctgttagactactggcaagcgtaccaatgtcgtcacaggttccaaatgttgttacaagtgaaactcctcctgagagaccaggggaaccggattgtccatactttctgaaaactcaaagatgcaagtttggttcaaagtgcaaatttaatcatcccaaggtttcctctgaaaatgctgatgtttcttctggcttacctgagaggccatctgagcccccttgcgcgttctacatgaaaactggaaaatgtagatatggcactgcttgtaaattccatcaccccaaggatatccagattcagttgtctgacgacttgagtcaaaatgttgcacagacacaaacaaattctatgatgggtggagctacaggagatacacagccaattaaatctcttatatctccgtcgttgcaaaatagcaaagggcttccaggggaagttgattgtccattctacatgaaaactgggagttgcaagtatggtgtcagttgccgctacaatcatcctgacaggaatgcaattaatccacccattgctggattaggtgcctctattttgccatcctcggctgctaatctgaatattggacttcttaatccagctgtttctgcttatcaagcttttgaaccaaggctgtcaaatccaatggtaatgtggaagttgttactgtacttattctcatag

SEQ ID NO: 101179 - DNA, 435 bp, Glycine max
  Peptide Sequence Number=SeqID_217957
atggaaccgcctttgccgcaagagtactttggaaactcagttcatgcagtgagtggtgaagccacggcaagggagctgcttgagaatgatctaggatgggcagcatggaagctgccccttgctgtgcaaactataaccacagagtggtgcaacacatgctcaaagagtggttacagtgtcctttcatctttcaagttgtttccctggtttaacatgaatgggagtgagtttggaatggggaaagcggtggctgttagaagtggttatgccaacaaatttgatgggaaagtgaaatatcatacccaggccgtggaagcattgatttgtaagaaattaaaaaagggtttacgggaagaatcggcacctattgatgatggtaagattgatgaactcaaccgcggggaagtcagccttccaaattattactctgattga

SEQ ID NO: 101180 - DNA, 714 bp, Glycine max
  Peptide Sequence Number=SeqID_217958
atggctaccgaagtgagaaagaagacttcaagaggagccacaacagtaatatggctggcctcgtggagccttattatggcctacaatgtctgtttagcagaaagagttttgaaagaccaaaaacctgagagttttgttgtcaaagaaaggcaaggagttatgaatagtataattgatttcttttggaacgatggagagcctaccaatgaccgtgtttggcctgaaatgaagtttggttggagaattgtagtagggtcgattgttggattttttggagctgcgttgggtagtgtaggcggggttggaggtggaggaattttcatccctatgctcactttggtcattggttttgatgccaagtcttccacagccctttctaagtgtatgattatgggagcagcggtatcaactgtatactacaacctgaggtttagacacccaacactagacttgccagttatagattatgatctggctttgctcttccagcctatgctaatgctaggaataagcattggtgttgcatttaatgtcatgtttgctgattggatggtgacggttttgcttatcatcttatttattgctacatccacaaaagctttattcaaaggcatagatacatggaaaaaggaaacaattatgaaaaaggaagcagctaagatgttggaatcagattcttctcctggttgtaagtccctgcaaaccttcctataa

SEQ ID NO: 101181 - DNA, 447 bp, Glycine max
  Peptide Sequence Number=SeqID_217959
atgtattcttattggccaacccttgtacttaccatcgatgagctatttttcatggcaaacgaaaatgatgagaatatcatcgtcgaactgtgcatgacaagagaacatgcgtgtgctggttggcaagggaccaaagagcgtttcatatttttctacgaaaccatattttctaaattagagcggacaacaaagaagagcatggcaccctcaaaccatgacatggctcgactagtcgctgagaagaaaaaggttgatcaagtggttaacgttgttgttgttaatacaattgcggcaagaaatgtgattgatgctggcgaaaaatcaataactctgactgtcaagctgcttaacattgttaatgtagaatccctacctcgaggaagagggaacgaacgaaaggcgacagacaaatctacattgaggtggactctaaagatagcctcctag

SEQ ID NO: 101182 - DNA, 861 bp, Glycine max
  Peptide Sequence Number=SeqID_217960
atggctcatgagcattcactatactttggacatggattgttgctaaaaattgtggtggatgattgggggccaaggccgtttagagtcatggattggtggcatcaagagaagaattttagaagggtggtgaaaagtgaatggtctagtatgaatatacaaggttgggcggcatttgtattgaaggaaaaactaaaaggcctaaaagaagcattggggtgctggagtaaggaaaatgagggagatctaaagaggagaccacaagacattatgaagaaaataaatgaaatggatattaaagaggaagagtcaaggaaagacatgatccaagggttacatactgatggtttgtgggtggaagagcctagaagagtaaaaggtgttttagaatttttccaacaaaggtttattgagggggaggggctgttgaaaggggacatcattttctttatggaagagtttaatgaaaatggtgttttcccaaaaggttctaactcttcatttatagctttgatactaaagttgagtgagccacatggtataggttattaccgacctatttctttgaagggatgcatgcataaggtagtagctaaggtgttggcaaggaggcccccaacaatgggtgatttagcctctcattgtcttgagaggccttacaaaatggagaaatacaagagtggaaggagaaaaaatggcccttgtcttgtcactccagagaacatagtactcgcggggcgagttctttgcgaattccaaaagttgcaattaattttcgcccttcgagaaagctttgctcattgggcgagttgcacttgctgggtgagctttgaagatgatctggaccctcttcctccattctag

SEQ ID NO: 101183 - DNA, 1197 bp, Glycine max
  Peptide Sequence Number=SeqID_217961
atgtgcggctccaagaccaaggtgactgtaggcatagaagccacagctacctctctggtggccagaatcaatggccggccagtccttcaaccgacttgtaaccgagttcctaacctggagaggagaaattcaatcaagaaactgtcaccaaaatcacgttctcctccatcaccaccacttcttagcaagacctcattgacacctccagtttctccaaagtccaagtcccctaggcctccacctataaagcgaggcaatgagagtaatggacttaactcaagttctgaaaagattgtgaccccaagaaacaccataaaaactccaactctagagaggaaaaagtccaagagtttcaaggaagggtcatgtggtgctttaggcctttctgcctccacagaggcttcattaagttactcctccactttgatcactgaatccccagggagcatagctgcagtgaggagagaacagatggcactgcagcatgcacagagaaaaatgaagattgcccattatggaagatcaaagtctgcaaagtttgcaagagttattcctcttgaaccttcaaccaatcttacttcaaagacaagtgaggaaaagagatgcagctttatcacagccaattcagatcccatctatattgcttatcatgatgaagaatggggagttccagttcatgatgacaagatgttgtttgaacttctagttctaagtggtgctcaggttggatcagattggacctcaatcttgaagaaacgccaggatttcaggactgcattttcagaatttgatgcagcaactttggccaacttgactgataagcaaatggtgtctattagtatggaatatgacattgatataagcagagttcgaggtgttgttgacaatgctaaccgaattttagcgattaacaaggactttggttcatttgacaaatacatttgggattttgtcaatcacaaacccatctccacgcaatacaagttcggccacaagatcccagtgaagacatcaaagtcagagagcataagcaaagacatgatcagaaggggctttaggtgtgtaggtccaacggtgcttcattcatttatgcaagcagctggactcaccaatgaccacttaatcacttgccatagacacttgcagtgcaccttattggcatcaaccccccattgtaccacagagcactttctatag

SEQ ID NO: 101184 - DNA, 591 bp, Glycine max
  Peptide Sequence Number=SeqID_217962
atggagttcatggaattgggccagagaatggaagtaggccacaaaaacaagcagataagtgtacgttggcaatttaagcacatcaaaatgagaagatggcatgcacacaaaaggccaagttttgatggtgacgatcatggtctcaaacgtggtgacaaatgtgaccatgctaagctaaagttagtatcacacgagagaaagctaaagaaggaaattgccctacatgagcagatagaggagttggtcaaggagtcttgtttatttttcatgaccacatactactatgagaaagcagataagggactattgtctactttttctgagaggtggcatatggagacagacatgttccatttgcctatgggaaagatgacaataacactagatgatgtgtcatcattactacatattccttttattagatgtttttgcagtttccaacatatggaaaaggatgtggcaagtcccttgctagaggagttacttagggtgggaaaaaaaaggatgcagttgaagagacaaacaaaacaagagatgtatatgtccattttagttggtcacgagatttctatgccaagaggtgtcatctag

SEQ ID NO: 101185 - DNA, 765 bp, Glycine max
  Peptide Sequence Number=SeqID_217963
atgtcaatgttggggaaagggagtcctatagatgagtttgatattcagaaggatttgaggaaaaggaatatgttagttccattcctttttaaaattatggtcaaaggattgagtggtgtgatgaaagaagcttgcaataaaaatcttgtctctagttacatggtgggaaaggtagcttctgaagagagaaatgtcagttctgatcttgcaatgtatgagagatctgtgacgtgggattcacgttgggctgttgggtgtaggggttcattcactattggggcaaggctgaaaggttacggtgcaagggaatttggggcttgttgcagtggtggtaaaaagaggagatgtgatggcatttggggattatcaatggtagtgatggtgttaagaaagatggtggaggtgttaaggaggacagcaatggtgtttgcgacaacgataaggggttcaccgatgtcagaagtgttgtcggcaatgacaaaatgtataaatgcgaggaatagtaacaaagaagattacaatgcaagggagtttgaggcttgttgtggcggcgacagaaggaggatgatgtggtggcggttggggattataagtggcagtggtggtgttatgaaaaacaatggaggtgttgaggaggatgatagaggtgcctatagggacaatgaggggttcactggtgttgaaagtgtcatcaacgatgaaaaaagtatagacattaaaacaaaaaggactgagacaatatatggaggtgagggtctatcgtaa

SEQ ID NO: 101186 - DNA, 204 bp, Glycine max
  Peptide Sequence Number=SeqID_217964
atggcccgtggtggccactggtggtcgtggatggtggaggagaaggtgttagggtttgggtgggcgtttggagagggggagaatctcactcaacgagctcatctctctaagcggaagtccacttttggcgctaagtgcgacaactcgcactcagtgcaattccctctcgggttagaattgtgctttgcgcactgcttgtgctaa

SEQ ID NO: 101187 - DNA, 2721 bp, Glycine max
  Peptide Sequence Number=SeqID_217965
atgacatgcttcagtgttcacaaaataaatactacacctctgcagcacaaatctaatttgtgtgtgaccagcatctgcattatgagtacccctgtcgttcgacgcatttccgaatgcttcatcaagccacatcgtccaatcgaagagtctaaccaaatatgttatttagcaccttgggatattattctattgtcttatcactatatccagaagggtctactcttcaagaagcctccaacacttgtcgatcaacagaatttcatagaaaatctgttggagaagctcaaacactctctttcgttcaccctctcccatttctatcctttggctggtcgccttgtcacccacacaacccaagaccctccctcgtatgcttttttcgttgattgcaaaaacagtgatggagctagattcatctatgcatctttggacatgaccatatctgacatactcacccctgttgacgtcccacccattcttcattcattctttgaccatcacaaagcagtcaaccatgatggccacaccatgcccttattgtccatccaagtcactgaactagtggatgctgttttcattggttgttccatgaaccacactcttggtgatggcacttcctactggaatttcttcaacacatggtctcagatctttcaatctcaagctcaaggccatgaatacaatgttcccatttcacacccacccattctcaaccgttggtttcccagtgattgtgatccgtctgttaatcttcctttcaaacatcatgacgagttcatttgcaactttgaagcaccttttctgagggagagagtcttccacttttctgcagagtccatagcaaaactgaaagcaaaagccaactcagagtccaataccacaaaaatctcttcattccagtcattatcagcacttgtctggagatccataactctcgcgcgctccgtgccgtacgagcaaaaaacaagttgcaagatggctataaacaatagatcaagaatggaaccgcctatgccagaagaatactttggaaacttagttcaagtagtgagtgcagaaacgacaacaagggaattgcttgagaatgatctaggatgggctgcatggttgttacacgtggctgtcacaaaccataatgacaaagtggtgctgcaatcgctccaaggatggttacagtctccttttatccctcaaattggtcgattgtttgatccgtacagtgtgttaatgggaagctcgcccaggttcaacaagtatggttgtgaatttggaatggggaaagcggtggcgattagaagtgggtatgctaacaagtttgatgggaaagtgacatcatacccaggtcgtgaaggaggtggaagcatcgatttggaagtgtgccttttgccacatataatgagagctctggaatcagacaaggagtttatgaatgcagtttcgaagggtctactcttcaagaagcctgcaacaactcttgttgatcaacaccatttcatggagaatctgttggagaagctcaaacactctctttctctcaccctcttccatttctatcctttggctggtcgccttgtcacccaccaaacccatgaccctccctcttattctgtttccgttgattgcaaaaacagtgatggagctagattcatttatgcaacttcggacatcactatatctgacatactcgcccccattgacgtcccacccattcttcactccttctttgaccatcacaaagcagtcaaccatgatggccacaccatgtcccttttgtccatccaagtcactgaacttgtggatgctgttttcataggttgttccatgaaccacgttgttggcgatggcacttcttattggaatttcttcaatacatggtctcagatctttcaatctcaatctcatgctctaggccatgaatatgatgttcccattcacaatcgctggtttccaaaagattgcgctccaccaatcaatcttcctttcatacatcatgatgagattataagcagatatgaagcacccaagctgagagagagaatcttccacttttcagcagagtctattgcaaaactgaaagcaaaggcaaactcggagtccaataccaccaaaatctcttcgttccaatcattatcagcgcttgtttggagatccgtaacacgtgcacgctccccaccgaacgaccagagaacaacttgcaggttggcagcaaacaatcgatcaagaatggaaccgcctctgcctcaggaatactttggaaactcagttcatgtagtgagtgcagaaacgacgacaggggaattgcttgagaatggtataggatgggctgcatggaagttgcacatggctgttgcaaactataacaatggagtggtgctgcaatctctgaaggtgtggttagagtctcctttcgtaattcaaatgggtcgtttctttgacccctactgtgtgatgatgggtagctcgcccaggttcaacgtgtatggaaatgaatttggaatgggaaaagcggtggcggcaagaagtggttatgccaacaagtttgaggggaaagtgacatcatacccaggccgtgaaggaggtggaagcattgatttggaagtgtgcctttcaccagaaaatatgaccgcgctggaatcagatgaagagttcatgaatgctgtttctaagtccaatcctttgtacgagttgactaatgtggcttgtcctggaccgtctttctaa

SEQ ID NO: 101188 - DNA, 1182 bp, Glycine max
  Peptide Sequence Number=SeqID_217966
atggccaaccccatggacattcagggccctgcggggatttttgggcctcaccggtttttaccgtcgttttatcaaagggtatgcatcactggcgacccctttgactcatttgttaacaactcctcaattgtgccgttcatggcggagtctgatgcgtcgggaacatggatgggagttgtcctatctcaactaggtcatcctattgcattttttagcaggcaattttgtccaaggcttcgtctagcattttcgtatgttcgcaaattggaatcacatttggttgcccaatggcctcaaccttatcccatcattgttgacgaagttccgtacttcaccaacgggagggcacatgacctctcattggacttcattgtggatcttcccccttatcatggaaatactaccattctcttaatggttgataggttttcgaaagccattcacttaggcatgctaacttcgaactttacgacacagactgttgccttattgttcatggatatggtgggcaaaattcatggtatgcctcgaagtctcgtgtctgatagagacccattatttgtgagtaagttttggcaagagctctttcgattgcgtggaacgaaattgcaaatgagttctgcctatcaccctcaatcagatggacaaatcaagccaggacaatgggtaatggttaagctcaggctataccgccaactttcagcaacccgaactccttattcaaaacttgctaaaagattttatggcccatttaagattttatctcgtaatggcaaagtagcttacaaattacagcatccagaggattctagaatccatcctatttttcactgttctatgcttaaaccattttatcaaacccctttgagcaaggacaaacctatagccttaccacctcaggtttgcaaacaccaacctgtaatttcacctctcgcgattattgacactcattgggagatcagggaaggtgaaccttgcctgatggtgctagttcaatgggaagaagagttccaccttaaggacaaggtgttgtcaaatgatgtagggattgataagcccgcagacaagcagcaggcacttatcctggatcagcagactagttcgacgaataacgtgaggaaaggtggggtatccgagtatcacttgaaagtggagaatctcggaagcttgtctctcagatag

SEQ ID NO: 101189 - DNA, 249 bp, Glycine max
  Peptide Sequence Number=SeqID_217967
atgtcgactttggaggatggcaacggtgttggccaacttgttgggcaactagcaaaattgatgggctactatgttgttggaagtgctggaagtaaagataaggttgaaattttgaagaataagttcgggtttgatggggcttttaattacaaggaggaacaagacctggatgcaactttgaagaggtactttcctgaaggcactgatgttagatcaagtggtctcggaataattaagaagggggattga

SEQ ID NO: 101190 - DNA, 1065 bp, Glycine max
  Peptide Sequence Number=SeqID_217968
atgtcagaagtagcatttctaagtaaaaccctcaaattgaacgccaccgtacaatacaagtcaccaaatgaaatctctattattgacaagaagtattgcagcagccgcaaggaatggcatgaagaagacgccgccggtgagggggcagatggtgaaggtggcgatgaggtgctagctgggcttgggcttgggcttgggcttgggcttgggcttgggcttgggcttgggcttgggcttgggcttgggcttgggcttgggctttcagtgggtggtagggagggtgacatttgtggtgggagagtagaaggtgcaggggaaggagcttgtgctgtggttatagccaccagagacaataaaatggcaagcccaagccagataaaggaaaaaagaagagttgtagttgacacgtgtggaacggatagagaaacagataagggcgctctccgtaccatcttcctaatcctccttacatttgcagtgttcccatgtctcctacccactgaagtcgaacccctatttttcctctccctaatggcttctcaagttcttcttcaggcactgtttgcccccaagctaagtttcccttcttcttctcgtaacgtggcgttaatttctagggttccttccaccccaatttcatggcgttgcactcccctcattgctaagcctagtttcgtagtgagagctgacaccaacctcgatggcggtggtgaagccaccgaggatgttccttcggataatgctgaaaaagtttcggaaggcgaagcagaacaagtttcggattctgaagctccgaaatcgcctagaaaaccccgagtcaaactcggagacattatggggatattgaatcagagggcaattgaggcatccgagaagcaaagaccaactccagacattaggactggggatattgtcgaaatcaaattggaggttcctgagaacaagcgtaggttgtccatttataaagggattgtcatctcaaaacaaaatgctggtattcacacgactattcgaatccgaagaatcattgccggcactggggttgagatagtcttcccagtgtaa

SEQ ID NO: 101191 - DNA, 834 bp, Glycine max
  Peptide Sequence Number=SeqID_217969
atggactccttcaattccttcttcgattcaacaaaccgatggaattacgatactctcaaaaacttccgtcaaatttctccggtcgttcagaatcacctcaagcaggtttattttactctgtgtttcgccgtggttgctgcggctgttggggcttaccttcatgtcctcttgaacattgggggttttcttactacagtggcatgcgtgggaagcagtgtttggttactctcgacacctccttttgaagaggcatgtaggaaaagagtgactttgttgatggccgcatcactgtttcagggtgcctctattggacccttgatagatttggctattcaaatcgatccaagccttatctttagtgcatttgtgggaacatccttggcctttgcatgcttctcaggagcagctttggttgctaggcgtagggagtacctgtaccttggtggcttggtttcttctggattgtccatccttctctggttgcactttgcttcttccatctttggaggttcaacagctctctttaagtttgagttgtactttgggcttttggtgtttgtaggttacattgtagtagacacccaagaaatagttgagagggcacacttgggcgatctggactatgtaaagcatgccttgaccttgtttaccgatttggttgcagtttttgtccggattcttgttattatgatgaaaagggaaccgagaaagggagtagggaagaagtcaatggtgaaggtccctaataaattcttactccatgactatgtgaggatttttgttggggaggaagtggaattcagcaatacacttttttttcacacatcagggtaa

SEQ ID NO: 101192 - DNA, 852 bp, Glycine max
  Peptide Sequence Number=SeqID_217970
atggaaagtgggagaattagtagtgagaaaaatgcgattcgaattgagaatccatttagtttgaaagtgggtcaggtgtttacaggtgcaatacctatgttgaatcaagtaatgagtgccaccagaggtgccaccgatgcattttctggtgttagcaggcatgtcaatacttctttgaggaagttgggagccaagaatattgaagttggtattggatgtggggttggttttggtcatggttttggagttggtcttgctgtgaaaccagtggttttgaatcaaattcaatctagtcttgtagatgtaatgacaaaggtgatgacaaagattggacttagtccaaatttaccctttagtcagggtgcatttccaccatccttgcaaagtgctgcaagcacagtcaatacaaaccaaagttctgctggaagcatgatgcagttggcaactaaatcagttgatcaagtatctcaaggcctgccagggtctcgacctgtgcaaattggttcagattttgaaaataatccattgagagtcactgcggttgactctgcatttggcagccggactgagaaggtcattagcaactttctgcaaaatccactattgaagggagaaggaggaggacttgatgaagcaagtgttgaaagaagagatgtagactataggagtcattttcatcttggaataattatatccctggaatttgtttccttttttttatgtgttaatactaggaaagttcaagacatagtatggagatggggcaggcaggctaaaatggaggtgaagcagccttggtggaatctagtagcttccgagctacttgagttatggctcttgggtggaatgtga

SEQ ID NO: 101193 - DNA, 246 bp, Glycine max
  Peptide Sequence Number=SeqID_217971
atggaagtagctaagtttaaagggctgattccaaaacctcaaactaagcatcactttcttctttctcaaaacttccctccattttccactgatgatgcagtgggcgtatcaagggtgacgagtgatgattgtgatgtcagcaacaataatagagatatcagtagcagtggcaatgacggtagagttgacaacattggtggtggtagtaataacattggtgatgaaatgatgacagtggcacgatag

SEQ ID NO: 101194 - DNA, 351 bp, Glycine max
  Peptide Sequence Number=SeqID_217972
atggcactcacacttgccattttattgtctctggtggctataaccacagcacaagctccttcccctgcaccttctactctcccaccacaaatgtcaccctccctaccacccactgaaagcccaagcccaagcccaagcccaagcccaagcccaagcccaagcccaagcccaagcccaagcccaagcccaagcccaagcccagctagcacctcatcgccaccttcaccatctgccccctcaccggcggcgtctgacagtacggtgccctcaagccccagcaatgcgtttattcatggaaccaccttcttcatgccattccttgcggctgctgcaatacttcttgctgcttaa

SEQ ID NO: 101195 - DNA, 420 bp, Glycine max
  Peptide Sequence Number=SeqID_217973
atggctgccaccccatggtttctccctccacacgtgtttactttcgctaggtcttttttttttgtcaaatttaatctcttcaatgatggattgtcctcttctcaggttgaacctccatttgtcaaactcaatgttgatagaagttgggtttgggatactaacagtgcaggttttggaggtcttattagcgaccccctccttgttcttgaacatggactgagtaatacttggaatcaacgttttcagagtgctgaggccatgaatgctattctatgcaaaaatgtgaatcagacttatatgcatcttcatgcgttcaaggtgtatgagattcaacttatagtcaacagggcatgggagttgagctcctcttccaatacctttgatcgtgtttggacgactcctcttgaagctatcctataa

SEQ ID NO: 101196 - DNA, 1674 bp, Glycine max
  Peptide Sequence Number=SeqID_217974
atccattcaattcgcaatatctcctccaactccttgacgctatctgcagcagaatcgttcattaattcattcattcgacaaaaccttgagcaattgacgatgatgcagatcagctccaccgtaccagcccacaaccttcacaagttccaagcaataaggtgccccagcttcagcttcagatgccaacaagcttcctcttccacctttcagaagcccttcatctccaccgagtcaactcgcttgcacctcgccaacctccacaaactcctcgagacccagaagcccgaggtccctccacccacccaaatccaacaccaccagccaatcattaacgatccaaaggaaaagaaaggaagaagctttctggagggtctcaacttggccaggctatggccggagatgaaagccaccgatgaaatgtccccgcgccacctcaaacgcctccagcgcctcctctccatgacggcggagtattccccgaggaacatcctcggcggccgctggagagaataccacggcagcaacgactggaaagggatgttggaccctctcgacgagaatctccggcgagaggtcgtccgctacggcgaattcgtccaagccgcgtatcaagccttccattcagaccccgccatgtcaacggaggagccgccacacacccaacacgtggcacttcccgatagatcctaccgaatgaccaaaagcctctacgccacgtcatccattggtttacccaaatgggtagatgacgtggcaccggatctaggatggatgacccaacgatcaagttgggtgggatatgtagccgtttgcgaggacaggagagagataacacgaatgggaagaagagacattgtgatctctctcaggggaacttccacgtgtctagaatgggcagaaaatctcagggctcatatgattgacatgcccgacaacgatagctcagaagaagcccaaggaaagcccaaagtggagtgtgggttcatgagcttgtacaaaacaaaaggagcacaagtgccaagtctagcagaatccgttgtagaagaagtgaggagactgatcgatctatacaaaggtgaagagttgagcatcagtgtgatagggcacagccttggggcgacgctagccttattggtggctgaggagataagcacgtgttgcccccaagtgccacccgtggctgttttttccttcggtgggcctcgcgtgggtaacaaggcctttggggatcgcttagctgccaaaaacgtcaaggtgctgagaatagtgaactcgcaagacgtgattactagggttccagggatcttcgtgagcgaagagcttgaacagaaaatacggaacgttggtgggggtgtgttggaggagaacacgcccttagcatactcgcacgtgggaacagagctgcgtgtgcacaccaagatgtcgccatatcttaagcccgatgctgacatggcgtgttgtcatgacttggaggcttacttgcacttggtggatgggttcttggcctccaattgtcctttcagatccaatgctaagagaagcttggctaggttaatgcaagaccaaagtgccaatgtaaagaagttgtatactagcaaggcaaaatccctcactgtcaatcttagtaggcagggatctatgtctatgtctaattgtttgcctagtccatcttaa

SEQ ID NO: 101197 - DNA, 438 bp, Glycine max
  Peptide Sequence Number=SeqID_217975
atgaggccaaccacagtggattcgagcgagattctagaagtgtgtaggaaagaggtgatggagtgggataaagaggtggtgcatgtggcacatgtgctgtatggtttactcagtgaggggttgggattgggtgcggagaggctcacggagatgggtctgttggagaagcattgtgagattggggagattaagagtgtttctagtgggaggtatgttgtgatggttgaggattcagagagaaaacaatgtagtaatagtaacgagaagaagaagagggagaaaatgagaagtaaacatggtgaaggaaagagtgttgaagaaaaatctgaagagagatggcttcaaatgtttggaaaacaaagtcatcaacatgttgaagcgaaagcggaagcagaagcgcaatgtggattaggagagtcacaaattcaggtgttgtga

SEQ ID NO: 101198 - DNA, 495 bp, Glycine max
  Peptide Sequence Number=SeqID_217976
atgtttggggtagagaaccatttcaggtatacaacagagaactctgtgaagtttggggctcatcgagatacggatcaccgtgagctcaaacaaccattagccatggaagtttggaactctgtattgcaaagacttaaaccaaggtctaagattacagtattggctaatggacccttgactaatctagcaaaggagttatatgtagtggggggacacataagcaacaatgtcaatgacaaaggagatatcttttcagttcgttcaaaccaatatgcagaattcaatatgttcctggatcctttagttgccaagatagtgtttgaatcagaagttaacatcacactcattccactcaacatacatcgtagagtaagatcatttttaaccattataggcgagttgcatagaacacatgaggctgtattttctaagcatctgttgtcaaggctataccgtttaaagcaaacccataatagatatcagaatatggcatga

SEQ ID NO: 101199 - DNA, 330 bp, Glycine max
  Peptide Sequence Number=SeqID_217977
aaacaacaaggaggagaaaagaagacaaatggtcatatcaagaagaaggcttacatagcatggaaagagaattcttccaacacttcaagtgattcaagaaatgaagaagaagccaatctttgtctcatgacggatggtgaagtagacaatcttgtaagttcttctgattctgaaactgaaattgatgataactatgaacaacttttagatgcctttaatgagatgcatgaaaaggataaaaatttatctcaagccaaaaaatttcacaaggaaaagttgagatggcatgtggataagatggttgatttggattggtataaatgttgctaa

SEQ ID NO: 101200 - DNA, 390 bp, Glycine max
  Peptide Sequence Number=SeqID_217978
atgtgccggcaaaattctccggtacaccatgccggtgaagaagaaattgcagctgatgagagccttttgatttattgcaagcctgttgaactttacaatattctctaccgccgtgctcttcaaaatccttcttttcttaggagatgtttgcgttataaaataagagcaagccgtaaaaggaggttgagagcaggaattgtgattttcaattatagggaccgctacaacattcttcgaaagactgaagtgaccgaagacttttcttgtccgttttgcttgatgcagtgtggaaactttaaggttactgaagattaccaagcagtgaatgtctctgtaaaaattgatatattgagatcagaggtcagaaccttgttcaattttgatttatag

SEQ ID NO: 101201 - DNA, 984 bp, Glycine max
  Peptide Sequence Number=SeqID_217979
atgtgttcgcgcgacagaggggagcgccccgacgcgacggggatggacttagaggtgctggaggtggccgaggagggcagttacgggcgggtgttccggtgcctcgacatccacaccggcgccctcgtgaccatgaagcagatcacgatggtccgcttgagccagggcgttccggcgccaataatccgtgaagtgtcgctcctcaaagaactccaccacgccaacatcgtgaagctgctcagggtgggactaaccgagaataggtacgtcaacctcgtcttcgagcatcttgattacgatcttcatcacttcattgtcaaccgaggttaccccaaggatgccttgactgttaagagtttcatgtaccagatactctctgctgtggcttactgtcactcgcttaaggttctgcacagagatttgaaaccaagcaatgtgctgattgatcattccaaaaggttgatcaagttggcggatttccgtttggctggagagtttgcagatgacttgttatatactgagaagttaggaacttcctggtacagggcacctgaaatcttgtgtgactctagacaatattcaactcaaattgatttgtggtctgttggctgcatatttgctgagatggtaattggacagcctttagtccaagctattaattgccgggatgaattggaggggattttcaaattattaggtacccccacagaggaaacatggccaggaatcaccaaattaatgcctaaccttcatatctactaccccaaatttgatgcattgaatcatgagaagctacgagaattcacatgcctctctgcttctatgcagggcctggaaacatttgttactgatctggaaccaagtggcctgaatctactatcaatgatgctttgcttggacccaagtagaaggatttctgcggaagctgctctaaagcatgcttactttatagatgttaattatgtatctcttctgcttctctaa

SEQ ID NO: 101202 - DNA, 519 bp, Glycine max
  Peptide Sequence Number=SeqID_217980
atgcaaaagcagagacggagaaggaacgaaattctcagcatagtgattgaagcacatcgatatcaagaagcagcacctatgaaggaagccattgcgagctctaagagcccaggcatgatggattcaactttgggttcatcaaggatttctgagatactctcaaaggttacatgtacaaggttctacctatctatctctttgataggttacatgtacaaggttctggcaaggttattgcctaacagattacttaaggtgatggaggtgagcttgggtgaaggtgaaggggtcggtggtcattgttgcggtggttggtccgtcgttgtcggcatacgaggtaaaatcaaagggagactagtcagggtcacgctgttttgcgagaatgctccaaccatatgggatcaacataggtttaaaggagcactcaaactgggtgtatttacccctaaggcctacactccgaagagtttgtcagggtctctccctcctgattcaggtccaacccagaaaacattttag

SEQ ID NO: 101203 - DNA, 576 bp, Glycine max
  Peptide Sequence Number=SeqID_217981
atgtttcattttattaagctagatgaaggtttcaaatacaatacaatcatgtattcagctaagaaacctaagatccaattaaaaagaaaagaaaagaaagtcgcacaagagaaaagtgtccaggaagagaaaacgaccaaggaacgggattgtggccgcaccgttatacttcagcttcactgcccattacatgcagccggtcactttttgaatccagagttcttctatgacaactctcaaatggaatttgatggtgaggttataaggggattgtatgcggccatcaataagttggtgggagatctagacatggagaagatcatcatgagggagttgctatcttataaaatgggggctggtatgtttgggactccaattgctgtttcaacgaggaaagaaattgcaccggctcaatggtgccgaatgtatggtccagatgctccccatttacaacaactagctataaggatcttaagcttgacaagaggcaaaggaggagcttcttcaactagggagaaaaaatggttcaagttgaggaagcattggaagataatactagtgagaaggaggaactag

SEQ ID NO: 101204 - DNA, 2406 bp, Glycine max
  Peptide Sequence Number=SeqID_217982
atggctgtcttaaccttccttatccgtacacttgtctttcttcgtgtttccttagtttttgcaaacgttaatctggattcgcgactttccacagatggcaatgatgcgtggcgttcaccctcgggcgaatttgcttttgggtttcggcaactgagtaattttggtacgaagctgttcatggttgccatctggtacgacaagatacccgacaagaccgttgtttggagtgcaaaaacagagtacaaacttgcaacagcgccaacaggatcacacgttcagatcacgaaagaagggctgtcgctgacaagtcccgaaggagattccatatggagggcgaaaccagaagccactgtttcggaaggagctatgcttaacaatggcaactttgttctactaaacggaggctctgaatatgaaaatatgtggcaaagttttgacaatcccacagacaccttgttgcctaaccaatctctccagcttggactcggaggcgttctaacttcacgattcacagacaccaattacacaactggaaggttccaactttattttcaggattttaatgttatgctgagcccccttgcttttccttctcaactgcgttacaacccttattatcatgcaattaatgatgcctcagttggcaatgcttcacgattagtgtttgataaatctggggaaatctatgtagagacgactggtgggactagaaatagaatcctacctcaagttgataatactcttgataccgaggtgaattactacagagcgacccttgatttcagtggagttttcacgctgtatgctcatccaaggaacaccagtggccaaccaaggtggagaatcatgaactatgttcctgacaacatttgcgatgcaatattcaatgattatggtagcggttcctgtggctataatagttattgctccatggaaaatgataggcctacttgcaactgcccttatggctattcactggttgatccaagtaatgaatctggtggatgccaacccaatttcactctcgcttgtggagccgatgttcaacaaccgccagaagaactgtatgaaatgcatgtagccaaaaattttaattttcctttgggagattatgaaaaggtagaaccttactctcaacaggaatgccaacaagcatgcttgcacgattgcatgtgtgctgttgccattttagaggtggacacttgttggatgaagagattgccccttggtaatggaagacaactaccaatcagggatcaacattttgtctatatcaaaacaagacttagtcctgacttttatcctggtcttgcaaacagggaacttcccgctgctcctgattcaaagaaagaaaatcgagctaagtcaattattttgggatcacttattgcttcccttgtcgttaacagtattctcctggctgcggttgctttgttttttctcttgaagccgaaactgaaaaaggttatacaagcttccgctcttttggaaacaaatttgcattcctttagttttgaggcattgaaagaggccacagaggatttttgtaaagaactaggcaggggttcctgtggcattgtttacaaaggcaaactagaaacagcagattcttgtaatgtgattgctgtcaagagattggacagattggcacaagaacgagagaaagaatttaggacagaattgagtgccattggtaaaacatcccacaaaaatctggtcaggttgattggattttgtgaccagggaatcaatagactattggtgtacgagttcatgagcaatggtacccttgcagacattctatttggacactccaaacccatctggaatttaagggttggatttgttttggggattgcaagagggttggtgtacttacacgaagagtgtgactctgccatcatacattgtgatataaaacctcaaaatatactcatagatgaacatttcaatgcaaagatatccgactttgggttggccaagttgttgttgtttgaccaaagtagaacgaatacgatgatccgaggaactcgaggatatgtggctcctgaatggttcaagaatgttgctgtgacggttaaagtggatgtttacagctttggggtgatgttgttggaaaatatttgctgcagaagaagtgtgatgaccatggaacccgaggaagaagaaaaggcaatattgacagattgggcttatgattgttgtgtggaagggaggttacatgctttggtggagaacgatagggaagcattgtctgacattggcaggttacaaaggtgggtaaagatagcaatttggtgcattcaagaggatcctgaaatgaggccaactatggggaaagttaaccaaatgctggaaggtttagttgaagtcgctaacccaccatcgcctaatcctgatatttga

SEQ ID NO: 101205 - DNA, 783 bp, Glycine max
  Peptide Sequence Number=SeqID_217983
atggcctataagcctggccaatgggcccacaaaggcccaaggcaagagtataaaatgagagcagtgacaagtgcaaaggtattgtggaagaacaaagcaatggcttcagctaaaaggtggcttccgctcgaagctaatcctgacgtcatgaatcagttcctttgggggcttggacttcgagaggatgaggcagaatgctgtgacgtttatggcttagatgaagagcttctggaaatggttccaaagcccgttcttgccgtgctttttctttatcccataaccacccagagtgaagaagagaggttgcagcaggaaaatgaaaaaaaggaatataacagtagagtctattttatgaagcaaactgtgggtaatgcttgtgggacaattgggctgcttcatgctcttggtaacttgacttctgaagtcaagctcgttgaggggtcgttctttgataacttttttaaatctactgcaagcttggatccattgcagcgtgcaacatttcttgagaatgacaaagaaatggaagtggctcatttggtggcagcaactgctggtgatacagaggcatcagacaatgcaactgcacatttcatatgctttgcttgtgtggatgatgaactttatgagcttgatggaagaaagtcagtgccaatatctcacggtccatcatcaccaagtactttgttaagggatgcagctaaagcaatacagagcatgatccagaaaaatccagactccttcaacttcaatgtcattgccttgtgtaagaaatccgggtag

SEQ ID NO: 101206 - DNA, 972 bp, Glycine max
  Peptide Sequence Number=SeqID_217984
atgcggtatgtccctgacgacatttgcacaacaatattcaatgagaatggtagtggttcctgtggctataacagctactgctccatgaaacatgataggcctacttgcaaatgcccttatgggtattcaatggtggatccaagtaatgaatttggtggatgccaacccaatttcaccctcgcttgtggcgcggataaacaaccttattctcaacaggagtgccgacaatcttgcttgcacagcggtaacacttgttggatgaagagattgccccttggtaacggaagacaagtagcaggagcttcccctgctcccgattccaagaaagaagatcgagctaagccaattcttttgcgatcactttatcccttgtctttatcaccgaaactaacaaggcttgtcccagctactcctagtcttttggaaacaaatttgcattcctttacttatgaaacattggaaaaagccacgcggggttttagtgaggaaataggcaggggttcttctggcgttgtttacaaaggccaactagaagcagcttcttgtaacttgatgattgccatcaagagattggacagattggctcaggaacgagataaagaatttaggactgaactgagtgccattggtaaaacctcccacaaaaatctgttgttggctgaccaaagtaaaacggatacgatgatccgtcgaggatatgtgcctcctgaatggttcaagaatgttcctgtgatggttaaagtagatgtctacagctttggggtaatgctggaaattatttggtgcagaagtgtgttgatgatggattccggggaagaagagaaggcaatactgacagattgggcgtatgattgctatatagaagggagaaatgtagatgctctggtgaagaacgatgaggaggccttttctgatagttgcaggttacataaatggatcaaaatagcattaatgagagattcatatttgtga

SEQ ID NO: 101207 - DNA, 1088 bp, Glycine max
  Peptide Sequence Number=SeqID_217985
agcctccggatattgggaattggttctcaagctatgaatatcgatcacccggtccggattcgaattttagtgtcgaagattctgctttcagcgaagaagaaacccagagagacggtgaagaagaagaagaagaaaatgttagggttcaaggtgaaggggttgctggggagaatgtagtacaatgtatcagaacttgtgttaaagaggataatcatagcgaagatcagtgcttgaacacgcctccagacatcagaaactggttctcgagctatgtttacgagtcacccgagtctgatacaagtagtctttttagagatgaagtttctgaagagaatgagtgtgggaaggagaggtttgattttgaagtagtaaaagaagatgaaagccggtttgagaatgtccactctaaagggcgtgtggaccacaatagctcttctaataaaaacacaaagggtgatgatagtgcagaaatgaagacaaattcaactactgttgatacttctcatctggaaaagattttgcagccatgcctgcaagataagacactgcaacaacataatcttggtccaacgaagtacaaggaggcattgggccttaatcacaaaagtcctggttgtgatccagaaggacatctgatgtccctggatactgatagaagtgtaatgaaacctccaaagctgctacaaaagaatgatactggagaatcaaaaacaaaaggtgaaatccaacatgacaagaagcttgacttgagtgcaagggtagcaaaaaacttttcagcaagaagttcaacttgtaccagcaataaagaaaacgatggttttgtgacgacaaggaggaacagctacactggaggaaatgatgaaagttcttgtaagaaagcagaaaagataatattagcaggagcagttccattggcatgtgaaaagcaaggtgttacaaagagaaaggcattaacagaagcaacaaatgttaaacaatataatgtcatggggataacagggaaatggcaatgcccacagaaacgtaaacctgatgttggacctgctatgaaacaacttaggctcgatcgctgggttcgtagagtttga

SEQ ID NO: 101208 - DNA, 2430 bp, Glycine max
  Peptide Sequence Number=SeqID_217986
atggctgccttaaatttaaacctccttatagttacactcatctatattcatcatgtttccttagcttttgcaaaagttactctgaactcgccacttttcacggataccgatgatgcgtggctttcaccctcgggagaatttgctttcgggtttcgacaactgaatgataatgacaccaagctgttcatggttgccatctggtataacatgataccggacgaccagaccgttgtttggagtgcaagaaaagacaacaagcttgcaacagcgccagcgggatcaaagttgcagatcacacaagaaggtctgtcgttgacaaatcccaaaggggatttcatatggacggcaagttcaaaagattttgtttcggaaggagctatgcttgacagtggcaactttgttctcctaaacggtagctctgcaaatgtgtggcaaagttttgaacatcccacagacaccttgttgcctaatcaatctctccagctcggaggcatgctgacttctcgattgacagacacaaattacactacaggaaggtttcaactttattttgatggtggtaatctcttgctcagcccccttgcttggccctctcaactgcgttacaagtcctatcctgtaattgatgcctctggcaacgcttcacgattgctgttcaacatatcgggggatatctatgtggagaccaccaatgggaatagaatccaacctcaaggtcaaaaatgggttagcaatagcagcagtagcttggatctcaatcctgagatgaatttctacagagccacgcttgaccccagtggagttttcacgcagtatgctcatcctaggaacaacactgctcggcaagggtggataatcatgaggtatgttcctgatgacatttgcaatataatatttgatcggtttggtagtggttcctgtggctataatagctactgcgacatggaaaatgagagacctacttgtaattgccttgatgggtattcactggtggatccaagtaatcaatttggtggatgccagcccaatttcaccctcgcttgtggagccgatgttcaagcaccgccagaacaactatatcatatgctccaatcctcaagatataattttcctgaggcagattatgaaaagatacaaccttacactcaacaggaatgcctacaattttgcttgcacgattgcatgtgtgctgttgccattttcgggctggacacttgttggatgaagagattgcccctttctaacggaagagtaaccgatgttaatgatcaccattttgtctatatcaaaataagaaatagtcgtgacttttatccgggtgtaaacgaggaacttccccctggtgcagattcaaataaggaagatggagctaagccaattcttatgggatcacttattggctcccttgtcgtgaacggtattctcctggctacggttgctttgttggttctcttgaagccgaaactaaaagtggctgtaccagttgctgctgctagtcttttggaaacaaatttgcattcgtttagttatgaggcattgaaagaggccacatggggttttagtgaagaactaggcaggggttcctgtggcattgtttacaaaggcaaactagaagcagaagattcttgtaatgtgattgccgtcaagagattggacagattggcacaagaacgagagaaagaatttaggactgaattgagtgccattggtaaaacctcccacaaaaatctggtcaggttgattggattttgtgaccagggaatcaatagactattggtgtacgagttcatgagcaatggtactcttgcagacatcttatttggacactctaaacccaattggaatacaagggttggatttgctttggggattgcaagagggttggtgtacttacacgaagagtgtgacactccaatcattcattgtgatataaaacctcaaaatatactcatagatgaacatttcaataccaagatatctgactttgggttggccaagttgttgttgtctgaccaaagtagaacgaatacgatgatccgaggaactcgaggatatgtagctcctgaatggttcaagaatgtcgctgtgacggttaaagtggatgtttacagctttgggataatgttgttggaaattatttgctgcagaagaagtgtggtgatggaggagcccggggaagaagagaaggcagtactggcagattgggcttgtgattgctatatggaagggagaatagatgctctagtggagaatgaggaggaggccttatctgacaaagagaggttacaaaaatggatcaaaatagcaatatggtgcattcatgagaatcctgaaatgaggccaacaattgggatggtcgtgcaaatgctagaaggctttgttcaagtctctaacccaccacccacttttaccatgcattccgtatcttga

SEQ ID NO: 101209 - DNA, 237 bp, Glycine max
  Peptide Sequence Number=SeqID_217987
atggtggttatgtttgttcatggaaacattactttgagttccacactgtccaccaacgactatgatgcatggctttcgccttcggccaagaccattgcttggaatacaaaagcaaatgaaatccttgcaacagcaacaacaggatcacaggttcagctcacatcagaagggctcacgctgacaagtccgaaaggaaaatccatatggaaagcacaaccagacgctgctctttcctaa

SEQ ID NO: 101210 - DNA, 165 bp, Glycine max
  Peptide Sequence Number=SeqID_217988
atgtatatctttatgacattatttgtagatgttcaattcttgattatcatacttgaaactgatccaaatgttatagttgggaaaattgctaataatagtatagattatggagctcctttgtccgaacagacactaagtcaagcattatctaggagtgtaaaatag

SEQ ID NO: 101211 - DNA, 1338 bp, Glycine max
  Peptide Sequence Number=SeqID_217989
atggcaatagcatattggtcattgacttcatcaactctttgcaggacgatgagtactcctccagttgttgagcgcgtttcagaatgcttcatcaagccgcagcactccaaccatgaatcaaaccaaatctgctacttaacaccttgggatattgctatgttgtctgctcactatatccaaaagggccttctcttcaagaagccctcatcaccacttgttagtcacaataatttcatagagaacctgttgcagaagctcaagcactctctttctctcaccctcttccatttctatcctttggctggtcgccttgtcacccaccaaacccatgaccctcccttctatgctgttttcgttgattgcaacaacagtgatggagccagattcatccatgcaactttagatatgaccatatctgatatcctctctcccgttgacgttccacccattgttcaatcattgtttgaccaccacaaagctgtcaaccatgacggtcacacaatgccgttgttgtccgtccaagtcactgaatttgtggatggtgttttcataggttgttccatgaaccacactcttggtgatggcacttcttattggaatttcttcaacacatggtctcagatctttcaagttcaaggccatgaacatgatgttcccatttcgcacccacccattcacaatcgctggtttccagagggttgcgagtctattgcaaaactgaaagcaaaggctaactcggagtgcaacacaaccaaaatctcatcgttccaatcattatcggcacttgtttggagatgcataactcgtgcgcggcgcttgccgtatgatcaaagaacaagttgcaagttgtccgcaaacaacagaacaagaatggaaccaccactgcctcaggagtactttggaaactcaatttatacactgaatgcaggaaccgccacctcagggaaattgcttgagaatggtataggttgggcagcatggaagttgcacaaatcggttgtaaaccataacgacagagcggtgttggaaacgctcaaagagtggttagagagtcctctgatatatgatcttggtcgttattttgacccgtactgtgtgatgatgggtagctcacccaggttcaacatgtatgggaatgagtttggaatgggaaaggcagttgcacttagaagtgggtatgccaacaaatttgatggaaaagtaacatcatacccaggccatgaaggaggaggaagcgtagatttggaagtgtgtctttcgccagctgtaatgagtgcactggaatcggacgaggagttcatgaatattgctctagtttctgtttacaatcctctctag

SEQ ID NO: 101212 - DNA, 318 bp, Glycine max
  Peptide Sequence Number=SeqID_217990
atggaaatggaaaaaggccgatctaataggagaatcacggtatgcgtgactcagaataaacagggaaagaaagctcctatcttggatatggggtgctttttattcgatttattgttccctttctttcctcctggtgataaaggcaagaacaaggccaacggagcagcccgtttgacctgcgaggtaggggcggaccaatgtatattaaattcgtgcaaaagtgcaaaacaggttggcttggtccgttgtcaatgtagacttacgcaggtggaccttaacgcaagacgagataacctgcttacccatctctaccaatga

SEQ ID NO: 101213 - DNA, 447 bp, Glycine max
  Peptide Sequence Number=SeqID_217991
atggagactcaaaatgtgatattaaagactagtcgatctaagaaggatgcatgtatattggagaagtccttatctcataggtatccagatttggtgttccacgaggccctcaaagaggagaaagaaaaactgcatgttgaaatacgtagatcaagaaccaataatgacccggaacaatgcagggtaattgagcatcttattgaagtcacaaaaaatgttgtcaacatgtcacctaacaaaaaggttacaaaaattgttttcaatgaaccaactgatttaattgcaaggcatataactgataatgcaataggctctgaggaccttgagttggaatctgcatataaaagtcaatcagaatggaagactgatctctttggtttctgtagggatccttgcttatgtaaatttaaccccatcttgtatagattctatttcaaaaaatggtaa

SEQ ID NO: 101214 - DNA, 978 bp, Glycine max
  Peptide Sequence Number=SeqID_217992
gaagagtgtgagattggcacaacagcgaaaaaagccattttggtcggaataaactacccaagaacaaaggctaagttgagaggatgcataaacgacgtctggaggatccaccgctgcctgatcgagaagtacgatttctatgaacacgacatcaccgttttgatcgacaccgacgaatcctacatggagcccaacgggaagaacattcggtctgtgcttactaggctggtccaatcagcggagcccggggatgttctattcatgcactacagcggacacggcacgcgcctcctcgcgaaaactagagaggatggtgacactagttatgatgaatgcattgttccttctgatatgaacctcatcattggttgtgcattttcggtcaacgtcagtcaaggatgtttttggtcaatctcagtgttgaccgtgactggtttttggtcaacgttggttaggatttgtttggccaacatcgataaggtttttcacagcactactgatgatgatagggacattgaactcccacataagcaatgtggctatgtaaagaatagactctcactttatgacatttttggggaagatgctagccctaaagttaacaagttcctgaaggttatcttaaataaactcgaacatgggaatggtagaatcttggggttggtgggtagtcttgcccaagagtttctcaagcaaaagctggattcaaatgatggtggtgggtatgcaaaacctgccatggagacaaaggtagaaagaaaatatgaggcatatgttggatcaagttcaatgaagccacgcctttccaaatggaggaattttgatgagtggttactagacagaccaaacagtgatggttcagtaacaaatcaagagattattttgaaggcaagagagaagctcaagagggtaggtttcaaacaacgacctggactttactatagtgatgaccatgttgatggtccttttgtgtgctga

SEQ ID NO: 101215 - DNA, 603 bp, Glycine max
  Peptide Sequence Number=SeqID_217993
atgtgcttgatctccttaaatagactggtcagttttgatgagcctgtggatttgaaggctcaaggccttggaaggtgttgggaagaaaaaagaaacaggccaagactggcaagtactgaatgtctttgtttaggagtgtgtaggacagttatgctgtgttttgttaggaatggcatgaggaagttatttacattgtgtagtttgttgtttgtggtgtgtttgaaagaggatgttgtgatccttgagcatcaatcatttctttctagaatagctgatgttcatgatcgacacagggatatgcgacttgatgttgataacatgtcttatgaggagttgttggctctggaagagcgcattggaaatgtgagtactggattgagtgaggaaaccctatcgaaactcttgaaacagagaaaacactcggttgaaaaagggtctgagactgatgcagaaccctgttgtgtttgtcaggaggattatggtgatgggaatgatattggaacgcttgattgtggccatgatttccatagcagctgtatcaaacagtggctaatgcataagaatctgtgtcccatttgtaagacaacgggcttggcaacatga

SEQ ID NO: 101216 - DNA, 336 bp, Glycine max
  Peptide Sequence Number=SeqID_217994
atgcatgcacaccatcaccactcagatccacctctctgcacgtgcaacaacagtgaactagccactaccaaccaccgcatcgtcatgcacagctccaccctcatcacacctccatccagatcccccaaacacatcctaaaacaacatcccatgaccaaaaagcattatcatcgacgctcattttcacgtattcctattttctctaatgtcaacgatgttgtaagtggggaagaattgggctgggaagaggggttggacggtgtggtggtggtagtcaacgattgtggtggtggtggttttcgttggagaaagggaataaggagaaagggaaaaaag

SEQ ID NO: 101217 - DNA, 1407 bp, Glycine max
  Peptide Sequence Number=SeqID_217995
aatctcaacttaaatgcaggtttagcggacagtggcagtgatgatagtcaacatctggagctccctaacttaaacaagtctagtgggtcagcaaacgagtgtataccacctaatgttggatctggttcttttctgcttccttctggaaataatgccttcctggtagaagatactgatggtaggcctagttgttctcttgatactcggcgggtctcttgtaaacgaaaggctgttgaaggaaataatggacaatcgtcagatgctgggagttctagctacagtcagcatacagatggtagtgcatggcacaccattcctactcaggataatgctggaagcagttcgagaagatctattccctcagaagaggtaaacgcaagacttggcctgggtatcggggatgaagcatctgaaaatgtttctgattcaaaaactgcaggaagctcagaaagctttcacaggaatttccgtttgaggttaaatccttcaaacccagcaaattctgttcctcccaccgcattctcaactgggagcatgattaggcattctggtgtttctccatcctctcaagtatcacaaagacttcattctgttaataattctctgaactcgaggtcggcaccaccgatagataatgtggttcctcaaagccagccacatgtaatccatgtccctgctttgcccaggaatagacaatcatttagatggagtggtggttctagctccagaaacatccattcatcaaactcaattatatccccagccagggatcaggaggatgcaagctcaagaagaatgtccagaaatatgttagaacatccagtctttcaacctgcaactgatttaagaaatttagttcaaaatccaacagttagagcttcaagttcaagtagtgtaaatttaagtattccaggaaatgttgcttcatcacggactggatcaaatccagctaccaatccctcatctgccccaacttgggtttctcctcctaatcctccacagcatccacggaggttatctgaatatgtccgtcggtccttgttttctcccagttctgatgctattggaagtccaagcaataattattcttccttgcgctctggtttttctacatctgaaccaagggcgttatcatctgggagtggggcaaacccgagatcatcttcatggttggagaggcaaggaggtagtgaatttggaattccttattcactacgtactttggctgttgcaagtgaaggaagtagtagacttgtatctgagccgattcccaatctgaacagattgacaagttctgcttgtggtgccggcagtcctacctcaaccggaggtggccgtcgggacaaccaggtcgatagtgaccttcttggacagcagaaacgattttatcaggcccacaggatgtga

SEQ ID NO: 101218 - DNA, 621 bp, Glycine max
  Peptide Sequence Number=SeqID_217996
atgctccaaccatatgagatcagcataggcttaaaggagcactcaaacccggtgacccccaaggcctacactccgaagagtccgtcagggcctctccctcctgattcagacagctctgggtttctgcgggaaagaaaaaggctacaatgcgaagggtgtttctctcagttcagacgtgatatcaaaattcccaacggtgagaattctcggaattgtgttgcgaacatgatactcaaatttcacgacgatccaacggtgaacgggggtggttgtgggtggtgtgttatggcatggccgggagtagaggtagaggcagccatgaatggcaggtgggtgatcgagaatcgcgggatatctaatttggctacattacgtggatggagctgggcggacgacggcttcttcaaggcgatcggtggtcgtctttctggttccgtggtcagccatggcgatggtgacggcggaggtcggaacagttgttatgtgacagagggtggggtagtgcctttgttcgaggcaagactcctcctaagaaatggcatggacattataggagaacaaacacgtgcaaactctagacataatagaatcagtgaaaagcaagtcatggaattgacttag

SEQ ID NO: 101219 - DNA, 1896 bp, Glycine max
  Peptide Sequence Number=SeqID_217997
atggggaaaccaagaagagaagatgttctttgttttgtgctttttttctggttttgtagcttttccaatgccttgctttctccaaagggtgtgaactttgaagtgctagctttaatgggcataaaagcttctcttgtggatcctcatggtattctagataattgggatgaggatgcagttgatccatgcagctggaacatggtcacatgttcccctgagaatcttgttattagcctgggcattcccagtcaaaatttgtctggcacactatctccaagcattggaaacctaacaaatcttcagactgtggtgctacagaataacaacataactggaccaatcccttcagagataggaaaactttccaagctccaaactcttgatctctctgataacttcttcagcggggaaattcccccctctatgggtcacctgagaagcctccaatacttaaggcttaataataacagttttgatggacaatgcccagagtcactagctaacatggcacagcttgctttccttgacttgtcctacaacaatttgagtggccctatacctaaaatgttggccaaatcattcagtattgtaggaaaccccctcgtttgcgctacagaaaaagaaaaaaattgccatgggatgacacttatgcctatgtcaatgaacttgaacgatactgagcaaaatctctttgcttccctagatgctttgccatcaggcagaaaaaaggctcacaaaatggccatagcctttggtttaattttgggatgcctcagcttgatagttcttggtgttggacttgttttatggaggaggcacaagcataaacaacaggcattctttgatgttaaagaccggcatcatgaagaagtctaccttggaaacttgaagaggttccatttaagagaacttcagattgctactaacaacttcagcaacaaaaacattcttggaaagggtggttttggaaatgtctacaaaggaattctcccagatggcactctagtagcagtcaagaggcttaaagatggcaatgccattggaggagatatacaatttcagactgaagttgaaatgatcagcttggcagtgcacagaaacctcctcaaactgtatggattttgcatgacaccaaccgaaaggcttttggtttatccttacatgtccaatggcagtgttgcttctaggctcaagggtaagccagtgttggactggggcacaaggaagcaaattgccttaggagcagcaaggggactactataccttcatgagcagtgtgatccaaagataatccatagagatgtgaaggctgcaaacatattgcttgatgactattgtgaggcagtggtaggagattttggattggcaaagcttttagatcaccaagattcacatgtcacaactgcagtgaggggcacagtggggcatattgcaccagagtacctttccacagggcaatcttctgaaaagactgatgtatttggatttggtatactgcttcttgaattgatcactggccaaagggctctagaatttggaaaagcagccaaccaaaaaggagccatgcttgattgggtaaggaaactacatcaagagaagaagcttgagttgcttgttgacaaggatctcaagactaactatgacagaattgagcttgaggaaatagttcaagtggcactcttgtgcacacaatatcttccgggccacaggcccaaaatgtccgaagttgtacgcatgcttgaaggtgatgggcttgcagagaaatgggaagcctcacaaagtgctgacactaccaagtgcaaaccacaagaactctcttcatcagataggtattctgacctcactgatgactcttctttgttagtccaagccatggaactctcaggccctaggtga

SEQ ID NO: 101220 - DNA, 288 bp, Glycine max
  Peptide Sequence Number=SeqID_217998
atgccactccaagacaagaatcatcaacgtcttaaggattttcttttcttaatgttgcaaagggggtttatgggaatgcactgtaatcatttatgttgggctgatgagcttgataaagacattgatgaagcggttgcaaaggctattgaggaacaaaggaagagaattttgaggcctgatgtgtgtgttgaatttaggatgtgtctaatttggaggcttgttgttgctattttggggtggtttagtttagttgtggctattgaagttgttgtttgtggaaccttttga

SEQ ID NO: 101221 - DNA, 830 bp, Glycine max
  Peptide Sequence Number=SeqID_217999
tggattcattctagggtcgaccgtgattgtttatgtacaagatcatgtaaattggggagttgctgatatcattctctcagtggtcatggctgtatcattgctcatattcttgataggaaggaagggaccaatcactagaaccatgagcaagaggctccaagaagattgggctagagctgctgaagaatgccctagggttctcatgaaccttaggactcatcttctccttgaagtggcgtctcctctctctctccctttctccattccactgtcattcatcttccaagaagcaaaggaatcctttgatgaagaagatcctaggcctacaagctccaatggagcttgcatcattgttgctgctatttccaaaagaaagcttccatatccttccgatccaactcaattgtatgaagtttccaagtctaagggaaacagggaaagatttctgcctcagaccatgaaactcaaatttcttgagaaggcagcaattcttgaaaatgaagggaacttagcagagaaacagaatccctggaaacttacaactgtgactaaagttgaagaattgaagcttaccatcaacatgttccccatttgggtattcactttaccatttggaatatgtactgcccaaaccgccactttttttatcaaacaaagtgccatcatgaacagaaagataggcaataagaggctaacaggaaatgaaagaggaatcagtatcctccaaaggattggtattgggatgttcttctcaattatcacaatgatagtggcagctttggtggaaaaaaagaggcttgaggctgttgagattaatggcccattaaagg

SEQ ID NO: 101222 - DNA, 201 bp, Glycine max
  Peptide Sequence Number=SeqID_218000
atggcggtgatggtgacggtggcttcgattcaacaccgtcgttttttgaaacctaaccctaggatcctcgatccaattcaacctcttcgttggtggtccttcttttcctttccctatttggctattgctatttctaaactcttttccgttattcaagagcgctgctgcttcggtgttaggacacgaatgacgttcttgtag

SEQ ID NO: 101223 - DNA, 321 bp, Glycine max
  Peptide Sequence Number=SeqID_218001
atgccacatcctatcagagcgttgtgtttcgacgtccttcagcacaaggttccttacatcaattcacctagtcatctgctcccccgaacacaaagttcaagatcatcacaggatccaaacacaaacaacacacggggaggagaccagtcagggtcacgatgttttgcgagaatgctccaaccatatgggatcagcataggcttaaaggagcactcaaacccggtgacccccaaggcctacactccgaagagtccgtcagggcctctccctcctgattcaggttcaacccctaaaatcattttagcacacagacactgctag

SEQ ID NO: 101224 - DNA, 540 bp, Glycine max
  Peptide Sequence Number=SeqID_218002
atggggtcgttgttattaatgaggagagagacaaagctcatttgcaatcagaaccatcagaataactacatggttacgaaaactcgacataaagaggaaaagggtatgctgaggggtctggcttggtataaggacaagtttaataaacatgattggtggtggtttacaccaatctatgctagccacattgaaaatgtgagaaataagttgtggaacaagattagtgccttcaatgctaacatcccaaaccaacggttgattgcgggagactataatgatattgtcagtcagctagtctctggtccaaggacatggagcttcttcaaaaaatttccaaagtggatggaggaaggtcttaaagagtggaaagctaacatttttggcaatatcaaggtggctaaaaggaaaattgaagccaagttggggggtattcaaagaatgattcatgatggaagaggcaacccttttctttacaagttagagaaggacttgcatcaccaacttgagacccttctttacctagaggaattatcttggtaa

SEQ ID NO: 101225 - DNA, 281 bp, Glycine max
  Peptide Sequence Number=SeqID_218003
gacagcagaagccagaagggaagaatgtctcaaaagtcaaagaaaatgtcgttgacgtggacaagtttgcgggtcaggtttgggatcatatccaacaaaatatgatccagagagggatgataattgggaaggacagtaagaaacctcaatctagtcgaaagccgtcgctgcaaatctctctccccaagaaaacagagtggatccaattcggagatcccgaggttactgaaacggtttcgcagagtaatccaaacgcggaagagaagaagcactacagagga

SEQ ID NO: 101226 - DNA, 507 bp, Glycine max
  Peptide Sequence Number=SeqID_218004
atggaggaggatctagacaatgaagaagaggaggaagatcttgagtggtgtcccaacttccatcctaacagccaacctatagagtttgttgcaattcaggtgaggttttttgggcttcctattcattactatgatgggaacattctgtgtgctcttggtaaccacataaggagaacagttagggttgataggagcacatggaccaatgagaaaggcaagtacaccaaactttgtgtggaggtggatctgacaaagcctttgctagctctttttaagattaaccagaggtttggtcattatgtagaaggttgtccagataaggggaaagagacatggaatggtaaccaaaacactgttgttaatagggctcaagtggaaaaggagggtcgggtgagcacatccaaagctaatggtccttgggctgctgtaaaaaaatgcagagacctaggagaggaaaagaaaaagagacggatcagaatggaggagggaatgagaataccaacatag

SEQ ID NO: 101227 - DNA, 2220 bp, Glycine max
  Peptide Sequence Number=SeqID_218005
atgaagggtacaaggcagaatggcctttacaaactgcaagccagggtaccttcattaggaggagaaaaatatttcataactttcattgatgattggtctaggaaagtctggacttatctgttgaaacataaaaatcaggcttttaagtgtttcaaacaatggaaattacttgttgagaatcaaactggtaggcatgtgaagctactcagaactaataatggccttgaatacttaagtgaggaattcaatgaattttgcaaagacaatggaataagaaggcacaaaactgtcagattgacccctcagcaaaatggccttgctgaaaggatgaacaagaccattttggaaagggtgagatgtatgttgtctaatgcaaaattggcaaacagtttttggggagaggctgtgaatacagcatgctatctaataaacagatgtccttcaagtgcaattgaattcaaaacaccagaggaaagatggacaggaaaagctccaagctatgaaaacttaacaatttttggatgcattgtatatgttcattctaatgaaggcaaacttgaacctagagctaagaagggaatcttcttaggttatccgaaaggagtgaagggatataaattctggttattggatcctgcagttcaaaagggtgttcaagctgagaaaaatagacactctgatcaaggaattaggttggaggtggagaagcttgcacaaacattaggtctagtagaggacagaaatgaagcatctcatgatgaacctatgatttcattaattcctgaacctgctgatacttcatatatcctggtcaaagacaaagaaggcagattaaagctccttatagaaattgatgatcaaggctcagaaccaatttcttacaaagatgcaatttccagaaccgacagtgatcagtggagatcagcaatgcaagatgagtttgactctttaatgaagaatgatacttggaaacttgttgaaaagccagcaaagcagaaagttgtagggtgtaaatggattttcaaaaggaaaccagaagaaacaggaatggatagctacagatacaaagcaaggcttgtggctaggggtttcacacaaagagaaagaattgactataatgagattttttctccagttgtgaagcatacaagcatcagaatcatcttggcactaattgcagttcacaaccttgaattggagcaaatggatgtaaaaacatcctttttacatgggaatctagaagaaacaatatatatgagtcaacctgaaggatatggggtaaaagggaaaaaggagatggtatgtttgctgaagaaatctctgtatggactgaaacagtccctaaggcagtggtacagtcaaatggtttcaacagaagttcctatgacagttgtgtctacttcagaagatgacatgttgattgcaagtacagatatgaaagccatcaaagaattgaagaatttgttgcaatctgagtttgaaatgaaggatttaagggctgcaaggagaatactgggaatggatattatcaggaaaagaaatgaagaagatgaaatcaaagatatgagtagaatcccctactcgaatgctataggttcacttatgtacgatatggtctgtactagaccagatttagcatactcagctagcattgtaagtagattcatggcaaatcctggaaaacaacactggagtgtcgtaaagtggatcttaagatatctaaagggttcaaagtctgttggtctggtctatgaagaaagtcagaaagaatcaatggtctgtgacattgacaaaagaaggtccttaacaggatacttattcactttgtatggaagtgtcataagttggaaggctaatttgcaatcatttgtggctctatctaccactaaggcagagtatatagctctcactgaagctataaaggaagccatatggcttaaaggtcttgttcatgagctcgaaggaaagactggtcctgttgaagtatggtgtgatagtcaaagtgcaattgatctctctaaaaaccaagtttttcatgagaggacaaagcatattgacattaggatgcattacatccgagacatcatagcacaaggtgaagttgaagtgaggaaagtggctagagcaaacaatcctgcagacatgctgacaaaagtagttccatgttcaaagtttactcattgtttaaacttggtgaacattggaacttgtgacacttga

SEQ ID NO: 101228 - DNA, 204 bp, Glycine max
  Peptide Sequence Number=SeqID_218006
atggaagccatatctgtcattgctaaaggaagtgcggttcctgcagagattagtagtatcgtattggagtttcgttctcagagagagcataattctattggagttgccttagcaaagtttggtttatctctagattgtgattgcgttttgtttgattatcctccaccatgtgtggagggcatgctgattggaaattcctttcgg

SEQ ID NO: 101229 - DNA, 261 bp, Glycine max
  Peptide Sequence Number=SeqID_218007
atggcacctacgaacatttgtgtgcaagttcgaatcaatggccaacgctcaactcacagcaatagcgtcatcgatctctacggcaatacactgcgattaagcctctgggagattagattgctgataaaaattaaggaagcagaggagaaaactgagggtgggattttgcttccatcaactgctcaaacgaagcctcaagggggtgaggtggttgctgttgggaagaacaatgtagagattagtgtgaagactggtgcataa

SEQ ID NO: 101230 - DNA, 348 bp, Glycine max
  Peptide Sequence Number=SeqID_218008
atggagatctgcagtgacttgaggattgccgctgagtctactcattggttggaagataactcgagaagcttatgctttaacggaattaaggtttgcgcgagattggcaagaggttgtgctcgaagagctcacgccttgggtgaaccccaatggttgggtccctcggggatgaagatgacatggatggctctgttggttccgtcatggcaacgccgagggaaaaatcatgagaaaatgagagagaaagagagagagagagaaagttgcagatctttgattcgagaacaagtagagggagaagagagagatgtggatagacccataacgaaagatctgtcaggaggataa

SEQ ID NO: 101231 - DNA, 243 bp, Glycine max
  Peptide Sequence Number=SeqID_218009
atggcaatatacaacacttttcttttggcttccggcatatctcggaacttcacaaatttcctaacgatgggtgccaaatacctcgaagtggtcaaacgagggtcgcatcccaacaacggatggtcctcggacgaaattaggaatgatcctaataagagttttccttatggtatattgctagtactcaaaacttggagtgttacacgagatccaatcactctgaatggagttttcaagttatag

SEQ ID NO: 101232 - DNA, 723 bp, Glycine max
  Peptide Sequence Number=SeqID_218010
atggagctgaaatcgttctctttcaattctgagatggtactcgtgggaagaacaagaacctgtcccgctttgctctcaaattccagcagcgttagattctgtagtcaactcaactgtttcggtgctgtcaccagttcagttggtccagataatcttgcggcagaaacgagttttcatcatattaatggcaccaatggctcaatttctagcttgtgttccagaaatctgagagtacttgatgcctctgatgatgtgtatgagggtgttgtaattgattcagaccggttaccagacaacccttctaccttcgcagctaatttgcgtttttctcttcatcattggaaaaaggtggggaagaaggggatttggcttagattgccatcagagcaatctgattttgttccaatagctattaaggaaggctttcgataccaccacgcggagccagggtatgtgatgttaacatactggattcctgaaggacctttcatgcttccagccaatgcatcacaccaagtaggagttgggggatttgtcatcagtggcagcaatgaggtgcttgtagtccaagagaagcaatgtgctcctgcaaattgtggtctatggaaaataccaactcgattcgttcttcagtcagaggagctatatgctggagccataagagaagtgaaggaagaaactgggattgataccgagttcgttgaagtcatagcattcaggtaa

SEQ ID NO: 101233 - DNA, 342 bp, Glycine max
  Peptide Sequence Number=SeqID_218011
atgaaggaagtgaagatgaagagaaaggatagtgaaggaagagccataacaaaaccgctaccagcaactgttaacttgtcgggttcgggttggtggcgtgcacctctcactcgttacagcgtgtctccctccaacgattcccgcaatggattgaaccatcttgtgatgacaacacctccatctgcctctagcctccttgtcaccattgaagggttgggttctgataaggaagggacttctgtgctggaacttgtggtgtggagagttggaagaagacttgagttggagaagagaagaactagaaagtggggtgctttgcgggaagaagagaagaacgaatag

SEQ ID NO: 101234 - DNA, 1098 bp, Glycine max
  Peptide Sequence Number=SeqID_218012
atggctttggggcacatgaatatccaagtagtgcgcctgtctgcaaaatatcatggagacacttatcatcttattgccaaaaactgcaaccattttacggatgaagtttgccagcatctaacaggaagtcctatccctggatgggtaaatcggatggctcgtgtagtgtggtttaagcttttaggttctttctgcaattgtcttctgccagaaagcctccaggttgctgcagttagacatctccctgaacgtgttgcatttgatgatgatgatggatcaggatctgatggcctttctgcatccattgagagtgaagaagatgagcccaatcaccattttttaacttcaccaaatggtgatgttgcctttctaaaggaaaaaccatctcaagtgatgggtgcattcatcttccttttcctcttgtgtgttttctgcttccaaagtaaggtgacctatgctacaaggtgtggagatgcaggccctgaaatccactatccatatcagataaaaggtcaacagcaacagcataagtcccttcctggttttgagcttctttgcaaagacaacctcaccactatccactttccatcttatggtgatttggtagtgaagtccatttcctatgacaccaaaaacattcacctccttgaccccaaaaactgtgcccatcatgtctttctcaacctcaatctctccctcacaccgttccactatttttatgttctgaaaaactacacatacctcaattgctccaccacccttccacatcctctcgtggaggttccgtgtttaagtgcttcaagctatcatgtatacacagttgaccctgcagtgcctgtgccgggttcatgtgatggagtcaaaaccgtagccattccttttgcatatagcccttatctctcagacaaaagtcttggtcttagattaacatggcacttgcgtgaacctctagacaacgaagcagcagtgaaccggactagagttataggctctagcatctgtgttttcgtgatggccatgctattgcttataagcatgaaggttcgtggtgccacgaggaacctccatcagaaagaaggacagttattgcagagctaa

SEQ ID NO: 101235 - DNA, 372 bp, Glycine max
  Peptide Sequence Number=SeqID_218013
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgcaactttgtcttgcgccccgttggctaagtctgtgcctcggtggtggatcatcatgtcataacatggcaagacacaaggggagggacgaatcaaagcgacaagggctgaatctcagtggatcgtggcagcaaggccactctgccacttacaataccccgtcgcgtatttaa

SEQ ID NO: 101236 - DNA, 318 bp, Glycine max
  Peptide Sequence Number=SeqID_218014
atgggggagacacatgaaatgccccaccacaatctagccgacttcgagtctcgcctcggatatgccgctaaagggcaaacagttggtgatatactcttgcaaaacactttggagggccctcagtatcacccacaaccacacctcttgcattccacagcgggtaaaaaccctcatgctatggcagaaatgggaaagttggatcatctagagaaaagaattaatgaagcattgggcttgaatccagaattgggcttgggcttgaatccagaattaggcttggacttgaagagggcagactattttattctacaaaattag

SEQ ID NO: 101237 - DNA, 1629 bp, Glycine max
  Peptide Sequence Number=SeqID_218015
atggataagaggctcaatggacccaccgtttcgtccagctctaacggcggctccgccgtgggacgatcttctcctacgcttcaaccaaactacagtagccgattagttcaggaagcattggaacacttggcatccattgatctgattgagttgtgcaaagaagccaaagttgagcgctgccgagcaactcgagacttgagaagctgtggtcgctatgtccaccatgtcttgaattcatgcggacatgcctctttatgtgaagaatgtagccaacggtgtgatatctgcccaatttgtagaatcccaatttcaaaaagtggtgctaaagtgcatcttcgactttattatgaatgcatagaagcaggccttatttcgaaaaggtgtgatgagaggtttcaagaaatagaagatggggacaaacaactaactgctgacgtacagcgcctttattctctgtttgacgttgcacttgagaataacttgggcatatcaaatgtgctagacattttggagtcatcttttaagggtactctttcagcacaacttcacgatttgcagaatctccaagagagcatcatgaagacaaagcagcatatggatgttattatttggtgtacgagacatcaatttttggaagatgtgagatcacgttttactgatagttcgtcatggtcatcagttgttcggacaaggaaatcagaagcaattagacgtgcttggcctgatccaataaatcaatctgtggagtcatcaggacatgatgggtctctatttattgaagatgcaatgaataatcttgatctggaggaggggtttaggaatgaaattgtagagggattggaaattgcatccttgcagaaggacagtgaatcatttttggggtcaaatactgatcagattctgggttactatcccttcaaaaatcttcgttctgctgttgacttgctctttttacgtggaggctctgatatgtttctgtattatttatatgatcgccactggacaattcctgaagaagaatggagatacatacttgaggactttgctgctacatttagtattagcaggcactcattacttgaatctttgactttttaccttctggatgatcacacagaggaggctttacaggaagcttgtcgccttcttcctgaaataactggctcaacatcacatcctaaaattgctgaagtactattagaaaggggtagccctgatacagctctcatggttttgaggtgggctgggcgggatggtggacctcacgtgacttcactcagagatgctgtcactgcagtgcgggtgagggttgagtgtgggcttctgactgaagcatttatgcatcagagaatgctctgcaccaaagtgaaggaaaagaatttcaataaaacagcatctgggaatacttctgagaagcaaaaaggtcaatgtaataagtgggtggagtggatggaggtcctggtgactgagatttgttgcctctgtattaggaggaacttggtggatcgaatgctagaattgccatggaattctgaggaagagaagtatatacataaatgtcttttggattatgctattgaagaccctttaaggacaacaggaaatctacttgttgtgtattattttcag

SEQ ID NO: 101238 - DNA, 1014 bp, Glycine max
  Peptide Sequence Number=SeqID_218016
cgccacagatactctgaagcatatcaagttcatattaaacttgaaaaggcggagcaagattgcatttcaaaaggttccgtaagtcaacaaaatctgccagtattagagaaggctattcacttcagagccaatttgattaatagatgcttggaattgttgccagaagttgagcagcagcaactgaggagcggaaacttgactgaaggtgttgttacttcttgtgaagaagttgaaattcctgacaaatttgacgttcctcagattcaggatttcttgtcaaccagtttattgattccttcatctgtaaattcttccttgatgttgcataaagatcatccaactggcttgttgagttcattgactttaggaacatcagccaaaataggcatgtctttccctactactggcactgagctaggtaattttggttccttatcataccatcatgatgggttatttacaaataatgagagggttccaagtcatcaacgtaaaattggtaaaaatctaagaaatgataactctccaactcctaggaatcataggatccgtttcatgaatggttcacccctgaagggatttaccaggacatcaccaagcaattcccaggagaataggccggacaaaatctcgcctggagttgaacaaaataatcaaactaccagtcctatggaatcctggaaggctacagttaaccctgttactagatccacacttagctatcctaaagaatttgcaaatgatctctcaaatgtatctagtaagaatgtccaatcacataaagatgaaagaagttggaacatggggtccactaatgatccaatggatgtttctcggagccttgtagataataaattaaatactgaagaaaacatcaagggtgcacctagatggagatctgatgatgcgagtgatgaggaagatgatcgggatgtgggaagagcaatggatatagcttattattcaactcctccaactcagatgacaagacgaagcagagtttccaggagatga

SEQ ID NO: 101239 - DNA, 1754 bp, Glycine max
  Peptide Sequence Number=SeqID_218017
atgaacgtgaaaggaaaagtagtgagaaatgaatcacgtgtggaagatgagaggaggaaaagaaaagaagaaagaaatatgaaatatgaaatattcagttccgattccaatgttatcacgttttcttcttttggcacgttgaaaacacaacttaaccacataaagcatccactattctattctaattgctgttactgtaacacaacacaatcttcattcatcactgaaaccaaagccacaagctgcgacatcagaaagacattggcgagaatggaagacagtattgaccacttggctttcgagaggaacaaggcgcagttcgatgttgacgagatgaagatcgtttgggcgggttctcgtcaagactttgagctttccgatcggatttctcgccttgttgccagcgatccggccttcagaaaggatgacagaaccacgcttggtaggaaggagttgtttaaaaacaccttgagaaaagcagcttatgcatggaaaaggatcaacgagctccgtcttaatgaacaggaagcttataagctcagatcctttgtggatcaacctgcttttacggatcttcattggggaatgtttgtgcctgctatccaaggacaaggcactgacgaacagcagcagaagtggttgcctctagcttataggatgcaaataatcggttgctatgcccaaactgaacttggtcatgggtccaatgttcaagggctagaaacaactgcaacatttgatcccaaaacagacgaatttgttatccataaccccacattgacttccagcaaatggtggcccggtggattgggtaaaatatccacccatgctgttgtttatgcccgtctaattattggtggtgaagaccatggagtgcatggtttcattgtccagctgcggagcttggatgatcacttgcctctttcaggcataactattggtgatattgggatgaaatttggaaatgcagcatataacaccatggacaatggagttctaagatttgaccatgtacgaattccaaggaatcaaatgttaatgagggtttcacaggttaccagagaaggaaaatatgtacactccaatgttccaagacaattagtttatggtactatggtaaatgtgagacaaaaaattgtagctgatgcatcggttgctttgtctcgagcagtttgcattgctacaagatatagtgctgttagaagacagtttggatcacataatggaggtctagaaacacaggtgattgattacaaaacacagcaggctaggctcttcccattgctggcttctgcttatgctttcagatttgtgggcgagtggctgaaatggctttatatggatgtgacgaaaagattgcaagctaatgatttttcaacattacctgaggctcatgcatgcactgctgggttgaaatccttgactactacggcaactgctgatggaattgaagaatgccgtaaactatgtggcggtcatggttacctttgtagcagtggtctccctgagttatttgctgtttatgttcctgcctgcacgtatgaaggagacaatattgtgcttcttttacaggtggcaaggtatctcatgaagactgtttctcagctgggctctggaaataagcctgttggtactacagcttatatggctcgagtggaacaactgatgcaatatcactctgatgttaaaaaggctgaggactggttgaagcctaatgtagtgttggaagcatttgaagctagggctgctaggat

SEQ ID NO: 101240 - DNA, 549 bp, Glycine max
  Peptide Sequence Number=SeqID_218018
atggcaccccccaagaatgatgaaactgctaagaaaacaaacaacagaggagcatggaccgcggaggaagatcagaagctagcccagtgcattgaaattcacggtgcaaagagatggaaaactgttgcaattaaatcaggtctaaacagatgtggaaaaagttgtaggctaagatggttaaactatctgagacccaatatcaagaggggcaacatatcagttgaagaagaggatttgattattaggcttcacaaactgctgggaaacaggtggtcattgatagctaagaggcttccaggacgaaccgacaacgaaattaagaactactggaatacttgtttgtgcaaaaaacttaatcgcacaaaggtgaagcctgaaacttcaacagcacaagcaacacatacgactcggagtactgaggaaagagcagcggtagagaataaagagcgcattgatgatgggagtggggactcagaagttaactttgatgtgaacgaattcttcaacttctccattgaaggaccctttgcgttagattggatgatctag

SEQ ID NO: 101241 - DNA, 1196 bp, Glycine max
  Peptide Sequence Number=SeqID_218019
atgaaatatagggtttcgcacaagttccctgtgcttcctcgccacactcgtccctttaaccacactcgctacttcacttccttcgccaagaagttccaaacacctcaacctcgggcttctatcaatgccggaggaagtggaaattctcaagggaattcttttgttgtacctggagcaacagttgctaccatacttatgcttggtgttctccatgcccgccgactctacgaggacaagaagactgaacagatgaaggagaagggaatcgaaatagaattccaacctgatgcaaaggctacatttttgagattactgcctctgcgttcaatttctagatgttggggatacttgacaagcatggaaatacctgtttggctaaggccccatatctataaagcgtgggctcgagcattccattcaaatttagaagaagctgctttacctctagacaaatatgcctctttaagggatttttttgttcgcactttgaaagaaggttccaggcctattgatgttgatccacagtgtctggttagtcctgtggacggtacagttttaagatttggggagttgaagggagctggagcaatgattgaacaaattaaagggttttcatattcagttttttctcttcttggtgcaagccctttccttccaacaacagatgtgcaagaggagcatagtgaatcaataacaactactgtgaagagcaagaagtcatggtggagagtttcattggcttctccaaaagtgtggaacccaacatcatcacgagctagccagtacaaacggagcaacatgggaaggagtggaaccaccctaaatggatgcttaacttgtagaacttcaagggttattcttgaaggtctatggcaggaagggtttatggcacttgctgcaattggtgccacaaatattgggtcaattgagcttttcattgagcccgaacttcatacaaacaggccaaggaagaagtttcttcattcagagcctcctgaagaacggatttatggatgtgaaggtgtaggcagaatgctcaagaaaggggatgagttaggtgctttcaacatgggatcaacagttgtgcttgttttccaagccccaatttcaaaactccctgagggcgattcatctcaagagttcaggttctgcgtcggccgtggggatagaattcgtgttggtgaggctctaggaag

SEQ ID NO: 101242 - DNA, 414 bp, Glycine max
  Peptide Sequence Number=SeqID_218020
atggatgaagaagctaaagttgaagctccgcaagagcctacacaccaatggagtccttttgagtctctcatgattcaaaagatgaatgttatgcttcacctccatcaaaagcacttagctgacattcacagtacaatagagaacatcacaactcagctagagaacatagaaactagggtgacccttagtaccctccttaaccctgatgagatgaagcttagtgtcgcaacgtgcccttcgcgggcgagcgagggcgaggctcacgggtgcgctttccaaaggaggaaagatgcgcggagtcgccaccaacgtttatttgtgggaaacgtcgggaaaaccgaaggaaaccgtcgacaaaagcggggctcttgctcctacgtaccctccatcaaagaggaaatcagacctacgtag

SEQ ID NO: 101243 - DNA, 303 bp, Glycine max
  Peptide Sequence Number=SeqID_218021
atgtatccgctaagcgcattcaaccagaaggtagattatagaggagatctgaggaggctgcttatcttgagccagtaccagtaccagctgatggatccatcttctcctgcgccagaagtagatctcccatctacacctattcttatatctgatgaccctacaatgcgaacacctgaatggattcctactcctctaaccacacctaagcttcagttttcagataaagaagaggggcgactcactactcctccagggacgccagtgttacatttggatgatgagaagcaagatcgagatgaatga

SEQ ID NO: 101244 - DNA, 333 bp, Glycine max
  Peptide Sequence Number=SeqID_218022
atggaggagttcttcattttagtatgcctttgctttgatcacgtagatgtatgctcagttagggtcattcaacattgggaaatgaaatatcaaagaaatgaagcagaaatattggagcaggagatggaattaacagcctcagccatgatattacagacacctggggagaaagaatatgaattgttggaaaacaatagaccaaaagaaaagcccaaagtagaattaaagatccttccaacacatttaaagtatgtattcttggaggacaatgagaccaaacctattataattagcagctccttgcagaagaaagaagaggatcaactggtatag

SEQ ID NO: 101245 - DNA, 159 bp, Glycine max
  Peptide Sequence Number=SeqID_218023
atgagttcaaccttctcggcaaggctttcgcaacacccctggaacttccgaatcaaggactaccagcagggctttcgatccaacgtcagcaacaaagacattggtttgacttcgaagaaagcagagggtggcttcttatggtggagttttaagggatga

SEQ ID NO: 101246 - DNA, 1149 bp, Glycine max
  Peptide Sequence Number=SeqID_218024
atgggcatcgtccaaagactgtgttctagttggagtaacgttttcagattgggcaacaggaacagttacagttcttttaataaatctgttgatcccacaaacccatcatgttccagttcttccttcctcacgcatggaatccacgtgtttcaatgccccgatgcggttggaattgtagccaatctatcggattgcattgcttctcggggtggcaacattctctctgctgatgtttttgtacctcaaaataaacgagtcttctactccagaaatgtttttgtttttgatcctgtcatgtggcctcgaatgcaaatggaggaggatttcctaaggatctctaaaacattcaatgccatgagatctgttataagggtgccagctctggatcctaaatataagattgctattctcgtagcaaagcaggaccactgtctgattgatttgttacatggatggcaggatggaagactctcagtggatatcacttgtgtaattagtaaccattatcgaagtccagaaaatgaggtgattcgttttcttgacatgcacggtgttccttatcattatttgagaacaacagcagagaataaaagagaagaggagatcttggagctggttcaaaatactgattttttagtacttgcgaggtctatgcggatactatccagcttctttttaaggagttatgggaaggatataattaacatccaccatggcctgttaccatcatttagcggtagcaatccatctaaacaggccgttgatgcaggtgtgaaattaattggtgcaacaagtcactttgtgactgagggacttgatgctggacctattattgaacaaatgttgaatttgattctagcacattatgactatgagtctccttttacatggccaaatctcaaagctgacttcagttttaatctcatgcaaattttaacttatgctctttgggggttgaaagagtttcccatagagataacttgcagagctatgtgcagaaatcagagaaccttgagaaacaatgcctcacaagcgctatcaggtcttattgtgagcttcgagtgttgccatatgaaaaaaagaatactgtcgtattttgaggacaaacaacaattatacactctgccaaatgggggtatatctctataa

SEQ ID NO: 101247 - DNA, 342 bp, Glycine max
  Peptide Sequence Number=SeqID_218025
atgacatggcatgtggtttttttttattgtgcacttcccagtgcttctgacaggaacctgaaattctcaaggggtggagttttgcgtcctatagagaaagacgagcatgaatctcttgcttcaccaccttcagtgagggcttctaggttatcaagtccattacacgacaacctcaccagtaacaagaaaaccttttcaaaacctagagcatccttggaaaaagatgttgaacagctacagctacgcctacagcaggaaaaatctatgcgtattctgctcgagagagcaatgggtcgtgcctcaagtactttatcacctggacacagacactttgcagctcag

SEQ ID NO: 101248 - DNA, 504 bp, Glycine max
  Peptide Sequence Number=SeqID_218026
atgaaatggagaaaagcatcgggggtgttatgtgatgcaaatgtaccgatcaagctaaagggaaagttttatcggactgcggtaagaccggcgattttgtacggaacagaatgttgggcggtcaagagccaacatgagattaaattaggtgtagcggagatgaggatgttgcggtggatgtgtggtaagactcgacaggataaaattagaaacgaagctattagagagagggttggagtagtgcctattgtagagaagatggtggaaaatagacttaggtggtttgggcatgtagagagaagaccggtagactctgtagtgaggagagtagaccagatggggagaaggcaaacaattcgaggcagaggaagacccaaaaagactataagagaggttatcaaaaaggatctcgaacttaatgatttggatagaagtatgatttgccacataaaacaacaaagcttttctggtaaaggagcatgccatgtttgcctccacttataa

SEQ ID NO: 101249 - DNA, 684 bp, Glycine max
  Peptide Sequence Number=SeqID_218027
atgcaattctttggggtgtctgagattagtccttcacctcctgctccgacagcatcaggaaacaatggccatatgatgtatgtgttcaataggaatggtgtgtgcctgctctatagggagtggaatcgtcccttgcggacattggatgcccagcaagaccataagttaatgtttggtctacttttctctctgaagtcattaactgccaagatggaccccactagtgctgttgagaaaggaaaccttggtatgcttcagttacctggccaaggttgttcatttcacagtttctgcactaatacgtacaaacttagtttcatggaaagtccttctggaataaagatcatcttggtgactcatcctagaactggtgatctacgggaatccttaaagtatatctacaatttgtatgtcgaatatgttgtcaagaatccgctctatacacctggatcacctattagtgtcatccatggacattcccatcatcaactggcatcattctatgtcttaaatgcatatgataactgctttaatcatgaggaggtgcgagctgttcaatacaacgttggaccagtatgtgagaggcattgcatagatgctgagttgtttccaatcaacactgttgatgacttgtgtggttttaacgccttgttttgcatggtgtatgtgagaggcattgcatag

SEQ ID NO: 101250 - DNA, 534 bp, Glycine max
  Peptide Sequence Number=SeqID_218028
atggtgtgttttcacccaattatgttttatggccaaatgaacaattgtcattgtcttccttggtcgagtctatcctcacacgcctttgcatttggaaactcgcccagtccttctcccactaggcgtccaaaagcaagcttaaagctccatgagcatcgttatttctgcaaagttgattcacgtgtgctgaccttcgccttctcctccctcggcatccgtcgtggcagtgttgtcttcgtcctggccctgaacgtccccgtcatgtacgagctccacttcgccggcgcaattctcaacaacatcaacacccgcctctacgcccgcaccgtctccgtcatcctccgtcatgtgaaatccgcgctagtcttcgtcgactgcgcctcatgccacctcgtcctcgaagccctatctctcttccctgaaaaccaaaatcaacacccaaccctaattctcatcacagacaaaatcgtggagaaagagaaagccttacccgccgttgataatttcctcgacatcgacgaggggcttgagtga

SEQ ID NO: 101251 - DNA, 336 bp, Glycine max
  Peptide Sequence Number=SeqID_218029
atgtcgaggaaattatcaacggcgggtaaggctttctctttctccacgattttgtctgtgatgagaattagggatgacggagacggtgcgggcgtagaggcgggtgttgatgttgttgagaattgcgccggcgaagtggagctcgtacatgacggggacgttcagggccaggacgaagacaacactgccacgacggatgccgagggaggagaaggcgaaggtcagctgaaggcatcaatggcacgtgaaggtggtgtcattgtaggtcaacatccaattgaggctttagggactgacattgtagaattttataaaacagggggacccaatttgtga

SEQ ID NO: 101252 - DNA, 948 bp, Glycine max
  Peptide Sequence Number=SeqID_218030
gttaatgagaagttttccacaaaggagaaaactccagcattgcgaactttaaaagatcatctaaaccagtgcccaaacaggctttctgaggagatggtgaagtcatccactcatgctgtacagccaagacatggttttgggaatgatcgagactgttcttgcaaatcagtagtggaaatatcttggatagctactcgtaaacgtcattcttctcatgcttcttacgccattgacaactacagagtactggtggaacaacttgaaagggtgaatatcagtcaaatggaaagtgatggacaaattgcgttctggatcaatgtgcataatgctcttgtgatgcacgcatatttagcatatggaattccccagggctctctcaagaggctggccttgtttcacaagggttatggggatggcggtaaccagggcaggggtggtagttgtggtagacgtgggaaagtagtggtggtgacagaatggcttgaaagctttttgtctgctgccctgaggaagaaaaatggtgaagaaaaacagcttatcagctcaaaattgtgtattactgattttcaaccccttgtttgctttgctctttgcactggggcattgtcagatcctgtgctaaaagtctacaccgcatcaaatataagagaacagctgaatattgctaagagagagtttcttcaagcaaatgtagttgtgaagaagtcaagcaaagtttttctccctaaattggtggaaagattttctagagaagcgtcaatcagtttagatgatctccttggatgggtcatggaaagtgttgacaagaaactgcatgattcaatacagaagtgccttgatcgtaaatctaataaaaaatcatctcagatcatagaatggttgccttacagttctaggttcaggtacatgttctcgaaggatctaatagacaagccatggtgggtataa

SEQ ID NO: 101253 - DNA, 708 bp, Glycine max
  Peptide Sequence Number=SeqID_218031
atgaaaaagcaggatttgagcccagatggagaacggaagcgagggaaatgtcctcttactcctcatgaagtgggtttgatgctgcaggcacttggcttttcaaaagatacatacctctatgttgcgtcaggagaagtatatggaggggaagaaactatgcagcctctcagagatctttttcccaacatctatacaaaggagatgctagctgaggaagagctgaaacctttccttccattctcttcccgccttgctgctattgactacattgtttgtgatgaaagtgatgtatttgttactaacaacaatggtaacatggccaagattcttgcaggtcgaaggagatatatgggtcacaaaagaacaattagaccaaatgcaaagaagcttagcacgatattggcaggaaggcatcaaatggactgggatacctttgccaaaaaggttaagtcatgccagagaggattcatgggagagccagatgagatgagacctggtcgaggtgaatttcatgaatttccaagttcttgcgtgtgcaagagaccatatgtggatgaagaactcagcaaagagcttattcctcctcgaatggaattagaagaggcaggacatgaagttaacttgaaccatgaggttatcgggagggggggaatcaagagttatctcgctctgttaatgccaacggaacgtcaattgaaaattgaataa

SEQ ID NO: 101254 - DNA, 4071 bp, Glycine max
  Peptide Sequence Number=SeqID_218032
atgaactttgctggcaaaattttatgtggaaaccaaatttccatatcttctgcttttgtactggactcttacattgagttgtgtgagacaggaggtggaagcctttcccaaactgaaaaggacaaaaatcaagttgaggcttctgctaatcagaacacccaagtttctgaggtgataaatggtggtccgaaaaatacattgtctactgctgaagatctaaaggagaataatgcatctaaagatgaaagaaggtcaactcctgaggtaaattcagtgattgatttgtccaaaaaggatgttgcagatgatgttggcaagatgcaaccaattcctgttactgaaaccgtcaaaacatcatcagctatggagggatctccttcaacttttgggcgaggtccctcaaaaaccaaatctgttggagaggtagcaacaaatggtgcttctaaagctacggctgagcgcaaaactaggcgagcatctaataagagtgctggaaaggaatcttctagaagaggaagtcatgcaaaggacactaaactggctagacagactgatagaggtgataaatcaaccaaagtttccctgagcccatctcctggttttcagatgatgcagtcaaatgaggtgcagcagtttgggcatattgactcaaatagtacaaagtcatttgctgttgtaaatacttcaacatatagcattccagatttgaacacttctgcttctccacctgttttgtttcatcagcctttcacagatcagcagcaagtacaattacgtgcacagatctttgtatatggagctttgattcaaggcatggtaccagatgaggcttatatgatatcagcttttggaggatcagatggtggaaggagcctttgggataatgcttggcgtgcctgcatggaaaggcaacatggtcaaaaatctcatcctgctaacccagaaacacctctgcaatcacgatctgttgctagaacctctgatttgccacataagcaaagtgctgctcaagcgaaaggtatctcttcgccacttggtcgaaccagcagcaaggctactcccccaattgtaaaccccttaatacctctttcatctccactttggagtctatcaactctaggtctaggtagtgattccctgcaatctagtgccattgcaagaggttctgtcatggattatccacaagcaattactccattacacccttatcaaactactcctgtgaggaattttcttggacataacacaccttggatgtcccaaaccccccttcgaggaccatggattggttctccaactcctgcacctgacaatagcacccatatttctgcatcacctgcctcagatacaattaagctaggttcagtcaaaggatctctgcctccttcctctgtcataaagaatattacttccagtctccctacttccagtacaggtttgcaaagtatctttgcaggaactgcctctctgcttgatgcaaacaatgtgacagtatcacctgctcaacactcttcagatccaaagcccagaaaaagaaaaaaagttgtggtctctgaggatctaggccagagggcttttcaatcactggctcctgctgtcggtagccatacatctactcctgttgcagttgtggtccctgttgggaatgtgccaataactactattgaaaagtcagttgtgtctgtatctcctcttgctgatcaatccaaaaatgatcagaatgttgagaagaggattatgtcagatgagtctcttttgaaagttaaggaggccagggtacatgcagaggaagcttctgctctctctgctgctgcagtgaatcatagcctagagttatggaatcagttggataaacataaaaattctgggttgatgcctgatattgaggctaaattagcttctgcagcagttgccgttgcagctgctgcagccattgcgaaggcagcagcagcagctgccaatgttgcctcaaatgctgctcttcaagcaaaactaatggctgatgaagcattgctttcatctggttataataattccagccaaagtaatcaaatttgtctttctgagggtaccaataacttaggaaaagcaacccctgcttccatcttgaaaggtgctaatggaaccaatagtcctggttctatcattgttgctgccaaggaagctgttaaaaggagagtggaagctgcttcagctgccaccaaaagagctgaaaatatggatgccattgtgaaggctgctgagctggcagcagaagctgtatctcaagcaggaaaaattgtaactatgggtgatcctttgccaataagtcagttggtagaagctggcccagagggatgtttgaaagcaacccgagagtcttctcagcaagttggattattcaaagacattaccagagatatggtgaacattaatgtgagagatattcctgaaacttcttatacacataacagagacattttatctggtggcatttctgctagtattaagatcaatgaaaagaattcaagaggaccaaagggacgcaaggttgtttctaatttagtcaagcctattcatgtggttcctggatctgagcctgaaattcaggctccttttactgttaataatggatctgaaaatctggtggaaagtagcatcatcaaggagggcttacttgtagaggttttcaaagatgaggaagggtttaaagctgcatggttctcagccaatattttgactttgagggatgataaagcttatgtaggctacacttcacttgtagctgctgaaggtgcagggccattaaaggaatgggtttcacttgtatgtgatggagacaaacaccccagaatacgtactgctcgtcctcttaatactttacaatatgaaggaacaagaaagagacgtagagctgctatgggagattatgcatggtctgttggggatagagttgatgcatggatacaagaaagctggtgggaaggagtcatcacagcgaagaataaaaaagatgaaacaacatttactgttcactttcctgctagtggagaaacgttggttgttagagcttggcatctccgtccatcccttatctggaaggatgggaaatggattgaatcttccaaagtgggggcaaatgacagttctacccatgagggtgatacaccaatcgaaaaacgacctaaattgggtagtcatgcggtagatgtaaaagggaaagacaagatgtcaaaaggcagtgatgctgtggagtcagcaaaacctgatgagatgaaattacttaatttggctgaaaacgataaagtgtttaatattggtaagagcagcaagaatgaaaataaatttgatgcacacagaatggtgaggactggtcttcaaaaagaaggatcaaaagtaatttttggtgttcctaaaccggggaagaaaaggaaatttatggaagtaagcaagcattacgtggcacatgaaaacagtaagatcagtgatagaaatgattcagttaaacttgcaaatttcttgatgcctccaagttccggacctagaggatggaaaaatagttccaaaaatgatgccaaagagaaacatggagctgactccaagccaaagacaagtcatactgaaaggattaaggattcttcaaatcaattcaagaatgcttcccagagtgaaagtaaggtggagagagcacctcactctgcaagtgatggagcaacaggatcaatcttgttttcaacgctggcaacttcggtggatgctcatcccactaaaagagcatcctcatcaagagcaagtaaagggaaacttgcgcctgcccatattaaatcaggtaaaggtgagatggaaaaggctttaaatgacaatcccatgaaatcagcatccgacgtggttgagccccggagatccaatcgcaggatccagccaacatcaagactattagaaggattgcagagctctttgatcatctcaaagattccttcggtttcacataatcgtaatactaagagctgtgctgtatatcgatattctccatgttaccttggtggtagagtggctaaagatgtagaatgggaaagtttcatttatagctaa

SEQ ID NO: 101255 - DNA, 1677 bp, Glycine max
  Peptide Sequence Number=SeqID_218033
atgcgaaggtttctctttctctacaacgaagcacgaaaattccgcaaacctcatattccccttgcatttccatcgcccttagcttatagtactagcttgaatcatactcataatatcggagacagtaaattcaatttggtggatgtttctgcccaaggtggaaccaaagctgagtttgcgttatttgaagcctctcgtggaattaaaccaaattcctttgctcttgtcaacctacttggactagtcagtaacctgaactgtgcctcattcggacataaactccacagttatgttatacgttctggctatttttcacatatccatgtctcaacttccctcaccaaattttacccagtttcgaaacgctttgtcgttcttcacgcgcctagacaagtcctacgtttgtgccgacgcagtctcgttcacatctgctttgtctgcctgttcccaactgagtctcttcaacttggaagctcaattcattgcaaaatagttaaacttggcatggatgatggcactgtggttgcaaattgcttgattgacatgtatgggaaatgcgggtttgttgaacgtgctgttcaggtattctctcagaccattgagaaggatgttatttcttggaattcagtcatagcagcaagtgcaaacaatggacacattgaacttgcttacaagtttttgcaccttatgcccaacactgatactgtgtcgtataatgggttgataaatggaattgctcagtttgggaatgtggaagttgctgttcaggttttgtcaagcctgccaagtccaaattcgtcttcttggaattctgtaattacgggatttctggatacgaatcgagctagggaagctttggatatgttccgtaaaatgcacttgagaaaagtagagatggatgagttcacattttcaatcattttaaatggaattgcttgtttgtctgccttaacgtgggggatgttgattcattgctgcacaataaagtgcggtttagatgcttctgtagttgttgggagtgccctaattgacatgtactcaaaatgtgggcaggttaagaatgctgaatcaatcttcctccatgcactgcctaacaagaatttggtgagctggaatgcaattatgtctggttatgctcgcaatggtgattctgcaggtgttatccacctcttcaagttactgaaaatggaaagagatgtaaagcccgattgtatcacgtttcttaaccttaaccttatatcagtatgttcccatagtgaaataccatttgaggttgctattcgttactttgaatctatgattgatgaatataagattgcaccatccattgagcattgttgttcaatgatacggctcatggggcagaaaggagagctgtggagagcagaaaggttgatacttgaacttggttttgagtcatgtggggtggtttggagggctttgcttggtgcttgtggaacacaggcagatttacaagtagcagagattgcagctgccaaggtgattgaaatggatagggatgaagattatgtttatgtgatgatgtctaacatgtatgcatcttgtggaagatgggaagatgtaaatgtaattaggggactcatgagtaggaaagaagttaggaaagaagcgggttctagttggatagaaattgatagctctgtctcgtctctatga

SEQ ID NO: 101256 - DNA, 1017 bp, Glycine max
  Peptide Sequence Number=SeqID_218034
atgagtaggggagctatggaagatgtagcaataatcggagggttgataggagtccaatttatctacgcagggaatgctgtgttgatgagttattctatgtcattgggattcagctctcttaccattatcattttaacttctttggcaacattccttattctattccccattgccttttttgttgaaaggagtaggtggcccaagcattgcagtttcagactagtcttccagtatttattcctcaaaggaatcaatctaacttcgccagcaatgggaactgccatgccaaacattgccccaggtcttatcttcatcatcgcatggatttccgggttagagaaagtcaacttaagcaataaatatagtcaagtaaaaatcttgggaacattgctttgtgtgttgggagctctcacaatgagcataatgcaaagcatttctgctcctgcaacagtgaaaaatgacacagtcgaattaacaccgccaccatctgcttttacctttgacatacagaagataatcggttgcctctatctcgtggttgcagtcttcattttgtcaagcaacgttgtcctgcaggcttttgctctaggagattttcctgcacccatgtccttgggtgcaataacgtccttgattggggcgttcatgactgcaatttttcagtttcttgaagaccacgaagtgaaaaccagttggctgcttgtgaggtctggagacttaattggcttttttattctggcaggagctgtgagtggaatatgcctgagcttcaatgggtgggcactgaagaagaaagggccagtgtttgtctccatgtttagcccaattggtacagtttgctctgttattttctcggtagttaccctagaagacactattaatattggaagtcttgaaggcatgtttctcatgttcactgggctctacttagttctttgggccaaagggaaagaaggacacccagatggagatggcttagagagtgagtgtgatgcagagacgcctcttttatcttaa

SEQ ID NO: 101257 - DNA, 891 bp, Glycine max
  Peptide Sequence Number=SeqID_218035
atgtcggaactgaaaaagtacttccaccgcttcggctacctctccctccccgaaacgacgccgaatttcacagacaccttcgattctcaattcgagtccgcgctcgtccgttaccagaagcgcctcggcttgccggtcaccggaaaactcgactccggcacgatttccgcgatcgtggcgccgaggtgcggcgtctccgacgccgcacctcacggatttcgcgccacgcgtcgctacgcttacttcaacgggaagccgcgatggacgcgcggaactccgatgactctcacgtatgctttttctccgtacaacatgatcgaccgcgtgagcgtgccggaaatccgagcggtgttcgagcgtgcgttcgcgcggtgggcgtcggtgattccggtgagtttccaggagacgccggagtacgatagggctgacatcacgatcgggttttacctcggggatcacggcgacggagagccgttcgatggagttttaggcgttttggggcacgcgttctcccctcagaacgggagattccatttggatgcggcggaaacgtggtccgttgatttcgagcgcgaagcgtcgagggtggccgttgatttggaatcggttgccacgcacgagataggtcacgtgcttgggttgggtcactcttcggtgaaggaagcggtcatgtacccgagcctcagccccaggagaaagaaggttgacttgaagattgatgacgtggcaggagtccaagctctttatggctccaacccaaactttacttttagttctttgttgcagtctcagaattcattaaacgctgctgttgggttggaaaccggtttctataaatggaccctctctttgcctcttcttgccttgttcgcattatttttatctgcttga

SEQ ID NO: 101258 - DNA, 1155 bp, Glycine max
  Peptide Sequence Number=SeqID_218036
atgagcaagggcgatccgaacttcaagtgggtcttacctaactccgactgggaccctatgattctcaactacacttcgggaacgacgtcgtctccgaaaggcgttgtccactgccaccgtggagcgttcatcagcgcattggatactcttatcgactgggctgttccgaagaaccctatttatctctggacgcttccgatgttccacgctaacggctggaacttaacgtgggggatcgctgctctaggtggcaccaatatttgcgtccgcaagttcgacgctggggttgtttactctctcataaggaaccatcacgtaactcacatgtgcggcgcacccgtggtgctcaacatgttaaccaactctgataagaggccattggagaagccggttcagttcatcacagccggagcgccgccgcctgcggcggtgctcctccgagcggaggagtttgggtttgtggtggggcacgggtatggcttgacggagaccggcggaatcgtggtatcgtgtgcatggaaaggaaagtggaacaggctgccggcgacggagagggcgaggctgaaggcgcgacagggggtgagaactgtcggcgtgacggaggtcgacgtggtgggtcccacgggggagagtgtgaagcgtgacggagttagcgtcggggagattgttgtgaaaggagggtgtgtgatgttagggtacctaaaagacccttcaggaaccgcgaggtgtttcaagaacggtcggttctacactggggatgttgctgtgatgcatgaagacgggtacttggagataaaagataggtcaaaggaggttatcattagtggcggtgagaacttgagcagcgttgagttggagtcggtgttgtacgggcacccggcggtgaacgaggcggcggtagtggcgagacctgacgagtattggggagagacgccgtgcgcgttcgtgagcttgaaggcggcgataaaagagaaagagaaactgacggagaaggacatgattcagtattgtaaggacaacatgccgcattatatggttcccaaaacggtggttttcaaagacgagcttcccaaaacgtccactgggaagatccagaagtttgtgctcaaacaaatcgcaaacaacatgggatccctcaaacatagtcgaatttga

SEQ ID NO: 101259 - DNA, 303 bp, Glycine max
  Peptide Sequence Number=SeqID_218037
atggtaaaagtagttgttgcttccttgcagactcccatgggaggtaaagacatctttctcctcttgaacctcatctctctccaattaggtccctccaaacttgatgttttggctgcttcatttgatcctcaagtggcatttacagtcaagaactcttctctgacaatacctaagttggcaaaaaatatagactatggattgcttagtcacagatattctctaggatgcaagaaatgcaagcctaccagtcaagattttgatcccccatatagcatcaatcaagttttttgctggtgcttctaa

SEQ ID NO: 101260 - DNA, 1662 bp, Glycine max
  Peptide Sequence Number=SeqID_218038
atggatgacctaaccccaaaccccgcaaactcaccacccctcactccactcaccttcttggaaagagcagcaatcgtctacggcgattcccactccatcctctacaaccgcacttccttcacctggtctcaaacccaccgtagatgcctccaactcgcttcctccctcacatccctcggtctaggacgcggccacgtcatctctgttctctctcccaacactccttcaatgtacgaactccacttcgcggttcccatgtgcggtgccattctcaacaacctcaacctccgtctgaatcctcacatactctccgtgctcctccgccacagcgaatcaaaactcgtcttcgtccattcccactctcttcccctcatcctccgcgccttatccaacttccccaaaaccacgccacgcccttccctcgtccttatcacagacgatgcagatgcagtcaccgtctcactcgcacacgtcatagacacctacgagggccttataaaaaagggtaacccgaacttccactgggcccgccccaactccgagtgggacccaataaccctaaactacacctcgggaacgacgtcgtctcccaaaggcgtagtacactcccaccgcgcaaccttcataatggccctagattcactcatagactggtgcgtgccgaagcaaccggtttacctatggacgctaccgatgttccactctaacggctggaccttcccgtgggggattgccgctgcaggcggcaccaacgtctgtccgcgtaaaatcgacgcgccaatgatctaccatttgatccaatcacacaacgttacacacatgtgcgccgcgccggttgttctaaacttgctgttaacgagaaccgagccggtgaagaacccggttcacgtcctcaccggcgggtcaccgcctccggcggcgatcctcactcgcgcggagaagttaggatttagggttcgccacgggtatggcatgacggagacactaggagtggtggtgtcgtgtgcatggaagaaggagtgggataagtttccggcgacggagagggcgaggtttaaggcgaggcaaggagtgaggacggtggcgatgacggaggttgacgtggtggatccagccaccggagttagcgtgaagcgcgacggtgtaacctccggtgagatagttttccgcggcgcgtgtgttatgttaggttatttgaaggattcagatggaacaaaaaggtgcataagaaataattggttgtacactggtgatgttggagttatgcatggggatgggtatttggagattaaggataggtcaaaggatgtgatactaagtggtggtgagaatttgagtagcgtgcaggtggaggcggtgttgtacgatcacccggcggtgaacgaggtggcggtggtggcgcggccggacgagttctggggggagacgccgtgcgcgtttgtgatgctgaaggaggggctggtggcgccaccgtcggagaaggaggtggtggagttttgcagagagaggttaccgcactttatggtgcccaaaacggtggtgtttaaggaggcgctgccgaagacgtcgacggggaagattcagaagcacgtgctgaggatggacgcacaggctatggggtccttggcggctccacaaccaacaatacctagtcgcatgtag

SEQ ID NO: 101261 - DNA, 2019 bp, Glycine max
  Peptide Sequence Number=SeqID_218039
atggcttcgaatcctccattgcacatggaggatcagacggatgaggatttctttgataaacttgttgaggatgatatggagcctgttaagtttggccatgatgaaggggatgattccgatgaggctaaagcatttgcaaatctgggaatcaatgatgttgatgctgctgcatttgagaattctgctgctgctgagagtggtgttaaagtcaaaggggaattaggtaatgtggaatccgatgtaggacttgaacagaagggaaattcagtgcccgccatgagttcagttgggtttgatagtaaggtggatcccggtgaggatgggagtggggtgggatcagaagtcacatccgctttagctgtaggcacgagcgatacagtcggtaattctgggattaaggaggtgggttggaattcttttcacgctgatttgaatggagttggcgggttgggatcatattctgactttttcagtgagttgggagatcagtctggggattttacggggaatgtgtatgataatttaagtactgaggtgaagcctggtagtgaagttcaaaataatggcttaaatgcctcgggtaattatgtgcaatatcaagagggtcaaggttatgatggatctttagaaaaccactcaaacaggcaaggtaatggattaaatgaatcagttaatcatgtacaatatccagaagatcaagcttatgttgcatcttcagaagaacacgcatatggacaggatctgagtagtagtcagtattgggaggatctttatcctggctggaagtatgatcaccagaccggacaatggtatcaaatagatggctatagtgcaacagccactactcagcaaagctctgaagtcaatacagctgcagattggactgccgcttctgatagggaaacagagatctcttacatgcagcaaactgctcaatctgttgcaggaactttagctgaaactggcacaactgaaaatgtgtctagctggagtcaggtttccgaagggaataatgggtatccagagcatatggttttcgatccacagtatcctggttggtattatgacacaattgcccaagaatggcgttcattggaaacttacaattcaaccatccagtcttctggtcttggacttgaaaatgggcatgcttctgccagtactttcttgcccaaggataatagtttgtatagcgaatacagccaagctgataattatggatcacagggcattgatagtcagactgtagatggaagctggagtggtttgtatggcactaaccatcagcagggttttgacttgtacacaactgggtctgccactacaagaggggataatataacttcgggtggcaaccaacaaattaatcattcttatggttcaagtatttctgcgaacaaaaatcagcaaagtacttctagttcttttggatccgttgcattgtacaatagagtaaaccatgatcgtggtttggccaatggaacttttgaaccaccaagctttggtcctactggggacactgttcaacagtttaattattcaaccacaaagtttggtgaacaaaatgttttttcaaatgattttactgaaattcaaaaaccctttagttattcttcacaatcaattcagggtgggcatcagtattcacataaccctcatgttgggagatcatcagctgggcgtccttctcatgctctggattctgtacaaggttccatttctgtgttgaacttgattgaagttgtcacgggaaatatggattctttgagcatcggaaataataccagtaattatttccgtgctctgagccagcaatcattaccaggtccattggttggcgggagtgttggaaataaggaactgtacaaatggttagatgagaggattgcacactgcgaatcacctgacatggattataagaaaggtgaaaggttgagactccttctttccttgcttaaaataggttgtcaacattatggaaagctacgttctccatttggtacagacactatactgaaa

SEQ ID NO: 101262 - DNA, 279 bp, Glycine max
  Peptide Sequence Number=SeqID_218040
atggaaagtcattttgaaataaagacaagtgtcaaagaaagggttttgccgatgttagaggaacaacctccacattttctcctttgtaaaaagacacttgttagcattgtggaagcaatgtcttccaaggttattttaatgatgccaaagaatcaatcaagagttaagcaaagtttcaagtttcaagattcaagattcaagaatcaagattcaagaaaagtcaagatcaagattcaagactcaagattcatgaatcatgagaagactcaatcaagataa

SEQ ID NO: 101263 - DNA, 2331 bp, Glycine max
  Peptide Sequence Number=SeqID_218041
atgggtacatgtttgagcaagaagaatgggtcctcaacctcacccaacaagtcagtttctcagcataggaattctgagaacagtgtcattgtcaccttgtccaaacccactgagccagaactgagcctcaagaacaagacaccacaagatgaagtgaagaaagagatattcatcatcaaaccaaggaatagccatgatgatagagaaaaaacaacaacaacatcaaaaacccaacctttcattgctcagtcaccagcaccaaaacaaggtgatggggttttcatgaccaatgaagaaacaatggttgttaacaagaccattgcaccatccacaccaagcattggtattgtgggagtgaggacttcaagctgcactaaagaagaggtggatgaaattctgatccagtgtgggaggctcagcagaagctcttctgggagaaagtactctggctccaagagaagttttgattttgaccactgtgataatgacactacttctgctgaggatgaccaaagaaagtccaagggcaatggcaatggcagggaggagaatgatgtggcgggggagagctgccgccaccgccagtccccgaggcggtcgtctcagggaaggagaaggactccaagtagggaaagagaccaatccaatggcagagaaaggaaagtgagtagatctcctggtagaagatcatctgacaccaccaatactacaaatgcaagcaacaacaacaacaacacaagttctaggcctgggaaaatggtgtctgttccagccactgtttcatctttggttatggataagagcaacagctgtggtggagattctggcaccaagaagatcactactgttaagaggaatgttggtgatgctggttcaaagggtgctgcatcaccacgtgctcaatctcctgctagagttaatggaaatgtgggaagggataaaatgttgaatgagaatctgcagcagcagcaccaacaacaaccctctcttagccgtaataactcttcaaggaaagtagaacaatctccttacagaagaaaccctcagagtgaggtggatcataactcttcaagaaaagctgaacaatctccttattctaacagcaaggtgcaacaaaacaagcccaagattgaagcagaagccattcagaaaccaaatggcagagttgcattggagaagggtgtgagtgtgaattgcaagacaaaggagcaacatgaggaagaagagtcttcagtgcctattagtgctgttgtgaagacaacagcagtgtcatcaggggttgacaaccttaaaccccaaggcttaacaagaagcagatcttctagaagatctagagacttagacaccaatgctacaaactcctatgcctccctactacttgaggacatccaaaatttccatcaaaagaacacacaacaacaacaacaacaaccttcttctgtttctctcccagcttgtctcaacaaggtatgctctatccttgaagctgttgctgatctcaactccaccaccagctcaaatttcactgaggacaagagaagtccatccactcagcaatccaatattaggaatgatgagtactatggaaagaaagtggcaggttccaacaaggacccttttgtggaatctgaggtagctgttagtgatgatgtgatggaaccaagcttgcacaagtatgtgacagtgaaaagaggtggtggtgtagtagtagaagacatggaggaccaagagtcttcaggaagcaacagcttcactgtgagtagtagcagtggccaacatcactgggggaacaacatttcttgttcttcatcatgggaaccaaattctgctgactccaccgattgctggacttcttcaagattgagctccagagaggaggaggctcagaaaacacccttaggattgggatgtagtttgtcatctgaagccaagaagaagaagaagggtttgaacagcaaaaggagagagtgtgatcatgaacatagcggtggcattggacgtggcaggcttggttccaataaagggatgttcaatgaggtgttgacatttcttctgtttggagttgcgtacttgcaactgtttcttgtttcagcaaggccaattcaagttgatctctctcatctttgtcatgttacttgtgctgtttatgaacaatttgtcattcttcctaaagttgtggtttctccacaaggaaaaacaagtgatttcacatactctacgtatataaacttaaatcaatattttagcacacagaaggtcactccacaaggaaaaacaagagattgctcaaacctcatgactacaactccaaggcctcttccttcgtactga

SEQ ID NO: 101264 - DNA, 768 bp, Glycine max
  Peptide Sequence Number=SeqID_218042
atggcagaccctcagaaaattcaccctgtgcaccatgatgttgaggcacaaaaccacccttcagcaccattggtgccaaggagcatgtccaaatctgatgcaggtgatccacaacgagtagtagtacaacaacaacaacaaaacattcctctgaagcaaaccaagccaccaccgaagaaaagaagaagctgctgctgcaggttcttctgttggctaataagcatattgctgattctgatagtggcaattggcatcactgttggaatactctaccttgtcttcaggccaaagcttccaaagtactcggtggacgaacttagagtcacacactttgatcttgcagacaacaacagcttatcagtgacattcaacttgacaataaccgccagaaaccccaacaaaaaaattggaatagactataggggtggcagccacataagtgcttggtacatggacacaaaattgtgtgaagggtctttgccaaaattctaccaaggtcaccgcaacaccacggtgcttagcatccctcttactgggaaaacgcaggatgctaccggcttgcaaagtacccttcagaatcagctgcaagaaagtgggaatgtgcctctcaatttgaaggtgaagcagcctgtgaggatcaagcttgggaagttgaagctgttcaaaatcaagttcagggttaggtgcaagattgtggtggatagccttagtgctaatagttctatcagaattcagagtagtagttgtaaattcaggtttaggctgtga

SEQ ID NO: 101265 - DNA, 2181 bp, Glycine max
  Peptide Sequence Number=SeqID_218043
gaaaatgatactcctgagtcagcagttgcaaaacattttgcatctgccaagatgagtggcacagagttccctcaatatgggatgccaagcaactgcttgcaaaatttgccttctgaaggacaaatgagggcaatggctcttgaggttcaaaatcttcttgtctctgggaaaaagaaggaggctttacaatgtgcacaagaaggacaattgtggggacctgcacttgttctggcttcacaacttggtgaacagttctatgttgatacagtgaagcaaatggcacttcgccagctggtttcagggtcacctttgcgcacattatgccttctaattgctgggcaacaagctgaaatattctctactgatacctcaaatagtgggcatcctggtgcttctgatatgtctcagcagtctccacaggttggatccaatggtatgcttgatgattgggaggagaatctggctgtaataactgcaaacagaaccaaaggtgatgaacttgtaattattcaccttggtgattgcttgtggaaggaaagaagtgagattactgccgcacacatctgctatttagttgctgaagcaaactttgagtcatactcagatagcgcaagactctgtctaattggagcagatcactggaaatgtcctcgaacttatgctagtccagaggctatccagaggaccgagttatatgaatattcaaaggtggttggaaactctcagtttactttgcatccatttcagccatataagcttatatatgcatttatgctagctgaagtgggaaaggtttcagactcattgaagtactgccaagcactactgaaatccttgaaaactggccgtgctccagaagtagaattgtggaggcaattagcagtatctcttgaggagaggattagaatttaccaacagggtggatatgctgcaaatttagctcctgcaaaattagttggcaaattgctcaacttttttgatagcactgcacatcgagttgttggtggtttaccaccgcctgctccttcatcatcgcaaggaactgttcatggaagtgaacatctataccaaaatatggcacccagagtatcctctagccaatcaacaatgtcattggctccatctgcttcaatggaaccgataagtgactggacagctgacaataataaaatggcaaagcctaatagaagtatttctgagccagatattggtcgaaccccaagacaggaaacaacgtcacctgatatacaaggaaaagcacaggcatcaggaggtacatctcgcttttcccgctttggttttggctcacaacttttgcaaaagacagtagggctagtcttgaaacctcgctctggtcgacaggctaaattgggtgagaaaaacaagttctattatgatgagaagctgaaaagatgggtggaggaaggtgctgaacttccagctgaagaagctgctgctctgccaccacctccaacaactgctgctttccagaatggttcaactgaatacaacttgagatctgcattgaagactgaaagttctcctcctattgagggctctaacataagaactgctagccctgaactcagtccagggatgccaccgataccacccagctcaaatcaattctcggcccggggtcgtttgggtgttaggtcaaggtatgttgacaccttcaaccaaggtggtggaacctctgcaaacttgtttcagtccccttctgttccatccgtgaaaccagttctggctgccaatgcgaagtttttcgttcctactcctgcaccatcatcaaatgagcggacaattgaggctatagtagaaagcaagcaagaagacaatgcaacaaatgaatatccttcaatctctaccacaaatgagtggtcataccaatccccaaaacatgtatcatcaacgaccatacaaaggtttccaagtatgggtaacatctcaaaccaggtagcagcagatggaaataactctcatttacctcattcacgccgaacagcttcatggagtgggagttttaatgattcatttacccctcaaaaaatgggcaatattaagcctttaggggaagctttgggcatgcccccgtcaagattttcgcctgatgaatctttaatgcataaacctgtgaaaagtagcagttatggagaagatcttcacgaggttgaattttga

SEQ ID NO: 101266 - DNA, 540 bp, Glycine max
  Peptide Sequence Number=SeqID_218044
atggatgacacaggtagcactcgaccacgtatatgtgatggcgtaattgatgacaagcctcctatactctcacttccctctgatttgttggaagaaattattgcaaaagctgcatctaaatcctctattgacctagttaacatcaaactttcttgcaaagattttctgcatgcatccgaagcaaacaacgtttggaaaaacgtgtcattggaggactttccatcaggttggtaccctcatcaaacggctattgattttttgcaacattgcagggaaaagggcaacattgacattctatatagagatggagtgaaagaattttgcaattatttagttgcgaatgttagtggccatgagaagctgaagtatgctgctgaatgtgatctcaagcaagcaaaatacctatacgagattatattgttgtgctcagatgataatgaaacgagacaagaaggaatgcagcatttgcgtgatttagtaacgaacaagtgttttttggagactaagcgtagtgtgtttaattttctcggcaatttttag

SEQ ID NO: 101267 - DNA, 1151 bp, Glycine max
  Peptide Sequence Number=SeqID_218045
aaatcggtgtgttggtcgctgctgttcatcctgctgctgtacttcatggcgccggcgctggcgctgctggtgaagtacgaggtctatacccaggtggtcgggtccagcttcctcagcctgccgaattgggtgcacgcctggagcgccgtggacagcaacctgctggacgtgaccgatgtcaatcgcgacggcatcgtgcaattgagcgagatcagcatgggcgccgacgtagtggtgctggccatgccggaaatcggcggcttgccctacgtgatttcggccctgatcctgttgctgctggtggccttcggcgccgcgtgggtggcggcgcgcaagccggcggacattctgttcatggtgtcggccgcgttttcgttcgcggcctcgtcctttttcccggcgctggtcatgggcgttttctggcgccgcgccaacaagtggggcgctacgctgggcatggcggcggggctggcggtgacgttcgcctacatgacccatacgcacccgtggctgcgcgagtgggtgttgggcatttcgcgcacgcagcctgtggacctgtggtggggcatccagccgatcgcggccggcgtgttcggcgcaccggtggcattcctgacgatcatcgtggtgtcgctgctgacgccgccgccggaccgcgccacgttggcgttggtcgggtgaatcccgcaggcgtgcggaacgctcggggcggctcagtgcgacacggacttcgagaagacgttcatgaccaccacgccggcgatgatcaggccaatgccgatcaacgcgggggtgtccaggtgctgcctgaagaacagcgcgccgacgatggagatcagcacgatgcccacgcccgaccagatggcgtaggcgatgccgaccggcacctcgcgcagcgtcagcgacaggaaatagaacgagatcatgtagccgaacaccgtcaccaccgatggcaccaggcgcgaaaaaccctcggagcttttcagggcgctggtggcgaagatctcggcgacgatggcgatgcccaggtagagccacttcatttgcgcggcccttccgattgccgcagcagcaccagcagggcgcccgcgccgccttcgcgctcgggcgcctcggaaaacgccagcacttcgttcttctgcaccagccag

SEQ ID NO: 101268 - DNA, 125 bp, Glycine max
  Peptide Sequence Number=SeqID_218046
agttatgggaattttacggaagcattacgggtgtcccggaagttccggaagcccatcttttaacaaaacgagggaggtggttgccacctagctcgcccaggcgagctaggttgcttccaccttaa

SEQ ID NO: 101269 - DNA, 1083 bp, Glycine max
  Peptide Sequence Number=SeqID_218047
atggcagacaacacccgtatgaaggaggtttatgcagaattgaagaaaaacgctgatgcgattactcgtgttagtgacgatcttcagaaccatattgaacggttggaagctacaaatcacgctcagatggagaagattgaagtgatgcagtcgacgaatgattctcaattctcacaactgaatgcagtaatgtcacaggtgctgcagcgtctacaaaacattccgatgtcttcccatggtgcatcgaactcacagaaagagcagcagagaagttcgtttcaggtgagatctatcaaacttgattttcctcgctttgatggaaaaaatgtgatggattggatattcaaggctgaacaatttttcgattactatgcaacaccagatgctgatagattgattattgcttcagtacatttagatcaggatgttgtcccttggtatcaaatgcttcaaaaaactgaaccattcagttcatggcaagcatttactagagccttagaacttgattttggaccatctgcttatgactgtcctcgtgctactttgtttaaactgaatcaatctgcaactgtgaatgaatattatatgcaattcactgctctagtaaatagagtagatggattaagtgcagaggcaattttggattgctttgttagtgggttgcaggaagaaatcagcatggatgtgaaagcaatggaaccccgtaccttaaccaaggcagttgcattggccaaattatttgaagaaaaatacacttcaccacctaaaacaaaaacattctcaaacctagccagaaattttacctcaaccacttcagccacacagaaatatccaccaactaaccaaaaaaatgacaatccaaaaccaaatttaccaccacttctacctacaccatcaaccaaaccattcaaccttcgaaaccaaaacatcaaaaaaatttcccctgttgagattcaattgagaagagaaaagaatctgtgttacttttgtgatgaaaaattttcccctgcacacaagtgtcctaatagacaagttatgctgttacaactggaggaaacagatgaggatcaaactgatgaacag

SEQ ID NO: 101270 - DNA, 4389 bp, Glycine max
  Peptide Sequence Number=SeqID_218048
atggcttcgaatcctccatttcacatggaggatcagacagatgaggatttctttgataaacttgttgaggatgatatggagcctgtaaagtctggccatgatgaaggggatgattccgatgaggctaaagcatttgcaaatctgggaatcaatgatgttgatgctgctgagagtggtattgaagtcaaaggggaatatggtactgtggaatccgatgcaggacttgaacaggaggggaatttgttgccctcctctagttcagttgggtttgataataaggtgggtcctggtgaggatgggattggggtgggatcagaagtcacgtccgcttcagctgtaggcacgagcgataaagtcagtagttctgaggttaaggaggtgggttggaattcttttcatgctgatttgaatggaggcggcgggtttggatcatattctgactttttcagtgagttgggagatcagtctggggattttctggggaatgtgtatgataatttaagtagtgaggtgaagcctggtaatgaagttcaaaacgatggctcaaatgccttaagtaattatgtgcaatatcatgagggtcaaggttatgatggatctttagaaagccacacaaacaggctaggtgatgggttaaatgcttcagctaatcatgtacaatatcaagagggtgaaacttatgttgcatcttcagaagaacacccaaatggacaagatctgagtagtagtcagtattgggaggatctttatcctggctggaagtatgaccacaacactgggcaatggtatcaaatagatggctatattgtaacttccactactcagcaaagctctgaagccaatacagctgcggatttgagtgctgcttctgatgggaaaacagagatctcttacatgcagcaaactgctcaatctgttgcaggaactttagctgaatccggcacaactaaaaatgtatctagctggagtcaggtttcagaagggaataatgggtatccagagcatatgatttttgatcctcagtatcctggttggtattatgacacaattgcccaagaatggcgttcattggaaacttacaattcaaccatccagtcttctagtcttggacttgaaaatgggcatgcttctgccaatactttctcgcccaatgataatagtttgtatagcgaatacagccaaactgataattatggaatacagggaattgatagtcagcctgtagatggcagctggagtggtttgtatggcactaaccatcagcagggttttgacatgtacacaactgggtctgtcactactagaggggataatataacttcgggtggcaaccaacaaattaatcattcttatggttcaagtatttctgcaaacaaagatcaacaaaatacttctagttcttttggatctgttgcattgtacaatagagtaaaccatgatcttggtttggctaatggaacttttgaaccacaaagctttggccctactggggacactgttcaacagtttaattattcaaccacaaagttcggggagcaaaaagtattttcaaatgattttactgaaaataaaaaaccctttagttattctccacaatcaattcatggtgagcatcagtactcacatgcccctcaggttgggagatcatcagctgggcgtccttctcatgccctggattctgtacaaggttccatttctgtgttgaacttgattgaagttgtcacgggaaatatggattctttgagcatcggaaataataccagtaattatttccgtgctctgagccagcaatcattcccaggtccgttggttggcggtagtgttggaaataaggaactgtacaaatggttagatgagaggattacacactgcgaatcacctgacatggattataagaaaggtgaaaggttgagactccttctttccttgcttaaaataggttgccaacattatggaaagctacgttctgcttttggtacaggcaccatactaaaagaaaatgctactcctgagtcagcagttgcaaaactttttgcatcagccaagacgagtggcacagagttccctcaatatgggatgccaagccactgcttgcaaaatttgccttctgaaggacaaatgagggcaatggcttctgaggttcaaaatcttcttgtctctgggaaaaagaaggaggctttacaatgtgcacaagaaggacaattgtggggacctgcacttgttctggcttcacaacttggcgaacagttctatgttgatacagtgaagcaaatggcacttcgccagctggttgcagggtcacctttgcgcactttatgccttctaattgctgggcaacctgctgaagttttctctactgatacctcaattagtgggcatcctggtgcttctaatatggctcagcagtctcctcaggttggatccaacggcatgcttgatgattgggaggagaatctggctgtaataactgcaaacagaaccaaagatgatgaacttgtaattattcacctaggtgattgcttgtggaaggaaagaagtgagattactgccgcacacatctgctatttagttgctgaagcaaactttgagtcatactcagatagcgcaagactctgtctaattggagcagatcactggaaatgtcctcgaacttatgctagtccagaggctatccagaggaccgagttatatgaatattcaaaggtggttggaaactctcagtttactttgcatccatttcagccatataagcttatatatgcatttatgctagctgaagtggggaaggtttcagactcactgaagtactgccaagcactactgaaatccttgaaaactggccgtgctccagaagtagagtcatggaagcagttagcactatctcttgaggagaggattagaattcaccaacagggtggatatgctgcaaatttagctcctgcaaaattagttggcaaattgctcaacttttttgatagcactgcacatcgagttgttggtagtttaccaccgcctgctccttcgtcatcacaaggaactgttcatggaagtgaacaacaattcaaaaatatggcacccagagtatcctctagccaatcaacaatgtctttggctccatctgcttcaatggaacctattagtgagtggacagctgacaataatagaatggcaaagcctaatagaagtgtttctgagccagattttggtagaaccccaagacaggaaacgatgtcacctgatgcacaaggaaaagcacaggcatcaggaggtacatctcgcttttcccgctttggttttggctcacaacttttgcaaaagacggtagggctagtcttgaagcctcgctctggtagacaggctaaattgggtgagaaaaacaagttctattatgatgagaagctgaagagatgggtggaagaaggtgctgaacttccagctgaagaagctgctgctctgccaccgcctccaacaactgctgctttccagaatggttcagctgaatacaacttgagatctgcattgaagactgaaagttcacctcctattgagggctctaacataagaacttctagccctgaacttagtccagggatgccaccgataccacccagcgcaaatcaattctcagcccggggtcgtttgggtgttcgatcaaggtatgttgacacctttaaccaaggtggtggaacctctgcaaacttgtttcagttcccttctgttccatctgtgaaaccagctgttgctgccaatgcgaagtttttcgttcctactcccgcaccatcaaatgagcagacaatggaggctatagcagaaagcaagcaagaagatagtgcaacaaatgagtgttcataccaatcccctaaatcatcaacgaccatacaaaggtttccaagtttgggtaacatctcaaaccagggagcaacagatggaaataactctcatttacctcattcacgccgaacagcttcatggagtgggagttttaatgattcatttacccctcgaaaaatgggcaatattaaacctttaggggaatctttgggcatgcccccgtctagatttttgcctgatgaatctttaatgcgtacacatgtgaaaagtagcagttatggagaagatcttcaagagcatttctttggatgtacggaacagtggtacacatcagatggagttctcacaaacagatcagagaataacaacagacatctatccccctcctcccttcccttcccatcctcttttcagtattttttaaagtccccaactcccacccaacctattgatgtattttttttctcctttaatgccaagggagttgacagtggacaccatctccggattatggaactggtgtggtacaacaaaggacaagaccacctgcttagctga

SEQ ID NO: 101271 - DNA, 114 bp, Glycine max
  Peptide Sequence Number=SeqID_218049
atggtcgacgacgatgctcttgttgttattgggcatagtagggctgtggcatttaccctgcaccaaagcgacgtcgtacaggaggaacgcttaggcgacgatgatgttagataa

SEQ ID NO: 101272 - DNA, 642 bp, Glycine max
  Peptide Sequence Number=SeqID_218050
atggatgcttcttactactatcttaaacttcgctggagcgtaccctgtggaccaaataacgtgatcacattcccaggggcactatggttgaagccatggtatggtgctgagatggctgtgatacttgtccaatctgcaatatatctgggagtaatagcaatgacgcgtttggcaaggccaagcttctcaaagctatgttataggcgctctgataagagcatcaaccttgtgcataacagcctcaaattagtagctttgtggtgcatccttgctgcttacgtaacaccattctttaccattcctcacacggttcaccctcttctgggttggatcctgtatttgcttggtacctttgcactttgctcaattgcaatcaatgtctttatgctaccaatgttaccagttttggtaccatggcttggaattattggggcacttatggtcatggcatttccttggtatcctgatggggtagtgagagctctgtttgtctttgcttatgccttctgttctgcaccatttttgtgggcctctatgttgaggatagttcaaagtcttcagttatctctagaaagggaagcttttctgccagcaagattgggagaatcttcgccaaattcatggtttaacaagttatattga

SEQ ID NO: 101273 - DNA, 967 bp, Glycine max
  Peptide Sequence Number=SeqID_218051
atggacgaaccgaacgaagcacaagacaacagagaactctacgcgctcttgaatttgtctccagaagcttccgatgaagaaattcgcagagcgtatcgtcaatgggcgcaagcctatcatcccgataaataccaagctcctcacatgaaggatattgctacggagaactttcagcgaatatgcgaagcgtatgagattctttcagatccaaataaaaggcaaatatatgatatctacggcatggaggggttgacctctggtttggaacttggtccaaagcttaatggagctgaagagatcaaggcagaactcgagagattgaagaggatgaaggaacgcgagaaaatggcggcgcattttcaaccctccggtacaattgtggccaatatgtctttgccacgctatctagacggaaatggcatgctcagaggcttttcttctttgttttctcgtctgattgtgtattttattacgtttatgagtatcagaatggctatgacaagtgaaatccagtctcagttatcaaagcgtaatgctgttacgattggtggtaatttagcagtgaatggagaggaaggcggtggagctgctactgctgtatttaggcatcatctttcagaagtttcgtcagtagaggttgtggcctcagctggtctgcgtgcactaattggggtgcaaacaactcgtaatctatcatcacactcagctgcaacaatgggcatagcactgtctctgaaagacggttcattgaatctttcaaatttatggacccgccaactgtcagaaacagcaagtggacatatagagcttgctttggggccacattcatctgtaactgttgggtggcaaaagaaagatcagagaaggtctgcctctggagaagtgaaggttcttttgagacatcagttcattatactcatcgtttttctcctaaatctcttggctgcattgtgggaagagttgggag

SEQ ID NO: 101274 - DNA, 210 bp, Glycine max
  Peptide Sequence Number=SeqID_218052
atggcgaagagggaagcgcacgttgtcactgcctccgcaataattgtccttggctttgtgatgatcgacgtgacaaagacgtgtgaaggagatcaattatgcaagagaaaggggcttcggctccgcgatgaccaaccaaagatgaggggtgttgactgtggtgtgaggggagataaagaaatctttggtgttgagtgtggtggagattga

SEQ ID NO: 101275 - DNA, 396 bp, Glycine max
  Peptide Sequence Number=SeqID_218053
atgcaatcacaaggactcacagtgtctcctgagcctgagattggttctttagctgctagtgtcagcataaaaaagggttatgttgatccttcatggaacaatccaaacacaggtgactcagagaaatgcaggttgtacgtcgaagaaaatcctccccgcctggttgccctaggaagactttatgaggggtcgacaactgttcacaatgtctttttgtgccatgatcaagtcaaggttggtgttgaggaagttagagatgtagatactcccattcctgtgcctactgaagaggttcagttagtggggcagacacttaacaccttcattgcttggctgacacatcttgtcaagcttttatcaaaacagttatgggacccgacgaaacccaccagatag

SEQ ID NO: 101276 - DNA, 375 bp, Glycine max
  Peptide Sequence Number=SeqID_218054
atgtctgcacttagtttattgttagtatgccaattaagaggaaaacattttgttatgaaactttttattaaaccttattaccttagaaggaataaacagaaggctctggaggagaaggagaaaacttctgctcaggttaaggaagcacgagctacagcagagaaagctcagaatttacaacaaaatgtggctaataggaaaagaaacaagcaattagaaacaggtggactggttattatgagagcactatatggaaatcagagaattttgaacaacttaaagtcatcaagtgaaacaagttttgaattaacttcagaagtcattgatgttacaatacctttgaattttctagttaatgattctggccaactcaag

SEQ ID NO: 101277 - DNA, 345 bp, Glycine max
  Peptide Sequence Number=SeqID_218055
atgttgatgttggatcaatttcatctgttcattcacgattccattgaaaacattgtggatgtgaaaactgacggtaattgtggatatcgtgcaattgttgcgttattagatattggtgaagattcatggtcattggtgcgcaataatttgcttaaagaacttgccaaatggtctgatgagtacatcaacctctatggtggcatagacaaatttgaggaattaaagaggtctctgcttgttgatggattatccatggttactatggataagttgatggatataaccgacatgggatatgtcattgcatcaaggtataatgttatcatggtatcattgtctctgtaa

SEQ ID NO: 101278 - DNA, 996 bp, Glycine max
  Peptide Sequence Number=SeqID_218056
atggcgcaaggattttcgagtggacgtgctttcaaaggtcttgaaatttctgtttcgttcaatgttggattatccagaatcgaattcaatttcacggaatacgatgaagtgaagaaatgctatcctcatggataccacggagttgatagatacggcagacccgtgtatattgagagaattgggatggtagaccttaacaaactggggcaagtaaccacatttgaaaggtttatcaaacatcatgtgtcagagcaagaaaaaactctcaaagtaagattccctgcatgttcactagctgctaaaaggcacatagcatccactacaagtatcttggatgtcaacggagtaggaatatctaatttctcaaagcctgcaagatacctctttatggaaattcagaaaatcgatagctgttactatcctgagactctaaatcagctctttattattaatgccggatctgggtttaggatgctgtggaaagcagtaaagacattcctagatgtacgcacagtggcaaaaattcatgtgttaggtttcaattatctcagtgtcctgcttgaggctattgattcaagtaatttgccaacttttctgggtggtaattgcacatgttctgattatggaggttgtctgatgagtgatcgagggccctggaaaaatccagaagtgttagaaatgattcaggttgttaatttgagagaagagattgatggtaaaagcgaagatggtgatgtggatatagaagattcctcgatgcccaaaaaggttgatatgcaaaacaaagatggcaattctctcagtctacttgaggaagcagcatgtgcgggatctgactcggcatgttcttgtagattagcattgcaaaaaattgattgccttgaagctagtcttggagacatcaagaataaaatcaagacactggaagatgtacttcaggacaccaagatggccttgatagaacatgcacaacatgaggaacgaccaaaaatgtaa

SEQ ID NO: 101279 - DNA, 684 bp, Glycine max
  Peptide Sequence Number=SeqID_218057
atggaggagtgccactattgtaaagctccttgggaggaagattggatacaaggattggagactcgtttgaagcagatgtggctcaagaaagggattatccatatcatcaatttgggagatcatattggtaggacggtaagggtggataggaataccctagcacaggaaaggaaatatgtgagactttgtgttgaggctgatcttacaaaacttctattggctttgtttgagctaaaacagaggttttataagattgaatataaagattcgggcattatgctgaaggctgccctgataaagggaagccaaacagttggaacggggaaccaaaattccgctcaaggaggaattgaaaggggacaaggatcgattttgaatggaccatggaatgtggtcaagaagcccagaaggcaaaggagaggaaaggagaacccaggtaatggtgtagatgtggtggctgctaaaaagactgagaacaagtttttctctttagggtcacgtcatgagttgctgaagaattctgaggaatattttgaaggggaggcaagtggggtagtgccagatgcaatgaatattatggggaagatggcagtcaaagagaatatggaagttagtatacctactgaagggaatcacatggctcagaatagtgttatcctcgaggaaaataataaagaaacttaa

SEQ ID NO: 101280 - DNA, 382 bp, Glycine max
  Peptide Sequence Number=SeqID_218058
atgtctgaagaagttgatatgaataatcaaaatgaagatgaagttggtgtgaatgaagaagaacatgctcgatcagtcgtttatgaaattggatttgtgacaatgattaagaggaagaaagatttttttagaagaaatactagtagtaggaaatgtgggtgtccctttaagcttcatgggaaaccagtggttggaaggcaaggttggatggtgaagttaatgtgtgaaagtcacaatcatgaattggccaagtcattagttggacattcatatgctggtcgattgactaaggatgagaagacaactattgttgatatgacaaagtcaatggtgaaaccaagaaacaatctcctaacgttgaaggagcacgatgccaatagtt

SEQ ID NO: 101281 - DNA, 738 bp, Glycine max
  Peptide Sequence Number=SeqID_218059
atgttggctcaaaatatacttgaagaggaccttagctcaccgattaccagaggtatctttactagaaagagaaaatttataagccgtttaggagggattcaaaggaagtttgagctgaattgttcctatcccttccttatacatctagtaaagaagcttttgaacgagttgcatgaggttttgtatcaagaagagttgaagtggtttcagagatcatgtagcaagtggcatcaagatggtgataggaatacccattattgccacctaaagatagtggacaagagaaggaaaagtaggattcaaatgttaaggggtgtggatggtaagtggattgaagaggaaaatgagcttaaaactcttgtcaatgggttttattttgaccttttctcggatgacaatcctcaaggaatatggcttcagtccaggtatggttttgcaactttgtcggatgataaaattcatgatcttaatgttattgttcatgaggatgagatgagaaggactatttttgagatgggcccttggaaagccttgggcccgtatggttttccagctggtttttaccaaaatgattggtctattactgggaagtttgtgtgtaacttcatcaagcatttatggagacatcctggagaagctgggagtgttaattgtacaaatatttgccttattccaaaaattgataaacctgaatttgtgtcccaatttcatctcatctctttgtgtaacacaagttag

SEQ ID NO: 101282 - DNA, 231 bp, Glycine max
  Peptide Sequence Number=SeqID_218060
atggattcgaagcaggtgaggaggtcagatcctttgcggcggcagtggccgcgtttgaaactaaagctcgtgcgacgggaccttaagcacaatcatgagaggccagatctacagcgaggaggggtgcaacatggaggaggattgagtgggaggactttttggacatttcgctacaaatttaacaccgttactgactgtgatgattcgggaggcaaaagaagtgtattttaa

SEQ ID NO: 101283 - DNA, 278 bp, Glycine max
  Peptide Sequence Number=SeqID_218061
tgacaactaaaagcaagaggattcaagaagactccgaggagaaggaaggttctctcctaaaagatgcaaatgacgtccttgctgaaaagggtcaagcatctaggaaagctaaggtttctactgatgggaatccaatggcaagtaaggacaatgagatggaggtactgacacctcctcaggccaccaataagatgaaaaatgttgtggctaagcctcacctaaaggtggggaaagaaaatcctccaagaaagaaagtcatttcaaaagactctggttga

SEQ ID NO: 101284 - DNA, 471 bp, Glycine max
  Peptide Sequence Number=SeqID_218062
atggggcttctgccaacagtagcggttcctatttatgggattcactattttttacaaatgaaaaaagggtcggggaaagtgacaaggatggggaatgatgcagaaacaacgtcaatagatcacatgggccttagtcatggcagtgtggttaaatcagttgtcgaatttgtgttattgtgtttctgcaatggtggctttggcaatagaagcaagcttcatgatgttgaatcaagattgattcaaggtacatcctttgtggtacaagtagagggtacatctacttgggttgttgtaactgagaacaagagaggatacatctcttatggatcagttcaagtggagggtacatccactcggttgttcaaagagaacaagggagggtacatcccttgtggatctttgcttgtaaaggattttacaaggttgaaaagaaatctcaaggaccgcaggtcccttggggactggatgtag

SEQ ID NO: 101285 - DNA, 915 bp, Glycine max
  Peptide Sequence Number=SeqID_218063
atggactggggagtgacgccactggtgtctctaaggtggtgtgctgctatggctgaggctactggggttgaggttgctactatggctattgaccaagtagtggaagaggatgttggccttagagacgacatgatgaaaatagtagacccaatgatctccctaaagaaggctacctcctggtaccaatgcctgggcttcttgatgaaagccatttggttttcctttgtctacatggactcagacgtctcgaacccaagaatgatgttgaactcagagagagtcatatgtgggtttggccaaggagggaaaatgctaccatgtgctcagcgggaggcactagttgaccctttgcattgtcatcatcccttaaattggtatctccaccagaggagctccacacttgataatgatggactctatcatagaggcataagtcctggagcacccgatcctcaaggtattgagagtcaattggagggacaggcgagtcgtggtgctcaggttccacccgaggatgtaattgtggtgactatggaatcgaagccttggggcctggttgctgagtatgggatatggataaaatgggaaaataagggcaccacggtcattgtgatgctgatcacgaccattgtgatgttgatcacgaccgtggtgttgtgtcgtggccctcaatgtcaaagcaccccaactatgatgctaaaagggagaataaaatatagtgaaaggaaccacgaccatggtgaatgtgataacgatcgtggtgccaatgaaggatgggacatgaaaggtgtcacgaccaaggagatagtgaccacgactatggtgaaaagaaaggaatacgcgcggagtcgccaccaacatttatttgaggaaaacgttgaaaaaaccggaaaagacgtgatctacgaactttaa

SEQ ID NO: 101286 - DNA, 1044 bp, Glycine max
  Peptide Sequence Number=SeqID_218064
atggccacctctaactcctctgctatcgagatcattccagccctagagatttccactatacacaccgataatgagccttcaatccatgatgaacactttttcgacatacaagaacttgaaaaggtaggtcttaagctcaacgagacactaatttttggtggagcaaggcatttctttaacgagcctcagactatatatccaaaactcattagaaccttttggaggagtgttgagtttgtcaacaaaaaggctatagtatccaaggttttaagaatcaaggtgttgtccagtgactcgattgccaaggaaactgggcgccttcgtgaaggaagcacatatcaagaaggatgcgagaagaattatgattcttatgttataagggaactatacaaagagaacactgagaagccaagctcaaaaatgaccttgtcagatctccataaatttgttctctttcacttaatggagaatttgccctttgatatgcctcataccatctacatcaacatcctgagaaacttgaagggcttatatggtctggacgacatctatcatgctactctcgtcaataagctactttgggataaaggtgtgtatcacgtcttcaacaaaatggacaatgattctaagcacaccctagtagccaagggttcagttgttgctaaacaacacaaatttagcaaaactaacctaaaagctatgaaggaaaaagaagaggaagaactacttgcaagggagcacaagacgaagaagagacatgaacaagctaacaagtccactcctgtgcgtccagcaactaaaacattagtactacaaaggctgaagtacttgagtaagattgcagccctagaaggaaaccatcaaagcccttgcatggacaaggccactgcttaccctcttgggctgcacatctcaagggtcactgatgtcaagatagttgctgacaaggtggaagtattcaactaccctcgtaattggatttccttgtttaataggaataagcttgttcgtgctcctgatgcttttgatgccaagaccttctag

SEQ ID NO: 101287 - DNA, 353 bp, Glycine max
  Peptide Sequence Number=SeqID_218065
gatcatatccagcatcggtcagtaattctttcaaggcgtctaaactcatgatcaatgacctcgtgttggaaatccaagaatttagagagagtcttttagatttagggatcgaagttagatcaattttgatgcctattggacaagggagttcactggttttaggaaaatctaatgtcagtttcttcaaacaggagtttgtttgtgttattgtcgccaagattacaaccatagtgatggacaactattcatggtgctatccggcttgtggtcaatgttataaaaaagctgacatgcaaactgtgctgttcacatgtccgtctggcaaagagaatgatcaacctgttctgaggtga

SEQ ID NO: 101288 - DNA, 981 bp, Glycine max
  Peptide Sequence Number=SeqID_218066
atgtctgagatatcgaactccaaagccaccgtggtggaagattgtcgtggcgttcttcatgtctataacgacggttccatagtacgttcttcacgtccaagcttcaacgtacctataaacgacgatggcaccgttttgtggaaagatgtcgtttttgacactgcacttgatcttcagcttcggctctataagccagccgacgactcagccggatccaagcttcccattttcatttatatccacggtggcggcttttgcatcggctcgcgcacttggcctaactgtcaaaactattgtttccagcttacttctcggcttcgagccgtagttgttgccccagattatcggcttgctccggagaatcgactccccgatgcgatcgaggatggctttgaggctcttaagtggcttcaaactcaagccgtgagtgatgagccagacccgtggctcagccacgtggctgattttagccatgtgtacatttcgggtgactcagctggagggaacatagctcatcacttagcggctcggcttgggtttgggtctcccgagttggatccggttcgggttaggggttatgttctattggcccctttctttggtggaactatccgaaccaagtcagaagctgaaggaccaaaagatgcttttctcaatttagaacttattgataggctttctatacccattggggagactactgatcaccctcttgtgaatccttttgggccttatagccagagccttgaagcaattgatttcgacccaattctagtggtggctggagggagtgacttgcttaaagatagggcagaggattatgcaaaaaggcttaaggagtggggtaataaagatatagagtatgtagaatttgaaggacaacaacatggtttcttcactatttatcccaactcagaaccatcaaacaagttgatgctgatcatcaaacaattcatagagaagcatttggggaaagtttga

SEQ ID NO: 101289 - DNA, 369 bp, Glycine max
  Peptide Sequence Number=SeqID_218067
atgtttaaacctattaagtggcttcaagatcaagccgtgagtaatgagctggatccgtggttgagccacgtggctgattttagcggcgtgtttgttttgggtgactcggctggagggaacatagttcaccatttggcggctcggctcggcttggatttgggtctcccgagctggcaccggttcgggtattggaggctttgtttacccgttggggaaactagttatcaccctcttgtgaatccgtttgggccaaatagcaagagccttgaagcaactaaactagacccaattttagtggtggctccaggaagtgatttgcttaagagacaggacagaggattatgcaaggaggctcaaggagtggggtaa

SEQ ID NO: 101290 - DNA, 948 bp, Glycine max
  Peptide Sequence Number=SeqID_218068
atgttgcatatttctcgttcgttatatagaacttccttcctcacagaggatggattgtttgatatgattcgtgcctcaaaacctgcaaaagcttcttcacaagaagacaagaaacttgtgaacaaggctgttgcagtagcatcccagtcaaaagtttctccgaaatcacaagttaaggtccctctgtcttcacgctcaccttctaaacaagccaagccgaaaactgctactactgttcagtcttcttcgatgtggacagaaaaatatcgacctaaagatccaaaggatatcatagggaatcagtcacttgttttacagcttcgtaattggttgaaagcttggaatgagcattttttggacactggtaacaaaaagcagggaaaaaagcaaaatgactctggtttgaaaaaagctgtcttgttaagtggaactcctggtataggaaaaacaacttcagcaaagttggtctgccaggagcttggtttccaagccatagaggtggaaatatttcttgttaaatttatatgtttggaaaaggtaaatgctagtgacagccgtggaaaagctgatagcaaaattgaaaaaggaattagtggaagcaaaacaaattccgttaaggaacttgtaaccaacgaggccattggtgttaatatggaacggtcaaagcattacaaatctgtgcttattatggatgaggttgatgggatgtcagctggtgacaggggtggtgttgctgatcttattgctagcatcaagatatcaaaaattcctattatctgcatttgcaatgaccgttacagccagaaactgaaaagccttgtgaactactgtttgcttctaagttttcggaagcctacaaagcaacaggttatcccattttattccccttcccctctgacagatggggtgtataatctgaataacaaattctttagatcccgaaagtga

SEQ ID NO: 101291 - DNA, 216 bp, Glycine max
  Peptide Sequence Number=SeqID_218069
atggcagttaacatgggagcgtcacttcaagcatttccccctcaagaccctcagtcacagaaacagcttctaagctttgaagaaccaagcagctgcaaggaactgggatcatcatcttcaaaatgtaacaaaatagcgccatttcacgaggcagtagagcatgaacaacctaggattcctcccattcgtcgtgagccctcacactctattaattga

SEQ ID NO: 101292 - DNA, 267 bp, Glycine max
  Peptide Sequence Number=SeqID_218070
atggattctccatcctttcttgcaagccagttatacagttcaaacaaacacgtgcatttgtacgtcaggcataagtacaatttcttacgaccagagaaagtatcagccaaagatgagaggaggcatgcccggtcaatgctgggacctgctcagcacaacgatgaagaaacagtggttacaaacgccagtgacactgaagaggacatagtcgagatggattatgctcaaccacatcggaagccacccattcacaacgaaaagccttaa

SEQ ID NO: 101293 - DNA, 1059 bp, Glycine max
  Peptide Sequence Number=SeqID_218071
atggcaatgcacaagagcagttcaggttcagcattgggtccgggaggcttggacttaactcaagccttcttcaagtcgatcatgaacgctgcagcttcttctcccaccaaacgccacaacaaaatctctgttgttggggcaggcaacgtgggaatggccatagcccaaaccatcctcactcaggatctcaccgacgagcttgtgctcgtggatgcaattcctgacaaactccgcggcgagatgcttgacctccagcacgccgctgccttcctcccccgcaccagaattcaggcctccaccgattactcggtcacgctgggctctgacctctgcattgtcacagccggggctcgtcaaattaatggcgagtcccggctcaatctcctacagaggaatgtcacactctttcagaaaatcatacctcctttggctcgttactccccagacaccattcttctcatcgtttcaaatcccgtggacgtgctcacttacgtggcatggaagctttcagggttcccttcaaaccgcgtcattggctccggcactaacttggactcttcccgttttcgtttcctcattgctgatcatcttgatgtcaacgctcaagatgtccaggcttttatagtgggggaacatggtgacagctcagtggctctgtggtctagtattagtgttgggggtgttccggtgctgagttttttggagaagcaagaaattgcgtatgagaaggaaatgttggagaacatacacaaggaagttatacagggtgcttatgaagttatcaatctgaaagggtacacttcttgggcaataggatactcggtggcaaacttggcacgaaccattctcagggaccaaaggagggtccaccctgtctcggttcttgcaaagggtttttatggcattgatgatggggaagtgtttctcagcttgcctgcacaactaggaagaggaggggttttgggtgtaaccaatgtgcacttgactgaagaagagacacagaggcttagggactcagctaagacaatcctccaagtgcagaatcagttggttatttga

SEQ ID NO: 101294 - DNA, 1134 bp, Glycine max
  Peptide Sequence Number=SeqID_218072
atgtcaacattcctattctgccacatcttggcatttgtactttcatggagacttacactggcagccataccactgtctgtcatgttcattgttccggcacttgtatttgggaagatcatgttggatcttgtgatgaaaatgatcgagtcttatgggattgctggtgggatagcagaacaggcaatatcttcaataagaactgtttattcatatgttggggagaatcaaacactaaccagatttagcagtgcacttcaaaaaactatggaatttggaataaagcaaggttttgcaaaagggttaatgttgggaagtatgggagttatttatataagttggggatttcaggcttgggttggaacttttctgatcactaataaaggagaaaaaggaggccatgtatttgtagccggcttcaatgtcctcatgggaggcttgagcattttaagtgcccttccaaatttaactgccatcacagaggcaactgctgctgtcactcgccttttcgaaatgattgatcgagtgccgactatagattctgaagataagaaaggaaaggccttatcatatgtgaggggagaaattgaatttcaagacgtctacttctgttacccatctaggccagacacaccagtcttgcagggattcaatctcactgtcccagcaggcaagagtgtaggccttgtgggagggagtggttcaggtaaatccactgtcatacaactgtttgaaaggttttatgaccctgttgagggagtaatactcttggatggtcacaagactaataggcttcagctcaagtggttgagatctcaaattggcctagtaaatcaagagcctgttctctttgccacttccataaaagagaatatattatttggaaaagaaggagcctcaatggaaaatgtgattagtgcggctaaagcagctaatgcacatgatttcatagtcaagttgccagatggatatgaaactcaacctaataaccacaataacaagttacataagcagtataacactcaactgcgtgctggagaacatttatcttatgattctattcgtgaccaaaatcaagtaaatataaagatggcaagagtcacattaaatgaatatttaacaagtaaaatgaactaa

SEQ ID NO: 101295 - DNA, 855 bp, Glycine max
  Peptide Sequence Number=SeqID_218073
atggattcatcagaatgcggaggtggaatgaagaggaagtggtatctttgcaacttaacagacgtggaagaagtgaaaatggtactaagaatgctacccatatgggccaccaccatcatgttttggacaatccacgctcaaatgaccacattctcggtagcacaagcgacaaccatggaccgtcacataggaaaaacatttcaaatccccgcggcatcaatgaccgttttcttaattggaaccattctcctaactgtccccttttacgaccgtttcatcgttcccgtggcaaagaaagtgctcaagaacccacatgggttcacccctttgcaacgcattggagttggtttagtactctcagtgatttccatggtggtaggagcactaatagaaataaagagactaagatatgctcaatcgcatggtttggtggataagccagaagcaaagatcccaatgaccgtgttttggttgatcccacaaaacttcattgtgggggcaggggaggcatttatgtacatggggcagttgaactttttcctaagagagtgtcccaaagggatgaaaacaatgagcacgggattgttcttgagcacactctctttggggtttttctttagcaccttgctagtgtctatagtgaacaaaatgacagcacatggtaggccatggctcgcagataatcttaaccaagggaggctctatgacttttactggcttctggctatattgagtgctataaatgtggtgttatacttggtttgtgctaagtggtacgtctacaaggagaagaggcttgctgatgagggcattgtattggaagaaacagatgatgctgctttccatggccattga

SEQ ID NO: 101296 - DNA, 270 bp, Glycine max
  Peptide Sequence Number=SeqID_218074
atggttcttatgtctacattctacagtcaaggaaaatacaagaaagtggttggaagcctagatggttccgaagagaaggtgaaaatggaacgtttcgatacgttggtgggtattgggaggcgagagagcatggaagatgggacgggtgcccgaatatatttgctttgcgaagacgctgatgtcgggatccttaaagcagtcatggtacaggctttttgtgcattgcccgtgtgttggtgttataggaacaatgaacaattgaaagggtag

SEQ ID NO: 101297 - DNA, 105 bp, Glycine max
  Peptide Sequence Number=SeqID_218075
atgactcagaaaaacgggtgccaagaggaagcaatactaattaataagtgcagagctgaaacgaagaaatgcttccagcaacgaccaatggcaatgcagcgatga

SEQ ID NO: 101298 - DNA, 1701 bp, Glycine max
  Peptide Sequence Number=SeqID_218076
gtttctgaagttggttcaccaactctgagagttgatgagaaccatgagaccagtacagatacagaatccatgatatatgatggggacattgacaaagatgttacttctggcagtgaggatatgtggggagcatcacttcattcaagagaagtacgtagagtaagtgagcaagatatttcagagttaaacagctggagagacatttcttcacccctttctatgcaaaacatagatgaagaaaatgcagctgacgtgagctctatgtcctcaagatctgacatgcctgatgatactccaacttatgcaatgagtagtgaccataataacatctttggtaatatgaaagattttggtgcaccccaaaattctcattcttcagttgtgtcagaacgttggaagcaattgatgcggttgatggacacacgtgatagtcatttacctcatgataggcattcaaaaaaaccaggggaattgttcaacctctcagagaattcatgtaaggcacaagttatcaataatgggaacaacttagcagcctctgagcaagataacacacataaatcaagaggaaatgaagaacctgctgcatcacattcagttatgcaacaagaagtaactgatggagtctcaatcaactcaagttcttcatcttcacccaggtctgtattgtcaataacacagaagaccatagctaaccaagttccctcgtcaggtttcaatccagagacacaccaagatgttcagcaatctaacatgcaggatgtgtcacaaggaacattaaatggtgaaggtccacctgactccatccctcaaaatattcagccttccatggatgatccaaatgttgaatcacataacagtgacttgagtcatcctcaggggcagaattttccactggagaattacattcaggaatcaaatatgtctagcaagatggatgattcaggagtttgtaacaaaggagaagaaaataagtcaaagaatgataagaacagtggagacaaacttgctcccctaattataccagatgcttcagcagaaccccatagacaagcagagatgatagcttcagtggatataagtgaggaatcaagagaaagatttgatgacaatgtgccattgatttctctaatactagaatcatccttagaaagccaaggagaggaagaggatgaagaaagttctgaagcatcagtgagacaagaggcaaccacagaatcaagtatcaatgctgaaacaacagacacaagttctgatgaagattttgaaagaaaccgcagtgggaatgaagccatactctcaacaagtttgtcagcaggagaaagtgacaagttgaaagaaacagacaagccaaagcatagttcagaagaagtgaattatttgcaaagtgagtcaaagcaggtggttgaagatcatatggtgaaggaaaagttggataaaggtgacatctctaaagaatctccacttccaattgccactgaagtaaccaattctgcagacacagaaggagaatgtaacaagatgaacaagaatgaagccactgaccaggaattgaacaagaatgaaaccatggttataactgaacctgcagcagaaagtgatcagaaaggactccaacttgagcaagttagtgcaccaaagccatataaaccaaatgatacctcaaaagaagtaggatgtttccaacaagagtcaacataa

SEQ ID NO: 101299 - DNA, 1432 bp, Glycine max
  Peptide Sequence Number=SeqID_218077
atggtggatgggtttcagaagttggcacttgaatcacggttagccataccaatcatttatggggttgatgctattcatggtaatagtagtgtctatggtgctactagatttcctcacaatgttggtcttggagctaccaggttgggccatcctccagagagacagccaaggggctacccatttgtggctgggaggaacaatgttgttgcatgtggcaagcattttgttggagatggaggtacagagaaaggtgtaaatgaggtggactgcatagctaagggagtttctacaatcatggtctcatattccaggtggaatggaaacaaactccatggtcaccattttcggcttaatgaagttttgaaagaaaagctgggcttcaagggatttgtgatttctgaatgggaggaaattgatgaatgccaaccttatgggtcagattatcgtcattgcatctccactgccattaatgctggaattgacatggtgatggttccttttagatttgaaatatttattgaagagttgatgtctctagttcaattaggggaaataccaatagcaggaactgatgatgctgttgagcgcattttgagggtgaagtttgctgctgaactttttgagtttcctttaactgacagatctttgctcgatgtagttggtggcaagtctgatcaaactgaattagtttcaacatcatcttggtgtctcaacaataatttgattcagtggcggatccagaaattttacttagtagagctacatagagatctagcacgtaaaacagttcaaaagtccttggttctgttgaaaaatggaaaggatcctagtaaaccctttcttccactgaacaggaatgctaagagagtccttgttgctggaactcatgctcatgatattgggtatcaatgtggaggatggataggtactaagtatgaatctagtggccagatcacaatcggcacaactatcttggatgctgttaaggaagctgtggggaatgaaacagaagttatttatgagcaatgtccatcaacagacatcatagaacgtagcgacgtttcttttgccatcgttgtggtcagagaaggtccctatgccgagtgtggaggtgacaattcagagcttgtaatcccatttaatggagatggaatcataaacttggttgctgataaaatcccaacacttgtgatccttatatctggaagaccttttctctcagaacagtgcctattggaaaagatagatgctcttgttgctgcatggttgccagttactgaagcacagcgaatcacagatgttatatttggagatcatgacttcaaaggtcaactaccaatgacttggttcagaagagttgaacaacttgatcaaccagttggagttagttcatgtgaccccttgttccctcttgattatggactaaaatatg

SEQ ID NO: 101300 - DNA, 1170 bp, Glycine max
  Peptide Sequence Number=SeqID_218078
atggaacctactttgaaggaaacaaaaaagggtttgaatgcaagggacattcaacttcgtatattaaaagtacttcatgtttcatttgagattagctacactttcatgcaaaggaatccattggtttcgggtgctttgttagtcttcttcattttgtacatatttctttcttttatttataacgtgttggtcttcttgtccccatttttcatgtgcactgccatttttgttagaatcttttggagttctgagcaaaacctccttaatattgtcaacaatgaggaggaaaagggaggggagaaaagggatgaaccaaaaatttcacctgagatgatcaggaatgagagacgtagtttgctttataagtgtccatcatacaatgcaacaagtagaagaagaaatttcacagggaagaaattggatgtttatggtggtttagaaataaaagccaaggatttatcgtcggtgtttcgcaatgaattccctagaaacaacaataagattggaaggactaaatttgacaaggaagagattggttctttggaggctcctataaagcaagttttgttttctgaaccttcaacgatgaacctggtgactcatgttgttagttctgatggtctagagaaaaggacagaaaacaaagaggatgagaaaaaagttcaagagggtggcaataaaggtgaattgacagaggatgaacagaaaaatgaaatggatcttgggacatgtgagttggagagacacaaaaggttggagagtctcatagctagaagaagagcaaggaaacaattgaagttgcagattgagaaaggtctaattgatatgaaatcagttactccaagccaaattgctccactatttgtttcaagactcaacccttttgattctccaagggagattgatggcatgcaaatgcctggttctgccccatctgctttgagaagcccatttgatattccctatgatccttttgaggagaaacccattctcactggggatagttttgatcaagaattgaagggtttgttaatagaacctagacaagaagactttgaagccataggccacaggttggcacatccaagagtcagaaggctgcaaggtaatattgataatcactttcttttctcctcatcctttttacttcttcttttcacccctttctga

SEQ ID NO: 101301 - DNA, 144 bp, Glycine max
  Peptide Sequence Number=SeqID_218079
atgacggtttatttagtggagaaagatgccagcattattaacattagtctcaaacaacatcaaaggaggaaattcaaaggattaaggctagtaatccagatatcagccacagggaggctttcagctcagcagccaaaaacgtga

SEQ ID NO: 101302 - DNA, 282 bp, Glycine max
  Peptide Sequence Number=SeqID_218080
atggtgacaatgatgctggtggtggttgcgacaacgttggtaacggttgttgttgtggtgatggtaacaataacgatggcgacaacattgatggtggtggttgtagcggtgctagtggtagtggtagctagttatggcggtcacaatgatggtgatggtggcaatgacgaatgtggtattaatggtggtggtaatggtagtggcaaagacggtggtgatgacgatggtgacaacaaaaaagtttttggatacatcaacagaggaatggaacatgatgaataa

SEQ ID NO: 101303 - DNA, 273 bp, Glycine max
  Peptide Sequence Number=SeqID_218081
atgtgcaaatttgttgctgctgtcagattttttgcacagccactgatgcagaaaaccatttggtctgaggaattgaaatccgttatcatatttctgagagttactatgccagtaagcatgtgcccagtgtcaccttctaatgcatcaagtttgattcaagatgattgtggtttgtacaatgtcacgttgactagaaaacaagctactgctgctaggaagttggctgtggctggaactttgtattctgtgggacacttccactggtggttttga

SEQ ID NO: 101304 - DNA, 420 bp, Glycine max
  Peptide Sequence Number=SeqID_218082
atggagtcatctaatgaaaaaatagcgagcaaaagaaaagtttcaggaaaaaataacgaggaaacaagaagttattttacatggaatttggagatggaacgtgtattggctgatgtactgagagatcaaaggaatttgggcaacaagggcgacggaggttgggaaaaatcagcattgaatgttatagctacaatgttgtctacaagtttcgatgctaatgtcacatcagagaatgccaaaaaccatatcaaattatggagatcatggtatggtattgtaagtgaaatccctggccatagtgggtttgattgggatggcactaagcacatgatcacagttgagaatgaaaatgcttggaatgaatattgcacttcgcataaatcggctaaaccgtttcgattcaaggtgcttcaaaattag

SEQ ID NO: 101305 - DNA, 411 bp, Glycine max
  Peptide Sequence Number=SeqID_218083
atggtgattttccaccatggagatgcagcagaagataaaggagaacagccatggaagaaggaacttcaccaccaagagagtgccttggataagaagcttagagaggaagcttcaatggaggaaaagaaagagagagaggggaggagcatgaaattaaagagaggaagcttaaatggaggaaaagaaagagagagagagaggggggagcacgaaattgaaggaggaaaagagggagagaaattgagctttgagcatattccaagaatataccaaaggcatcttaacatattccctttagatgtcacaagaatggaaggtgtgactctagcacatgggaaaggaatatgccacaagaatatgcaaaaggaatattccaagaatatgctaaaggcatctcagcatattccttga

SEQ ID NO: 101306 - DNA, 136 bp, Glycine max
  Peptide Sequence Number=SeqID_218084
atgaaactaagaatgcggtgcagactttcacacttcattgtgactttgacagcaaagaaaggaatgcaaggcatgagcaaccatatggcaggagtatgcatgagtgaacataacatgcaactaatgacaacagaag

SEQ ID NO: 101307 - DNA, 370 bp, Glycine max
  Peptide Sequence Number=SeqID_218085
ctacatattgctcgacggagtgtcttgggatgccaccatgataggcgcatgtggcattaggattgtaccatcggggaaatggaggtcggcgtacgacattgggattggggtgaactccacgggtttcctctctaggaagtttctccttgggttggtctttgtggttgattgggcattctcggtcggaagggcattgggcaagggggagaaccaatattggccaagtaattatattggtgcgggggatattgatacatggggttgtgaggggtttgtgggggtgcttggccatgtgggtgttgcggtcacggcgtgggcgtctccctcctttttctttgctccacctgccccaggcctcctattgccataa

SEQ ID NO: 101308 - DNA, 441 bp, Glycine max
  Peptide Sequence Number=SeqID_218086
atgaattgctattggaaatgccactcatcagcatccacaacagctagttactttgtaggaaatgcaaattatagaggacttgcttctggtttagccagaggaggagcaccattggctcacctagctatctataaggcttgttgggaccttccaattggagattgcactgatgttgatatcctcaaagcttttgacaaggctatacatgatggagttgatgtcttaagtgtttctcttggcttttccattccattgttctcctatgttgatctatgtgatattctagcaattggttcctttcatgcaactgctaagggaattacagtcgtttgttttgctggaaattctggcccctctcctctcaaaccattacaattttattttgtaaatcagcaaacagatttattaattaaatggtaccagaagtaccttgttacatag

SEQ ID NO: 101309 - DNA, 2046 bp, Glycine max
  Peptide Sequence Number=SeqID_218087
atgacagagatcgaagaacttcttttagttcacgaagcacgtctgaacaaatttcacaaacaaatgcttgttgattctccttcaattaattacacacaagaaaacatcaagtctttctcatcacatggttctgacagctacacagtgccaaacaagaatcttcaacaatcggaacctgaaagttttcccaattatcctggtggttctagcggtggtggcagtttcaaccgtggtggtggccagtccgctaatttccattgtcaagtgtctaaaataggccagactgcttcagttgagaattattcaagccagccacagaacaacttcaattctggatatgctcaaaataacactaagactaatgcacagtctcagccaaattcagctaattggatccctgattcaggtgcttctttccatgttactggagaatctcagaatatccaacaaattgagccttttgaaggccctgaccagttcattggcaatggcaatgttggtcctgatggtctctacagtttctccaacattcagtttcagaactctccttctggtaaactattcatctctaatgatgttctttttcatgagtctaagtttccttatgctgacctgtttgaatctgctccatctcttagtcaaccttcttcatcccctactcattttaattttccctccacacctattatacctcctgttcaaaataatattcaggataactcctcttctgatcagtcctctcctgctcagacttctttaccctctgatcagtctctttctgatccaaataattctgttcagtcagcccctctagctgctgacaccaatgtcactcaagcattaactgattccaattggaaattggctatgcaacaagaatatgatgctctcatgaagaattatacttgggacttagtgcctcttccacctgacagaaaggcaattggctgcaaatggatttttcgggatataatcaagttgaagcccgtcaccatcaaacttattctgaccttggctgtcactaatcagtggaaactatttcagttagatgttaacgatgcttttgtgaatgggtttctcaaggagactgtctacatgtctcaacctccaggttttaaagattctaattcttcattgttctgcaaactgaatatggctttgcatcggcttaaacaggctcctagacaagggtttgagaggttgcagtctactcttattcagtttggttttgtggctagtaaatgtgacccctctttgttcatctatacagtctcttctcatgcatttcctctcaagcaacttggtcaacttgattattttcttgggattgaaatcaagacactatctgataattctctactgcttacacagagcaaatatattagagatctcctacagaaaaccaatatgagacaagctcaagctatttcctcccctatgacttcaagctgcaagctcactaaaacaggttcagatctatttactgatcctactatgtatagctctgtaataggtgcattacagaacttgactatcactaggccagagataagctttgctgtaaataaagtttgccaattcatggaaaatcctttggatgctcattgggctgcagtgaagcgaattctaagatatctaaaaggcacagttctttatggtcttcatttaagacctgctgctttgggtcaaccttacttcattagagcactttgtgatgctgattgggcatttgacattgatgacagacgatctacctctggtgcagctgtatattttggttctaatctcatttcctggtggtctggcaagcagaaagtagttgctagatccagcacagaggccgagtacaaaagtctagctcaaaccactgcagaaatttccaggatcaagaccttgctaactgagttaggagtaccattcagaactcctgttatattttgtggcaaactcaatgcgatggagactttgtcaaagtctcaaccccttgagtttgaggggggtattagagtattgtacagacctgcggttattcaactgcagtcttag

SEQ ID NO: 101310 - DNA, 297 bp, Glycine max
  Peptide Sequence Number=SeqID_218088
atgtcagaaaaaccaaaaagcaggtctacaaactttgagaataaaaaggttcgggagttgtttttacacacgaggaagttacgacttaaacgatcggtcaaaactctcttaaaacaaagaaaaagaataccgaaagtagatgagatgaagatgaaaacatacaaagcaagtgtggaagcaatgatttccaagattattttgatgatgccaaagaatcaagagttaagcaggttccaaagaatcaggaatcaaaaagcttcaagaatcaagtttcaaagaatcaagattcaagaataa

SEQ ID NO: 101311 - DNA, 207 bp, Glycine max
  Peptide Sequence Number=SeqID_218089
atggagtcctttgtcgaatgccagcgccaagagaataagaaatcatgccttttatctgttgctgcacctacacatgttcctcaaccaccacctatacttgcatcccttgatcctccaccatcacctcctccatcttcaccaccaccttctcaacctccacgactgttggacttccggcaagtgcaccggatcacacaagtagtataa

SEQ ID NO: 101312 - DNA, 131 bp, Glycine max
  Peptide Sequence Number=SeqID_218090
atggcggaaccatcgaagaagcgaaagggcacttcgagtcggagtcaacggcattccgggtcacaggaaacaccaattccttcctccattccctctggatcattgttttcatcagaggaacagcgtatacg

SEQ ID NO: 101313 - DNA, 795 bp, Glycine max
  Peptide Sequence Number=SeqID_218091
atggagcagttaaagccggaggagtaccagatggacgtgatgactatgatgttgcagcaactccctcaactctctgaaccatacactcacaccatggaaggatttcatcccccagaagatcacttctatggtaacaacactatgccactagcagatttaattgataacaataaccctcacagttccatgccttggtcctcctcatactcgttcacacacttaccatcatccacaatctctttctccaataataacccaataatgcttcaagaacaacaacaacatagcccgagtgaaacatacgaggatgcaaatgcaaacccttacggaggtgagaagcggagctcgatggcggcgatgagggagatgatattcagaatggcggcgatgcagccgatacacatagacccggagtcggtgaagcagccgaagcggaggaacgtgaagatttcgaaggatccacagagcgtggcggcgcggcaccgcagagagaggatcagcgagaggataaggatactgcagagactggtcccgggagggactaagatggacactgcttccatgttggacgaggccattcactacgtcaagtttctcaaaacgcaggttcagtcactccaacgcgcttcctccgctaacaacaatattaggccacttggtactagtactgttaacgcaacaggaatagggttccctgttgctatgtctaccacttccaattccaccccttattttcctctgcctaaaccttaccaagctcgccacatggagaatatgcacgatagatatgattaa

SEQ ID NO: 101314 - DNA, 513 bp, Glycine max
  Peptide Sequence Number=SeqID_218092
atggacgtgagaatcaacatctcaaatttcctcaacaccggccttgacatgatcattcctgaaagggacgttttggactattgtcgaaccctcataaactcttccaagggcaaccagatgtcatctctccaaatttgtggtgcgagccatcttccacttcatgtgtcgtctaatgtgagatggaggatcaatgtgccatcgtcctcctctttgccttgtgccagagcccattttgtagaagcaaagcttcatggtgaatcaaaggtgattcaaaggtgttttgatgataacaatgatcatgacaaagatgatgataaaaagctcaaagatcaatcaaagaacaactcaagagaaacaagaacaattcaagagttcaagaatcaagaagaattcaagacccaaagaagaaagcctagaatcaagattcaaggttcaagatctcaagaatcaagatcaagattcaagactcaagattcaagaatgaagaaaatactcaatctagataagtattaa

SEQ ID NO: 101315 - DNA, 603 bp, Glycine max
  Peptide Sequence Number=SeqID_218093
atgacatggattgaacttctagagagacatgcaaatgaaccttctaattctttacattttgtgggtttatgtatcaaactcatcctttttaataatagtattcacgaggatggtattcatattattgagaagttgaaggagatgcatcagatactatcaagaaggtttgaacatgaaaagcacaagttgcagttgaatacaggatccaaagacctttcagcttttgctgaaaattcagctgcttattgttcatttacacctataatgttgtgtgaaaaatttgtatttgaggcttggcaggatacgtttcttacggttgattataccagtttattctgggacatgaagttattacaaaaactcacatcaattcatttggatgatcttgaagagttacaccaagggcaaggggggcgggggtggtgttgtgatgcattaaatttgaaaattgaaagctttattctagagatgtggtttaagtggcatgaatctatatgggtatatttccctaaatctgcgaagattgatggctctgatgaaattgaactaccctacatgctcattgagcctttcagtgcattagttgtgtttcagatgacgtga

SEQ ID NO: 101316 - DNA, 210 bp, Glycine max
  Peptide Sequence Number=SeqID_218094
atggaggatttgaaaaaggtcattctgaagacaatatttggtcataagatatgccaatcagcacaagttggtgtgcttgccatgttcaatatgtgtatgtctaggcctcaatttggaattcttttgatgagtacggttaaggaaatgatgaatttgcaacgagaagtgaagagaagacgcctaagaagaacacaaactggtccgtggtag

SEQ ID NO: 101317 - DNA, 1944 bp, Glycine max
  Peptide Sequence Number=SeqID_218095
atgaaagttttgcgcaaagaactctgcaaacttcatgagaaattggaacaacaaaagaaaatccttttggagactattgcaaaccgaaagaagttcctgaccagtctcccttcacatctaaagtctctcaagaaagcctccttgcctgtacaaaaccagctagggcttcatcatacaaagagattaaagcagcatcattcagcagagttgcttcctccagctctttatgtgatttactcacagctgttggctcaaaaggaggcctttggagaacccattgatctggagattataggaagcctgaaggatgctcaagcttttgctcgtcaacaagctcacaaggacactgacatttccactaccgtggagagttccaaattggaagatgatgctcctgatgaagaagaagatggtcagagacggagaaaaaggccaaggagggttcaagccaaggagagccttgaccaggggggaatatatcaagttcacccactaaaaatcattatccatgtgtatgaagatgaggcttcgggtcctaaatctgcaaaactcattactctaaggttcgagtacttggtgaagttgaatgttgtatgtgttggaatagaaggatctaatgatgctccagagaatgacctcttatgcaatttattccctaatgatacgggacttgagcttcctcaccagtcagccaaactctttgttcaagatgctataacattcaatactcaaagaacctcacgtccttatagatgggctcagcacctggcagggattgatttcttgcctgagatgtctcccttgcttcttactgacaacagtggagcagccaagaatgaaaatgttatatctggtctttcactatatcgccagcagaaccgagtaccgacagttctgcagagaattcgtgcaagaagaaaagctcaattggcccttctggaacagctagaatctctcactaagctagagtggcctcgtttgccctgcaaaagtgttccatgggctttacacactcctttgtgcaatttggacagttggtcacctgtaaaacttccacctgtacctagagagtcctcatctcctgctgtcatagataaagaagagcatattcaggaagcaatggatgctgatgtaattgaacgatctggtgccacaaaagcagaaccagagagtataacagaagatggggagcttccaacgttgcttcctaaagtgtctaagcttggcctttccgcacaactgaacttaatttcaaaaagtatcgttcctccactcaataaaatcaggtcacaaagtttcaaaaagattgatgatagttctgatttcttgctggatactgaaagtgatcttgatgagccggcacagattgaacaagaacatgaaaaatccaattatcatgccagaaagtctgtttcatggatgaattacgggctcaaggaatttcacttagttatttgcagaaaaatcggtacagatgagagcaatttgaatttagaagccaagatccagatcagtatggaatatcctctaaggcctcctctttttctattgagcattagttgtatatcgtctggggaaaaccatgatgagacaggattggagtggtacaatgaacttcgtgcaatggaagcagaggtcaatctacacttactaaagatgttaactgtcaatcaaaaaaattttgtattggctcatcaagtgagttgtcttgctatgttgtttgactattatttggatgaggcatccccatcatctgaaaggacaaattgtacttccgtggttgatgttggcttatgcaagcctgtttctgagggtaggatcaaattgatcttatgtgaagatacccctccaaattgtcccaagcaggaatgttcagctttggaggtgacaaatggatgctacggaatatggtaccgcaaggataatgatgttgtacctctgtaa

SEQ ID NO: 101318 - DNA, 174 bp, Glycine max
  Peptide Sequence Number=SeqID_218096
atggccggtaatggcggtagtgatgcatctgcatccatcgagtttccaactgctcttgctagacctaatcaattgactcacgccacttttgcgcgatgccaaggagcaaagggccttcgagctagaaccgcggattgggatccggaatgtgaaaccctaggattccaaaaatag

SEQ ID NO: 101319 - DNA, 480 bp, Glycine max
  Peptide Sequence Number=SeqID_218097
atggctttggcttctttactacccaaaacggcaccgcatgtcctttccctcacaaacccttccgcttccactcccttcatcttacctttcagtttccactgtttgcctcaccctcctcttctctctgccctcaaagctagttcctccggtggcgacgatttacgcggcaagcccctgctttctcagggaattggaaagggaattttggaggaacatgcctttgaagacgacgacgacgacaaatgggttgattgggaggaccagattttggaggacaccgttcctctcgtcggcttcgtcagaatgattcttcactctggacacgatgtggagtggccccttgccgctagagaagccactatagtggaacagttaactgtagtggccgtagtggaccaaatagcggccgtagtgcaccaaatagcggccgtagtggacgagatagcagcgctatgtgttgattccaaaaaccccctttga

SEQ ID NO: 101320 - DNA, 3014 bp, Glycine max
  Peptide Sequence Number=SeqID_218098
atccaatcgcatttgctgtcaagtctggtaggacatcgagttgggaaaagaaacctaacacagggtcggagaaaccatgctcacattgcaaacgtgatgggcatgatatcgactcatgttttcagctggtgggttacccagattggtggggagatagacctcgatctgtaggtcgtgcgcttggacgtggaaagcatgtgcatcgaccaatgagtggcgcgctaaaaggaagaggcaataatgcaaaagtgaatatgacacaagttgttgatgacactgaagtaatgaagtatgaagatgatcaggtgctgccggggttgagttcaaagcagtggaatgctcttcttaatgcgattaacacacaaaaaggtgggacgagtacaagactaacaggtgagaattcatggattattgacacaggtgcctctcatcatatgactagcactcttgcgtgcatgaatgatgttcgagatatagagccttgtccgattggaatgcccaatgggacacggacatatgcaactaaagaaggaatggtcactgttggtgacaagctaatgttgaagcatgtcctttttgtccctaatttaaattgcaatctcatctcaatctctcagctcttacatgatgctgattatattgttcactttactaaaacaatgtgtgttatacaggaccgcacttcgaggatgatgattggagcgggtgaacaatcagaggggctttatgtgcttagtgtggtgactccagtccgtgcataccaagcaaatggcattagattttgtgtccttcatcaaacttcaattcattatacaccgcaacaaaatggaagggtggaaagaaaacatcgacatatattgaatgtggcaagggcattgaggtttcaagccaatttgcctttgaaattttggggagagtgtattcttactgctgcgtatttgattaaccgaactccttctgcactacttgatgggaaaactccttatgaagtgttgtttgatgctaagcctgcatatacacaaatccgaacattcggatgctacccttatggaaaaaaggggtgggaaatgtatgatattgaaactgaagagtactttgtatctcaaaatgtgaactttgtggaagacatattccccttctctagcaatggcaaggtgagtgaaacacacgtagatgaatggggatggccgcttgatccaattgatgaatgtgaggaaaggaatgagacaagaaatgtagtgactactaacgacttgggggctgtagttgtgggaaatgatgttcaggacattgaaaaccatgaggaagtacatgttatggagcagcaaactgagacaattgaagatgtagaccaaggtgagagattggattctcaacagagtattcgaagtgatgaacttattggtcggggacatagaatcaagaatccctctacacgtctgaaggatcatgtcacacacactgcgactgtaagcctctcgaccagttcaccacttcattcaaaatcctcagggtatgagccaaattgttttgccgaggctgttaaggatgagaaatggcgaaatgccatgaaggaagaaattcaagctttggaggacaatggtacatggacaaccgaagatttaccactgggaaagaaagctataggatgcaaatggatctataagatcaaatataattcagatgggtctattgagcgtcacaaagcaagattggttattcatggcaacagacaagttgaaggcgttgactataatgagacatttgctcccacgacaaagatggtgacagttcgaacatttttagccattgcggcagccaagaacttccaactacatcaaatggatgttcgcaatgcgttcttacacggagacttggaggaagaagtgtatatgaaattgcctcctggctttgaaaagaaatctctcggtaaggcccctagatgttggtttgctaaattttcggatgccttgaaaacttatggcttcgaacagtcctactctgattattctcttttcatgttgcgccgccgtaacaccgagctgtatgtcttggtgtatgttgatgatatagttatatcaggaaatcaaagtgatgctatacataaattcagggattatttgggccactgtttccacatgaaagaccttggaaagttgaaatatttccttggcattgaggttgctcggaatgctacaggtatttttctctcgcaaagaaaatatgcattggatttgatatctgattgcagactactgggagcaaagcctgcgaccattcctattgaacaaaatcatcaattggcccttgttgaaggggagggcatcaaagatccaactggatataggagtctcattggacgacttatctatttgactattactcaccctgagttgtcgtattgtgttcacatcctcgctcaatttatgcaggcttcaaagattgagcattggaatgcagctcttcgggttgttcggtacctaaaaggcaatcccggtcaagggattcttctaagaactgattgtgatttgcgcttgtatggctactgcgacacagactgggcaggctgtcccctcactagacgatctttgacagcttattttgtgatgttgggtagttcccccatctcttggaagactaagaagcaaactacagtgtctcgatcttcggccgaagctgagtaccgctccatggctgcagctacttgcgaactcaagtggttgaaaggattgttgagctctcttggtgttgagcatactgatcctatgcaactttattgtgacaaccaatctgcccttcatattgctaataatccggtcctccatgagcgtacgaaacacattgaagttgattgccattttgtgcgagatgaaattgtcaagggtagcatccaacctttgtatgttcacacttctaaacaactagctgatatcttaacaaaggctctaggaaaacgtcaatttgactctttgctgtccaagttgggcgttcttcatctccacgctccaacttga

SEQ ID NO: 101321 - DNA, 111 bp, Glycine max
  Peptide Sequence Number=SeqID_218099
atgatgaggcagaattttgcgggtccaccagtttcccatgcgctcaatcaagtcaacgggaaagtgcctgtagccggtttcccacgagctttttcgttgacacataattaa

SEQ ID NO: 101322 - DNA, 666 bp, Glycine max
  Peptide Sequence Number=SeqID_218100
atggcagagaaaaaggatgatggcaacaagataaatgacgaatccaacaaagatgaaagtgggtctcatttgaagaaacagatctctccctacgatctgtattcaagtgataacccaggaaatatcataacccagcacgacgaaagtttcgattcgttgacggatcgattaaaaaaacctgatgatgctgcccctgaaatcgatgattggtggactgtcaattccatgattgtttcgtggattttcaatacgattgaaccgaaacttcgatcgaccatcacatacagagaaaatgcacaagaattgtgggatgatatcaaacagaggttttctatttcaaatggacctcgcatccaacaattgaaatctgaattggcgaattgcaaacagaatggagactcgattgtcacatattttggacggcttaagaagctgtgggatgaattgaacgatttcgaccagatacccatgtgcacatgtaatgggtgtaagtgcggcatatctgcggcgctaaataagaagagagaagaggaaaagcttcaccaatttctgatggaccttgatgatactcagttcaggaccgtgcggtctaatgtcctgagtctagacccgctgccgaatctgaacagagcataccagatggtggtgcaagaggaaagagtcgga

SEQ ID NO: 101323 - DNA, 639 bp, Glycine max
  Peptide Sequence Number=SeqID_218101
atgccaccggttatcattcccgggcagaatagcaagtcctttgtcagtgttagactagacatacagaaacaagttgagtgtagaatttcccgtgcagttttcagcttggttcctaggcacattcatggcaaactatgctttggtggtacaaaagttgaacctctagtaaaaatcaggcacacattctgccctagcaggataagagttgccgaagaatatcaagaaggtttgtctgatgaagatgatgatctctgtcccgtcgaatgtgtaagagaattcaccactgatgaagagttcagcaaaattctggacaaggctaaagaaactggatctttggtggtggtagatttctttcgcacctcttgtggaagctgcaagtatatagagcagggttttgcaaaactgtgcaagaaatctggtgatcatgaagctccagtaatctttctaaagcataatgtaatggatgagtatgacgagcaatccgaggttgctgaccgacttagaatcagggccgtgcctcttttccacttctacaaagatggggtcctgttggaagcattcccaaccagagacaaagataggattcttgcagctattctcaagtactcatctcttgaagctgaagatatcttaggttaa

SEQ ID NO: 101324 - DNA, 406 bp, Glycine max
  Peptide Sequence Number=SeqID_218102
ccccgcgaagttattgcgtagcgctgttcgccaattctccattctccaattttttcggagccccatgaatttattgcctggcgctgttcatgtgtcctccaccatcgagtctggagccccgcgaatctggagccccgagaagttattgcgtagtactgttcgccaattctccattctccacttttttcggagccccatgaatttattgcctagcgctgttcatgtgtcctccaccttcgagtctggagccccgcgaatctggagccccgcgaagttattgcgtagcgctgttcgccaattctccattctccacttttttcggagccccatgaatttattgcctagcgctgttcatgtgtcctccaccatcgagtctggagcccctccgaagttattgcatagcgct

SEQ ID NO: 101325 - DNA, 447 bp, Glycine max
  Peptide Sequence Number=SeqID_218103
atggcgttggtagagataccaggggtggttgcaatggtagtggtggtggtagcggtactagtagtgataaccaatggtgacaacaaagatggtattgacagtagcgatggtagtagcaatgacggtggtaatatcagtggcgatggtggtgacaacaatgttggtagtggtggttggggtagcagtggtaacaatgacgacaacaatgatagtaatgttggttacgatggtggcgacagtgactacggtgctagtgacaatgacgatggtggtgatgatgatggtagcagtgctggtattggccaccaacgatggaagtgcggtggtggtagttatgatgacaatgacggaggtgatattcgtggtggtgataatgacagtgctactggcggtgttggtagcagtggcgaaggtgatactggtagtaccggtgacaagaaaaagtga

SEQ ID NO: 101326 - DNA, 1720 bp, Glycine max
  Peptide Sequence Number=SeqID_218104
ctccacccccgccgtcaataacgccgtcaagctctacgtccacatcggcggcaacacccccaaagccaaatgggtaacttccgaaaaactcacctcttattcattcgtcaaaacccactccgacaccgacacagacgatgaaaacaacgactctgacaacgacaacgacgactacgtcgaaacaaacgaaaagcctttctgggttttaaaagtcggttcgaaaatccgatcaaaggtgggcccggagatgggactgaagagcttccccgagcagcggcgcgtggacttcgttgcgcgtggcgtctgggcgatgaagttcttcaccgaccaagaccagatcgacttcatcgattccttccagaagtgtctcttcgagaacacgcacggcgtcgaggccacggaggcgaacaagctcaaagtctatggcaaggatttcgtggcgtgggcgaaacccgaagccgccgatgattccatgtgggaggacgcagaggaagtcttcaccaagagccccacaccggttaggtcaaaccaagacctaaaagaggagttcgaagaagcctccaacggtggaattcagagccttgcgttgggggctttggacaacagtttcttggtgagtgataatgggattcaggttgtgaagaatttcgcacatgggattcacgggaagggtgcttttgtgaatttcagtgatgggtatcaaaatgggggtgggggttctacctattgtacccctaagaagacacttctgatgagggctgagaccaacatgcttctgatgagcccaatgggtggtgggaagcttcactcaacgggtcttcatcagcttgatattgagacagggaaggttgtgagtgagtggatgtttgggaaggatgggactgaaattacgatgagggatattacgaatgatagcaaaggggctcagttggatccttctgggtcaacttttctagggttggatgataacaggctttgtaggtgggatatgagggatcgtaatgggatggttcagaacttggctgattcaaatgcccctgtgttgaattgggcacaagggcatcagttctcgagggggactaactttcagtgctttgccactactggtgatgggtccattgttgtggggtctttggatgggaagataaggctgtattcggtgaacacaatgaggcaggcgaagacggcatttcctggccttggatcgccggttactcatgttgatgtaacctttgatggaaagtggattgtgggtactactgattcctacttgattcttatctgtaccctctttactgacaaaaatggaacgacgaagactgggtttgctggacggatggggaataggattgctgctcccaggttgctgaagctcaaccctcttgattcacatttggctggagcaaataacaagttccgcaatgctcagttttcgtgggtgacagagaatgggaaacaggagcggcatatagtagccactgtggggaagttcagtgtgatatggaacttccaacaagtcaaggatggttctcatgagtgctaccgtaaccaacagggtctaaagagctgcttctgctacaagatagtccttagggatgattccattgttgagagccgatttatgcatgacaagtttgcagtcactgattctcctgaggctccattggtgatagccaccccaatgaaagttagctcattcagcatatctagcaagcgatga

SEQ ID NO: 101327 - DNA, 1800 bp, Glycine max
  Peptide Sequence Number=SeqID_218105
atggagagcaccacattggtctcgcatattgtccccacttttacgtggtctgataatcgtccatggatacatttagttagtcctctctactcgggcattgttgataatactgctcaagggatgcaaggttctagtcttaaaaagatgctgaagacaatgccatctaaagcttcgattaccagaatcaatttggtcttccttgttgtatttctggttgtttatgccactgttcttccccatccatcttctgactatttgcaggatgcaggatccatagtgaggtgctctttgggcgaatgtcatcacagggtaagacacgaaaacttcaaaatgaaagcggcattggatgaacctcaagcaaacccacagaggcaaaagaataagagtgcaaagaagatagaagtaccaagcttttttagcaagttaggggaaagaatgaagattggaatggtaaacatgaaagaaaacgatgtaagtaactggagcacgcatggggaaaggacaagcgtttattttgagagggtatcgcagtttttgaactggacggacttgtttcccgaatggatagacgaggaggaagagaatgatgtgccatcatgtccagagatacctatgccggagtatgcagaatacggaagcatggacgtgatcgtggctaagctgccatgcaggtatcccgaagaagggtggaagagggacgttttccgtgtagaccaaatgctggagctgtttccatgcgacaacttggttaagggtgaaggtgaatggtggtattatgaacctgaggtgaagaggttagaacacaagtgtactgcaaaaataacagagttgaaatttgcagttgtcgacgaggtgtacgaattatccaagattgagaaaagcgttgaaagcagaaggagaataaaacgcgaagcgtacgcaacagtgctgcattcttcggaagcgtacgtttgcggcgcaataacactagcgcaaagcctgctccaaacaggtaccaaacgcgaccttatcctcctgatagacaagttcatctcggttcgtaaacgcgaggccctatccgaagcgggttggaagatccgaatcatcacccggatccgaaacccgaaggccgagaaaggaagctacaacgaatacaactacagcaagttcaggctatggcagctcacggactacgacaaagtaatcttcatcgactccgacatcatcgtactccgaaacctcgacatcctcttccacttcccgcagataacggccacggggaacgaccaatcgatattcaactcgggaataatggtgatcgaaccttccaagtgcacgttccgtacattgatgcggcaccgggacgacgtcgtttcgtacaacggaggggaccaggggtttctgaacgaggtgttcgtgtggtggcacaggctgccgcggagggtgaactttctgaagaacttctgggcgaacacgacggtggaggcgagggcgaagaacgcgttgttcgcggcggagccggcggaggtctacgcgattcactacctgggatggaagccgtggcactgctacagggactatgactgcaactgggacaccccggagcagagggtgtacgccagtgacgtggcgcatcggaggtggtggaaggttcacgacgcgatggaggaggggttgcagaggttgtgtaggttgacgaaacggcgtcggagtgagttgaactgggagaggaggaaggccagcaagatgaggttacccgatggacattggaaaatcaatatcactgatcccagacgatttgcctctctctttatggattag

SEQ ID NO: 101328 - DNA, 2922 bp, Glycine max
  Peptide Sequence Number=SeqID_218106
atggaagatgttgaagacaagataccccctgtcacctcttcaaaaattactgaagagacaacactggcagagcatgttggagacaagcttccatctgaatcctctccaaaaattgcagaagagacacccctggcagaacttgttggagacaggcttccatctgaagcttctccaaaaattgctgaagagacaccactggcagaacatgttggagacaagctaccatctcaattctcttcagatattgttgaagacacaccactggcagaacatgctggagacaagctaccatctgaattctcttcagaaattgttgaagagacaccactggcagaacatgttggagacaaccaaccatctgcatcctcttcaaaaattgatgaagagacaccaccggcagaacatgtgacagacaactctgaatcctcttctaaaactgctgaagagtcaccactggccgaacatgttgtcgacaagctaccctctgaatccactacaaaaattgctgatgagatgccactggcagacccccctgaagaaaatactgaagtgataaacccacctggcaatcaatcttccactgaagctccaacaatcccacttagtaatggaaaaatggagcctggtactcatttgccagtggatgagttctctgaattagcagtgttgccaaatgcttctgatgatcaaactttaatacaagatgttgcagttgatgtaacagaaaaaagccagcaggtaacttcagctgaagattctgaaccaggtgctgtagaaaatgtctctgacaggcatgaattgcaggatgatatttctaatatcactgctgacagtgatgctgataatgagattagactctcagcttcttcttctgaaacaaaagattcacaaagtgatcacaatgaacttacaatggctatgggaacagttggctcactcccccgtgccaagctatttgatgcaaaaagaggccttattgataccacagctccttttgaatctgtcaaggaagctgtttccaagtttggaggaattgtggattggaaggctcataggatccacaccgtggagagacgcactcttgtagaacaagaacttgaaaaggcacaggaggagatcccagagtacaaaaaacaagcagagactgctgaacaggaaaaaggtcaagtactaaaggagttggacagcacaaagagactaatagaagaattaaaacttaacctagagagagcacatacagaagagcgtcaagcaagacaggactcagaacttgcaaagctcagagtggaagagatggagcagggtattgcagacgaatcaagtgttgcagccaaggcacaacttgaggtagccaaagccagatatacagcagctgtttcagatttaatagctgtgaaagaggagctggaagcattgcacaaagaatacacttccttagtgactgatagagatgtagctattaagaaagctgaagaggctgttactgcatcaaaggaagtagagaagtctgttgaagatttaactgttgaactaattgctgcaaaagagtcattggagactacacacgctgcgcatttggaagcagaggaacaaagaataggaacagtcatggcaagagatcaagattctctcaattgggagaaggaacttaaacaggcagaagaagagctccaaagactcaaccagcaaatttcatctgcgaaggaactcaaatctaaactggaaacagcctctgctttgctgattgatttgaaagctgaattaactgcttatatggaatcaaagttaaagcaagaaggaggcccagaagaaccagagataaagacacacactgacatacgagaagcagtggcatcagccggaaaggaacttgaggaagtaaatcttaacatagagaaagcaactgctgagattagtatcttgaaggtagctgctacatcattgaaattggaacttgaacaagaaaaagcaactcttgcctccattaggcaaagagaaggaatggcctccgttgcagtggcatctctggaagctgaattggaaaagaccagatcagaaatagctttggttcagatgaaggagaaagaagctaaagagaaaatgaccgagcttcccaagaaactacaactaacagctgaagagactaatcaagccaacttgcttgctcaagcagctcgggaagagctacagaaagtaaaggcggaagcagagcaagccaaggctggagtaagtaccttggaaagtagattacttgcagctcaaaaggagatagaggctgcaaaggcttctgaaaatttggcaatagcagcaattaaagcattgcaagagagtgaatcaactagaagcaaaaatgaagtggacccatctaatggggtaacactgtctttggaagagtactatgagcttagcaagcgagcacatgaggcagaagagcgagccaatatgagggttgcagctgctaattctgaaattgataaagtcaaggagtctgaattgaaagcctttgaaaagttggacgaagtgaatagagagatagctgctagaagggaatccttgaaattggcaatggagaaagctgagaaggcaaaggaaggtaaattaggtgtagaacaagaattaagaaagtggagagctgaaagtgaacaacgaagaaaggccggcgagtctggccaaggagtaataaaccagagtaaaagccctaggggtagttttgaggggaaagcaaataattttgaccgcactagtgatgcagctaatcccgcacattacttgacaagtccaaaggctaatgagcatgcagacaatgatgaaggtggatcatccccagaatcaaaacatggaaagaagaagaagaagtcaattttcccaagggttttgatgttctttgcaagaagaaaaacacattcaaccaagtctgggtaa

SEQ ID NO: 101329 - DNA, 147 bp, Glycine max
  Peptide Sequence Number=SeqID_218107
atggagaattggcgaacagcgctacgcaataacttcgcggggctccagactcgaagagaatggacaattggcgaacagcgctacgcaataacttcgcggggctccaaactcgaaggtggaggacacatgaacagcgctaggcaatga

SEQ ID NO: 101330 - DNA, 615 bp, Glycine max
  Peptide Sequence Number=SeqID_218108
atggctttgtgttcagtttttctcaatcttcatctttggctttttgtttgtttgaccattgaagcgttaggtgtgccgaagccttcagtagctagttaccttagccaggagctactggcagagcaagaagttgatagagtgcatggattactagcgcagcctccagtgaagctcaacaatatgttggttatatcactgtcaatgaaactcaaggaagagatctgttctattggtttttcgaggccacccataaatcggaacaaaaacccgttctcttatggctcaatggaggtgtactgggacttgctttattgcagaagcaaaggagacactctcttgttttgtaatggccttttctctcactctggtgtcttacagatgacaatgtatgtttctaccattactcttagtcacagcttagagggcaatgctggtgaactgacgaattttgaggtccttgatttcttacgagctaaaggagcttcaaaggatccaacaagagttattgccaaagtagcgcagtctgaatacaaggttcatgattatttggttgacactgctacctctgttcaaacaagagagagcatcaatgagttcttaacaagtgttacatag

SEQ ID NO: 101331 - DNA, 408 bp, Glycine max
  Peptide Sequence Number=SeqID_218109
atgcgaattcctaatgactgttcttttgatacactcaagtgtaaaatgcacaagacccttcagctaaccaacgatcaattaggggatgaaatctactaccgacaaccattcatagatgcagaattattatataccatcaatagaacaccagatgctatactcaacctgcttcaatccactatcactcctactcatgatgcaattatgtattacaacgggaagtggaacatatcacgccaaggtgggattttgggttactccttcactggaacaaattcaataagatttggcattccttcgggatgtagcatggacaaactcatggatttaatcaagcaagttgcacctataggggttcctccttgtggaattcacggatcacaattggtcagacgattgttcttttga

SEQ ID NO: 101332 - DNA, 249 bp, Glycine max
  Peptide Sequence Number=SeqID_218110
acatccagtggacccggagaagtccaacagggtccgggggtttccagctctaattacgggcctttgtcagttctacggagtgcccatcacccctaacaagggcgagacaccacaacagcctggggatggccgggagcaagcaatagacacatcgctgccacctctagagccccttagctcatctacaaaggctggagcgttgcctacgacccgtggccgaccagcaggcgaccaagtccaaagccaaag

SEQ ID NO: 101333 - DNA, 120 bp, Glycine max
  Peptide Sequence Number=SeqID_218111
atggcatgttctaagagaagtggaactaatagcggaccacaacaacatggactcaaggatgaattccatgtaactgttgcattgcaagatttggaaaagaaacctgattctggtgattga

SEQ ID NO: 101334 - DNA, 822 bp, Glycine max
  Peptide Sequence Number=SeqID_218112
atgggagaaactacagaaaggtatgcagttgtgacaggtgcaaataaaggaattggattagagatagttagacaattagcttcagctggaatcaaggtggtgctcactgcaagaaatgaagagaggggtatccaagcactgcaaacactcaaggactcgggtctatctcaccttgtactgtttcatcaagttgatgtggctgatgcaacaagcgtagcttctctggcagattttatcaaatctaaatttggaaaacttgatattctggcagcaccagaagatgggacaaaggcaatcactcaatcatatgagttggctaaagaatgcttgcaaataaattactatggtgctaaaacaactgtagaatcccttctgcccctcctccagttatctgattcaccgagaattgtgaatgtatcatcaactatggggcagttagagagtttgccaaaaggatcatgggctagagaagtcttcagtgatgccaatatcatcactgaagagaaagtggatgaaatattgaagaagtttttgagagatttccaagaaggctcattagaaagtaatgggtggccaagacatctgggtgcttatattgtctctaaagctgctatgaatgcgtatactagaatccttgctaagaaatacccttcattctgcatcaatagtgtttgccctggttatgtcaagacagatataacttccaacactggcctcttaacagttgaagaaggtgcagctagtcctgtgaggctagcattgcttcccaatggtagtccatctggccttttctattaccggagtgatgtggcttccttttga

SEQ ID NO: 101335 - DNA, 2028 bp, Glycine max
  Peptide Sequence Number=SeqID_218113
gatacagaagctgaggaagttattgagaatgctgatcttgagtctcattctcggattcaacaaacagatagttcagattctgatgatattaggtacaatgaggtggttgttgaagagcaaccaacatctccaaaatctcaaactgtcaaaatgggcctaggacattattcaaatgagaaagttgagccaaattgtattatcaaaccttccagttacagcatcttggctgaccaagccttagatgacaataatatgaaggacaaagatgtctctagcacactatcatctcctctggattctgttgatgattctttacctagaaaagcatcaaggagatcatcatcaccaagttcagaggacgaaaatttcctttttagtggccatgacaaaagtgttatcaatgatcgattcgagagatcattctcccctgaacatgtagataaagaagatcatgtttcttatgggaatgacagtgaaaagttaacagcaatatccaatcccatagacattcctatgaacaaagctgctggggaggaagttgtgcagttttcgggatccttgccaaatatttcttctggtagtgacatcatggtcgaacacaatgttcgatatcctttatgtcaatcactggactcaaaatccacatccttgccatgggcatttcctggaaaagatgacttggaatgtctaaaatcagacgaagacaaaggaaaccagttatcacatgaagggcaaggtgccaaggattacaatgattctggggaactcaaaggtactgttctttatcttccccttgggatggtagctgactgtacttctaaagcattcaatgccgaatatctggttggcatggtgtcttttgaaagcccgtatatatttaaactgaaaggcatgataccagctgaccaagttgagaaaaatcatacaggagatccatcaacacgcaacccttccgctggtggaagttggagaatttggcctttctccttgaggagagaaggatctagaaagtctatgttgcccccttctccaagtgattccaaaaacactacttttgttaattctccagagaatacgattagtactgatatgaacaaaaatgagctcaaacccaatttaatgaaaaagaaggttaaggaaatgactccaacctctgaacagctagcctcgttgaatctgaaggatgggatgaatactgtaaccttcactttctctacagctgtgctggggaagcagcaggttgattgtcgaatatatttatggaaatggaacgctcgtatagtgatctcagatgtggatggtacaattacaaggccgagccctggtgcagcggtaaagttgtgccttggtgacttgttggtcatgggttcgaattcggaaatagcttctttgcatatgcaagggtcagatgttcttggtcagttcatgcctttggttggtattgactggtcacagacaggtgttgcacatttattctccgctatcaaggaaaatggttatcaactgctttttctcagtgctcgttcaatttctcaggcctatattacacggcaattcttactaaaccttaaacaggtgatggatggaaaagttttaccagatggtcctgttgttatttcccctgatggactttttccctctctatatcgagaaggctcttcgttatgcgaaggtatgggggagggatgttgtacgcagccttacccttgcatatgcaaagaggctgtttccggattcgaacccatgaccaacaagtcaccaaggcacaactttaccgctgcaccagggctcgccctcattattaggagggttcctcatgaattcaaaatagcatgcttagaggacatcaaggcactttttccttctgatagcagtccattctatgctggttttggtaatagggatacggatgaaatcagctaccttaagggagaggtggttataaaccgccgtgttgacgcaaaatcatatacttctctgcatgctcttgtgaatggaatgttcccccctacgagctcttctgagcag

SEQ ID NO: 101336 - DNA, 891 bp, Glycine max
  Peptide Sequence Number=SeqID_218114
atggaaacacatcatcaaccccaaaagaacaaagaaaacgatgtgcaaaagataactgaagaaggagtagcaatagcaaagccaccttcaccatcctcttccccttctcacgaattctccttcacaatctctctccattcttctaacaccacaatccatgacaaatccaaaactccaccttctcttgaagtagatctatctccagcagatgatattttcttccacggtcacttgcttcctctacacctcttatctcacttctcttcatcacctcgcttttccaccaactccgtggacagcttcacactccccatcagagagttcttagaagacgaaaaacgcaacagctgcaatagctgcaacagcagcaacatcaccatagatagcattaccaacagcaacaacatagaagaccacaacaatagagtcacaaaggaaggaagtaagtccaagcctagtttctcattgtttggtttatcaaaggggcgtaaagggtgtcaagttagagacaaagaagataaagaggataacatcaagcacaagaagaaactcgggtatgatgtgatgcatgcacttaagaagtacttgagaatggtgcagccactagtgcttttcggagggagaagagaaaaaggtcggttccatggacaagcttattctcattcggggaatttgatccggaaaaacaagcctgaattgagaggaagaagaggcgagtattcagcaccagcatctatgagaacttctccaacaaacagtggtcttctgctagcaactgctgctcttcctcctgcgaatgacagcaccatggaagagttgcaagcagctattcaagctgcaattgctcactgcaaaaattctattgccaaagaagagaagctcagttgctga

SEQ ID NO: 101337 - DNA, 534 bp, Glycine max
  Peptide Sequence Number=SeqID_218115
atggtctcagaggaggtgacaatgaggattctcagaggtgaagaggggagggttggtaaggatagagagaaagagaaagagaaagaggccgttcccgatagtcacgtcacgttgggggggcttgaagctaacgacagaggagtcaaaggaagctttggttgtgcatcagagaggggtttgggcatgacggatgagtgcggtttggagacaacgttggagaagcacgagacttatgataagcacagggattatgcgaatcgagtgtatgcttcagatgagggccttccagtccacttctgcaacagtcttccaaaaaaggacgaagtggtgactttggttgatgaggatgggattgagtattcgacaatatatttggcaggaaaaacaggacttagtggtggatggagaggttttgcaattgctcatgacctaactgatggggacgctttaatttttcaattaattaagcgcaccacattcaaggtgtacattgttagagcagattgtcctccagaggataaacagcttgagtga

SEQ ID NO: 101338 - DNA, 243 bp, Glycine max
  Peptide Sequence Number=SeqID_218116
atgtcgggtctagaatctgaacatccagccttcataaagtcaatgctacaatcccacatcagcgggggattctggctgataaatgagtatgtgcacaccaaggagagacaaaaagggggagagtttttggtaccaaaacccttaatttccgaaaataacgaaaacaagcttgttattaagatattaagtggaagtattggtcaaaacacacaaggattgggatataggattcgttattcgtga

SEQ ID NO: 101339 - DNA, 759 bp, Glycine max
  Peptide Sequence Number=SeqID_218117
atgttcatgactgaagcaataccatcaaggtcaactagcacatcttcagacacaaagcaaaggtgttgctcagatagtacgttttcaggtactaacctggggaggaagttgcgagggaacatgccaagaaaccaaatagggcttcaagtcatgaggctcgcagcagaacacgagggaacaccttcgcaagtgatggcggtgagtcagagtcgtgagggagaggaccgtcgcaagggtgagagtaagagtgaagtgccacagagagagagagaatggatgacatatatccccggcactactacaaaagcaaatttctacgacagctattctaagacggtcacgcgcacgctgtccacttccctgaaaagcttgcttctcttgccctcccgtcgtgcctctgcatccttgtcgccatccgccgtgccgctcgccgtctgccatacctctattgtccctcgttgtcaccgtggtcggctgcctggattttttggtggttcgagttcgcttggttcatctatcgtacatctgggttttttgcaaagtgatatagatggaaaaagggatgtgaacagattaatgcccgagaatttcgagcagaatggtttgagaaggaaccgggaagaggtgcatgaaagcagatctggaagtgacaacatggatggtggttctggtgatgattttgatgctgccgacaacccaccaaggaaaaaatgctatcaccgacacactcataagctgattcaagagcttgaattgtag

SEQ ID NO: 101340 - DNA, 141 bp, Glycine max
  Peptide Sequence Number=SeqID_218118
atggcaacgcccagaataataaaatggcattgcaattgcagcagtgtcgtgtctcctcaatcgaccgttgcattcccacttcccaatgtcttgcgtcatttccgcactaggttttccctcattcttgccgctaaaaattaa

SEQ ID NO: 101341 - DNA, 315 bp, Glycine max
  Peptide Sequence Number=SeqID_218119
atgtggagcgcagagaatcagaaagtgattgttctgatggatgtgctctgtcttggcttgcaggaaaagaatgagaggcaaaacttctacaaggaaaggcagaagttaaaaaagaactccgaatttgaacataggggatctgctgtagtgatgattgctcatttccatccaatgaaagaggaaagcgaaaaagctgcatattacagtggcaggatcacttttgcaaaaatcttcaaggcatatgctgcaagcatcatcacaagcttcttgaacccccttccacaaaggttgctgctgatgtcatatgacttttag

SEQ ID NO: 101342 - DNA, 632 bp, Glycine max
  Peptide Sequence Number=SeqID_218120
atggcgagagggaagtgggtttgttcctacaagaaaaccactctcttagtttgcttcttcaacattgccgttgctctctacgctcttcactctctctattcttctctttatatctactccggtaacgtttcccgcaacgttgcgttgtatagcccagatcagattcggaaaatggaactgtcaatccaaatccgcggggaatttaaacctgtggagttaattaagtgggctttagaaggggaattttcgagtgaaactgtggcagttgagttgccccggcatttgaaacagaacataattgatgagatcttgcagagactaaggagcttgaatttcagtagaacagatattgctaaggaacgaggggtttataaggttttgggctctccaactacaacaactaacttttgtggtgtggctctccaagattttgatcaattggaattagagccttttgccatgtctctcagctgcaaactagcagcacgagcatgctgggatgttaggatccaattgcaaggtatgggacttgaattgcacattggaagtatgggaattctggtgaggagtttatataaggctttgggctctccaactacaacaactagcttatgtggtgtggctctcctaag

SEQ ID NO: 101343 - DNA, 876 bp, Glycine max
  Peptide Sequence Number=SeqID_218121
atggcttattggcatttcattttctgtgatcttaacatttcagcttcagaggcgccgtctatttctgaattggttaacaatgtgacacttttcaatccagcaaactctgctggtgaccaagccttggagatagctaataaaacaatgtctggagaaaacgacaccattccaagaactggttttgtcttggaaccaggaagcacaccaaacaatgtctctggtattaatagatcagaaaatgtatctgaaacacagctggtaggagatcctggacctagcagtttcaacaatactattggtttgagtttctccactaaccattcccaagaagacaaccttgcatcacttgaacataaatctggaagtccgtatgcttcttcgacaaatataagcacaaacattgtaactgcagtgttatcaaatgattcctcaatatctttattccagaaagacaacacaactaactccataaaggaagatagtagtgttagaccaagctggttttcagctgttgatcaagagctactgcaggccagatcagagattgaaaaagcaccaattgtaaagaaggatccaaatttttatgctcacatttatcataatgtttccatgttcaagaggagctatgaattaaaggaaaagactctcaaagtgtacgtatacagcgaaggagctagaccaataatgcactcaccatttttcacaggactttatgcttctgagggatgctttatgaagcaaatggaagctaacaagagatttgtaactagggatccaaacaaggccaccttgttttacttacctttcagttctcaaatgctagaggaaacattaactggagtcgctgatcattttgtcgttggttgccatgacagg

SEQ ID NO: 101344 - DNA, 747 bp, Glycine max
  Peptide Sequence Number=SeqID_218122
atggatacatcacccatctcccctcctcctcctgattcagcaacacattccacttctaccttgaagaggacaagaaaagtgacatggctgagatcattggcaactagaccagttggcatggagaaaccacaggttcatgtggatcctgcgactggaaaagtcaatggtccccatagaaagaagttaagcacatatttggggatcattgctcatgataaggctgaatttgatacccctgaagcatctgatttgaggacgaagaagaaaatacttaagaacatgggtgagtggtggaaacagtttaagtccgattggacatccaaatgtgcacttgcaaatgacaaggagggcgtggatgatactatgcaatcacagagacttgtactgcctcctgagcctaaggttggtccttctgatgcttgtgtcagcataaaggagagttatgttgatccctcagggcatgaccaagacacgggtgactcaaagaaatgtggattgtatgtcgatgaaaatcctccccgcctggttgcccttggaagattttatgaatggtcgaccaccgttcacaacatccctctgggcaatgatcaagtcaaggtcagtgttgaggaagttagagatgttgatgctcactttcctatacccactcaagaggagaagcgaggagttgagggatcggtgaaacttgcagataggtcggatcttgatgtcaatcccctatatctgatgacattgaccatcccataa

SEQ ID NO: 101345 - DNA, 621 bp, Glycine max
  Peptide Sequence Number=SeqID_218123
atgggtgtgttctaccatgaagagccaccaaaccatcccaagagatgcaaataccttgtggcaactcttaaggaagtattttcccgttgccaaacgtttgcagcacggctttcaacttcaagttttgaggatgagtgcccagtgagcgattttgacgagaaacaagaattgtttatctcagcagtgataagccgaaacatggagaaacaaaagcacaagccaagtgtcttgagacacagcttttcctgggtatattctcctgcaacgaaagaactttatttcactcaggcagtggcaccagaagaaaaggtggtgaagggtgatgaagaaagtggtgaaggagaagagtttttgtcagttaaaagttgtttctcacgctgttcaagttcgccaagtggggaagcattctattctgtgaagacaaacctttcacggtgttcaagcttgaacgaacttgacttgtctaaatattggaggcgctcagtgattcaggagttttgtcattgccagggatggccttttggtctctgccgcagagctgtgttgcttccaccactgcccatgtcaccttctgagtcatggttgtcgcgtaaaatgcaaccaactattaagaaaccatga

SEQ ID NO: 101346 - DNA, 608 bp, Glycine max
  Peptide Sequence Number=SeqID_218124
aagtagttgagagttggcgcaaagaaaaactggaagaggtcaagtcggctcttgtgaaggggacttccaattcaaccattccccatgaagaagctgattgtgtgatgcttttagataatgctctgtgcaaactggtaatggatgctttacaaatctttgacaccttgtacataatattatttcaacttcctagaaatttattctttggacttaccaagtatacattctctccagaggacgagatccttcctggcagacctgtttcacccgagtgccatgctgaactgcacacagattatgatggtgctgcagtaagatggggtcttaccttccacaaagatagtgcggctgattgctgtcaggcttgtttggatcatgcgaaacatgccaaagaaggggaaaagaaatgcaatatatgggtttattgcccatctgagtttgggtgtcattctccagatatctaccagcacaaacatcaggaatgttggctgaaatatgctgagaaacctcgattaaattttaaggataagtatcctgaatcatatcgaaattcacatccttctgcaccagtgatcgttccgtgggtctctggagttattagttcatga

SEQ ID NO: 101347 - DNA, 351 bp, Glycine max
  Peptide Sequence Number=SeqID_218125
cgagaattcgctaagcgtaaccttcagtggctaagcgcgaggaagaatccaaaagaagatgagctgtcaagtttgctaagcgcaccgctccaagtcaacaagcacatcgcttcagctcatccgctaagcgaaataagcgcgctaagcgatccagatctgcggcacgagcatgaacaaggccacctatttaagcctgaaatcagatttgcaaaaggagtttggacatttcttgagaagctctgcatgcacgaaggttctagagagagaaaggtccaagttccaaagagttctgagagattttgctgtgtgaagatctacagagatgcgagttcgaagcgaaagccgttctga

SEQ ID NO: 101348 - DNA, 381 bp, Glycine max
  Peptide Sequence Number=SeqID_218126
atgttggtggagttattgatggtctctacagaggctgccagggctgagacagggcagtgtcgtggactgtatgtacacctccaatgggcccttcgtgacctcagtctgactgggaggtacacttggggagtagctgcgctggtgcatatgtacgaccacctaaatggtgcttctatctgcaccagccgacaacttggcggttacatcacactgttgcagtgttggatatgcgagcactttcccttgatcgtgaagtccgctgctgatcgggactatgacgagggctcactgcatgcttggagtgcctggaccgactccggattccggatgtctgttggatcccatatggggagcaccaaccgatccaggagttccatatga

SEQ ID NO: 101349 - DNA, 402 bp, Glycine max
  Peptide Sequence Number=SeqID_218127
atggggattgtgaggaatgccaaggaaggattatggtttgttggtgatgctcctactatgctccttttgagcaacaatgagaaggacaacaagaacaaggagaaggggaagagtgagaaggagaaggttgtcaagattattgggggaagagatgttgggttgaagggtggtgttgtgtccaggactattgatggttatcttgttttggagctttcaaggagtggagagaaggtgaagggagaccagtcagggtcacagtgttttgtgagaatgcttcaaccatatgggatcaacataggcttaaaggagcactcaaatcgggtgacccccaaggcctacactctgaagagtctgtcagggtctctccctcctgattcaggtccaacccagaaagcattttag

SEQ ID NO: 101350 - DNA, 369 bp, Glycine max
  Peptide Sequence Number=SeqID_218128
atggaatgttacattggttatgttgttgaattgggttctaaggaggaagaggggtgtttcagaagatcgaaggcgttgaaaactgagtgtgaggataaagtgtcaatgagtaagcgtggtaaggacgaggttaggaatgtccttctccagaacaataactgcaaaggattcccaattctgaacctcaaaaaagggtggcacaaaattgtcggatattataaccggaatgcattcatagaaaatggcttccaccagtgttggactgttcacttcataggctttggcacaaatgcagtacttactgctcttcatgtactggatgtagttcctgttgcccctggtctttggcaatctctcaaagattttcat

SEQ ID NO: 101351 - DNA, 677 bp, Glycine max
  Peptide Sequence Number=SeqID_218129
atggagagaacattgtcatcccttctacagattcagcctccaacctatggaaacttagtcactattctcagcatcgacggaggtggtatcaggggcattatccccgcaactattcttgctttccttgaagcgcaacttcaggagttggacggtgaggatgcaaggcttgcagactattttgatgtgattgcaggaacaagcacaggaggtattgtaacagctatgttaactgctccaaatgataatcagcgtcctctatttgctgccaaggatatcaagcccttttacttggaacattgcccaaagattttcccacaacacaggaaagttgttgagatcattgggaggaccgaaatacaatggaaaataccttcaagaagtggtgagagagaaagtaggggagacacaggtctccttgcttggatgctcgactctccgacatatgcatcagcacttctgccgcacctacttatcttccagcctaccacttcaacaacaaagattcagaagggaacatgcaccaattcaaccttattgacggtgacgaaagagaatttggaaaaacttagccaaattggtgagaggttgttaaagaaaccagtatctcagatcaatttggaggatggtctgtttgagccggtaggaaatggggagaccaatgaagatgctctcaaaag

SEQ ID NO: 101352 - DNA, 450 bp, Glycine max
  Peptide Sequence Number=SeqID_218130
atggccacagagaccaaaagcagcactgtgaagctcaaatcaagggccccagatggctcttccaagggaaagattgattcttcagctgtcaggaagaaagtggaaagctcaagcaagctccccgctgattcaaagatgaaatctgtttcaactgtgacaaaatctgaggttaaatcgaaatcaacatcgtcatcttcaaagacagtaacacagacaactacaaaagcgagagagaagaaagtctacagtctgcccgggcagaagcatgatcctccagaacagaaagaacccctgagggttttctatgagtcattgtcaaaacagataccaacaagtgaaatggcagaattttgcttgaagttatcttcattttatgctgtcttgtgtttcaaaaattctaagctatcttgcttggattctgattggcggaggagaattggagaatcataa

SEQ ID NO: 101353 - DNA, 595 bp, Glycine max
  Peptide Sequence Number=SeqID_218131
accagttggggcaaaaagaccagtggttcatgttgatcctaccactaggaaagccgatggtctccacagaaagaaattaagaacatatttagggattgtcgctaacgataagggcgaggaaaacaaagtatgtcaaaagtacgacataagcaaagagaagtggaaccagttttgtcagagctgtagagacccttcatgggagggatcccgcacctcttcgtccatggctcctgatgacctaaagcggctgacacaaaagatcagagaccagctggaggagtcaatcacacaaaaagtgactcaacaattaatgatgtccttcagccagatgcagccacagattcaatcacatggactcgcattgcctcctgaggctgaggttggtgcttttgctgctcgtgttagcataaagaaaagttgtgtcgatccttcaaggcaggaccgaaaaatgggagactcaaacaaaggtgggttgtatgtcaatgacagtcttccccaactggttgctcttggaagagtttatgaggggtcgatgaccgtccacaatgttcctttgggcaaagatcaagtgaaggtcggtattgaggaactttga

SEQ ID NO: 101354 - DNA, 573 bp, Glycine max
  Peptide Sequence Number=SeqID_218132
atgcggaactggggaaaatgggtgtccgaaatccgcgagccccggaagaaatcgcggatatggctgggcacattccccacgccggaaatgccggcgagggcgcatgacgtggcagcactaagcataaaggggaacagcgccattctcaacttccccgaactcgcggcctcgctccctcgtccggtgtccttggctccccgcgatgtccaggccgcggcagccaaggcggcccacatggacctgccttctacttcatcttccatttcatcgtctttggttccaactactcagtccgcgtcctcgtcatcttcttctctatcgtcgttgacttccgctgacttgttgcccactgcctccgaagaactgagcgagatcatcaagttgccgaggctggaaacaacgagttacgagctggggaacgagtttgtgttcatggactcgcaggacgcgtggatgtatcagccaccgataccgtggttgcatactacctacgacggttctgatgcagatgagtttgtagtgccagagagtggggttgtgactagttttgagagttttctgtgggactactga

SEQ ID NO: 101355 - DNA, 360 bp, Glycine max
  Peptide Sequence Number=SeqID_218133
atgcccgaggacggggtggggatgtggcgtgtgtcagactctcctcaacattgctatttttctttccttaatgatttttcatggaaccttttcagctcagggaaggccactgaaattggacataaaggagcaagagtcacaacccacaaaaacattatcgaagaaatagctaaagtggcagaatatactgccacgtggcatcgtcacaccttagaattcgaagcttcgacagcacctgaaaccaggaatccacaatatgacatggttacaaacgatttccaaccaacggatccagggcacagtcccggtgccggccattcctccccacacgctaacatagtttcaatttcaaagccataa

SEQ ID NO: 101356 - DNA, 609 bp, Glycine max
  Peptide Sequence Number=SeqID_218134
atgttgaggttgtacataatccagagtgaacctacaacaacgataccgatgatcatagcggtgaacagcaatgccaccaggttccagcgctcttccgatgaggatggtggaatgagaggcagtgccgttcattaccatcgcaaatggaattaccgtcaggatgatcgacaggataaagccgatcaggtagacaacggtaaatacgcagatccagaccacgtccaggaagtgccagaacaggctcaggcacatcaggcgggttttgttggtcgcggtcaggccgaacttgctcacctgaatcatcagcacgatgatccaaatcaggccggaagttacgtgcagaccgtgggtgccgaccagcgcgaagaagctggacaggaacgcgctgcgatccggaccgaagccttcggcgatcagatgatggaattcatagatttccatcgccacgaagcccagaccaaacaggaaggtcaggaacagccaggtgtttacaccgccaactttacccttgttcatggcgatcatcgccatgccgtaagtgatggagctgaacaacagcaggaaagtttcgaccaggacaaacttcaggtcgaagatgtctttacctga

SEQ ID NO: 101357 - DNA, 237 bp, Glycine max
  Peptide Sequence Number=SeqID_218135
atgaagaataagaaggttgttgtggctggagtctcgctaagcgaggcttgtgcgcttagcgaggcactcagcccgctaagcgagttgggagaatctggaggagaatctgtcaagcatctacgcgcccaatgtgtcatcaacttgcttagtgagtcgtttgtcttctctcgcgctaagcgcacccagctcgctcaatggaaaatcatttacttgcgcttagcacgaaaatggtgctaa

SEQ ID NO: 101358 - DNA, 999 bp, Glycine max
  Peptide Sequence Number=SeqID_218136
atgccgatgcaatacccggcggcggcgatggtaatgcagcaccacatgatgccgcctcagcattacgcgccgccgcagccctacatggcctaccaccagtaccagcagcaggtgccgcaagcgcaccacctgggatccagcgccgagaacaagaccgtttgggtcggcgatttgcatcactggatggacgaaaattatctccaccgctgttttgcttccaccggcgagatttcctccattaaggttattcgcaataagcagactggtctatcagagggttatggatttgtggaattctattcacatggcacagctgataaagttttgcagaattatgctgggatattgatgcctaacaccgagcaaccgttccgcctgaactgggcaacatttagcacaggagacaagcgttcagataatgttcctgatctttctatttttgtaggagatttagctgcagatgttacagatagcatgttgcatgaaacttttactaatagatacccatctgttaaagctgcaaaagttgtttttgatgccaatactggccgttcaaagggttatggtttcgtcaggtttggagacgataatgagaggtctcaggctatgactgaaatgaatggtgtttactgttctagcagacctatgcgtattggtgctgcaactcctaggaaaacgtctggctatcaacaaggaagtcagtcaaatggcacatccagccaatctgaagctgattctacaaacacaactatatttgttggaggacttgaccctaatgttacagctgaagatcttaagcaaccattctcccagtatggtgagatagtctctgtcaaaatacctgttggaaaaggatgtggttttgtacaatttgcaaacagaaataatgctgaagaggcattgcagaagctaaatgggacaacgattggcaagcaaatggttcgtctttcatggggccgcagtccagcaaataagcaggtgtactccctccactcttaa

SEQ ID NO: 101359 - DNA, 702 bp, Glycine max
  Peptide Sequence Number=SeqID_218137
atgaaaaggatcctcaaggctaaacatgaaatcaattgtttggagcttcctctcattgagcacattcaaggacctgatttaggcaggcttccttctgtattaggtgacaatgcatttgattgggttgtgataacgtctccagaggcaggttctgtctttctagaggcatggagcactttatatgattatcttgtcttgattgttgtccctagatcttctgggatgcctcatgtcaaaataggtgttgttggggctggtactgcaagcattttcaaggaagctttgcagtcttcaaaccgatcaattgatattgcctttgtgccatcaaaagcaacaggaaaggttttggctactgagcttcctaagattggaaataaatgcaccgttctctatcctgcttctgcaaaggctagcaatgagattgaggaaggactttcaaaccgtggatttgaggttactaggatgaatacatatacaacggtgccagttcaacatgttgaccatacggttctaaagatagcacttgctgcccctgttgttacagtagcttcaccatcttctattcgtgcctggaagaatcttctttcagattctgagtggaacaattctgttgcatgcattggtgagacaactgctacaatggcaagaagtttaggtttcacaaatgtgtactatccagcacaaccaggcatcgaagggtaa

SEQ ID NO: 101360 - DNA, 252 bp, Glycine max
  Peptide Sequence Number=SeqID_218138
atgcaacaaattgaggccttaaaaaagcagataggccaacttcctcagcaatatcaccaaggtggaccacaaaaaacacatcaagctcaccaaaggaggcctattatctacagaaccaagccagacctcaacaaaactttcaaggaagctaccaaggctatagaggtggctcaggtccttctaacaactcttatagaggtttttcaaataggggtccataacaacaacaagctcaatcagatagaatgttaa

SEQ ID NO: 101361 - DNA, 571 bp, Glycine max
  Peptide Sequence Number=SeqID_218139
atggattctgtaggaataagatcggctaacccttatttggcgactcctggagcaacggttcatggccattatggggaaatactttctgaaggagatatattagttacatttatctatgaaaaatcgagatcgggtgatataacacaaggtcttccaaaagtagaacaggtattagaagttcgttcgattgattcaatatcgatgaacctagaaaagagagttgatacttggaatgggcgtataacaaaaattcttggcattccttggggattcttgattggtgctgagctaacgatagcgcaaagtcatggaatgtctaatgtttttttgcccggtgaactaattggattgttgcgagccgaacgagcagggcgttccttagaagaggcgatttgctatcgagttctattattggggataacaaaaacatctctgaatactcaaagtttcatatctgaagcaagttttcaagaaactgctagagttttatcaaaagccgctctccgggggcgcatagattggttgaaaggtctgaaagagaacgttgttttagggggaatgatacctgttg

SEQ ID NO: 101362 - DNA, 894 bp, Glycine max
  Peptide Sequence Number=SeqID_218140
atgaatagtgggaggataagaaagaacttaaatggaaagcgcattatggttcatcatgatgacatgcgcctcagccccctttggttgaagccttccacacaagttactgtgcctgcttccattttaggatgtacttcagaatgctttttagatgagaagaagttgacaattgagtttccactttccagtggccgatatattcatgcagttgcagcagatttagaagaagtgcaaaagatgaacaccagcgtcaggccgaggctgcagcataggaaagctccaactccaacgacagtgtcacatgaaaagcgtgagagttctcaatctcatccaaagctatggcttcagtttttaatgatcaatgatcccagaaattctgaaaatttgattctaacctctaaagccttgaatgaaaaggcagagatgcggggaagctcgcgagggggagcaaataatgctgttaagggtggaaaaacttcaagcaaagacagaaaactggctttgcaacaagatgtggacaggttgaagaagaagcttaagcgagaggagaacatccacagagcattggagagagctttcaacaggcctttgggagctttgcctcgtcttcctccatatctccctccttatacactaggacttctggctgaggtggcagtgctggaagaagaaattgttaggcttgaagagcaggttgtacattttaggcaggacttgtaccaggaagctgtctacatgtcatcctctaagatgaaactcgagcaatcagcaagagtgaacaatgcaagcccaaatagtagtcccaaactgggtaaattgaagtccctatcccagacaatggatgatgctgcaacatctgaaactaggcctacaacaacgcttccaagtgagtaa

SEQ ID NO: 101363 - DNA, 237 bp, Glycine max
  Peptide Sequence Number=SeqID_218141
atgaagaaggctttagagaaaaagaaattaacttctgaggaggcaaggaatgctgaaagattagcaatgcaagcttttcatgagaataatgcccttgttgaagaaggagataatggggaaaattctgatgaggaagaacatgaattaactcaatgggaggcaataatctggcttgctatcttgacaacagaggtatctatattgtctggataccttgtagaggccatatgggtatag

SEQ ID NO: 101364 - DNA, 906 bp, Glycine max
  Peptide Sequence Number=SeqID_218142
atgagtgctgcaaagaatttggattctacagctgatgtaccacccttaagaactccaaaatctaaaaattgtgtagaaggaattgagttttgggatccttatagtatctgtttggaatttggaaagagggatattggtccatacaagcaattacgttcaattgaaactaaatcattcgatccaaaacgaactgcgaagtctttgtttttactgcatcggttgaagcttcttctgagaaaactagcctgtgtcaacattgagaacctcaaccaccaggagaagcttgccttctggatcaacatctacaattcatgtatgatgaatgcgtacatagaaaatggtataccagagagtcctgaaatggttgctgcgctgatgcagaaggcaacaataaatgtgggtggacacttgctaagtgcaacaactatagaacattgcattttaagacttccttatcactggaaatttaaaattataagcttcttacagctaaattctaaacagacattatcaaagggagggaaaaatcatgaaacttatggactggaattgtcagaacccctagtgacatttgctctatcctgtggaacttggtcctctcctgctgtgagaatttacacagcatctcaggttgagaacgaacttgaaatggcaaaaagagaatatttacaggctgcagttggaatttcgatatcaaagtttcttatcccgaagttgctggattggtatttactggactttgcaaaagacttggaatcattgctggattggatatgcctccaactaccaagtgatgtggggaaagaagccattaagttccttgagaaaagaaaaaccggccccctctcacaatttgtacatattatgccatatgagttcaattttagatacttgctatgcacatag

SEQ ID NO: 101365 - DNA, 255 bp, Glycine max
  Peptide Sequence Number=SeqID_218143
atggaaggagagaattcttcttcaattgaggtggatggacatatactaaataaggctttaacaaacaccctgatcataaagttctcatttctccggctcaccagtgtgaaggagtgtgaagaagaaaggcttttaatggagatcggtgagagtgcattgctaacaactacttgtgggaagaacaaagcagctaagtctcaagctaatcagaaagggaatgggtatgcaaaacctaaggaaactagtgggaagtga

SEQ ID NO: 101366 - DNA, 291 bp, Glycine max
  Peptide Sequence Number=SeqID_218144
atgaaacaactagacacaattgggctcgaaaatggaaggagcaatgagaggaggttagaagaagtggggttgcagagtgtgagaaggcaacgaaggagggggttagggaaatctgttagggtatggggtgggagtaacaattttgggatgagaatagcaactatttacttccgctatcagtttctaggcccaattgttttgcatgggcaagccgaaagagcgagtaacccaacaaagaaaaagaagagtgaacatatattattggcttcttacaaatataagagaccttaa

SEQ ID NO: 101367 - DNA, 252 bp, Glycine max
  Peptide Sequence Number=SeqID_218145
atgaattatttgaaaaagtggagttgttgggttgagaaagaatgggtacctgagattgaggttgatgcaccacttcacttcatcactgtgccgtgtcttcgcattcagacagcagagttgaaaaaggaagaaactttcttagcaaagctttatcaaaaaatatttgtattctcatttatggctgttcataatgagaaattaaaggaagtagagaacacttttctgtctgtttctgacttagttatcacataa

SEQ ID NO: 101368 - DNA, 357 bp, Glycine max
  Peptide Sequence Number=SeqID_218146
atggctccattcaaacctggttatactgcaaattcacctgtctgccatcctggagatacttcaattgatatcagtgatgactgggcaaccactaggaatcctttagatttgcacaatgctcgacttttggctattgcagctgtggactaccaagttccagagactgagcacgaagattatgtcaatgctggcactggtggaaccacattgtggcactctgttggtctaattttaatggctcttttacttctgaggcatgctgctcccctcttcaatgctgatgtggagaaagctatagcatatttttatcaatcagctgaagaacttgcatttatgctacaggcagaggaacaataa

SEQ ID NO: 101369 - DNA, 1482 bp, Glycine max
  Peptide Sequence Number=SeqID_218147
atgtcagagaagatcatggttcactcaaggtttatattttgcatgatgataatttctctgttccttttgatcctgtcttccattttcctgctccagtttagcagtcattctttgatacctagatcagtgttagaacttattcttgtcaataacgcgtcgctttacttcatgcccaatttgaagagagaacaagttttacaccctccctacccttctggggatttaaaatttcaatcacaaaatcccagagaatctgactgtcaaacttctaattcaagccagaaaacaacttctgtaggacagcaaatgaatatggtatcctacccaactcgaccactattgaaagtattcatgtatgacttgcctcctgaatttcacttcgggttattgggttggaagagaagtgtgaatcaaacatggcctgaggtgaataaccccaaacgtatcccgcgctatccgggtggtctgaacttgcagcacagcatggaatactggctcacccttgatcttctgtcatcaaaagttggccagccttgcactgcaattagagtgcaggattcaagtcaagcagatgttatttttgttccatttttttcatctctgagttacaataggcattccaagcttaatggagaggaaaaagttagccttaacaaaatgttgcaagacagattggtacagttcttaatgggccagaaagaatggaaacgttcaggagggaaggatcatctaattgtagcccaccatcctaacagcttgttggatgctagaagaaagttgggtgctgctatgcttgtacttgctgattttggaaggtatcctactgaattagcaaatatcaagaaagatataatagccccctacaggcatctagtaagcaccataccaaaagccaaatcagcttcatttgaaaaacgtaccacactggtgtatttccagggagcaatatacaggaaagatggaggagccattcgccaagaactgtactacctccttaaagatgaaaaagatgtgcatttcacatttgggagcataggaggaaatgggattaatcaggcaagccagggcatggccatgtcaaaattctgcctcaacattgcaggggataccccatcgtcgaatcgcctctttgatgccatagtaagccactgtgttcctgtgatcataagtgatgaaattgagctaccctttgaagatgtcttagactactcagacttttccatatttgtccgtgcctctgactctatgaagaaaggctacctgctgaatctccttcggtcaatcacgcagaaggagtggagcaagatgtgggaaagattgaagcagattacacatcactttgagtatcaatatccatcccaacctggggatgcagtgaatatgatatggcagcaagttgaacgtaagatatcttcaataaggttcaatttgcacaggaagaacagataccagagatctcagcttcgtgttaagagtaactga

SEQ ID NO: 101370 - DNA, 276 bp, Glycine max
  Peptide Sequence Number=SeqID_218148
atgcggcaaattgccccctttgggacacttttagaaacttattccctagatggggtcatttttaaagtttttccacgacggggttgttttgtacgtaaattgcatggggtcacaaagcaaatcgccagtgaaactggcgagtttgctgtccgtgaaggaatcgccactgggaatggcgatttggccatgcatggggaaccaccagtcaaactggcgagttccacagcacaggaggtaggctcaggctttttagagatggcaagcgcaagcagctaa

SEQ ID NO: 101371 - DNA, 354 bp, Glycine max
  Peptide Sequence Number=SeqID_218149
atgggggagcacgtggttttatctgttcttgactctcttatagcacctgcaactttgcaaccacaacatgatggtgatggtgatgctttaggttcactcattgagggtgctactcatgttaatgatgttggggaatgtgatacacttgaagaagaagaagaagaagaagaagaccttatcaaaatggtggaatgtcgcatttgccaggaggatgatacccttcaaaatttggacataccctgtgcttgcagtggaactttgaaggggtatgtgggatacacccagaatattgataattttgcatatagattatataatgtaactattgtaggaaacattgtgggaaagccctga

SEQ ID NO: 101372 - DNA, 285 bp, Glycine max
  Peptide Sequence Number=SeqID_218150
atggcaaacttggagaacctaacgatggttatgcaaagagctattctaacttctacaaaagatgttgttgatagtataaatgattatgtcatgtctttgatatccactgacgagaaagagtattgtagtgttgatagtgttgataaatctgatgaattactcaatcctacttttggagttctaacacctgaatttctgaactcattgaaaacatcaggaatacctaatcacaagttaaaaatcaaggttgaccctcccataatacgcagatgggttatgcaatga

SEQ ID NO: 101373 - DNA, 879 bp, Glycine max
  Peptide Sequence Number=SeqID_218151
atggcgcagggtaaaagaaaggggcatagagcaactttactcaaaaccgcattaaccgagactgtgtatgagctttggaaatataggaatgaaggttttagaattttcacaaaaccctccatggcagaagaagcagcaccgaaagtcgtcgatcccaacaccgtcgtcgccgccgccgccgccgccgccgtggacatggacgtcgagaacatcgaggccggcgacaacggcgccgagccgaaccagaagcgcgccagggaggaagaggagcccctgggcgacgacgacgacgttttgaagaagcagaaggtggccgaggaaaaggaacagtccgtagaggaacagcggctggagaagcgcgatgaaaaagaagaaaaggaagcagaaaaagaagaggaagagaaggaagcaagtggttccgtgaacttgggattcaagagcttcgtttcttcctcggagatgtttcattacttctacaactttctccatacctggcctcaatatctcaatgttaacaagtatgaacatctgatgttgttggagttgcttaagaacggccatgcagagccagataaaaagattggtggaggggttcgggctttccaagtccgcaagcatcctaccttcaaaagcaggtgctttttcctcatcagggaggatgactctgctgatgattttagcttcaggaagtgtgtggatcacattcttcccttgccggaagagatgcatttgaaatttgatgcgaacaaggcattgggtggtggtggtggtggaggaggaaagcattatggaggaggaaagggtggcagaggggggaggggtggacgaggaggaggtggacgtggtggtcatgggagaggaggaaagtggagacattaa

SEQ ID NO: 101374 - DNA, 807 bp, Glycine max
  Peptide Sequence Number=SeqID_218152
atggagaatcagcaactaacgttttggaagtccaattatgatattgatgactattatccatttgcacctacgagccaattttcttcatatgattattgcggctggggtagtgccgctgatgggtatcattggccacatgaatttcctttgcaagatagctatcttgatgctatcccttttatgaagttttattatcctcatgacattttgtatgaaactactcttcccattgaaccaacctcactaagcatacaagactatgacttttctgattggaacgaaatcgatggttctgatcataaacctgtgttttcatcatgcaatgatggagaaagtgtaagtgaaatgaaggaggatttgaatgctaagaaatgcagagaagagaaaattagtagcagtgcgaaaatgttgtcaagaacaactgtttctcaatacttttacatgccaatatcaaaagcagcaagagagctcaatgtgggcctcacacacttgaagaaaaggtgtagggagttaggaattcagaggtggccacataggaagctgatgagtctgcaaacccttataaagaatatacaagagcaaggagaggccgaggggcatgaaaatgatgaaaaattaagggctgccattgagatgttgaagagagaaaaaaggaaggtggaggaaatgccggatttggaacttgaggataatacaagaaggcttagacaagcttgttttaaggctaactacaagaagaggaaactcgtgggcatgaggttcattgaacctgagtcttctcttagtggtctatccaacaagtattga

SEQ ID NO: 101375 - DNA, 183 bp, Glycine max
  Peptide Sequence Number=SeqID_218153
atgcatgctggaaccgccagtcaaactggcaagttccaacagctaggcgcaagcgtaggggaggtcaggtcagggtgcaggacacagcgaagcaggagtggtgcagcagggaggcagcagtggtgcagaggacattgcccttcttcttccaactatgtggtttctctcttcttgattttttag

SEQ ID NO: 101376 - DNA, 423 bp, Glycine max
  Peptide Sequence Number=SeqID_218154
atggaggctgaacctttgagcttcattgaggtctttttaatggtgattttcagccacgaagttgcagtggaagataaaagagaagagattggacaattcgtaatacacaccactttttgttttggcaccattcttgacctaattaactatctctttgagctcctcaaactcaagttgacgatcaaccacctcatgctcttcaaccatggctgccatgttgttggcatcgttctccacgaagttaaggacattgtacaaaacaaccttgagtcatgtgtccctgtcgtgtgtgttgagaccatgctcacttccttttacactcctactgagtccaacgttgatgctttaataggacacactctgttcggtgatggtgccacccacgctgaagaggaaggcagagagaagaagagactgagctaa

SEQ ID NO: 101377 - DNA, 243 bp, Glycine max
  Peptide Sequence Number=SeqID_218155
atgctgattgaaagagttagggttaggattgacattataattcaagggcttaccattcttgctccagttgactctccaaacactgatggaatagatccagatgctatatgtgagctaaatctctgttcaaatattaggcgactcatgtttaagaaagaatttgacacaagctatgtgggattcaattctggatcagagcttctctctcgtcagaatttatgtaatgcgtaccttgacttctaa

SEQ ID NO: 101378 - DNA, 225 bp, Glycine max
  Peptide Sequence Number=SeqID_218156
atgtcggcgggctatctcttcctgaaaattcgtgtactcatcgtccctgagctggacgcgtctttctctgtggaacgaccatcctttgatggtctcaaagcactgctggtgctcgacactcctgaaacgatggctatcaaactcgagggcagcactggtcccttcatccgcggcatccctcctagatctctacacggaaagctttttcggagccatttcctgtga

SEQ ID NO: 101379 - DNA, 450 bp, Glycine max
  Peptide Sequence Number=SeqID_218157
atgattatgaggggccaagacatttatagtagccaagatgaggctactacttcaccttcctctagtgaaagtgaagaagcaaaagaggaagaatctagtgaagaaatctacccccaagaagaaggacaacctttaatggttaaggaggagtgtaaggaggtaagtgtctcctccaagaggttagctaagaaggaaagtcattttgaaataaagaacaatattaaagaaacttcccctcttagacaacctccacatcttctcctttgtaaaaagacacttgttagcactgccacacctcttaggcttgaggttattcctcaggtgctcatatgggacaccataggtgtcgagggaaggagcctagagtatgaagaacctcgggatttgaggtcaaatcctttccaaggtggaggggatgatgcaatcctaccccccaaaggtattggatag

SEQ ID NO: 101380 - DNA, 354 bp, Glycine max
  Peptide Sequence Number=SeqID_218158
atgggggataaaaggaggaagtcaacgtcagctttttttaggatagtttttttagatagaagggagggagttctaagaaggaaacgccttgagtatgttgactgtatttctcagtattatcatattcctgatacagaacgttcagatgatgaggtcaacatgcatcgtcagattggtattgattgtccaagaattgttcctgatgttccattcttccagcagcagcaagttcagaaatcattggaacaagaatctaatcagctaatacagcaacagatatcaagaaggcataccacaaggcagctctccgacatcatgcagacaaggttagaatcttatgtgcctgcattatag

SEQ ID NO: 101381 - DNA, 408 bp, Glycine max
  Peptide Sequence Number=SeqID_218159
gaagtcctaccaaatgcaaattccactggggaagatgttatccctgatgataatgaacatgaaaatcatgttgaggaagttgggaactcccaagttgggttagaaccaatgggagccacaaattctgaacatgttaatgaggatatgttggatggtactaatgatttttctgaagatgagcaactacatgcatataatgaagttgatttcaagactcatcttctccttgaagtggcgtctcctctctctcttcctttctccattccactgccattcatcttccaagaagcaaaggaatccattgatgaagaagatcctaggcctacaagctccaatggagcttgcatcaagtttgataaaccgaagttagtcttggtgtggataaatgagaaatccttatattattga

SEQ ID NO: 101382 - DNA, 1389 bp, Glycine max
  Peptide Sequence Number=SeqID_218160
atggttcttcctcacttcaaacattctagattcaaagatgaccaacattgcagtcaccgtataactgaagtgctagatccagatggtaaaatttcaccaactcaaattttcaatatgttaaaaaggttaggactagcagttgcacctaggagaaagatgtgtgatgctgatgctgaaggacctttgtctactagccctaatcagttagacggtgacaaaataacaggagctacaaatcataaatccgtgaatttggagggaagcctgttggttcaacacatattcaaggaccacagaagatgtagttacatgatagccaatgcactggataaggatggtaaattcactactgcccaagtctctcgaaaacttaagctgcttggtttgtctcttcctctgaaaagttctggaggaaaaatgcacccaaagggtgcagatctcatggatcgttcaaatgaaaggatggatgaatctgatgatgagacattggtatcactggtaaaaaggaagaaaatggagagtggcaaattatcaaggggacagttacatgggcaaaccagtgaggataaattgtcaaaaggcgattctgatgatgaaatgctcagctctgttctcaagaaaaaaataaatagcaaagtatcaactgaacaattacttgaacccattaatgtggattcatcgtcaagagatgattctgatgatgaatgctcagctctgctctcaattgtttattctagcactgttcgtatcagatttaattttctttgtattggtataatttctggatgcagaagaactagacgaccatctcttaaatcaaagcaagttgagcttgaaaatatccaaattcatgagagaataatgggcgatgattctttcaatggacgcataacagaggggtgcttctccttaactaacacagcaatcagcattgatgtccctgcaaggactatgcaggtgtctataaattcagcattgatgtccctgcaaggactatgcagaaagatgctaaagaaaatgaaaaagcaacccctcttgtttgtggaactccttttctggaagactcggagggaatgccattacatcaatgttgaatatttgttgagcgagcttggtcatttgaagaaagaaagtgccaattggaataacactctgggagatgaagaaattggttcatccccagcaaaggtgtggacacaggatatcaaaaacaagcttgatgatgttattaaaggctttgcacctacctctggcagtaacagtgacaaagatgatcataatggggagcaattgatggaagatgaatctcaaattgctctaaggagaaggaagaaacttgttcttgatggtgatttggaaagacaaatcaaagatctccatgagaagtag

SEQ ID NO: 101383 - DNA, 555 bp, Glycine max
  Peptide Sequence Number=SeqID_218161
atgaaacagcttcaccatccatcagcattagacatgtttgacaaaattattgatgcgccaaaaggaaaacaatttgtcatgtttctggactatgatggcacgctgtctcctatagtcgacgaccctgaccgtgctttcatgtgtgattcgatgagaaaaacaatgaggaaacttcctaggtgtttccctactgctatagtgaccggcagatgcaaagacaagatcaggaaacttgatgactcagaattccgcaatgccttttctcgtgctttcatacgggttattctagaagtcctagtcgtgattcaaggaggagctattctagaagcctcagccgcagtccatatgtctcacgaagccgcagccatagccgcagcagaagtcatagctatagtgacaggagcagaagttggtctccgaaaccaaaacactctcgacgttcaatatctctttcaagtgaatgagtatccctgcgttattgtaactagggtgtttctcttggagtctatgtttctatcatctttcctaataggtagtatcatgtggctcatttaa

SEQ ID NO: 101384 - DNA, 228 bp, Glycine max
  Peptide Sequence Number=SeqID_218162
atgacatggagcaacttcccggctcgaacttccaagttcatgaacaaattagtttgcatcaaggagtggcagtttgtcaacaaggacattggagtcaagaaaccagggaacatatttgaacaacaactgatacatacttcactgggctgcaaacgggttttggattatatatcaatgaatggaaggtatctgggctgggttatggttactccagaaagagaacagtaa

SEQ ID NO: 101385 - DNA, 291 bp, Glycine max
  Peptide Sequence Number=SeqID_218163
atgggttctccaaaaatggatgagagtgagacacctaaggttacaataataacctacaaaacttacaaggctgaggttgaaaagtgcaacttatattttgtctacttgggattagcaacaatggtggtggccttcaaggaagggtattgctggagcaagacaagtgaaaggcaggcgctaagaattcgttacaagtacttagaagctgtcctaaggcaagaagtagggtttttcgattcacaagaagcaattaaagaaacaaaaatgagtaaatgcaggagatctacatga

SEQ ID NO: 101386 - DNA, 177 bp, Glycine max
  Peptide Sequence Number=SeqID_218164
atggccgacatcggccggctaggttttttcgtgagagctcaaccaaagttgtgtttcggccgacaccggcatgttctcattaactctgccaggaaaacattattctccgatactgatcgaaaagagaatgatagccgatgtcgtccgggaaaggtggccgatcgaggtctacaataa

SEQ ID NO: 101387 - DNA, 300 bp, Glycine max
  Peptide Sequence Number=SeqID_218165
attatggttagaactatagatttgggttttgcttcagacagagttataggaagagccctgggtagagaagataatcgtgattcaggtgaagctctccagcgacgaagacccacaacatttgcacataggcaaaaggaagctgttgcggaggatgttcatcacgtagatgacacacagctgaggaggtcttccaatagcctcaagaagcagttgttgatgcccaaggaatgtcttgaattgaagctatcctctcatggaaggaaggctcagaaattcgacaagcctgctgcagagatttaa

SEQ ID NO: 101388 - DNA, 825 bp, Glycine max
  Peptide Sequence Number=SeqID_218166
atgaacaaccaagagaaagatagatggatgagtgttacggtggaggagatgaattctttacaaaagaatcaaacacaggagctagttgagcttcctacgagcaagagagtcataggattcatgagacatacgtctatcaaggtcgtactagccttagccttggtagtcagtcatgacatgcacttagggcaaatagatgtgaagacaacctttcttcatggtgatctagaggagcaaatttacatggagcagccggaggggtttagtaaaggtggatcgagtcaccttgatgatgaatcttttatttttctgctactatatgttgatgatatgttgattgctagtaaccatttgcgtgatgtgaatgagttgaaatcactgttaagcaaggagtttgaaatgaaggacttgggtcctgccaagaagattcttaggatggagattcacaaggataggaaatccagacgattgcatatgctgaggtggagtaaatgtcaaaggttccctatgccaatgcggaaagtgacattgggaagtagtgaagtggatcttgagcaaggtgatcctttagttgcgagatatgtggattttgactatgttggtgatctggatgacaggaggtctacaacagagcatgtctttactctcgaagggctagtgaagaagctgagcattgagcaaggtggagttcaattgcattgtgatagtcaaagtgctattgatttggttcatacttcagataatgccgctaatatgataaccatggcggtcacaactgacaagttcaagcattgcttggacttgttgaatgttggtcagtgctag

SEQ ID NO: 101389 - DNA, 432 bp, Glycine max
  Peptide Sequence Number=SeqID_218167
atggccggagggtcgacttctccggcgaaggcaatcttctggccgaagagcttaattgctggatccttattctcctgcattttctggagatccaaaagggacacgacacaacaacaaaaaagaacgcgcgagattaacggttttttgtttatgctaatgtttatggttgtggcggctgtgtcagttggcaatgggaagcacgacgacttggattttgatccgtttaaaccagagcagggtgccacgtcaccaggggtttcgattcttggccacaagtttttgtggcttgcaatagattttcttttaaaagtgtttgattctctcttctctgcgttgttgcacgctctttctgtgcactcgactcgccgccacgtcggcgtgctcgcaagggtaccacaattttggcctccctggagagacgttattggttag

SEQ ID NO: 101390 - DNA, 1125 bp, Glycine max
  Peptide Sequence Number=SeqID_218168
atggcgcttaactctagggccaaactagaagtagggaagttcgatggaatgggaattttggattgtgacaaaggagagttaaggatttgttggcaaagcaaggaggagttgcaagataggggcaacaatacatttgtgtttggcagacgaggtcctttatcaagtggagttgaagtctccgggggaggagggttcgaatcttcaacaggatgtgaatgccttcaatcagattatcaaagatttttcaaggggaaacatgaacgtgaaaggacacaagacaagggttctggtggttggcagaggaagaagtctaggaccagagaacgtaagcaaacattggagtgctacaaatgcaaccagaaggggcattttaagagggattgcccggagttgaagagatatggtaaagggacatcccgctcatcaaatgtagtagagactgacgattcagactactacactacagaagatgtctactacagtgagagaaatgttctttccagttcatgcagtcaattgatagaggcatggattctagatttcggattttcttaccatatgactcccaacagggagtggttcaccacatacatgtcagacaattttggtgcagattgcgatgttggtggagtgagaacgttgggtgatgttcgacatatccctgagttaagggagaatttgatctcacatggtaacttacaggccaatagttttatttacaaaactgatggagatcgggataccctcagagtgtgtaaggaggtgttgattgtgatgaaagcacaacgaattgcaagaaggctgaggtggagaactagacgaaaaaaaagatcaggcttttggacaaaagtggtgaataagacatgttatctacttaaccaatcaccgcaagcatcattggatgagaaagttgcagaggaagtttttataggttattccaaaggtgtgaaagggttcaagttttgggatccaatttctaagaagatggtgatcaatagggatgtagtgtttgatgagcagtccatgttgctagagatagtccatgcaactatgcaagtgtctaatggagtcccccaactccatggaggttcaggtggacttagagcagctatcaatgattcttga

SEQ ID NO: 101391 - DNA, 1266 bp, Glycine max
  Peptide Sequence Number=SeqID_218169
atggatgtcgacaaggacgaagaagacgactttggtgactcagagactgaagatgagaaagacaaggatccccgagctgaaaaagttagtgagaaaacgaaagaagctgatcctcctccaaatgctgcagactcaaagaagaccccagagggtattcagaacccaaacacaccttccatagacgaagaatctgcaaagtcaaaaaccaacaagtcagagaacaacaacaacaacaaaacactgaagaagccggacaaaattttgccatgtccgcgctgcaacagcatggacacaaagttctgctactacaacaactacaacgtcaaccaaccacgctatttctgcaaggcgtgccaaaggtactggactgcgggaggaaccatgcgaaacgtgccggtgggagcggggagaagaaagaacaagaactcggcttcgcactaccgccacatcacaatctctgaagcacttcaagcagcaagaattgatgctgcccccaacgggactcatcatcttttgaaaccaaatgggagagtcctcagcttcggattagaattagaccctccaatttgtgattccatggcctcagtccttaacctcactgcagagaaaaagggtactcttaacaacaattcaagaaacaacaacaacaacaacaacaacaacggtgatgattgctcaagtgcatcttcaattactgtttccaatgaagaaaacgggaaaagcacgtctcaagaatcaattgtggtgcctaacagcaacggtttcatccaccatgttccatgcatttcaactcttccttggccttatccttttccctcaggagcacctgctatgtgccctccagggtttccaatgtcattctaccctgcagcattttggaacattccatggtttccctcacaacactcacaccattcttctgctccaactcctaggtctccgaattctccgacactaggaaaacactcccgcgatgacgacgcgacaaaacaataccatttgcaagaagaacaaccaccctcaaggcagagaaacggttctgttttggtccccaaaacactgagaattgatgacccaagtgaggctgcaaagagttctatatgggcaactttgggcatcaagaatgagtgtgtcactggtggaggcatgttcaagggattccaatcaaagaaagaagagaaagaccatgttgttgaagcctctcctgtgttgagagctaaccctgcggctttgtctagatcccttaactttcatgagaactcttga

SEQ ID NO: 101392 - DNA, 402 bp, Glycine max
  Peptide Sequence Number=SeqID_218170
atggcaatgggatctttttcacaagcacgaggagccttgggcaaaattgctagattccaagtatggtggttggagggctttggaggagggctttgcaataagaaaagaaactggttggatagtggggggcggagacaagttcagattttgggaggactcgtgacaaccatttcgtgcatgggaaccaacaacagcactggatgggaatggaatctcacttggagaagggatctttttgaatcagagttactgttggcagatacttttattggggatttagctcagcagcaagttcagcctcatagggaagataaatggatatggaagcatgaccacagtggacattactcttcaaaaagcgggtatgaccttatatggagagagctaagggggtcaatctag

SEQ ID NO: 101393 - DNA, 168 bp, Glycine max
  Peptide Sequence Number=SeqID_218171
atgtggtaccgtgtcagtgaaaaatcaccctggggcgctgaggagtacataacaagacacatcacaacatgggcatgtcaggcctacactccgaagagtctgttagaacctctccctcctgattcaggtccaactcctaaaataatttttgcatacagacactgctaa

SEQ ID NO: 101394 - DNA, 531 bp, Glycine max
  Peptide Sequence Number=SeqID_218172
atgcaactgatttgccagaatgcctgcaaaagatgtgctggctttcatgtctggatacacaccaggaaacaaaagtctcgggcaagatggtgccaggattgccaagactttcatcaagctaaggatggtgatggatgggttgaacaatcttcccaaccatttctttttggcttattgcagaaggttgatgctccttcagcatatgtgtgtgctggtagcaggatatatgatgccattgaatggtatatctgtcagggcatgagatgtccagcgaatactcataagccaagttttcatgtgaacacaaatttaatgtccaagcataattctggcaaaggaactagttcaggtcaaagaggtgggcatatgccaacacctaatatcgaagaaaccatgactgaggaagaattatttgagtggttacagaatgcagtacatgcgggtgcatttgacaattttagtggcactgcaatagagagcccatctcccaaatctagaaatggaatgaaaagcctttgtgaaccatgctag

SEQ ID NO: 101395 - DNA, 288 bp, Glycine max
  Peptide Sequence Number=SeqID_218173
atgcagccaagaatgttgtggattgtggatgagaacttaaagccgctatcactgcctgtttgtgttggccaagcagtaaatgttgtaggacaagcaggtcatcctaaaacaatcactggctttcagacccactacacccctattctgctctgtgttggggacagggcaaagctggcaatggaaaaataccttcccctgtcaccaattcttgaagatgcagagaaagggagaggttacctattgagagtggcagcaacgggaagcacgcagagtgaagggaagccgtga

SEQ ID NO: 101396 - DNA, 372 bp, Glycine max
  Peptide Sequence Number=SeqID_218174
atgaccatcatcatcccggataccatcggactcgcttgcctcaggatgataaaagggactttgatagtctcagaacaattaaaccaagtgactattacagtctttgcatgtcaacaggcttgcttgcctctggttgacgaagtggagactgcaatagtctcgacttgtcgtctccggatgacgaagtctcagtcaacagacattgagtctttgacgaagagtgcagacaaccatgttggtctctgcgtgtcatcggacttgtcgtctccaaatgatgagggtgcggataaccataagccgtctccagatgacgagggtgcagacaaccatgaggtgtctccgcgtgtcatcagacttgtcatctctggatga

SEQ ID NO: 101397 - DNA, 435 bp, Glycine max
  Peptide Sequence Number=SeqID_218175
atggggagaaaccttactccagagaatagtgccatgataataataataataataagaggaagaactatgagagggaaaaagaagaagaagaagaagaagaagaagaagaagaagaactatgaaagggagagttcttcctcaaagaggcacattgatgatgtgctaagtactccctctcatgccaattttatgaacactagggagaagcttaactccaaagaacaatgccatgataataataagaagaagaactatgagagggaggaatcttttggctggaaaccacttaataaagggaatgatacttctgaaaggttctattctcaaagcatgggaaagggtagggacaagaacaagaatatagtggaaaacgagtgtgaacaatgtatcttgtcagattctatcaactactctttaatatggtcgtttgaataa

SEQ ID NO: 101398 - DNA, 456 bp, Glycine max
  Peptide Sequence Number=SeqID_218176
atgaccatcgcgcaaaataaaaaagcgttttttgactactttatcgaagaaaaatacgaagccggtattgtgctcgagggttgggaagtcaaagccattcgcgataaccgcattaacttgaaagagtcttatgtggtcatcatgcgtggggagatttacctgattggctgtcacgtgacgccattgggctccgcttctacgcatgtccgtccagatgcaattcgtacgcgtaaattgctattgcataacgaagagattgcaaagttgattggtaaggtggagcgctctggttataccattgtgccactagacatgcatttcacccgtggccgtatcaaggtacagattggccttgccaagggtaaaaagcaacatgacaagcgcgatgttgagcgcgaaaaagactggaagcgtgagcaaagccagttactgaaaaacaaggccagagagcgatag

SEQ ID NO: 101399 - DNA, 659 bp, Glycine max
  Peptide Sequence Number=SeqID_218177
atggcacaagtagaaaaaaccgttttagtcatgcattccagcgcagccatgtttcagctggtggacgctgtagaagactacccgagcttcctaccctggtgtggaggtagcgagctgattgaacggacggaaaacatcacccaggccacgatatatatacgctatcacggcattcaacaacacttcacgacacgcaatcacaaacagtttcctaaccgcatggagattacgctggtagatggccctttcaagcaactggccggtcactggcactttaccgctttacgcgaagatgcctgcaaaatcgaattcaaactggagtatgtgtttgccaacagcctggtggagcgcatcattgcgccggtattcacacccactgacacaatcccggttgaagtagcttatgccttgccacacaagcaaagcctgatcgcactcgatgtcttaaccgggaccaccgcattgcaagctgtcatgcaatccggcatcctggagaaatatcccgacctgactgccagcaaactcacattaggcatttttggcaaacgggtcgcagccgacaccatcttgcatgcttttaatcgggtagagatttaccgccccctgcttgccgatcctaaagaggcgagacgacagcgcgcagctgccaaaaatgggaa

SEQ ID NO: 101400 - DNA, 1042 bp, Glycine max
  Peptide Sequence Number=SeqID_218178
gacgtggcttattttggttgccgttgtagtactttgtacttttggcggtattcgtggcctgggaaccggccttgatgacttccagtatcgcgacttctatgcccagtttatcgataaaattattatcgaaggtttctggcgtgctgtcgtggaattccgttatgaaccagccatttacgccattgccggcgcgacacgtatctttaccgctaatccggacattttcatctttgtcttcgcggtcatcgctgttggtgtcaacgcgcactacttccgtaagctgacaccgctgccgctggtggccctcgccgtctactctgcgcacctgtttatcaacaaagacatgaaccagattcgcttcggtttatgttcggcgtttttaatgggcttcgtctggcacatgtcgcggcgcagcaagtctggcatgatcaccaccttcatcctgtcgtttatcagccacgccaccgcgattgtcgcgctgctgattccgctggcgatgattgtgcgtaaaaacaaatacatcccgattgccatcgtggtcgccagcctgccgctggcgtttctcggcagttcggcgctgatcgccgcgctctccagccacctcggtgcgctgggcgacagggccatgggctatgccgatgccgattctcgccaggaacagggtattctgaccctgtcgaacctgaagaatatcggcttcgtctttatcttcagctacatgttgctgagcgataaaattaaaaatttcgacccggaaaagtttaatacctattacattctggtgatcacttttgccatcggcagtggcctgaggatggcgctacaggattacgcttctggtggtcgtctggcgaactatttgctgcaggtggagccggtgcttatttcgctgtgtatctgggaaaccagaaagctgaagaaggtgcttgccgtggctgtcaccattctgatggtgctgtactatctctactacaacaccgtatcgagcaagcagtcgattgtcggctatgaggtgtcacgcaccttccagctgttccgttag

SEQ ID NO: 101401 - DNA, 630 bp, Glycine max
  Peptide Sequence Number=SeqID_218179
atgcatgatttacgtttagtggtgtgcagcggtgggtggcacaatcgacggatgagcgtgatgggtgcgcttcaggaaacggctctccagcaaattccaggaggtgtaagccagcgccagcttcatcacaatcgtcagccccaggccagcaaacgcattggcatcaaacacaccaaaatgctgcagtacctgaataatcggccagtgatagaggtacatgccgtaagagagatcgccgtactggctgattttaatctctttacacaggctggtgcagaacagaatcactaccgccgaaaacgccaccggctcaacgataaacgcgtaatccgtgctcttgaacagcaggaacaccaccagcgacacaatggtgatctctttcaggcggtcaaaggttggctgatgcaccgccagcaggctgccaaagaagaagtaggacgacagcgcaataaactgcttggccagcgtatcggctttcgggccgctgtacagcgcggtgaagtagaagtaccaggcgcaggagataataaaaatcacgctccacactttcagcgggcttcgcttcagcaacggcacgataaagggcagcagcacgtagagtgtcagctcggctttgatggtccacagtga

SEQ ID NO: 101402 - DNA, 524 bp, Glycine max
  Peptide Sequence Number=SeqID_218180
atgtaccctcccttgttctctttgaacaacctagtggatgtaccctccactagaactgatccacaagagatgtatcctctcttgttctcagtcaacaaccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 101403 - DNA, 159 bp, Glycine max
  Peptide Sequence Number=SeqID_218181
cccccttaaatgcgttttcgttcttgcatcttccacccatgagttgggagccccaagtagtgattgtttagtgccattctgcattttctacgtttttgttgggtgtgccttgaactgcgttttcgttcatgcatcgtccacccacgagtttcgagccat

SEQ ID NO: 101404 - DNA, 444 bp, Glycine max
  Peptide Sequence Number=SeqID_218182
atgagcttcgacgtggtgggaacccttatcgatttcgaacggggtctgacatcgacgctggccgcaatcggtgcggaaaacggtgttgagggcgatggtgaaaaggcgctcgcgctttaccgtgcggcccgctactccgacgcgaccgacctttttcccgatgatctcgtgcgcgtctacctcatcattgcccctgagctcggcctgccggtggagcgcgcctatggtgagcgtctgcgcgacgcggcgaagaactggaaaggcttttccgacagccgcgccgcgatggccgaactttcaaagacccaccgcctgatcgccatgaccaacgcccgacgctgggccttcgactatttctcgaaggaactcggcaaccccttccacgccgctttcaccgcggatgacaccggcactgaaaagcccgaccctgccttcttcgagaag

SEQ ID NO: 101405 - DNA, 1201 bp, Glycine max
  Peptide Sequence Number=SeqID_218183
atgtcccaccaagagacttcaatctataacacctgaagaagcttggaccggagacaagcctatgatgaatcgtttgaggatttttgggtctcttacctacagacacatcccagatgaaaagagtaaaaagctagatgataagagtgaagctcttatcctagttggatatcatccaactgatgcatacaaacttcacagccccttgaagcagcaggtggtgattagcgaagatgtcatggtagatgaaactgcagcctggaagtgggaaaatgagtctaaaattcccaactcatatattctcatggacagcccaagagccaaggatgttaaccctgctagctcaatgcaacctcttattagaaggtcaaagagaacaagatttccctccataagacttgcagattacgagctgtacagtaacagttcaatctctgataatggtgaaatggtacattttgcttttatgtttgacatggaacttgtacattggaagcaggccttagacattagagaatggaaagctactatgaaagaagagttggatgccatagagaaaaatagaacctgggagctggttgatttgccacataataaacatccaattgatgtgaggtgggtgtttaaaggaagtatacatcttgcagctctttatggccttaagcaagcccctcgagcttggaacaaagtgattgacaatttccttagcaaacaaggatttgtgaaatacacagtagagtttggagatgtgaatgaagaaatcgagcaattcaaagaaaagatgaagtcagagtttgacatcacagaccttggaatcctacattattttcttggttttgaatttatgcatacacagaagggaatcttcctacaccaaagaaaatacactggtgaggttctgaaatgctttaatagggagaattgcatcacagtcccagtacctgtgatgccaaacttgaaattaatagaagaactggatgaaaggccagttgatgcaacattgttcaagcaaattattggctcacttagatttttgtgcaacagcagactcgacattagttatggagtgggattgcttagcagatttatgggtaatcctcgagctcctcacatgactatagctaagcatatcctgagtgataaggttgaaagaaaaagcacctctggatacttgcttaagtatctggatgcaccaatatcctga

SEQ ID NO: 101406 - DNA, 237 bp, Glycine max
  Peptide Sequence Number=SeqID_218184
atgggtgaatacaaccaactatcattaagaatctcatccttagaccaaaaacaggcaaaaggtggaataccgcaaagagaaagcgtacccactaaaaaagaagtttttgtaattggtagaactatgaaaagaggaagaagtcgagctacaagaaaaattcccgcggctaccatagtagcagcatgtaaaggcggaaattggagtagcccttccatagcatctggtagccatacatga

SEQ ID NO: 101407 - DNA, 315 bp, Glycine max
  Peptide Sequence Number=SeqID_218185
atggagacaggggaacgagggaggggcgacgagggagggtccagcgtcgagggaggggccggcgtcgacctcccgcggcggtttgtggagcaagaagaagagagtgtgtctgagaaagagagtttcgggaagaggaagaggcattacattggggaaaggaaaaaggcattggaaatcactgaagcgattgaggagatcaagaaagagctcgcttgtggtggaggggaacttcaagatactctcccaaattcatggtgcattgaaatcctaactccaaggcaatctcattttgtaacgaattacaagtattcctag

SEQ ID NO: 101408 - DNA, 595 bp, Glycine max
  Peptide Sequence Number=SeqID_218186
attcaagtcttttgatgaggatctgttgaccatagtggagagggttgacaaggctattctagatcaattttcagtcttattggatgctcgggcaatcttgtcccttccttcgacgaacaatcctctctctgccttacatgatatcatgggagatttcgcatggaaacccttagttaagccgatcggacctattggtggtgatatgtcttcttttgctgcgaagaataggaccatgaggaagcgtgacggcggtgtgccaagctgtaaaaggtcaagggcccttttcagcctccgagtcatgaagcaagctattgggtttatgaccagtttgggttgcccctcttcagttggttctcaaggtctgcctttgactccattggttgtgcacgctacaactgctcttttggagccacattctattttggcaccctctgcttctccttcttccactattatgacacttcttagtgctggtgtgatgactacaaatttctcagcggacttgcctccttcctctctagccttgccagcttcagttcctattgccttgtcatggcgacgcgtacctcctcttctcgatcaagtgtctacttag

SEQ ID NO: 101409 - DNA, 780 bp, Glycine max
  Peptide Sequence Number=SeqID_218187
atggtaagcatttgggacctagctagggtagaagtctccatggaaccaattgcatcccttgcccagtattatgaccagcctttaaggtgcttcacatttgaggacttccagctagtgccgactgtggaagagtttgaagaaatcctgggatgcccattgggaggaaggaagccatatcttttctttgggttctatccctccacgacaagagtttccaaggcaaatgggctttcttttattgacatcttggcgcttttgatctttggagttgtcctctttccgaatatggaagggttagtggacctagcagtgattgacgctttcctcgcctttcatcatggcaaggaaagcccattcgtcgccattttttgccatgaaggaagaatcaagattctatcttcatgcgaaggatgtccaaatgttctcttgatgggaacaaggggttgtattaattataatcccgtcctcgccataagacagcttggctaccccatgagaggagtgccatcagacgaaagcatcacgcctttcatcgcacggggtttcagtgaccacaacgcgagggacagagagcttaggggaagcagtaatgggatcatcggcggctatcacaagtggctgagagtccggacacaaggattggattggctcccaaatctaaagactgtgagagacgatgaggttaaagcttcggaagaaagtgatgaggtacaagccctaaaggcagagcttgaaagagcctgggtagtcgaagagaagttcaagtccatagccatcaaa

SEQ ID NO: 101410 - DNA, 381 bp, Glycine max
  Peptide Sequence Number=SeqID_218188
atggcagcaaccttcaagtacctttttcccatcctcttccttacccttatagtcaaagggtcttgtgagtgttccataaacaacatcaatattggcactacaagaagtgggagagtaatacaaggccaacctgagtggaacgtagttgtgatcaacaactgcacttgtacacaaagccagataaggttgtcttgcaaagggtttaagacttcagagagtgttagcccatcaattctttccatagaaggtcagtcacaaagacaggttttagctgttaagcttagtgttcttgggctgatattcaaggccacccaagttcagggagctcaaggttgtgggggtggtagtggtggaagttgttgtcgcaaggaagaggaataa

SEQ ID NO: 101411 - DNA, 225 bp, Glycine max
  Peptide Sequence Number=SeqID_218189
atggcacttgggatcatggcagcttccccaagcaagctaagacttactcctaaagtattgctagagattgcttatcagctacttcgtagttgtagtgaacagattaaagattggggctggatctgcaacattcatgctcaaaattctgaatcctttagaaggagagatgttattttcaggttcattcttattatgcctcatgctaagttcaatgttatctactga

SEQ ID NO: 101412 - DNA, 144 bp, Glycine max
  Peptide Sequence Number=SeqID_218190
atgtttgactctaaaaataagaggatattcatatcttgtttcccatggcatatcaaatatagatacatgggcacaataactggcattagtgacttggattcagtccggtggccaaattcacattggcgctcagtcaagaagtaa

SEQ ID NO: 101413 - DNA, 477 bp, Glycine max
  Peptide Sequence Number=SeqID_218191
atgcagggaaccatttggtcccgcactttttttcaccttttgtcatccagaggcggcgggcccaatgacatgcggggaaccatttggtcccgcaccttttttcaccttttgtcatccagaggcggcaggcccgatgacatgcggggaaccatttggtctcgcactttttttcaacttttgtcatccagaggcggcgggcctgatgacatacggggaaccatttggtcccgcactttttttcaccttttgtcaaccaggggcggcgggcccgatgacatgcgggggaaccttttggccccacactttttcacctttggttatgtagagacgagactaacgttgtcttctgcaccttttgtcattcagggacaacgagtcgggcggtggacgaagataccttatggtcatccgcgcctttcgtcgattgaaaggaacgaattcggtagtatcaggatgatgttggtcgttcggtgctga

SEQ ID NO: 101414 - DNA, 255 bp, Glycine max
  Peptide Sequence Number=SeqID_218192
atgacatggaaatacgatttgttgattgatgttggaaatgcattggcatgtgcatgttgtgtatgttcgtggggggcactgtgcactgacctttcagggtctttggcattagcttttggccacgttcatacgttggatgttgtgtatgatcgtgggggggcactgtgcactgaccttccagggtctttggcactagcatttggccacgatcatacgtcgtatgaagtgtatgtcatggggggtagagtgcactga

SEQ ID NO: 101415 - DNA, 330 bp, Glycine max
  Peptide Sequence Number=SeqID_218193
atgcttaaactaggtatcccacacaaaatcttgacccttacaagtcagtttggtcaaagcacaatcctcaagtgttcctcactagtcttggaatataccaaaatatcattatcgcaacctacccttttgcgggcgagcgaggcgaggctcacgggtgcgtcttccaaaggaggaaaatgcgcggagtcgccaccaatgtttatttgtggaaaacattggaaaaaccgaaggaaaccagtcatgaagaatattccagattcgggagttgtatttaagtttgaggaaggtattagcacctctcacgtttgtcccaaaagacaacagccttaa

SEQ ID NO: 101416 - DNA, 213 bp, Glycine max
  Peptide Sequence Number=SeqID_218194
atggggaccaccaaggtgattacgaaatgccaagaaggcggaaccccttcctccttcactcctccctctatttataggaaaataggggaggagtttgccacgcagctcgtccaggcgagccaggttgcttcctacagaagcaaccgccttctggaggaacaatctggaaggtccaagtgggtctggttgctatttgcaccccctttttactaa

SEQ ID NO: 101417 - DNA, 222 bp, Glycine max
  Peptide Sequence Number=SeqID_218195
atggcatctgatggtgataagtgccaactttcagttgtttttgggattaaattattcatccatgattctaaacaaagctttaaggaagggcaaaatggtcatttcatgaaggtttctgaccctaaattcgcccaggctagcatctggcttgcttgggccaaagagaaaacttcagccataagcaaaccacttgcatgggcgagctccagctcgcctgggtga

SEQ ID NO: 101418 - DNA, 398 bp, Glycine max
  Peptide Sequence Number=SeqID_218196
gagggagtgatgaggacataaccaagggcaaggaccatgaagcacttgaagggcccatgaccagaggcagacttaaacaagctcaacacgtcatagagacaaggaacttttggcatttgataaaatttggtgagagtttctctctgagttccttgttgaaccaatctcagacttatcaaggttcacatcactctgtaccacgagcgtctatcattccctatgctattccaagacgtatcatgatgagggcgaccaaggccaacaacaagattggtgacaaggaatgggtagtttccttcactggaaataaggaggatccaacctcttcatcatcagatagtgagtccacagatgacactcatatttctcccctctacaaacatgcttcatccacttaa

SEQ ID NO: 101419 - DNA, 327 bp, Glycine max
  Peptide Sequence Number=SeqID_218197
atgcgtcttctgaggctaccatccctggagcttttgatttttcaggaggctgctactcctcagaggacaccacagaccccaaaagatccactcttatcatggatggagctatcttttgctcagcaggtagcagatcctcctacaccagtacatgagagacaagcatatcctcctacacccatcatggagatgccagaagaccctaccacgccagtcctgagactgtcatccactcttccagctaccccagttttacatctgatagatgaggaggatatgcaggaccaggacacacagggcacacaggaccagtcacaggaattctaa

SEQ ID NO: 101420 - DNA, 993 bp, Glycine max
  Peptide Sequence Number=SeqID_218198
ctgctccagcgcttgaggcgtgggcatgcggtcgggagcgctggcaggcagaccggcacagccggccagcacaaacgaggatccgagcacattgcagagaaggcgaattttcataggctttcagcgaagggaggaatttggcgatacgctatcgtgccacagcctgatgcgctcggacattttcggcaatgtccttgcgtaacggattggataatattccgcctatcagccgttaacccgttttcgcgcccgttgcgcagtattttgaatatgtcttcatccgccggcctgcatacgccgcgcagccctttctcaggcgccgcgccgcttgccttgcgccccttgagcgccatcgccgccagcgcggcgggcggggtgccggaggcgcgcatcaagcggctgctgtcggacctgctgccctccctgatgggcctgcatgcgcagggcgaaatatgtggcgacatttcgctcgataccgtcggcatggacgaaggcgcgcgtgctcacctgctgccggaattggcattgccgcgatcgcgccggaccgggttgacgccgatcccgggcttcgcgccgttcgagctgtatacggactccgccgaatggccgcgcggtccctggaccgacgtctatgcgctcagtgcggtgatgcacgcgctggtgatcggcctgcggccaccacccgcgccggaacgccgcgccaccgacagttatgagccgttgctgtcccttggcctgacgaagtacagcccggcctttcttggcgcgatcgatcgcggcctggccatgttgccggccgaccggccgcagaccctggccgagctggccgccatgctcgacatcccggcctatgccgaggccgcgcccgtcgcccgcgaagcgtcccgggccgatgtcgccgcgccggtcgcgcctgcggcacaagaggtgcgcaagccgcgcaatgccggccggccgttgctggtgctgttgctcttggtggcgctgatcggg

SEQ ID NO: 101421 - DNA, 831 bp, Glycine max
  Peptide Sequence Number=SeqID_218199
atgaagcaagaggggaagatgagaatcctagaattatctcattgggataatgctactacattgcatacaagaacaaacacaagttatttctacaccaaacttcccaatctggaaaattgggatgtcacaaaatgcaacattttgccccaactcatctacctaaagctcataaggatgttctggagaaactctgagttcttgaacaacaaagctattgtgtccaaagttcttaggatgaagaagtttaacaaatccaatctgaaggttataaaggttatgattgatgttgctaagaaagaagttcctcagatggataaggaagctattaacagaaagaagaagaggaagtcaaatgctcagaagcaagcatcaccggctcctaagaaagtcaaagctccttcaaaggcagttgacaaggaatggactcctccctttcctccttcatcatcaagtagtaaaaccacacatgatgctcctatctcaccacaacgaatgcatctattatctatagagcaacatccacctttatcaattatcaatctaaagaagttcaaatccacccagaagatgaaggtacctctaacggatgatcaaaggtttcctttggcattcattttaggctcactccaacttattatagatgcaaccacattagttggctcctggaacataacaatgtgtttgtccatcaatggaggaccagaagtggcttggagaaacttaataaggtcaaaggagcataaaagtactcaaaatggaattcctttggacctgtttgtaaaacacaagatggatccttctcaagaagtacaacctccaaaggttgagtga

SEQ ID NO: 101422 - DNA, 981 bp, Glycine max
  Peptide Sequence Number=SeqID_218200
atgagaagaaatcatctagaaagccaaatcattggcgacccaacaaaacgtgttcaaacaaggtcaacactcagatcacaaggtcatactacattgatattagaagtggaacccaaacatatagacgaggcaatgcaagacaagaactgggtgaaggctatgcaagatgagctcttagtagagctacccaaagacaagaaagttgttggagccaagtggatcttccataacaagctggatgagaatggtaaggttatggggaacaaggcacgtaatatgaagctatatcaaatggacatacaaagtgcattcctcaatggactcatcctagaggaagtttatgttgaacaacctcttgggtttgagagtgacactttttgtcacatgttttcaaacttaacaaagctttgtatgggctcaagaatactcctcgagcttgaatttgaaatgagtatgatgggagagctgaaatttttccttggactgcaaataaagcaaacaagaaatggaatttacagccatcaaaccttgtatatgaaagaacttctaaagaagttcaacatggacgatgcaaaagtgatgaaaacacctatgcatccaaccacataccttgaactagacgaaaaatctaaaaaggtggatgagactcaatacaaagcaatgattgatcacttctataccttacaacgttaccaaaagaaccaagggaagtccattatctgttgtcaaacacagtttttagatatcttattggaacttctgaccttggtctatactttaaaactcacaagttactatgatgctgactatgttggagataagcttgaaaggaagaacacaagtgaaagttttcacttcattggtggaaacctcgtaacttggatatgtaagaagcaaggttcatctgtgttgtccgctactaaagcaaaatacatatcaacaacaagttattgtgctcaactgctttggataaagaattag

SEQ ID NO: 101423 - DNA, 417 bp, Glycine max
  Peptide Sequence Number=SeqID_218201
atgtcaagcatgccatcgaatccctcattcttcattgatgccatcaagacacgatgggaacatgatgatatgctctatgtggattatttttatgggttcctctgttgccaccatgcgccaaatcctgatataattgttattccttccaagtcgtattcactatctgcggatgatgtgatgtcctctactggatcttattcttcatctaaagatactaaggccatttcccctactctgacttctccccgatgggtgttgcctgagtctcaggtcccacctagggtagacttggtggatctcgtgtcaaaggacgagggtgaggatttagaagaggacacatcttttgagaaggatccatcaatggataaggaggatctcgtcatggatccaaagttcatggaggaggattctttgtag

SEQ ID NO: 101424 - DNA, 246 bp, Glycine max
  Peptide Sequence Number=SeqID_218202
atggttcgaatagctgcacgtcttccatggtggcattgccgaatgaaactaccagaaaatgcacaacaactgccacttgcagacatggacaaatcaagtgaacaagcagcagcgactgagcctcagagtagaagaagaagaagcaacttagcgtgggaagaagaagaagaagcaaccggcagcttcgtaaaccctaatttttttggggaagaagaagcaaccttgcgtgtgagagagaatttatag

SEQ ID NO: 101425 - DNA, 264 bp, Glycine max
  Peptide Sequence Number=SeqID_218203
atgagaattccaaatttctacaagaagaagaccaagaagttccatgatagtttgatagctaagaaggacttcgtggttggacagaaagttttattatataactctaggctcaaactcatgagtgttgagatcaaaagtgaatccacagataagagcttcaaggtcaatggacaccgactgaaaccattcctcacaaatcccttcttaatggatgtaatggtagaggagacctccttacttcaccctacttctcttctaccatga

SEQ ID NO: 101426 - DNA, 498 bp, Glycine max
  Peptide Sequence Number=SeqID_218204
atgagtggaaagggattgcagcatgttcggaaatcactttctcaatatcagcgtcttagagcatgtttggaaatcaaatgggataccaattgggaaagagggtttgtagtttatgtaaagaactcaaaaacttcgacatccttaccttcaggaacacttgaaaggtggcaacgccactcaaaaaggcacgacttcggctacatggcggtggtgggagcagcaggtccacttcggcttcaagtacttcacggcgggaaacaaaacgtcagggtggtagcgggatggagttcacggcgggatgaagtagttcaggcaatagcgggggcgctaggtttttggagggtacgagagagggtgtttaccgtgagactatataaactacaaaatttacgacggtgtttaatgacatcgactttgtatgtgactatttctaggacggtgtacctacaagcaccgtcttttatgacttccatcaaaactacaacgacggggttatag

SEQ ID NO: 101427 - DNA, 513 bp, Glycine max
  Peptide Sequence Number=SeqID_218205
atgaagtaccagaagattcatgcatgccctaatgatggcctattgtacagaaatgagtttgaagaaatgcataactgccccaggtgtggggtatcgcgatacaaagtgaagaatgatgatgagtataatagtgatgaaagcaccaagaaaggcccctcagcgaaggtgttatggtatctttcgatcattccaaggttcaagtgtttgtttgataatgcaaatgacacaaaagaccttacatggcatgcagattggagaaattgtgatggaatgctctaccatccggatgattcctctcagggaaagaatattaatagtcgatatccagaattcaacaaagaggcaagaaatcttaggcttggacttgccagtgatggaatgaatttgtatgacaatttaagcaatcagcacagttcgtggcttgttttgctagtaatttacaacttgcctccttggttgagcatgaagcagaaatacatgatgttgtctatggtgatatcgagcccaagataa

SEQ ID NO: 101428 - DNA, 819 bp, Glycine max
  Peptide Sequence Number=SeqID_218206
atggataccttagagccctacactggggcaatgaaaggcaccatgcataaacctcaagtgaacctaggggaagataagaaattctcacccaataggttccctgctacaagagggttgtacatccttgccttcagagggctaaagtcttcgccttcagagagctacacgtcctcgacttcagagggctacacgtcctcgcctccagagggctgtacgtcttccgccttaagagggctacacgtccttacctttagaggactacacagggctacacgtcctcgccttcagagggctacacgtcctcgccttcagaaatttgtacatcctctcttgcagagggttgtacgtcctcgccttgagagggctacacgtcctcgcctccagagggctgtacgtcctccgccttcagagggctacaagtcctcgctctcagagggctgcacgtcctcgccttcagagagctacacaccctcccctcccgagggttatacgtcctccgccttcagagggttacacgtcctcgccttcagagggctatacattgtagcgttcgaagggttacacgtcctcactttcagagggctacacgtccttgccttcagagtgctacacgtcctcgccttcagagggctacacatcctcgacttcagagggctacacatccttgccttcagagggatgtacgtcctcgcctttagagggctacacgtcctcgcctccataggactgtatgtcctccgccttcagagggctacatgccctcaccttcagagggctgtacgtacttgccttcggagggctacatatcctcgcctttag

SEQ ID NO: 101429 - DNA, 423 bp, Glycine max
  Peptide Sequence Number=SeqID_218207
atgtgcaaaatcagaatgctgagaatcagaatgctcaaaattataatgctcaagatcaggatgttcaaaatcaccaataatagaatgcacagattcaccagttatggaatgctcagaatgatcaaaagaatcgctttttttggacgatggagacctcagccggcctacggctggctgccacggcgtaggaaatttttttccttgatatctgtcttatgcccaacttcatctatttgtgttcagtgttataagtattgcctgctaagtataggttcgctaagcgcaccgcttcatctttctaagcacaccgcttcagttcatctgctaagcgagaaaggcacgctaagccaaaaatcactaacgtgcgctaagcggtccatacgtgtgctaagcgcaggagcacgaacaaggccacctatttaa

SEQ ID NO: 101430 - DNA, 261 bp, Glycine max
  Peptide Sequence Number=SeqID_218208
atggagtttggagtttttcttgaagaagcctccgcatgcacgagagtctggccttggcttgaagcttttgcatgtttaggaagttctagagagagaaaggtccaagttccaaagagttctgagatattttgctgtgtgaagatctgcagagatgcgagttcgaagcggaagccgttcaaagaacttgagatgagtttgaggtttccggactatggaaagctaaatcctctgttggatcttccctataggtacttgatgtaa

SEQ ID NO: 101431 - DNA, 765 bp, Glycine max
  Peptide Sequence Number=SeqID_218209
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggatgtgtctgaggatgttcgtgtctacactgaaaatgagaacaagttcaaaattgagattccccaagaatggcaagtgggaacaagagacggagaatctagtgggtttaaatccataactgctttctacccaactgttggaaataaggaatggatatgtggtcttcttttaaatttggtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 101432 - DNA, 162 bp, Glycine max
  Peptide Sequence Number=SeqID_218210
gtaattcaacatttaacatttaatgtcagcactgtcttagaaactacatatttccacatcattcctgacatcagcaccgatgtggaaacggacatattctacatcgtttaccaagggatgaccgacttagaagatgtaatttctacatcggtggtgggctga

SEQ ID NO: 101433 - DNA, 161 bp, Glycine max
  Peptide Sequence Number=SeqID_218211
ataacaactacgccatctggaatgcgtttggtaatcagtactggccggcgcattatttcttcgacgcgcgggggcaactgcgttataccgcctttggcgaaggcgattatgcccgtcaggagcaggtgatccaacaactgctgcgcgaagcgcggacgtga

SEQ ID NO: 101434 - DNA, 1473 bp, Glycine max
  Peptide Sequence Number=SeqID_218212
atgtccaaattgaatccgattctggctgggtccgcggcaagcattgacgcttaccagcaggtcatttcccaggccagccaggcggttgcgcagtggctgcaacaacctgaaatgtatcaggggaaaagcgttgatgaactccgtgagcgcatcacccttgattttaacgaacagggtctgggcaaccaggcggcgattgaacgtgcgatcgagtacttcctgaaagacagcctgtcggtgcaccatccgcagtgcgtggcgcacctgcactgcccaagcctggttatcagccaggcggcggaagtgctgatcaacgccaccaaccagagcatggactcctgggatcagagcccttcagccaccatcattgagatgaagctgatcgagtggttacgtgcgcaggtcggttatccggctggcgatgctggcgtcttcaccagcggcggcacccaaagcaatctgatgggcctgatgctggcgcgcgacgccttctttgcccgtcaggggcattccatccagcaggatggtattccgggcgacattcgtcagtacaaagtgctgtgctcggaaaacgcccacttctcggtgcagaagaacatggcgctgatggggcttggctaccgctcggtcacgctggtgaaaaccgatgaattcgcccgtatggacgtcaccgacctgaaggccaagattgcgcaagcgcaggccaacggcgagcagatcatggccatcgtcgccaccgctggtaccaccgacgcgggcgcgattgacccgctgcgtgatatcgccggtatcgcggcggagcaccagatctggctgcacgttgatgccgcgtggggcggcgcgctgctgctctccgagcagtatcgcgattacctcgatggcctggagttagtggattccgttaccctggacttccataagcagttcttccagaccattagctgcggcgccttcctgctgaaagatgctcgccactacgagctgatgcgctatcaggcggcctatctgaactccgagtttgatgaagaacacggcgttccgaacctggtctccaaatcgctgcagaccacccgccgcttcgacgcgctgaagctgtggatggggcttgaggcactgggcaagaaacaatacgcttcaatcatcgatcatggcgtgacgatggcgaaaaacgtcgcggaatttgtgaaatctcagccaacgctggagctggtcatgcagccacagctggcaagcgtgctgttccgctcacgtccggcgcaaatggctggtagtgatagcgccgcgatcgccctgctcaaccagcgcgtgggcgacgccctgctggaatccggccgcgccaacgtcggcgtgaccgagcataacggcgtaacctgcctgaagctgacgctgctcaacccggtggtgacgctggacgatgtgaaggtcttgctgagcctcgttgaacgcaccgcccaggaactgctggcgaaataa

SEQ ID NO: 101435 - DNA, 165 bp, Glycine max
  Peptide Sequence Number=SeqID_218213
atgttgacccaagagatggaggctttggaggaagactatggagatggaaatgggaaaaatgaatcaaggcaatatattgagggctcgctacaagcacgcgcactgacagcaatgtgtgacctcatgcaggttatgcccagagccttacaagaagacttcaaataa

SEQ ID NO: 101436 - DNA, 297 bp, Glycine max
  Peptide Sequence Number=SeqID_218214
atggcgacaaacctggaaaagggggaaaaagaaggtgaggtaggaggttcaagatggaacaggttgccctttttggcgatgtattcattgtcacagtctagatgtttgttgtttacttactcttgttgggaattggattttgggatggaggaagtgaagaggatatgccaaattatccctgtaacatctaaagtagcttttcccgggagattcctcttggataggattcaacagaatcttaggaagtggactattgggatggttgatgatggattaaactgtttgttttgccaataa

SEQ ID NO: 101437 - DNA, 552 bp, Glycine max
  Peptide Sequence Number=SeqID_218215
atgagggcttctggtaatcgattaccaagggggtgtaatcgattaccaggcttagaaaagggactggaacattgtggaggcctctggaatgggtcactggtaatcgattaccagatcgtgatggcggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagctcacggtggagtggatactacccacgcctacaccatatcgtctagtggagcccgtccaagtgatcgaggtaacgtcatccgaggaagaccctgaggaggatcccaaggagctacctcctgagcctgctgtggatgctcttgactttctagagggcgatgaggacccacttcttgaggtggattctcccgaggaagtcatgtcggcatctgaggcagactctacggaggatagtggcccgggggagatggcgatcagcggaggctcttcatcatag

SEQ ID NO: 101438 - DNA, 636 bp, Glycine max
  Peptide Sequence Number=SeqID_218216
atggagttggctaaaattttgacaattttcacatccattgatttctcgtctaaccattttgatggacctataccagaggagttaatggattggaaagaactccatgtccttaatttgtcaaacaatgctttgtctggtaaaatcccatcatccataggtaacatgagacaactagagtccttggacctttcacaaaactctcttggtggagaaattcaagtgcagcttgcaagtttgtcattcctttcatatttaaatctctccttcaaccatttgatggggaagatcccaacaagtacccaacttcaatcatttccagcttcttcttttgaaggcaatgatggactatacggtcctccattgactaaaaatccagatcataaagagcaagaggtgctgccacaacaagaatgtggaaggttagcgtgtactattgattggaattttattagtgttgaattgggattgattttcggccacggagttatttttggtccactcttaatttggaagcaatggaggctatggtattggcaacttgtgcacaaaattctttgtcagatcttccctcaggtgtatcttgaatatgtaacttggagaggacaaacatacgaagctttaaggtggaggcattag

SEQ ID NO: 101439 - DNA, 270 bp, Glycine max
  Peptide Sequence Number=SeqID_218217
atggcagaaatcaaggaaggatcatcaaccaaacctcacggtaccctcctcttgacctatatgtgcatctgcgtcaaaataaaagggctcaggagggtgagctcatcctccccctctaccgttgctgccgctgctgctgtctcctcaagaacaggctcctgggctgcggaggccccaccccctccagaaggaaaaggctgggctcctagccaggctacctgcgcatggaactcctccatgctcatgatggatggcaagcccaagccctga

SEQ ID NO: 101440 - DNA, 334 bp, Glycine max
  Peptide Sequence Number=SeqID_218218
atggggcttgctaagtgtggggaggctcatggaggcattggagcttttccgcaagatgtagagacaaagggttcagccaagtcaatttacaatggtgagtctgttaggcttgcagctggtgtctcgctaaggaaggcttgtgtgcttagcgagaataatgcgttaagcgaggcactcagcccacttagcgacgcgcccagctcactcagcggatattcactaactcgcgctaagctcgaaaatggtgttaagcgagccttcgaggacagaaagccctttttaagactgaagttggaaaaatcaagcattcggcaaagggagcatgaattggaag

SEQ ID NO: 101441 - DNA, 249 bp, Glycine max
  Peptide Sequence Number=SeqID_218219
atgattactgaacaggggccaattgtaggaactacactaggactagaaggaagactcatattcatggtaattggtgcagcacatgcaatggcaggtgatgggttcaatggagccacaaatgtagacaatttcttatatgggattcccccataccaaacaaaacaatcagtggtaagctctatgatagctctcaacagctgctctattagcttcttcaacatcctctatattaccctctatccagggtaa

SEQ ID NO: 101442 - DNA, 294 bp, Glycine max
  Peptide Sequence Number=SeqID_218220
atgaatcaaggggatgtaaagaatgccaggacacgaagacctagatcaatagtggaagaagagcagtggttcctgaatgacacaatgaaaggacaaccaatggagaagaagcctccaactagaagccataagcgacgtcaacaaaaggaagaaatccatgcaaaagctcaaatcctgcttttagtgtgggaagactttgaattggatgggttgctattagatgatgcctatgttcctactgtagttgttagcatcctccctgtggagtttgctagtcaagatcaactttcatag

SEQ ID NO: 101443 - DNA, 375 bp, Glycine max
  Peptide Sequence Number=SeqID_218221
atggaagagcctgaagagggaggcgcaacagagataggcatcaaccaggactatgtggaggacatcactacggcacaggggacttgggacccatggcccacctcagctcaggatgcacccactccacctcaggatgatccagctccagctcaggaggattgttataggagagcattgtatagtttacgaaaaatttgtcccaaatttgggggagtgtgtttgggtgatctttgttgcaggaatgaaagtaacagctacatagagagcgaaatttgtaggccaaagaagagaaggtgcaaaaacttgctgttgaactcgcttagcgaggtagattggctaagtgagcctcaaccgcttagcgaggcagccagctag

SEQ ID NO: 101444 - DNA, 324 bp, Glycine max
  Peptide Sequence Number=SeqID_218222
atgaagtcatcagaaactcaagacatggagttagaaaaactcaatgtcaaaacaacttttctcaatgaaagtttggaggaagacattctgatgcaacaacttgaaggttttgaggtgcaaggtaaggtagaggatggttcccacatctatatgctactctatatggacgacatactcatagcatcacaagacaagtctgaaattttgaatctaaagtcactactcagtagtgaagttgagatgaaagatataggagttgtggaaaagtttttgggaatggagatcaagagggatccagtccagaagaagattttcttatgttag

SEQ ID NO: 101445 - DNA, 267 bp, Glycine max
  Peptide Sequence Number=SeqID_218223
atgcaattacgatcttctagccatcgtgccaatattcaaatagtttgtaggccaaagaagagaaggtgcaaaaagttgctgatgaactcgcttagcaaggtagattggctaagtgagcctcatccgcttagcgaggcagccagctcacttagtggatgggaaaccctagaagaggataagtcagagatatgcacgctcagcgcgcagtcagctcacccagcgaggacattgtctcttctcgcgcttagcgtgtccaagctcgcttag

SEQ ID NO: 101446 - DNA, 249 bp, Glycine max
  Peptide Sequence Number=SeqID_218224
atggatatcttccggaagaaccttcttccagaaacatttcgaatgtcgttcttccggaagtattttctgagtacttccgaaaatcagaaattcttcttccggaaaatttctggaaagaggttttccggaatgtttccggaaaaaatcttcttccgaaagatgaattgcttaaggacagtttcgccacttcactgtttgctggatgccccaacaataatgctgggtgcacgtagcaactctctaatttaa

SEQ ID NO: 101447 - DNA, 111 bp, Glycine max
  Peptide Sequence Number=SeqID_218225
atggcgagggaagttgtcgtcaatggggaggatgagcaatgcaagctaggaaatgtcactgtgtcacattctaagacgattattataaccgccttagaatgtacgacgtaa

SEQ ID NO: 101448 - DNA, 309 bp, Glycine max
  Peptide Sequence Number=SeqID_218226
atggatacacaaagtgaaatgaggcattcaaagttcaagaggatttgtgggttctatgggagtagccccgacaagaagagtacctaccaagatgctgccattgaacttgggaacgaattggtctcaaggaacatcgatttggtgtatggaggggggagcattggtctaatgggtttagtttcacaagatgttcatgatggaggtcaccatgtcattggagttattcccaagaccctcatgcctcgagaggtatgtatatgtgcttcagccactaaaaaaagcttaaacctttttttcttcaagctttaa

SEQ ID NO: 101449 - DNA, 269 bp, Glycine max
  Peptide Sequence Number=SeqID_218227
atggcactgccagaagtggtgaaatggctcaaagagctgcattttgagaaggtcataatagagggggcacttttttacgtgaaaagcatgccatgcaggacccaaaccgccattgccaatggcgagtttggtgtcagtgagcaactcgcttatggcactggcgatacggctagtcctgccatggcagtgcagcagcgcgtcagtcaaggccaaatcgcaaatggtaatggcgatttgccttgcccacggatcgctagcatggctggcgg

SEQ ID NO: 101450 - DNA, 204 bp, Glycine max
  Peptide Sequence Number=SeqID_218228
atgcaaatcgcagctcttattgacgttttcgttctcgacgcgacagctggtcatggtgtcgtcagcttcaatggcgtgttgcaggagcttggactcgccagtttgactggcgagttgaggaaatttgcaggagggacaaccttttcgcagatgaaagcgccagtgctactggcgatttgcgctgcagttgggagtagccagtag

SEQ ID NO: 101451 - DNA, 282 bp, Glycine max
  Peptide Sequence Number=SeqID_218229
atggggtgcttttgttattatttccggcagggggcacttttttacgtgaaaagcatgccatgcagtacccaaaccgccattgccaatggcgagtttggtgtcaaagccatagggaaccgccaatcaaactggcgagttccatggtctgacgctgcagctacgtcgcaggcgctttttcagtgcaggctaggttgcaggagctttaaaggggagttgcaactgccattggcgagttgcctggaagttgcaactcccattggcgatttagggcacaaaaaatag

SEQ ID NO: 101452 - DNA, 195 bp, Glycine max
  Peptide Sequence Number=SeqID_218230
atggttcaatgtggtaactggcttagacgagaaaatggtggcagtggatccatggacatggagatcccttgtatcaaaagtcttcctggtgtggcgacagtgcaaggtactagagcatgttgggggcaatggctagatgagtcgggaaagccactattaagctctaagggccaccattggatatttgtggattga

SEQ ID NO: 101453 - DNA, 456 bp, Glycine max
  Peptide Sequence Number=SeqID_218231
atggcctctaggaagaggaagtccaccatctccagaccctgggagccctatgacaccactcgatttatattagagggcgcctgggagagatattcccagaacgttcactctcatagaggaacgtcgttctttatgaaattggatgggcatattgatgtggccttggtcaaggaattctactctaatctctattatccggaggacaaatctccgaagcaggttagagtgaggggcaaattaattaagttcgatgctgagtccctcaacaccttcctggagaccccggtgattctggagcatggggagcagtacaccacctacaccagattctatcattcgcgtctagaccctcaggagtttgctgccaaactttgcattccagggcgtggatttgttcttaatgctgaaggagcgccctggaagctcctgaggaaggacttgaccaccttggcctag

SEQ ID NO: 101454 - DNA, 556 bp, Glycine max
  Peptide Sequence Number=SeqID_218232
cttaagtgatattgatgcaactttcttcgtgaaccaaggatcttttggaatgggattttgtatgagagatcacggtggcagattgattaatgcctactcggatttcaaacccatcatacgaccctccattcaggaaggagaggctttagcgttgaaggaggctcttttgtggttgcgcgattgtggagtagaggcaatcaccatcgaatcgaatcagattgtgcccagggattgcccaaagttgaagaaatcaggtgaaggggcaacccgttcaacaaatgaggtagagattgatgattcagactactacagtgagggagatgttctctatggttcatgcagtaattttggtagtgtctataatggtaacgacaaagcatgtgttgttgttggaatgggacgtatgcaaatcgctatggatgatggtggagtgagaatgttgtgtgaagcccacaacactcgcctaggcgagtgtggctcgcccgggaacctccagaaaaaatttgaagacgatccaatggttaacgaatccgggagagcgattttactgaaatag

SEQ ID NO: 101455 - DNA, 270 bp, Glycine max
  Peptide Sequence Number=SeqID_218233
atgtatgagaaaaagcatcccttcaaagagagtccccatcggatgttggacttcttcgcgatccaagctatggactatggtggtaaggctgtgattggtggaacaagctcaacttcttcctcatcatctttgtcttcgtcctcacttaagggaccaagttcatcattagctaagccaggctctgtggtaaacttaggctcgtttggtcgggttgatgaggtaggctctactgtagagtactcaaatatgggtgtggttgatcctcagtag

SEQ ID NO: 101456 - DNA, 195 bp, Glycine max
  Peptide Sequence Number=SeqID_218234
atggtgattttctaccatggagatgcagcggaagataaaggagaagagagaggaagcttcaatggaagtccttctctccctctccctccactcatcttctcctaccttcaagtaatgcctccaagcctccaaaccttagctcaggctataggcaatgaaaataggggagaagctactggagctgttgagtactaa

SEQ ID NO: 101457 - DNA, 261 bp, Glycine max
  Peptide Sequence Number=SeqID_218235
atgagggttcgggatttgtttatgcatagggaaggggactgcccttgctcatatgtatccttaggtgggatgaggaattcagacctacgtaattcttcaaaggaaaaatggcatttgggggccatggcagctcgcccaagcaagctcatgcttactcctgaagtaattggctcgcacaagcgtgctacagctcgtccaggcgagctggttccttcagccctaagcaatttgggggcccaggcgtgccagaggctagcctag

SEQ ID NO: 101458 - DNA, 497 bp, Glycine max
  Peptide Sequence Number=SeqID_218236
atgggggggcgccggtgggcactggtgataaaacgccgtcagatcttccatcaacaggcgaaagctcatggcatcgccggcgatcatatcgagatcgacatgcaggcggctgcgcccttccggcaacaggctcaggctgatatcgcagggcacaccctgttccagcggcagcagctgggtactttttgcctggcgtttggcggcgagcgcggctgccagcgtcgctgtatcggcgtgccgccagtcgtcgagatgcaaggtgtgccgggggccgggaggcgcgatcgtctgccggccatcatcggtaatgcgcaggcgcaacagcggatgatgcagctcgccgccgtcgaattccgcatacaggtgggcggccatgccgccgaggggaggagcggactgtcggcctacccaataggcggcctgcatcgtggtcaaagctttcatcgggtgctatttataaggggttttagcgatgccgggcagatagggctttggag

SEQ ID NO: 101459 - DNA, 537 bp, Glycine max
  Peptide Sequence Number=SeqID_218237
ttaccctcaccgttgagaggactacacgtcctcgccttgagaggactacacgtcctcaccatcagagggctgcacgccctcaccatcagaggactacatgtcctcgccttgagagggctacacgccctcaccttggttaccctcaccgttgagaggactacacgtcctcgccttgagaggactacccgtcctcaccatcagagggctgcacgccctcacctccagaggactacatgtcctcgccttgagagggctacacgccctcaccttgggtactcgttaccctcaccgttgagaggactacacgtcctcgccttgagaggactacacgtcctcaccatcagagcgctacacgtcctcacctttagaggactacacgtcctcgccatcagaggactacatgttccccattttcaaaggggggcatgccctcaccttcagaggattgcacatccttgccatcataggactacactccctcgccttcgaaaggcgacacgtcctgaacttcagagggctacacgccctcgcctttag

SEQ ID NO: 101460 - DNA, 255 bp, Glycine max
  Peptide Sequence Number=SeqID_218238
atgtatttgtcgcaacctacccttttgcgagcgagcgaggcaaggctcacggatgcgtcttccaaaggacgaaaatgctcgaaatcgccaccaacatttattgaaaggaaaacgtcgacaaaagcggggctcttgctcctacgtaccctccgtcgaagaggaaatcaaacctacgtagttcttgcaaatggggcgaatcaagtgattctgttttacttggaaggtagtcatttaaggcgttggaccttaaaatga

SEQ ID NO: 101461 - DNA, 162 bp, Glycine max
  Peptide Sequence Number=SeqID_218239
atggactcgggaaggttccaagttagtgtaccaggtaacagctacccaatggttcttggggcaagtagccccttgtacttgtcaaagtccagcaccttgaacttgggaggggtgatgatattgggttctaggaacaactcttttgggttagcaaaggcataa

SEQ ID NO: 101462 - DNA, 237 bp, Glycine max
  Peptide Sequence Number=SeqID_218240
atggggctccgaataagatttgatggtggaggatgcacgaacagcgctaggaaatcaattcgtggggctctggactcgatggcaatcaatttgtggggctccggactcgatggtggaggatgcatgaatggaaatcaattcatggggctccaaataagatttgatggtggaggatgcacgaacaacgttaggcaatcaattcgtggggctccggactcgatggtggaggatgcatga

SEQ ID NO: 101463 - DNA, 483 bp, Glycine max
  Peptide Sequence Number=SeqID_218241
atgagcgccggcaccggcggcacctcagctacgctggggcgctacattcgctatcagggccacgacacgcgcctgctggtggtcgatccgcaacactcggtgtttttcgattactggcacagccgcgatcgcacgctgcgcagcgagcgtggcagcctgattgaggggattggtcgcccgcgcgttgagccgtcgtttttaccggatgtgattgacgaaatgatgaaagtgccggatggcgccaccgtggcggccatgttaaggctggagcagattctcggccggcgtccgggcgcctctaccggtaccaatttctggggcatgctgcaggtggcaaaacggctgcgcgcgcaggggcagtccgccgcgctggtgacgctgctgtgtgacagcggcgagcgctatccggatacctattacaatccgcagtggatcgctgagcagatcggcgatattcaggcgtggcagcgcgagctgcaataa

SEQ ID NO: 101464 - DNA, 264 bp, Glycine max
  Peptide Sequence Number=SeqID_218242
atgtggaagaggataatgagggtggaattggtgctgtggatgcgctggtggcttcggaacgatgagctcttgaagccgaagcggaggcggatgaacccttatgtttctttgacgattctgccatttgaaggagtttttaagaagattgcaatttacgggagtcgatttgatgaagaaatgaatgagataggaaggtttggaggtttgggaatggaggaacgtcgcaagggggaagggactgcgcaggggattctgaaaacgtga

SEQ ID NO: 101465 - DNA, 1009 bp, Glycine max
  Peptide Sequence Number=SeqID_218243
atggtcaatgcgctgggcagcagcctggcgcagattgccgcccagctacagcagggcacagcgcccggcatgcagccgcgtgacggctggttagcgcagggcaagcgctgctggctgggtgaagtgccgggcgcgctgccgccggtaccggctgaactggcggcgcatgatacgcgcaacaatcgattgctgctggcggcgctgcagcagtgtcagccagcgctggatgaggcgattacgcgctatggtcgcgcccgcgtggccatcgtgctgggcaccagtacttccggcgtggatgagggcgatcggcagacggacggcggccatgccggttatgactaccggatgcaggaactgggcgatccgtcgcgctttctggcgcactatctgcagctggatggcccggcgtacacgatttctactgcctgctcctccagcgcgcgcgccatcatcagcggggcgcggctgattgctgccggtctggccgacgtggcgctggtgggcggtgcggactcgctcagccgcatgccgattaacggctttgccagcctcgattcgctgtcggaacatcactgcgcaccgttcagcgccgggcgcgacggtatttcgattggcgaagcagcggcgctgctgctgctgacgcgcgagccacagccgctggcgctgctgggctgcggtgaatcgtcagatgcctggcacatgtcagcgccgcatccgcagggcgtgggcgcggaagccgccatgcgcatggcgctgcagcaggccggtttgcagccgcacgaggtgggctatatcaatctgcacggtaccgccacgccgctcaacgatcaggttgaagcggcggtgattcaccgcctgtttggcgatgccgtgccgtgcagctctaccaagcacctcaccggccacacgttaggcgcagcaggcgccaccgaagccgcgctggcggccctgattatccagcaacagttgtcgctgccgccgcaggatttttcgcacgcgacgcaggata

SEQ ID NO: 101466 - DNA, 359 bp, Glycine max
  Peptide Sequence Number=SeqID_218244
cagcagcagttgctgtccgggcgcgtgaagagcaaaacccagtcattgctggtgctgctcagcgcggatgcgcagcagatctcgctggccgggctgtcgtcgcttggcatccggctattccgcgtcacttacgatcaacaggggattcatacccagcagatgatggcgctgcccgacctgccgccagccagccaggtgctggccgatattatgctgagctactggccggtcagcgcgtggcagccgcaattgccgtccggctggacgctacgcgatgtgggcgaccggcgcgaattgcgcgatgcctccggccagttgatcagccagattcattatctgcagcgcggggaacagcgtga

SEQ ID NO: 101467 - DNA, 645 bp, Glycine max
  Peptide Sequence Number=SeqID_218245
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcactggtggcttggttaagggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctggttctccccgaaatgcgttgaggcgcagcagttga

SEQ ID NO: 101468 - DNA, 304 bp, Glycine max
  Peptide Sequence Number=SeqID_218246
atggagaatttcgcaaaggtttcgaccgttcttcgacgttcttcattcgtttttcatcgttcttcgatcttcaacgggttgtcgtcccttgtgacggacgcgtggggtgctaataccttccccgtgcgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtcacgcgtcgcccttccgccgaagggtaggttgcgacaaacag

SEQ ID NO: 101469 - DNA, 228 bp, Glycine max
  Peptide Sequence Number=SeqID_218247
atgaccgatcgaggtctaaaaaagaaccttcacaagattatgcggatcgaacttttcctaaccgacatcatgcaaatttcgttcacggattggattgaaaactcaatagccgacatccgtcgtgaagtagccccgctaaaggcccaagtggagaaggacgaaggcccaagtggagaaggacaaagcccccaagtggagaaggatgaaggctcaagtggagaaggatga

SEQ ID NO: 101470 - DNA, 330 bp, Glycine max
  Peptide Sequence Number=SeqID_218248
atggaagtgccaagaccggacaaacccaattggcctatgatgcatgtgttaccctttcccaagcgtataacacctaaaactggcctgccaggccctagcttggggattagccgctcatggccattgagggctttacaactaggggtgaaagaaagaatgggtaataaaaacaagaatgtcaagagaaaagggagagctcaggcttggaatgctgagagaagtgttctgaggcgaggtgtacattctcccttggcttggatctctatttataggtgcagaaatgggctttgggcctttgaaggcgtgcttagcgcgacaccgcgcgcttaa

SEQ ID NO: 101471 - DNA, 252 bp, Glycine max
  Peptide Sequence Number=SeqID_218249
atgaggacacgtagccttctaaaggcgagggcgtgcaatcctctgatggcgaggacatatagtcctctaaaggtgataggtactagtagccaagggtccacctttatgagaaagcaagagatcgactcatcgagagggccgattgactgtccttttgaaaaaggtgataattcatgcaaccttatcctatcttttgcaaatctctccgggaactccctcagagtgtatgttctgtttgatttagtcacttga

SEQ ID NO: 101472 - DNA, 676 bp, Glycine max
  Peptide Sequence Number=SeqID_218250
tggttgcatgtttgcacccccccgacctaccgattcagcccatgaacatcaaggggaaggcaaaggtagtggaagaacaagacgataaaacgcccctcactccgaatgaggatattccggtgaaaggtcttctggagaaaagggatggttatggcaagaaggaggtgtcactagaggaagccagtgagtttctccgcataattcagcagagcgagttcaaggttattgagcagttcaacaaaacattcggtgggagtcgttccctctacgctccaccagaaattgaagttcgtagtggaagggcatttggttatcgtatcgggcgaggaataaatcttgtaatggtggcccgggtaatgttggggaatggttacgagcccgaaatgggtttaggcaaggacaatggcggcataactagcctgataagtgccaaaggaaatcgtgggaagtttgggttaggctacaaacctacacaggcagatataaggaaaagcattgcgggaaggaaaagcggaagagctataagcgcgggtctaggggacgaaggccaagtcgttgcaatatgcgaatatgatgcctcgagtgggtcgggtttggtacgaccatgccctcctgatttccgactaggaaattggcgagtggaggagcgcccggacatttacgcgacaagcataat

SEQ ID NO: 101473 - DNA, 261 bp, Glycine max
  Peptide Sequence Number=SeqID_218251
atggggaatcaaaataagggaaaagttgttggagctattgagtatcaagggttagatcgcttccaacgaaacaatctacctactttcaacggaagatacaaccctgatggtgctcagaattggataagggagattgggaaaatctttcgagtgaaggtgtgtccaaaggggccaaaggttcctcttggtacatatatttcggtggaagaagctaagtattggtgggataatcctcaccaatgcttggaggctgcaggttaa

SEQ ID NO: 101474 - DNA, 399 bp, Glycine max
  Peptide Sequence Number=SeqID_218252
atggaggtggaagtggtgagaatggctcccgaatacaggaattttgacaatccttttctcgctttacaaaacgagctggaaagccttgctgcagaactggaagccgaccccggattgcagcttcactcaaaagacagcagctacaagcagatcaagatctacatccagcaatgtcatgagtttgttaatatagcttttaaaaactcttccaaatatggaatttcagggaagatcaatcagtcacttctgaaaatccgtcagcagattgaaagaattaatgaaatcatcaagcttctggtcatcaatggtgatgaagatgtgattatcaaatccaaacagctcatgtttaatattctccgcaacaaagcagccggcgatgactgctgcaactatgactaa

SEQ ID NO: 101475 - DNA, 306 bp, Glycine max
  Peptide Sequence Number=SeqID_218253
atgtcccatgctgtcaaggaccatcgagggaaatgggccccgaactacgaagggccttttgttgtaaagagggctttttctggaggagccctggggcaggatcaccttgggctaccttctggagtagagacaaaacatgaacggcagaaaccaatcaaggtacttaaggacgaacgcaagtggggatggggtcacgaccgaccgatcgttgcccttctctgtgcgaaacaagcagagaatgttgctgcaaggcagccccgtatcctttgtattttgcagctttcttttactttttgtttgttttaa

SEQ ID NO: 101476 - DNA, 864 bp, Glycine max
  misc_feature (18)..(18): n is a, c, g, or t
  misc_feature (61)..(61): n is a, c, g, or t
  misc_feature (83)..(83): n is a, c, g, or t
  Peptide Sequence Number=SeqID_218254
atggcgagccaagagaantggggcccgtttgtggatatattagctttgttaatttttgggnttgtcctctttccgaacgtggncggtttggtggacttagccgccattgacgctttcctcgcatatcaccatagcaaggagagtccagtgctctctgtgtgtggttggtttcacacctattccaacaagacacaagacacccgtgtccgcttcaaagttatcgctcatgcgccgaaaaaggaagagtcgattgggaccacatttggctgggataggaggcacgcaatcaattggtttcctcgttggaaggaaggcaaggaaggagttctttctcggattaggcgcgcaaagtctcaaggtgatacaaagagtccacaaggcgtggagaggtccgttgaggaagacaaggagcttagaggcatccgatggcgtcatcggtggttatcatggatggctaagtgttcacatgcgagggaagatgaagaaatccaagctctaaaattagagctagggaaggcaagactcgccaaggagaagttcaaatcagccgctacacacatccggaaagagtataccgagttacaagaggaaaacgcggccactgcaagagcccttgaacaagaaaccaaaagggcccgcaaggaggaacatggccgaaataaattccgaggagcattgtggggtagcaacaatgagctcacactccgaagagaggaaagagaccgatcatgggtgcatggcatgatcttaaaagaagagttagccgcgtgcgcaaggtccaagaggagtttggctcaacacttggaagccacggagcaaagcatgctagctatcatagggcaatacaaggaagagttgaactag

SEQ ID NO: 101477 - DNA, 402 bp, Glycine max
  Peptide Sequence Number=SeqID_218255
atgggattgtttcgggaacccaggggacttccacccaagcgagaacaggaacacgctatccacttggtggaaggtcatggcccagttaacgtgcgcccttatcgataccctcaccatcacaaggatgagatagaaaagcagactaaagtggaagttgttcagcgagatttgatggaaaaggatgagtgcttgagacagctgaatatttcatatttctcttctcaagaaggttgtgggaattatcgtgtggagaaagagttgcccaaggagctagagaatgagccatctaccaaatgggagcctattcaagtgttggcttcaagagtggttagtgcaagaagggattcagtacaacattttcttattcagtggaagcacaaactagtagaggaagccacatag

SEQ ID NO: 101478 - DNA, 903 bp, Glycine max
  Peptide Sequence Number=SeqID_218256
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcacggcctcgtccagataggtgcgttccaggctttcgccgtagatccagacgatgttgcgcgggcgctgcagcggctgcgtcggcacctggtactcaggggcgatgcgggcgaagtcgaccgggcgcagctgctggtacaggcgctggccgtcacgggccagcgggctgatcatgatcgtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 101479 - DNA, 648 bp, Glycine max
  Peptide Sequence Number=SeqID_218257
atgacgatgttggatgaatcgatggggtgcatgctggggcagcacgatgatttcaaaaagagagaacgggttgtctattacttgagtaaaaagttcaccacctgtgagatgaactactctctgttagaaaggacgtgttgtgctttggtatgggcatcccatcgtctaagacaatatatgttgagccatactacttggttggtatccaagatggacccggtcaagtacatttttagaagcccactcttatggggtggatcgctcggtggcagaagtgttaaagttgatgtctcgctacgcgagctcaatgctcttagcgagtgtcatccgttaagcaaggcatcaacgcgcttagcagataggaggaatctgaaagggaatctgtcacacaggcacgcgctcagcgcgtcattagctcgctcaacgagtcgtttgtcaccttccaggcttagcgcgagtttggcgctgagcgaaaattcacttactcgcgctaagtgtgagaatggcgctaagcatgacgtcgaggtcagtaagccctttttaaagcctggaataacagaaagagaggagagagcgttgaatagccgtaagagcttgaagagtgaaatacacagaggcaaagaacagagcaaagaagccaagttttga

SEQ ID NO: 101480 - DNA, 210 bp, Glycine max
  Peptide Sequence Number=SeqID_218258
atgagggttcatatcatttggtatcagagcctgatgatgcgctccatgagaggttggatcaaatggagaatagagatcataatgaagaagaaaggaggagaagagggaatgatggtgtttctagacaaaaccgaattgatggtattaaactcaacattcctccatttaaaggaaagaatcatccggaggcctacttggagtgggagatga

SEQ ID NO: 101481 - DNA, 396 bp, Glycine max
  Peptide Sequence Number=SeqID_218259
atgcaagaaaagttcattgcttgtttttttttcggtactcatgctatttggttgaggaatcttatgattggacttcacattgtgaactatattgctaggccattgaagattttttgggatagcaatgcttctatgttttatacaaagaataataagatttatagaggatctaagcacttggatttgaagtacttgactgttaaagatcttgtgaaagatggttccatagtggtagatcatgtgaacacagattccatgttggctgatccattgaccaaaggacttagcctgttgtttttagacgacatgttgaaaaaatgggcattattattaaagcttggtgccatcaggatcactatgtcggtggtcaacaccagaattggagctgaggcataa

SEQ ID NO: 101482 - DNA, 251 bp, Glycine max
  Peptide Sequence Number=SeqID_218260
tggatgctggagtaggagctacagaagtagaaggaagctcagatggccttgccctcaccttcctagcccctcggatagagactgttaatgaccgggctcaagcgcttgaaggtaaggctgtcagagacaacccctctggctttgcaaataatgcggtgattagagcagggaacccaagtctagaggtgttagactgggctatagaggtcatatggccagagatcagtgctcctatgttcatatccaagtga

SEQ ID NO: 101483 - DNA, 429 bp, Glycine max
  Peptide Sequence Number=SeqID_218261
atggcttctagaaagagaaagagcattggtacaaggcccacatctcagtatgacacaaggagattctcttcattagatgcttggaccagatacactgataattttctaggaagaaacattttacctgagaggaaagccgagctggagaggtgtaatttccataaacgcctcaccaatttagccgattggagcatagacctggcttttgtgaaagagttctatgcaaatttatacagttctgaggatcgtccaccaaagcagttcagagtcagaggtcatttggtgaaaattgatgctgacaatctcaacacattcctggagacacctgtggtattaggtgagggaaagactctacccgcctactccagatactgcaagttgcctacaaacttcagagagatagaggatgccttatgcatacctggctga

SEQ ID NO: 101484 - DNA, 249 bp, Glycine max
  Peptide Sequence Number=SeqID_218262
atgggagaggtggttaccacccagctctcccaggcgagctcagctcgcccaggcgagctagattacgcaaccatcccctcttcggcttctggaatgttacggaactttacggattgggcaataatgattcctttcgactcccgacatgtcgcagaacttcacggattgcttaacgatgggtgtcaagttcctcgaagcggtcaagcaaaggttgcatgccatcaaacaatggtccccggacaaaattag

SEQ ID NO: 101485 - DNA, 261 bp, Glycine max
  Peptide Sequence Number=SeqID_218263
atgtatgagacaaaaggagtagagcccgacctgaaagaaacccttaaggttcacacttgcacatttgagaagaaaactcattccaccaggagatcgtggaaaacacccaaagccaatagtgatagtagggtacacgtgatgttagtcgctcatgcgaaactccttaggattcctttgaatccaatggtggcctttgcctcgggatcagcccgtgtcatcaagtttcagtgggatcaacagacccatggcatcactctatga

SEQ ID NO: 101486 - DNA, 180 bp, Glycine max
  Peptide Sequence Number=SeqID_218264
atggaagaaaaaatgctttctgacatcattagaatattcgaagtccctaggaagctctctttgttctttcaaagaaacagaatagagcgttctgttacagctttgctactttgtctccaagaagtgaagctgatatttaaaggtggacctgagagagatagggtaatacagaagtattaa

SEQ ID NO: 101487 - DNA, 762 bp, Glycine max
  Peptide Sequence Number=SeqID_218265
atgggttgcttcgtgtccactccaaaggattctggtggaaatagaaggaggccagggagtattggggaggtttctgtgtatgttcccggtctaagaattcctaaacctgttgattttgcacagtcacttggtgattacttgtccaagaatatagtggagcgcctgtctgctcttagaactcgtatagttgtaatggctggccaagaaggtcctacaattacaagaacaaaaaggaaaagtgccacccaacatggaggttcaacactggctgatcttcagcaggctcttgaagattacttgccagtacttttgggattagtcgaaaatggaagccatttacaatacaaagtacaatttgattgggtgaatcaagaggatgacacagaggaaacaaccatgtctaatgcctggtatgaagtattgtcagttttgcacttgatggcaatgctattactgtcacaggctaatttattacttcttcccagaacatccactgatagtcatcagccaaaagtatcagaagaaagcagacgagcttctgttgatatcttcttaaaggcagctgggtatcttgactgtgctgtaaggcatgttcttccacagttgcctggcgaactgaggagaaacttaccagtggatctcacagaaggagttcttcgagcactctgtctacaagcattgggacagcaaatgattaatagatttagcttgctagggtttatttatgtatttactattaaattgggaatggacgaggcctaa

SEQ ID NO: 101488 - DNA, 3165 bp, Glycine max
  Peptide Sequence Number=SeqID_218266
atggcgtttcgtagggagaaaggtttgtgttataattgcgatgataagtggagtcctaaccatcgctgtaagggacgcatactactgttcattgctgatgacttaccaccggacgacgacgaccccggctccgtaacaaccaattctggcttggaaggcaatggcggtgattctgaaccagccatagacacaagttttccccacgccaatcttcacgccatgtttggccttccatcatcggagacattccgcatctatggtaccattaagaacgcacgtctcaccatcctcatagacagtgggagtacccacaacttccttcaaccgagggttgcgcaattccttcaccttcccgtcgaaaccacacaacctctaagggtcctcgtcgggaacgggtctgtgctagactgcaaccaacgctgcactgatactcagttgtcgatccagggccactcctttccggttcacccatttgggctaagaaacatccctgcaagccgatgtagctattggaccagaacctgcttcagcaacccaacttccaccgtgagtcatcttccccctctagccgagcccgttgaaaggcttctccgtcgatatgataagctctttcagtccccgacacacctacccccctcacgcgaggtgaactaccatatcactcttcttcattccatggcgccggtaaatgtacgaccataccgttatcctcactttcagaagacagagattgagaagcaagtctttgaactgctgtctgcgggcctgataagaacgagcacgagtccatactcttccccagtctttttggtgaagaagaaggacggaacttggcgcctatgtgtagactatagatccctcaacacagttacgattcgcgatcgctttccaatccctactattgacgagttgttggatgagctgggccatgcattgtggttttccaaactcgatctcaggacgcaccatgggcactacgaatacctcgttatgccctttggcttgtgtaacgcacctttgactttccaagcagccatgaatcacctcctcgcgtcgttcctgcgtcgttttgcagctgtgttctttgacaacatactcgtctatagcgattcactatcctcccacctagagtacctcaggcatgttgttttcggcaagggtgtagctcctgagccgtctaagatccaggctatcatccaatggccagctccgacatcagccaaggaacttcgagcatttctcgggctcacagggttttatcggaagttcattcagaaatacgcagctatcgcaaccccattcaccaatctgctgtgtaaggatgcattcgaatggtcactagagtcgcagaccgcctttgaaaaactcaaatccgccatgaccactgcgccagtgttagctctccctaacttcaacgagccttttacagtggaaacggatgcatcgggctccaccatgggggttgtgctcatgcagcaaggacacccactagcattttttagcaagaacttcaacccacatttattacacgcttccacgtatgtgagggagcttcatgcaatcatcgcggctgtgatccacaccccgaagcaacactactatctctctaaattgcttggctttgattataaggctggtgcaactaacattgtcgcagaagcactctcgcgtaggccacctgattcaggccaactgctgctgctctctgtaccacaaatggatttcatgagtgatattcaacaaacgcttgagaatgatcctagtttccaggagttggtacgcaacattaaggttaatccttcagcataccctcaatttcgccttagtaagggatatttgttgttcaatggtcgaatttggttgaataaaaccaacccttatattccttccttattgttggaattccatgccacaccacttggtggccatctggggatagccaagaccacacattgtcttgaatcaagcttcttctgggagggaatgaagcacgattccagtactaggcatatggaaggtctattgcaaccgctaccggttccgacgggggtatgggaagacatctccagggatttcatcacccatctgcctccatccaatgacttcactgtcatcttagtcgtggtcgacaggtactccaaagggatgcatctcggagcattgcccacggggttttcagccttcaaagttgccacggtattcatcgacatcatctgcaagcaccatggattccctaagagcatcgtttctgatagggatccctcagatggccagactgaggtaatgaatcgcgccctcgagcagtacctcaggtgctttgtacactcccaaccgccgacatggttccgttatttgtctctcgcagagtggtgctacaacacttctctacactccagctcggggctaactccgtttgaggttatatatggtaagccttcaccgtcaatacctcagtacattcccggcttaacaaacaatgaagttgttgagtcactagttgcatcccgtcaagctatgaacgctaagttgcagaaaacactaaaaaaggctcaaggttccatgaagaaatacgcggatgctcaacgcgaggatataacattttttgtgggccaatgggtctacgtaaagcttcgtcccacccgagaggtcgcgtaccgattggaacttccggctgaagcacgcattcatcctgtgttccattgctccttgttgcgccattatcacggagctccgccctcagccactgaaccctggcccctggagatcatcggccataagccgctgcaacgccctctttgcatcctagacaacaagcttgatacttctacatctcttccaacacagctggttctaacccaatgggctggacaacctccagaggacacttcctgggagtcatggcccgaactacaagaagcctaccaccttgaggacaaggtggtgtcagggggaggaggtattgttagcacccataacacacacgctgcctctgacgaagatgaacgtcgtcctcctgctgttgccacgacgaggccaactcgcgcaataactaaacctagaggagcccttcctcgaatatgggcaaccacctctctcccttccctcacttgcgccaccataaagcctcaggtctcaacatgtgccaccataaagcctcaacagtag

SEQ ID NO: 101489 - DNA, 195 bp, Glycine max
  Peptide Sequence Number=SeqID_218267
atgggatatgaacttggacaaaaaaggatgagaataacatggggcaaacaaaggcggaacatatggagtgggcctaggacagatccaacagagattgggtatctaacattcactgacgcacaggatgttgctaggtgcaccgggcatattgcttgtgcacccagcattgcaacaaaattccaaaaatacccttga

SEQ ID NO: 101490 - DNA, 294 bp, Glycine max
  Peptide Sequence Number=SeqID_218268
atggaggttgatgaaccttggctagggttatggctaccattgaattatcaagtggtgttcgtcattggaagtgcggtagacagactttgtggtagatttagggatggcctttgtggatacctgggtggtgggaatggcagtcacaacatgggtttctcccttatcctcaccctctttatttgccccagttttctcagtcgtcctagtaggatgatcaaatttgcctcttttcggacccacattgatcctttcactggcgaagaccaaatccgcaaagcttttgagagtgcgtag

SEQ ID NO: 101491 - DNA, 333 bp, Glycine max
  Peptide Sequence Number=SeqID_218269
atgagtgaaattcaacaactacaggaacaaatgaaggtcgatatggagatcatgaaggaactaatgacaacgatgatggaagcaatgatgagcatgaggaagacgatagaggataacactgctacagttgttgctatgagtactgctatcaagatggacccgattcacccggtcgatttcaatcaagtgaatcatccagtctcagatgtagtaggtcaaggaggcgaggcaacgaaaaatgcatgtgggcctcatcatgttcagattcagaggaaacattccttcctactatatgggttgcctcttaattatacattgcccactgttgtatag

SEQ ID NO: 101492 - DNA, 1062 bp, Glycine max
  Peptide Sequence Number=SeqID_218270
atggcctcctatggtgtggcgtctcctctctctttccctttctccattccgctgccattcatcttccaagaagcaaaggaatccattgatgaagaagatcctaggcttacaagctctaatggagcttgcatcacatttgatgtcaccttggacaaagccaagttgatttatggcatcatcatgaagatggatatgaatgtggggtacctcatctcccaccagatctctattactgcacaacatgatacatccagacttggattccttaccttgatcatagttctatgcaaggccagaggagtccaaccagattctagatccctggagaacttgagccttgccattaacttggcatatattaagaagaactgttggaatcttgatgatccaacagtgacatttagagggccaaggaaggccaggggaaagagatcagaggtccccactacttcagcagcaccagagacaccaactccttcttcttccatagctctagtacctcctattcaaactccagttattccttctactattcctcctacatctactcagatacaacttctagctcctttatctgcaggactttcagatttttcatttacaccacagatgttgcacttcatgctccagagcttacacagggggcagtccattatcatgcagagccttcagggcttgggcttgccatccatcataagcatggatgagttcgatgcgcaggtggcctggccaggagtccaaccttccccttctagagggggtggggcctccgcagcccaggagcttgagccagaggagccagcagcagcaacaacagagggggaggatgagctcacccctcctgagcccttttattttgatacaggtgtacacatggctcaggaggaggagacttccacagaccaaatcctagagccatccccaacacccatacctgatgatgctataccatctgcaccagcatctgagttagagcagcctatctctcaggattcaccagctgctcaggtgttggatcttaatgagcatgcacaggagcaaccacaggagcaggacatttaa

SEQ ID NO: 101493 - DNA, 270 bp, Glycine max
  Peptide Sequence Number=SeqID_218271
atggcagaagctacaatcataaaaataagcccaaaggctgaaaacaataagccaaaacagaaaaactgggcaattctagacatggagagaacctcgagatctactaaactcaagggcatcaaatccgacatcaagcctgagacaacagttccatatgcatactcgccagaaatccccactcacggaggaggacggttgactcacggtggccaaaaatcgcctcacgacagcggagacaaaaaaaacaaaggggttttgttgcgagcataa

SEQ ID NO: 101494 - DNA, 933 bp, Glycine max
  Peptide Sequence Number=SeqID_218272
atggacacagctcaatggccacaggagatggtggtgaaaccaatagaagatatagtggtgacaaatactacatgtacaaaggctgcagtaggttctgtagaaaggaagccaaggccacagaaagaacaagctattaattgtccaaggtgtcattcaattaacaccaagttctgctactacaacaactacagcctcacacagcctaggtatttctgcaagacttgtagaaggtattggactgaaggtgggaccctcaggaacatccctgtaggaggtggctctaggaagaacaagagatcttcagcttcttgtagtaacaatagtcatcacaatgacaataattcaaccaataagaagctttctgcagatctggtcatcacacctccaactttgtcacacactactcaaaaccctaagagcaatgataatagtattattcatcaaggccaagatctcaatttggctttcccatccaccaccaccaccacctcagatttcagaaaaatctctgaattggtccaacaaaataacaacaacaatagtagcaacaacagcatgtcagcttcttcttcaaccacaactacaactacttccacttctcatcacctttctgcattagagcttcttactgggatcacttctagttccagtactggtttgagtacttctttcatgcctattccagttccatctaatccaaattctatctacacttgtggatttcctctgcaagatttcaagccaggaaccttgaatttctctttagatgggattggaaaggggtacacaagccttcagaatgttcatggtgggaggctcttgtttccatttgaggacctaaaacaggtttctagcaccaccacaatgaatcagacgcaacaaggggattcaactgggtattggactggaatgttaggcggaggatcatggtaa

SEQ ID NO: 101495 - DNA, 207 bp, Glycine max
  Peptide Sequence Number=SeqID_218273
atggactcgacgaagaagaatgccaggcatgacaattctccctgcaactcggggattcccgcaggactaccccatttggggccctgcagtcggaaaaaaatttcctacggagacggagatggggatgaaaaactccctgcagttaattcagggacgagtactatgcttctcgccccacaggattctcgtatccccgcgtatatataa

SEQ ID NO: 101496 - DNA, 2883 bp, Glycine max
  Peptide Sequence Number=SeqID_218274
atggagattttcaaatgcttctacatcaaaaatcttattcttgttaccttcttcatggtatcatcagcagttctagcaattgacccttactcagaggcacttctcagcctaaaatcggagcttgtagatgatgacaacagcttgcacaattgggtggtgccctctggaggaaaattaactgggaaatcctatgcatgttcttggtccggcatcaagtgtaacaatgactcaacaattgtaacttccatagacctttccatgaagaaattgggaggtgtggtttcagggaagcaattcatcatcttcacaaacctcactagtctcaacctgagccacaatttcttctctgggcagctcccagctgagattttcaacctcaccagcttaacaagcttggacatcagcagaaacaacttttctggtcccttcccaggtggaattcctagactccaaaacttggttgtgcttgatgcctttagcaacagtttttctgggccattgcctgcagaattttcacagcttgaaaaccttaaggttctcaatctagctgggagctacttcagaggttcaattccacctgaatatggttctttcaagagccttgagtttcttcatcttgcaggaaattctctaacaggaagcatacctccagaacttggtcacctcaaaacagtgacccacatggagattggctacaacgaataccagggttttattcctcctgaattaggtaacatgagtcagcttcagtatcttgacattgcaggagcaaatctttctggtcctataccgaagcaactctccaacctcaccagtttgcaatccattttcctcttcagaaaccagctcacaggatcaataccaagtgagcttagcatcatagaacctctcacagatttagatctctctgataacttccttatagggtccattcctgaaagcttctcagagctagagaacctgaggctgctcagtgtcatgtacaatgacatgagtggcactgttcctgaaagcattgcaaaacttccatccttggaaacccttctcatttggaacaaccgcttctccggctcgcttccaccgagcttaggcaggaactccaaactcaagtgggtggatgcctctacaaatgatttagttggaagcataccaccagacatttgtgcgagtggagaactgtttaagctgatcctgttttcaaacaaattcacaggtggcctttcatcaatctccaattgttcttccctcgttcgccttcgcctcgaagataactcattctcaggagaaatcactttgaaattcagccatcttcctgatatcttatatgttgatctgtccaagaacaactttgttggtgggattccctcagatatttctcaagccacccaactggagtatttcaatgtctcttataatccgcaattaggaggcatcatcccttcccaaacatggtcattgccccaacttcagaatttttcagcatcttcttgtggtatttctagtgatcttcccctatttgaatcctgcaaatcaatttcagttattgatctagatagcaatagcttatctggaaccatcccaaacggtgtttccaaatgtcaagctcttgagaaaatcaacctatccaacaataatctgacaggtcatatacctgatgagcttgcctctattcctgttcttggtgtagtggacctatcaaacaacaagttcaatggccccataccagccaagtttggtagttcttcaaatttacaactcctcaatgtgtctttcaacaatatctctggttcaataccaacagcaaagtcattcaaattgatgggaagaagtgcatttgttggaaattcagagctatgtggagcaccattgcaaccatgtcctgattcagttggaatattgggaagcaaaggcacgtggaaggttacacgtattgtgcttctctctgtagggttgttaatagtccttctgggacttgtttttggaattctttacttgagaaggggaatcaaaagtcaatggaagatggcctcattcgctggtctacctcaattcacagcaaacgatattttgacaagcctcagtgccacaacaaaacctacagatattcaatcaccatcagttacaaagactgttctgcctacaggaataacagttttggtcaagaagattgaattggaagcaagaagcataaaggttgtgtcagaatttataatgaggctaggaaatgcaaggcacaagaacttaatcagattgttggggttctgccacaaccagcacctagtctatcttttgtatgattacttgcccaatgggaatttggctgagaaaatggaaatgaaatgggattgggcagcaaaattcagaacagtggttggaattgcaaggggactttgcttccttcaccatgaatgttacccagctataccccatggagacttgaggcctagcaacattgtattcgatgaaaatatggaaccccatttggcagaatttgggttcaaacatgtgtcgaggtggagcaaaggctcatcacccaccacaactaagtgggaaacagaatacaatgaagccacaaaagaggaactgagcatggatatctacaaatttggggagatgattctggaaattttaaccagggaaaggttggcaaattcaggagccagcatacacagcaaaccatgggaggttctcttaagagaaatttacaatgagaatggagcaagttcggcaagttcattgcaagagattaaacttgttcttgaggtagcaatgctttgcacccgaagcaggtcatctgaccggccatccatggaagatgttcttaagcttctgtcagggttaaaacatctagaggatggcagaacttcgaaagaagggcaataa

SEQ ID NO: 101497 - DNA, 954 bp, Glycine max
  Peptide Sequence Number=SeqID_218275
atggatgatctattacttactaggagtagctcaactgggattgactcactaaaacagaatttgaagaaggaatttgaaatgacagacctaggaacattattatactttctaagaatggagtttgcatacactgaacaaggaattttcatgcaccaaaagaagtatatttcagatgttttgaagaggtttaacatgtggaattgtaactcaacagaaactccagcagaggtgaatttgaagcttgcaaaaggtgagaatgaagcctcagttgatggaaccttgttcagacagattgttggtagtctaagattcatctgccacagcagaccagagatcacattcaatgttggacttgtgagcagatttatgggtgaccctaggcaatcacacttcctagctgctaaaaggatcatgaggtatctaaaggggacattgggatatggaatcattttccctcatcaaaccaaaaaggatgataatctacatcttgtagcctattcagactcagattggtgtggagatttggttgataggaaaagcactacgggacaagtatttctattgtctggctctcccatatcctggaactcaaagaagcaatcaatggtggcattatcaacctgtgaggcaaaatatattgcagcttgttcaactgcttgccaagcactttggctttcatccctgattaatgaattgaaagtatcttcagatgaagccgttgaactaattgtagacaacaaatcagctatagatttggccaagaatccagtagctcatggaagaagcaagcatatagacactaaatttcatttcctcagagatcgagtaagtaaagacagaattaaactaaggcattgcaagtcaaaagttcaattggctgatataatgactaagtcattgaaggttgaaagatttaaagtgtttagaaagctactgaatgtagtttgcatgtaa

SEQ ID NO: 101498 - DNA, 663 bp, Glycine max
  Peptide Sequence Number=SeqID_218276
gctaaaaaggatgtggcaaacgtcgaggatccctttagtgcccctacttataacattcccgagaagcctgtcacgttcgtggaaggggcttcctacggtgttgtcattcttgcggggctcggaatcgcagctgctgcaggatatgctgttttcaaagagcttatttttcaacctaaagagtacaagatctataacaaggctctcaaaagaattcaggatgatggtcagatacgagtaaggattggatttccaattactggttatggtcaggagagtagaaatcgagctgctcgccaaagaattcctcacagggtatggactgatgaggaaggtgtcgagcatgtggagctaaacaaaaaacttcaagaaaaggttgtgagggaggagacaaagatgaaaaaaagagagagaaaagaggcaagagactcagagaggaggtggggggaccttatcaagttcgaaacatttggactcttggagagtgagggagaggttaatttttatatccggggcccccatggacatggaaaagtatttgcggaaatgttcaaaggcgctgacaatgagtggaagtttacttacttgattgttgagattagagcaccatctaccgcacaaataattctggagtcatacatcccatcttacagtgcaaccaagtag

SEQ ID NO: 101499 - DNA, 1353 bp, Glycine max
  Peptide Sequence Number=SeqID_218277
atgggaacgaccgtaatcctgtgggccgggttgcccttcggagttcgccttgaccaggaagccgccaaaatccggaatgcgcgcatggatctcatcgaccttgtcgcgccaccagcgccgcacagtcggatccaggggatcagccgttgccaggccgccgagttcgatgggtgcactgaagcgcgcgctcaggtagacccggatgccataggggcggaacaggtcggccagcgcggcggccttggccagataggccggcgacaggctcatcgcactggcattgacgttgttgaggacggtgccgttgatgccgagcgaggcgttggcacgggcgtaatcggtgtagcgcgggtcacgccactgcggcaacgtctgccagtcccagagcgagctgcctgcatagccacgctcgacgtaacgatccaggttgtcccaatggttgagcacacgcagtgcgacccgaggcgactcacgcacctccagcccccgcagcgacgtgccacgctgcagcaggcgcagcagatggaaggtgccgtacagcacgccgacatcctggcgtgccgccacaagcagtacatcgcgcccctcgatccggacccgccggatcaggaaccccccgtcgcccaacgtggcgatctcgttgccgtacgcggcgacgagggtcgaggattgcggcgtgcccagcaccagggcatgcgaccgttgcggcaaccggctggtaccgcatccacagcgcatagccatcctccgcccgtgccccgccagcacaggccagcagcacgagcagggcccacagctgcgtgccgacagcgcgcaacaacggcgttaacatgcgcctttgtagactacgtccgggcccggggcagcgcatcatcgtccttcgcacccgcgcggcagcgccaccaagaacaaagggatcgtgcattggacaagccgaagaaatcggttcgccgcagaaccgctggcgtgacgatcgacgaggttgcggcccttgccggcgtttcgccgatgaccgtgtcgcgggtgatcaaccagggcaaggtgcgcgacgtcacccgcgagcgcgtgctgcgcgccgtgcgtgagctgggctatacgcccaatcttgccgccagttcgctggccgccgcacagcacacgcgcattgcgctgatctacaccaaccccagcggcgcctacctgcgcgaactgctggtgggcctgctgcgcgtcgcctccagttccgccatccagctggtcatcgactactgggacaacctggatgccgaatccgaacgcagggcggcgcgcgcgctcgccggacgcgtcgacggggtgatcctgccgccgcccctgtgcgaatcgcaggccgcc

SEQ ID NO: 101500 - DNA, 201 bp, Glycine max
  Peptide Sequence Number=SeqID_218278
atgggtcgcttagcggctggcgaggagcccgctaagcctaaggtcagccacatggatttgcgcttagccaagggtaggctgtgcttagcggcactaaactgggcaaaaatttcactaagttatggaggcttagcgaacaggaatgctcaaatcagcaaatgccacaaagaatttcccttggcacaggagattctagcttag

SEQ ID NO: 101501 - DNA, 285 bp, Glycine max
  Peptide Sequence Number=SeqID_218279
atggcttcaccttggctaagcgagacccaatgtcaccaagtgcgattcattgcggtcagaattgatggccatgggactgagcgcgtaatttgcgggctaagcggatattcttgtgcatatgcgctaagcgatgctattgaccgctcagcgccagcttctctgtacctaaattgcataattttagctaagcagactaaagcctggcttagcgggaattgtaggttttctaatctgcatatcttgctaagcgacaacattctcacgctaagccaaattctatgctaa

SEQ ID NO: 101502 - DNA, 327 bp, Glycine max
  Peptide Sequence Number=SeqID_218280
atgttagaacctttgattccatggagctttcttccaggtgttacacctccactaacaaccacatcaaagcaaccaaatatggtgataagatcctttgtttccacgcttagccatgcttgtgatgtgccacttagtcaactccaagtgccttgtccaaagggagatgctattgcgatcaaactaccagagaaagagtatcaggaaggattggagagtcgcaagaataacctaaatgatcatatggtgctattaaacaaggataccctgcctcacattcatgacttgcgcaaaaatcttagtgcactgtggaagctagttggaaactag

SEQ ID NO: 101503 - DNA, 206 bp, Glycine max
  Peptide Sequence Number=SeqID_218281
agctgctctagcgatcaaaatgtccaatgtctacctccaggcaaagacacaatcgaatacttcactctgaaggatctttgggactgctattctgaatggagtgcctttggtgcttgcattcctctgatgttggaaaatggtgacactctggttcaatactatgttccgaatctgtctgccatccaaatctaccgcagtaaatctag

SEQ ID NO: 101504 - DNA, 1833 bp, Glycine max
  Peptide Sequence Number=SeqID_218282
atgggtgagtatcttggacgtgtgcagattctgaccaatcagatgattgtgtgtggagaatccctcaaagaacagattatcgttgaaaaagtgcttcgatctctccactctagatttgatcacatagtagtagccatagaagaatcaaaagatctggaaatattgtcgttggaacaactacaatattctctagaggctcatgaggctagaatcaatgaaagaaatgctgaaaaggatgttgttgaagccttgtgggttcatggtggaaaattaggtagaggtaatggcagtatgaagaagaataaaggaaaattgaaaaataaggataaaaggaaatggaagagaggttctaattctgaaattgtgaccagaatcataggttggggacactttgcaaaggagtgtaaaaatcctaagaggcctagagttcaaaatgatgaggccaaattggttcaagaagaggattcagaagattatcatgtgatattgatggtcaccactgcattaaaaggaggtagcagagaagaaaatgcatggtatcttgacactggatgcatgaaccatatgacaggaaggaaggattggctggttgatctagatcttagcaacaaagggaaagtgaggtttgtagatgacaataccatcagaactgaagggatgggaatagtgcaaatccaaaagaaagatggaggaatttctcgcatttctgaagttctctatgtgccaaccattaacaacaaccttctcagccttggtcaattactacaaaatgggtataggatgttattagaggataatgctctaaagatatttgacaagaagaatagattcatcctgaaaacccctatgctgaagaataagaccttcaaggttgaaatacaagccaaccaagaggtaaactgcttatcagtcactgaagaaggagagagctggttatggcacaagagatacgaccatctaaatttcaagagccttaacatattacatgatcaaagcatggtgtcaggattaccaaagctggttgcaccaggaagagtatgtgctggttgttgtatttctaagcaaccaaggaagtcttacaggaacctgatccatagtaggacaaagtcagccctggaagttgtacactcagatgtgtgtggaccaatggaggttgagacacttggtggtaacaaattttttgtcacctttacagatgaattcacaaggaaggtatggatttatcttcttaaaaaaaagagtcaagtgtttagagtttttaggaagtacaaaaccatggttgagaagcaatctaaactgagcatacaaactctaaggacagatggaggaggagaattcacctctcaggattttgagatgttttgtgagcaggaaggcattgttcatgaggtcaccccaccttatacccctcaacataatggaactgccgagagacttaataggcacgtaccagatcaaagaagacagaagttagatgacaaaggagaacctatgatcctgttaggttaccatcaaactggggcttacaggttgtttgatccaaatacaaaaaagattgtaataagtgcagatgtggtctttgatgaatggagaggctggaattgggatagattaccaaatagtcagacaaaattcacttgggtcagttctgagggagagaatagtgttgagtcaggagctaaccaagtgactgatcacactggagtcactgaaaatacaaggttccagggagaaggaaatcaaattcccattgtgagtgcaacaggaagacctcagagacacacaaatgttcctccaaggttgaatgattaccaaattctgaaagatacataa

SEQ ID NO: 101505 - DNA, 939 bp, Glycine max
  Peptide Sequence Number=SeqID_218283
atgaagagaggtagggacaaggagagagaagacggtaccatagccaaatattgggaaattggttggagctggaggttagcgatggagatgttgcttgccttgtgcttccttgtgcttttgcatgcaaatccttcatctgctcgtttattagtgaacagaagcagaggaatctccacgtcgacaaagcaagttacgaggagaaacctggtcgaaaatggcctcggccaaacacctcccatggggtggaatagctggaatcattttggctgcgacattaatgaaagtgtaattcgagaaacagccgatgcaatggtgtcaacggggcttgctgctttggggtatcggtatgtaaatatagatgactgctgggccgaacttaatcgagactctgaggacaatatggttcccaatgctgcagcatttccttcaggaattaaggctctggctgattatgttcacagcaaaggtctaaagttggggatctattcagatgctgggtatcaaaacataaccttaagcttagatcttgagcgtatgtcaaaggtttcaagcctttctgatcacttacaatttccttacagaaatcaaacatgcagtaaacgtatgcctggatcactgggacatgaagaacaagatgcaaaaacatttgcctcatggggaattgactatttgaagtatgataattgtgaaaataatgggataaaagccacagacaggtatccaccaatgagtgaagctttattaaaaactggaaggccaatcttcttctctatgtgtgaatggggatggcaagacccagctacttgggccaaaactgtgggaaatagttggagaacaacaggagatattgaggataactggaatagcatgactaccatagcagatgcaaatgaccgatgggtatcttatgctggatctggaggatggaatggtaattaa

SEQ ID NO: 101506 - DNA, 275 bp, Glycine max
  Peptide Sequence Number=SeqID_218284
agaatgatccagaatttcctattcttctttttctctatgcaccgtgtgtccgtggagccagcacttcggtgcaagattgtcgttgccgttgtggtgtgggtgaagaagtgtcgtcgtgcttggcttcgtgcaatagtggtggtttgagggggaaggaaggagggaagcgagggggaggttgtgacttcactggagctggtgccggtgcggtgggggcacgttgcatgcctgaaatcatctctggtggtggtgaacggtggccagtgacaaagtag

SEQ ID NO: 101507 - DNA, 879 bp, Glycine max
  Peptide Sequence Number=SeqID_218285
atggttcccaaggcttcaacatttccttcaggaattaaggctctggctcattatgttcatgggaaaggtttgaagttggggatatattcagatgcaggaaatcaaacttgcagtaaacgtatgcctggatcactaggacacgaagaacaagatgcaaaaacatttgcttcttggggagttgactacttgaagtatgataattgtgaaaataatggtatattagccacagaaaggtatccaccaatgagtgaagctttgttaaaaactggaaggccaatcttcttctctatgtgtgaatggggatggcaagacccagcaacttgggccaaaactgtgggaaatagttggagaacaacaggggatattgaagataactggaatagtatgacttccatagcagatgcaaatgacagatgggcatcttatgctggaccgggaggatggaatgatcctgatatgctggaagttggaaatggagggatgaccacagaagaatatcgtgcccatttcagcatatgggctttagctaaggctcctttattggttggttgtgatattcaagcaatggataataccacatatgaactgataagcaaccgagaagttgttgcaggaaagaaggtgaaaaacaataatggtttggaggtgtggacaggtcctcttcgtggtaacaaggtagcagtgatcttatggaacagaagttcatcaaatgcaacagtgactgcatgttggtctgacattggcttggaaccaggaactatagttgatgcaagagatttatgggagcactcaacgcaaacatcggtttcaggaaaaatatctgctgaactagattcacatgcttgtaagatgtatgtcctgactcccagaaggtattaa

SEQ ID NO: 101508 - DNA, 287 bp, Glycine max
  Peptide Sequence Number=SeqID_218286
aatgtgcaagcaaatatgagggaattgacacagggaatgacgcaagttgtttaattgggtggcgaagtattgtaggagagaaatgcaagaaaaaagagagtggttgcatgtctctctctccttttgggcttgccactttcaaaatgaggaaaagcgtttggttaaactcttataacaacaataatcaagtggtgaccaatctgtataacgctgcagactcgtggttgaagcaccgcaacgctgaccaccctgacttcaacttcttcacacgccaacctaccttgtag

SEQ ID NO: 101509 - DNA, 276 bp, Glycine max
  Peptide Sequence Number=SeqID_218287
atggctcatgttgctccagagttgtgtcatgtgaactttgttgccaacttcacagtcaggttattgacaattgttgctccatcttatagtgcgatacaagaaccagtggcattcttgggtggaatgtttgcgggtattttgagacttgatttgaatgaggagcccctcaaggaatgggttactaggactgtggaagctgcaggtattagtgaagaagaagccaatacagaagagtcaacaactgaggaagctccacaagagatccagattgaataa

SEQ ID NO: 101510 - DNA, 759 bp, Glycine max
  Peptide Sequence Number=SeqID_218288
atggcagatcatcagagactgaggatccaccctatggagggggaagcaccaccgcccccaacaactccattggtccctccaggctcatcaagatcagaaaagggtgttcctttgcaccatcctccacctctaccacgtgctatgccagcagcataccctacaccacacaaaagaagctcaagctgttgctgcaagtgcatatgctggacaataatcttggttgttctcctcctcattatctttgcagcaagtgttggaatcctttatctagtcttccaaccaaagcttcctgattactcagttgacactctcaggataagtgatctgaggcttaactttgacatgagcctctatgcaaagtttgatgtgaagatcacagcaaccaacccaaacaagaagattggcatctactatgaaaagggtggaaagttgagtgtgtggtacacaaacacaaggctctgtgaagggtcactgccacaattctaccaaggtcatgagaacaaaacagtgctcaatgtgtccttgagtggtcaagtgcagtctggaagcaccctaatgaatgcactgcagcagcaacagcagacagggcgcattccattggatctcaaggtgcatgcaccaatagccatcaaacttgggaggttgaagctgatgaaggtgagagtgttgggagaatgccttttggtggtggatagcttgtcatctaataatctcataagcatcaaggctagcaactgcaagtttagattgaaactttga

SEQ ID NO: 101511 - DNA, 445 bp, Glycine max
  Peptide Sequence Number=SeqID_218289
gaaagaacacgctttacggtgctcttaccgaatgcatgctagagctagagtaatgagtgaaatagaggaggtgcaagagcagataaaggccgacatggaggccatgaaagagaaaatgaccacaatgatggaagccatgatgagtatgagaaaaatgatggaggtcaacacgactacagtcattgccgcaagtattgctattgaagtggacctgactcacccatctggtctcaatcaagtaaatcctctagtctcggatatggtaggacagggagacaaagcgttaggaagtatgggcggcccccattctgtgcaagttcagaagaagcattccttcccaccatatggcttgcctcccaactatacactacccaatgttgcacacgctcccgatgagaatgtcaataactccactcccatactcattgagagccaacaaccctga

SEQ ID NO: 101512 - DNA, 612 bp, Glycine max
  Peptide Sequence Number=SeqID_218290
atgggcagttcagatagaatcgaactttcgattgattcgggtacttggaatcctatggatgaagacatggtttctctggatcctattgaatttcattccgaagaggaaccttataaagatcgtattgattcttatcaaagaaaaacgggattaactgaggctgttcaaacagctattggaattatggattttcagtttatggggggcagtatgggatccgcagtaggtgagaaaatcacccgtttggtagaatatgctactaatcaacttttacctcttattctggtatgtgcgtccggaggagcgcgtatgcaagaaggaagtttgagcttgatccaaatggctaaaatctcttctgctttatatgattatcaaaaaaataaaaagttattctatgtatccatacttacatctcccactactgggggggtaactgctagttttggcatgttgggggatatcattattgccgaaccaaatgcttatattgcatttgctggtaaaagagtaattgaacaaacattgaataaggcagtacctgaaggtcacaagcagctgaatatttattccataagggcttatttgattcaatcgtaccgcgtaatcttttaa

SEQ ID NO: 101513 - DNA, 228 bp, Glycine max
  Peptide Sequence Number=SeqID_218291
atgccatcgcgacatagggatcgcgcccacaggacacccagtggacccaaagaagtccaacagggtcctggggtttccagatctgattgcgggcctctttcatcaggccccctactaatcgagctttcatcaagaggtgttgcgcccccaggcaggcgtaaggcgaaacaccatagcagcctggggatggccagcaacaggcaacaaatgcaccgccgccacctctag

SEQ ID NO: 101514 - DNA, 222 bp, Glycine max
  Peptide Sequence Number=SeqID_218292
gtaatatctctcgagcccctaagttgtgcaactttgtggagtagaggggattcaaagttgtttataaaaggaggatttagtggaaactgccaaagaggaagtgatgcaatcctacccccaaggacattggatagaagactccaagaagattgggccaaagatgcaagagaaggccctagggttctcatgagccttaggatagattttgggcccatgggctaa

SEQ ID NO: 101515 - DNA, 378 bp, Glycine max
  Peptide Sequence Number=SeqID_218293
atggtcaaagaagtgggtgtaaacaaatgctatgtgcaaggctcaaggactttcaagattagtgatattgtgatgcatgtttggaagtatagaagcaatgtccaacatccagatgtgagaaacgaacgagccctagcccattcccattttactatgacagtgctatggtcagaatgtgatggcacggatgtagcaagcccaaatggaggcaaaagtggaggcctaattggcgccttgttgcgggatagggcagctttggcggcagcgacagcaaggtcgacatcttccttagtaggatgcaagcattcatcagagtacctcttatggttgttgtcataccctaatttcgtccggggacctttgcttgatgacatgtga

SEQ ID NO: 101516 - DNA, 846 bp, Glycine max
  Peptide Sequence Number=SeqID_218294
atggctaaggagtttcaagctgctatttatggtgaaagttggtggaatattattaatccaacaagaagtgtgtttcctcttatgccatcaactttttctatggcagcagctgatgcaggaaactacaacaattggcaaagtactattgatttcatggatttgaagggaacaaagtcttgtgatgaggagactaatattaacttggtttcttctgaagaaatagaaataggtggcggtggttcttccaatgattcaaaaatccaaaaggattggagtccaaagaatttatcatatgttggtggcagcgagcaagtttccaccattgatgcttttaagccaatgaaccaagaattttccttggatcaacaaagtctgaattctgttgttacaagcactgatggatcattatccaatggtaatttcctagttgtttcagcctcctatggttacccttcaacatttatacaaagcttatatgagcatcaaccacaaccacaaaactcaattttcactaacctctccatgtcctatgggacatgttccaatgaactgtcaccaacttggtccaaagtcttttcccttctcaaaccctcaatgccaaagcaacaacttagtggattgcacttttccaacaacactactcctttttggaattcttcagccgaagcgcttaatgacataagagcaggtgtttttgcttcatcacaagtgcaatatcaaactccaaaatttgaagagaaacccaactgcccccatactctattaaagaagagagaagaatcactagacgcagcgaagaaaaattctcctgagcctgctgcattcaaggcacttggtgatgagtag

SEQ ID NO: 101517 - DNA, 555 bp, Glycine max
  Peptide Sequence Number=SeqID_218295
atggcgccgccttccttgtcttctcgccctcgtgtcttattagatcatatgtacacctttagcaatgctgattcattgtggggtgcaacttacaggccaaaaacgctacaaattttgccaaagtattttccagaaaagtttggcaattctagaggagaatggacagtggcaccaaaaggctttgcacaaggtgacgtccttggaggcattgcagcggaaagggacaagcttgagaagctggttgctgatttagaggcctggcttaaggattcgaagtccaggcttggggattctgagctgcgggttactaaggagagggaagccaacaaggagcttaaggaggagccactcatttacaagaagaaggttgtggagcaacatgaaaaagggtttcaaaaagtcgtcaggcaggctgagttcttcaccaaggaccttgacttgagtctctttgaccctttcaaagatgcgaagggtggtgttctgcttgatgaggaggaaaattctacagaggacgaggctattaatgaggagcaaagtgatgatgccgctatttag

SEQ ID NO: 101518 - DNA, 435 bp, Glycine max
  Peptide Sequence Number=SeqID_218296
atggcgtgctcttgcatatgtgtcacttatgaagtggcatgtattggagacatggtggtggcgcgtactggagacttagtggcatgctcttgcatacatgtcactcaccgtgggtggcacgtattggagactcagtggcatgctcttgcatacatgtcactcactgtgggtggcacatactggagacttagtgatgtgctcttgcgtacatgtcactcgctgtgggtggcacctactagagacttagtggagtgtgctcttgcgtacatgtcacttgttgtgggtggcatgtactggagacataatgttagaagaatggctcaccaagggcgacccttgggttttaagagccttggagctatgactatgaataacaatagtctccttattgatggtttcccaacttcaatggggatcatggcgtttgtgccatat

SEQ ID NO: 101519 - DNA, 236 bp, Glycine max
  Peptide Sequence Number=SeqID_218297
gatgtgttgagggttcaatggaacctagtatttataggagaggagtggagttgtgtgtccttgtttatagggggttgagtgtttgtcctcctccttcacctcctcctgctatacttattcaagaggccactcctgatgttggtgaagttagtatgtcggctgctctggctgactttgtaaaggattttacaaagatagtggaaatctcaagtgggttgcttgagtactggacgtag

SEQ ID NO: 101520 - DNA, 492 bp, Glycine max
  Peptide Sequence Number=SeqID_218298
atgggtagcgaagaggattcgattgagcaaagcgttgcgtcccgtcgcgaaagactgctagctctcagagccgctcaggagttgtcgagtgttcccgaacctgaacctaacggcaacaaggacgatgataatgaagaagatcaagaacctcaagaaatgaagttccgtaactacgttcctcacgacaaaaacctccaggaagggaagcttgcccccgcggtgctcccaaagttcgaagaccctgtggatgatgtgcctccacccgagcctgaagctaaggaggatccgttcttgaatattgctccgaagaaacctaattgggacctgcgaagagacgtccagaagaagcttgataagctcgagaagcgaactcagaaggctctttatcaactcatgggtatttacgcatctccttattattcctcaattctgttgttcgatgaatttactcatcttattaatatctgttatactatggctattttctcttag

SEQ ID NO: 101521 - DNA, 540 bp, Glycine max
  Peptide Sequence Number=SeqID_218299
atggctagaatactccttgtaagaattgggcaatcctcccctcttgaactacctattgagagtgaggctgcagcatattattatcacggattgattcttgatgagggaaacacggagaaatctcatgggatggctgtagcttctttacaagcagctgatgagtatttcaaagaaagtaagaagttgtgtgaagcattcaatgcagtacctccattgtcaagttctcaagaaaatagtacttttggtggtaatatgctttttcatgatccatctaactggcagtcatggtgcagaaatccaccactttgggggactatgaaatatctttacgagaaaattcctaaggatacttcaagcaaggtgcgaataaaccgtgatctgtactcctatgagagaatcatggagacagcaccaacattgcctgattttgccttggctttgaaaccagatgaatatcaacttccgcagatggatccctcttggagaacagaaaatgtgaaagacgggcaaagtggcaccacaaatcatatcaatggatga

SEQ ID NO: 101522 - DNA, 198 bp, Glycine max
  Peptide Sequence Number=SeqID_218300
atgaagcaacggtttgctgccgctcctggcctcgtgcctaaaccacacgttttgtgccaccgcctccatggattctgtgtggcagtcgcaactaccaagatgttgttgaggacagtgacaacgatgggcacgacggagacaacgaggctgcagtggttgtcgagggatatggcggaggctagtggtactaaagattag

SEQ ID NO: 101523 - DNA, 936 bp, Glycine max
  Peptide Sequence Number=SeqID_218301
atggacttagttctaaacaccacaacaattggagttggtgttgtttctctgatcctcttatacttgtttttgtgtcgtcgttcctcgaagagtggcgaagagggtcctcccacagttgcaggtgcgtggccaataattggtcacctcccattgttgcttggttcaaagacacctcataaaacattgggtgacttggctgacaagtatggacccatattctccatcaagcttggtgcaaaaaatgctgtggtgattagcaactgggaaatggctaaagaatgctataccacaaacgacatcgccgtttcctccctccccaatcttatctctgctaacctcttgtgctacaaccgatccatgatactcgtagcaccctacggtccctattggcgccaaatgcgaaagattttaatgtcggagttcctatctccttcccgagtagagcaactacaccatgttcgcgtctctgaagttcaaaattcgatcacggacctcttcggtgcttggcgtagcaataagaatgttgagtccggctgtgccctggtggagttgaagcaatggttctctcttctggtgttcaacatgattctgcggatggtctgtgggaagcgctatttcagcgctaccacttcggatgatgagaaggcaaagagatgcgtgaaggctgtggatgagttcgtgcgtctcgccgccacgttcacggtgggagataccattccttatctgagatggtttgactttggtggctatgagaaggatatgagagaaactgggaaggaattggacgagattattggtgagtggttagaggagcatcgacaaaaaagaaaaatgggtgagaacgttcaagacttcatgaacgtgttgctttccttgcttgaaggaaaaactattgagggcatgaatgttgatatcgtcatcaaatcctttgtattg

SEQ ID NO: 101524 - DNA, 903 bp, Glycine max
  Peptide Sequence Number=SeqID_218302
atggagagcttaggttctgcattacatgaagtatctgcaaaagctagagaagccaaagaaaatctacttcacagccaacctgaaagtgaaagctatgatgcccagattgaagacttaaagtttgtcttaaaagctactaatgaaaaatacaattccatgcttgatgaggctgagaatcttctcaaggaagcttctcaaggaggtgagcttagttatgagagggcatcctctccaagcttcttatccaaggctcatcttggtggtgaagctccttcttccatggcttattccttagtggatggcgcctcctctcaccttttctcctttctcttccgctgcatctccatagtaggtaggagagatcgatcagttactatgaacgttgaaagcaagaggaaagatgaacaagaggtgaaagggtggagaaaagctttaaaaagtgtagggaattggctggcacataaggataaggatgaatggttgaaggacatgaggggaatgttgattttgttgtctacggtgatcgcaacaatgacctttcaaagtgctttaaatccaccaggtggagttagacccggaaacgagagtggagttgttcaatgtccagtaaacaaagcagataataatccatgtcctggagaatctatcctagttgttgtttaccctgatgaatatggaaaattcctcatttggaacacaacatctttcatttcatctttagcagtgtgtctcttacttgtagaaactgagcaagaagctaatgccaaaagggaggaaaaagctcagttgaaggaaaaactgaaggaagttgcagctgaggcaatccaaatgcaggaagctcttaaggaaacaactactcacaacatgaaattaaaggagaacttattggataaagaaaattag

SEQ ID NO: 101525 - DNA, 294 bp, Glycine max
  Peptide Sequence Number=SeqID_218303
atggctgtgctaagtaacccatcaataccactagcccctctgttagcagctaccctcgccaatcagactaataagccagaacaacatccaacttttgtcaatactaaggatcacagctatatgatgttgtcagtcccctcatcaaacagcaagctatatgattgcgcaaagaacatgggtgcagatacaaccaaattcaaggaggggcaccacaaagccctcttacctcaaagactatgtataagaaagaaagggagaaaggaacatgacctggaagctgacccacaacgatga

SEQ ID NO: 101526 - DNA, 435 bp, Glycine max
  Peptide Sequence Number=SeqID_218304
atgtctccaagtacacgagatgaaagcggtggcatcacttcatccaccatattcaaactgtgtgatgcaatcctccctaggaagggaccagtcactagaaccatgagcaagaggctccaagaagattgggctagagctgctaaagaaggccctagggttctcatgaaccttagggtagatttcagaggccatgggccaagagctcttttagagcacaaaatttcgtgctcttctctccctctcccttcattcatctccttcttcctccaagctcttatccatggcctcctatggtgtggcgtctcctctctctcttccttctccattccgttgccattcatcttccaaggagcaaaggaatccattgatgaagaagatcataggcctacaagctccaatggagcttacaccactgtgagtggaaggcgcaattag

SEQ ID NO: 101527 - DNA, 678 bp, Glycine max
  Peptide Sequence Number=SeqID_218305
atgatgtatatgtatctaatatgtagtgcagcaaaagtgtgcattgcaacaataattcaagcagcaaccgaggcaagcattacgactcttgtatgggcaacaagtttgatattgaataatccaagtgtactagaaaaacttaaagccgaactagacatccaagttggaaaagagagatacatatgtgagtctgatttaagtaagttaacatatcttcaagctgtagtcaaagaaactttaagattgtaccctccaggtcctctctcaagacctcgtgagtttgaagaggattgcactataggtggctacactgtaaaaaagggaactcgtctaattacaaatctttccaagatccacacagatcataatgtttggtcaaatccattagagtttaaaccagaaaggtttcttaccactgataaagatattgacatgaagggtcaacattttcagctattaccatttggaagtggtaggaggatttgtcctggagtaaacttaggccttcaaacagttcatttgacacttgctagttttttgcattcctttgaaatcttaaatccatcaactgaacctcttgatatgactgaagtctttggagtaaccaactctaaagccacttcacttgagattcttattaaaccacgtctatctcctagttgttatgaaagtatgtaa

SEQ ID NO: 101528 - DNA, 276 bp, Glycine max
  Peptide Sequence Number=SeqID_218306
atggattctgaacctaaacgatggagactattatggagttatcaggggatggtagttgtttcagcaagagcaacaaggttgcctatatattcttcatttgccaaagaaggaaatctcggtgacctatttgctaaaggagaggcattttcaactctctttaatgttattggaattggagttgggattcaattagcatctaccatccgtgcatcaatgcagggaaaggttaggccccctaatggaagtcatgcaaacaatgttagttacacactataa

SEQ ID NO: 101529 - DNA, 328 bp, Glycine max
  Peptide Sequence Number=SeqID_218307
gcttgtgtggaatcaacgagcaaggacaaaaaggaatcttcaagtgacgcgacaaggaatccgcggggtagctctcgatagggtctttggcactagcttttggccacgttcatacgttggatgttgtgtatgttcgtggggggcactgtgcactgaccttccagggtctttggcactagcttttgggcacgaacatacgtcgtatggagtgtatgtcatggggggcactttaattggtccatggtctttgacacttacttttggccgtgatcatagctcatacgacacaggaaatagagtaactgtggccaagtgtactttgtactag

SEQ ID NO: 101530 - DNA, 861 bp, Glycine max
  Peptide Sequence Number=SeqID_218308
atgaagaacaactcagaatcaactcaatttagtttagaaggttttgattgtagccaattctttgaagctgatgacaatgtgcagcatggagagaatattatacctaacattcttccaaatatctgccctccaccttctgctttcttagccccagaatgtgccctatgggactatttcagacttgctcaaggggttgaatggtgccagaactactgtagtagttgtcatgagctgttggcaaataacgagggtcttcctggcatgaccccaattttgcgaccttggggaattggtgtaaaagatggtcctttgtttactgttgttcttgctaagacgcggggaaaggaagtgggcatccctagttgtgaagagttctttgatctttcttttcttgagggtgaaactgttagggagtggctcttctttaacaagcctagaagggcatttgaaagtttaaatagaaaacagagatcacttccggattacagtgggcatggttggcatgaatcaatgaagcaggtaatgaaggaacatgggggacaaaagaggtcctattacatggacccccaacctcttagttatctcgagtggcatttgtatgagtatgagatcaacaaccaggattgttgtgcattatacatactagaattaaagctggtggacaaaaagaaaagtcctaaaggaaaagtgaccaaggaatctcttactgatttgcagaacaagatgggacagcttactgctactgttccatctactgatgatgacaaccagtcaagggaaaaacaaatgccaaatatgagaatgacgaatctcccaacaagtaaattaatacttcgttgcgcgattttaccatattactga

SEQ ID NO: 101531 - DNA, 435 bp, Glycine max
  Peptide Sequence Number=SeqID_218309
atgagtatagagcaattcattgagaaggtggtttggcctggagcccgaccttcttttgtgggggataatgaaagttttacaacccaggcacctcaacagcatgagacagaaccagaaaatgatgactcatctaaagccaccatctctggagctattgattttaaaaaaagaagattagagacaagatccaatgaggctgcttatcctggaccagtgccagcatcagctgatgcaccatttccaggagtggatccatcttcacctcagcatgcagcagactcttccactcctgtcttagagatacatgagggccagaccataccagtcctgcctttggacacttctcctctagctactcccgtatggcatctaacagatgagaggatgttcagatacaggacaatcaggaccagtcacagtcattttaattcctga

SEQ ID NO: 101532 - DNA, 248 bp, Glycine max
  Peptide Sequence Number=SeqID_218310
atgagggtgcaaatagcaaccaggcccacttgggccttcccaattgttcctccagaaggcggttgcttctggaggaagcaacctggctcgcctgggcgagctgggtggcaagctcctcacctatttcctataaatagagggaggagtgaagaagaaaagggttcagcccttctggtacttcgtgatttcgcgaagattttcaaccgttcttcgtcgttcgttcttcgtcgttcttcggtgttcaaccg

SEQ ID NO: 101533 - DNA, 354 bp, Glycine max
  Peptide Sequence Number=SeqID_218311
atggatgctgctgataaaggtactaaagcatctaaaactagagcttatccctttggtacagcattagttgaatttttagtgagtcgtggtctattgcgcttagtaacatataatgttgatttattaaatttctctgatgatagtggtccaaagactgttgtcaaaaatgttgtcaaaaagggccataattactataggagctctttagtatatgccgaatgcttgtttaaccccgcattacttcctataaagttaaacctacctatggtatttccacctaaagattgggagccccacaaacctgaacagaaaccaaccctacgggccaaatctacagcactcaacggagtatga

SEQ ID NO: 101534 - DNA, 288 bp, Glycine max
  Peptide Sequence Number=SeqID_218312
atggcccgaaatctgcaccatctagaaaagattatagtggtattaagaattactggtacacacttcctcttcttgcgacattttcatttgtttgcattcactttcgttctcgtgagaggtcttctgttagatgtgctcatttgtagttctgtcctctttgatggaggtgcattgtttacggtggttcgtcgacaagtggtggttgtagtggcggtggttggtttggccactgaaggcggaggtaaggtctttgatctggtttttttccgtgcaaaacttgctgattga

SEQ ID NO: 101535 - DNA, 243 bp, Glycine max
  Peptide Sequence Number=SeqID_218313
atgatcatgattaggactagaggcttaggtcgtgccttaggtacgcgaaagcctacagcatcggctcgtaggcaacgggaatatgcccctgttgccgaggatgagcttgtggtaggttcagatgaccctttggtagatgcggacgtagatttcacttttcttactagtcccagaagcaaaatagaatccatttccaaggaaaaaaatttagggtgcaagaagaattcatatgacggacattaa

SEQ ID NO: 101536 - DNA, 470 bp, Glycine max
  Peptide Sequence Number=SeqID_218314
atggcgatgggtgttaagccttctgaagtgattaacaacgctccccggatgaaattaggaactgtgtgtgtacggataaccgctgggtatattcgtatgccacctgactcatggatcggggtagcagaactgtataaccacttggggtatttccgcccgccaccggacgcatgggttgggataacaaaagatgctgacatctctagaaaaagagcaaatgatgacgtgcaaatgatgatgctagtcactgcatgctatcaagatttgagtcttacggatagaaatgagactttttcgcagtctcggccggaagacgctgacatcttcgggaaaggtgcaggtgacgacgtacagataaccataaggtatctccgcatgtcatcgtactcgccgtctctggatgacaaaggtgcagatgacgacattagtctctacgtgtcaatgggctccctgcctctggctgacaaaag

SEQ ID NO: 101537 - DNA, 720 bp, Glycine max
  Peptide Sequence Number=SeqID_218315
atggcagtcacagcatgggttcctccctcattttcttcattttccctaggcttcccattcatcaaagcatttaaaacatcgtttcgagggccccttccttatagggacctagatgacctagtccaactttgcataagggtagagcaacaacttaaaaggaagcctactttaaaatcttatggctctcactcttatccaaagaaagaccaaggtcaaggcattttaggggttgcaccttctaagcccaaagatgttaagagggacgaggaagaaatactagaaaaacaaaaagaaaaaaggataataaggccttgtcttcaaaggccaaggggaaggaaaaagaggaaaaggatttctccaagaagattgttaagaaggaaaatcattttgcaacaaaaggtgatatcaaaagagcactccttcttaaacaatccttctaccttctcctatcaagggaaacctcccttagcacagccatatctcttgagcttgaggtattataaggtaccaaatccctatgataggtggtatgatgaatgtgttgagtgtgatcaaggggttcccatggaccctaagagaataaaggtcattcctaagtggcacactccaccaagtgttaagggaagaagcctagagtttcaagaacctttggatttaaggtcaaaaccttttcaagggggaggggatgatgcaatcctaccccccaagggcattggatag

SEQ ID NO: 101538 - DNA, 156 bp, Glycine max
  Peptide Sequence Number=SeqID_218316
atgaaggtagctcgcccaggcgagctgttacttcattctaaagcaaccttgctcgcccaaggaagtaaagataaagacactaatttcattcgagcgatcttgctattcgaccgggccactggcgaaaaccaaggaagtgaaaccgagaaaacatga

SEQ ID NO: 101539 - DNA, 348 bp, Glycine max
  Peptide Sequence Number=SeqID_218317
accttcagagggatacacgtcctcgacttcagaggtctacacgtcctcaccatcagaggcttgtacgtcctcgccttcagagggcttcacgtcctcacctccataggcctgctcgcctccagagggctgtacatcctcgccttcagagggctacatgtccttgacttcagagggttgcacgtcctcacctttagagggctacacgtcctcgcctacggagggctgcacgtccttgcctctatagggttattaattaggcaagtttgtgaagtgctaatttttaccttatcgctaagccaatctactggcttagcgagtcatccgctgagcgcaaccctcctcgactga

SEQ ID NO: 101540 - DNA, 153 bp, Glycine max
  Peptide Sequence Number=SeqID_218318
atggaggttgaggaatctttgttgggattatggctaccattgcattattgtgtagatatgggacaggcgggttttgtggctgatttaaaggtggcctttgtggatgattgggtgttcttggctgatagggtggtgggtaatgagaagggctga

SEQ ID NO: 101541 - DNA, 522 bp, Glycine max
  Peptide Sequence Number=SeqID_218319
atggatacaaacttgggatccctcatctcaggtcagatttctctcatcgcaacccagaaatccagggctaggagatccgagggcccaccatcttctgctcctgcccctgctcatgtttctacttcagctccctttgcatcttccccatctacttctacaactctagttcctccagttcttacaggttttcccgctcagagctcagaacattccttatctatgctgcaaagcctgcatcagggccagctcctgatcatgcagagtctgcaggatgtggtccaccagcggccggagcctcagccagcaaagaaggatgcttctgctaacatctcagagccctctccatctgagccatacagttttgagactgatccagttattgttcaggatgatgttgtagtaccagagccatcttctcagcctgagcctgagccatctgcaccagtgttggacttgcctatttcttatgatccaccatctgcaccaacactggacttgaatgatgctacacaggataattga

SEQ ID NO: 101542 - DNA, 549 bp, Glycine max
  Peptide Sequence Number=SeqID_218320
atgatattggggaatctcattgctattacccaaacaagcatgaaacgtatgcttgcgtatacgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcaggcaggcttatatttcttagtttcaataggactccttacgagtgttgtttctatctactattatttaaaaataatcaaatagatatcatattcatggaatacgattcgctttcaagatgccttggtggtgaaatggtagacacgcgagactcaaaatctcgtgctaaagagcgtggaggttcgagtcctcttcaaggcataatattgagatctcttattgaattggaataa

SEQ ID NO: 101543 - DNA, 1143 bp, Glycine max
  Peptide Sequence Number=SeqID_218321
atggctcattttgcgcagtccccttctgttattttgcatcaggtctcctgtcagtttgcgacgggcgatatcctttttggtccgctgaatctcacacttgagccctccctgtgcgcgctggttggccgcaacggcagcgggaaaacgcgtctgctgcgcatgctggcggggcgggatgaaccggccagcggtcatattgaacgctttggctcgcacttctatgtggcgcagcagcaggctatttctccgcagacgacactggcggaactgctcggttacggcgcgatgtttgcggcgcgtaaacgcgttgatagcggcgattaccaacctgacgatctggacatactcgacggccactgggatttagccgagcgtctgagcgaggcatttatccatgcgcaactgcccgcgtttgatccggataagcccgccggtgaactcagcggcggcgagcgcattcgcgccctgctgtgtggggcatttacggcggacgcagactttcttctgctggacgaacccactaaccatctggatcgacaaggccgggcatggttttacgaccagcttaggcggtttcagggcggtgtgttggtggcctcccatgaccgggagcttctggagcaggtaccgcgtattctggaactgagcgcctcgggcctgcgcagctatggcgggaattatgcggattatcaaacccagcgcgatgctgagcaacaggctgcccgtgcggcgctggaacatgcagcgaccgagcgcaaacgcacccgggcgcgcatgcaaaaagagcatgacgacagccagcggcggtcggcaaagacgttacgcaccgtcgataccctgaatatcgcctcgtttgagcgggtcaaatacaaaggcgcggcaaaggaacgaattggcagctggaagaagcagcacagcgagcaaaacgaggcgctgaatgccgcggttaacaaggcgcgtgagcgggtggaagaagatgcccccatcatgtttacccttccgggaagccatattgccgagggaaaacaggtgctggtgctggaggacctgcaactgccgcatgtctctctcccgccagtcaactggcggatggatggccccatgcgcctggcgctcagaggaccaaacggctgcggaaaatag

SEQ ID NO: 101544 - DNA, 371 bp, Glycine max
  Peptide Sequence Number=SeqID_218322
gtatgcttgaagtggtgtctaatccttggaggtttacagtagggaactggttatgtgactcagatctggttagtcctactggaattgaacgggttctaactgaaaaagaccttctggctgactcatattcagacctagaggcttctatctttgatgaaaaagaatttctcctattgaaggttatctctacctttccggagttatcttgcttaatatgctctatggttggagcgggtcggggaatagacgatgtggccttatccataacccatctttcgggaagagttacttcatcccattttatttttctcgggagagacacgttagcctttgtcatatcagtgataaacaaggttgtttctcctttttga

SEQ ID NO: 101545 - DNA, 333 bp, Glycine max
  Peptide Sequence Number=SeqID_218323
atggccaaaatacatcatcaagcatggccaacaaaaacatatcatccaatgaaacatactccccacacttattcccaaaacaattccaaagctccaaaattccttaagggtagggggaacataggctcaaaggggctatcaaaggaattaattcaaggtaggctcatttggctagaggcttataagaacaaaatgcctaaatcatctcccaacatgcatgtgaagcaagaagtatcaacaagagtcaagccaaggctattctgcaagcaatcaatggagcaaaacacacagaataaaatagatgatgatggctcaaattctcaccaagggtaa

SEQ ID NO: 101546 - DNA, 315 bp, Glycine max
  Peptide Sequence Number=SeqID_218324
atggagcataaagcatattgggccttaaaatttttgaactttgatgaagctgcatctagagagcaaagaaggctgcaactattggagttggaagagatgagattaactgcatatgaatcttcaaagctgtacaaagagagggttaaaaaaccatttaccattaagaaagtccgaccatatggagcagtggagctttatgaccctcaagctaaagatcccgacagagcattggtggtgaatggacaaaggcaaaagttgtaccatggtggaaccattgagagattaaacactattctatactttcaagaagcataa

SEQ ID NO: 101547 - DNA, 372 bp, Glycine max
  Peptide Sequence Number=SeqID_218325
atgaacccagttgagcgatacatgaagatcctaaaagggtatacaaagaatctacactacccggaagcatccattgttaaaaggtacattgcagaaaaaactattgagttttgttcagagtacattgaaaaggaaaaatatgttgggcttcctgagtctcggcatgacgagagagtgagagtttttcatgaaaccttagtcaaggaaagtaagccaaaaatgaccaagcatagggtgttgaaagagcataaaaagactttcctagactggttaaaaaatacatgtagaagcaagcttcatgatgatgaatcaagtatgattcaagtagtattgatgatgacaaaaagcccaaaagaatgttgtcaagattga

SEQ ID NO: 101548 - DNA, 282 bp, Glycine max
  Peptide Sequence Number=SeqID_218326
atgacatgtctggaggggaagaaagttgcttttggtatatatactctggtggaagaagctaagcattggtgggagaacactctgccacaattctacggagtgcctgtcacctccagcaagggcatcatgccccctactaatcgggctttcatcaagaagtactgcgtccccaggcaggcgcagggcgaaacaccacagcagcctggggatgaccggcagcgggcaacagacgcaccgccatcacctctagagttcacctcagctcatccacaaaaaggttag

SEQ ID NO: 101549 - DNA, 261 bp, Glycine max
  Peptide Sequence Number=SeqID_218327
atggcgacaaaggtggtgcttcaagggtggaaggacgaggagaattcgatgcccaagtggatgtgtaggtttatgtggatcacgtacttgtgcaccagatatctaggtggagtggatcccagatatgggaaaagagacaatatggagggcagagtcgtatattgcggcggtggaatcgacggagagaagatgaagttgtcgtcatcaccgtcgtgggagaagacttttgttggagttgttgggaaatcttgcctcagctag

SEQ ID NO: 101550 - DNA, 819 bp, Glycine max
  Peptide Sequence Number=SeqID_218328
atggttgagaggcagtttgatataaaggtgaaaatgatgagatcagacaatggatcagaattcattctaagacaattctatgatgaaattggaattatacaccaaacttcctgcgttgaaacacctcaacaaaatggaattgtagaaagaaagcatcaacacttgcttaatgttactagatccttgttgtttcaatctaatttacctttcatttgttggtcttatgctttaattcactttggtattcttgttaactgcatacctactacttttcttggtaacaaaactccctatgagaaactctatggaaccccctatgatattagttctttaagagtatttggttgtctatgcttcactagttccttaactgccaacaaaaagaagcttgatctaagagttgctatttctattttcctgggattcaagccaaacacaaagggatatgtcaccctagaccttaagaccaaagccatttctatctctagaaattttggtgactttccctcagaatcaccaattgatcatcctattgatgaacttgctaacactgttattgatcctgatactacacgaagagtcactcagacacctagaaggtcaatgagacagatacataagccaagcaagtataaagactttcacatcacatatccatcatcaactgtttccaatctctctacaagtactactctttatcctcttagtttcgttctttcttataacatattgtctccttcctatcaaaaggttatcttgtttattacacaacaagttgaacaccaatcatatagtgcaacctttaaagatccttactag

SEQ ID NO: 101551 - DNA, 510 bp, Glycine max
  Peptide Sequence Number=SeqID_218329
atgttgtgcaacattttaagtcattttgttacgaaaccaacatcagctcatcaacaagctactttcaagattcttcaatatatcaaagggtccccaggtgcagagatttttctttctgctgatagtaacatccatatgaaaggatttaatgattcaaattgggctggttgtattgatacaagaagatctattattggttatgccatatatcttgataattctttgatttcatggaagtctaagaaacatgttactgtctctagaaactccttagaagttaagtataaagctttacctagtgctacttatgcaaatcctgtttttcatgagagaacaaaacactttgagattgattgccatttggttcgagagaagatgcagaaaggaattgtgaagttgcttcctgtcacttctactaatcagcttgcaaacatatatactaaggcttcgctgcttggtgcttttcaatttatgtattccaagctaggaatgtctaatattcattcctag

SEQ ID NO: 101552 - DNA, 330 bp, Glycine max
  Peptide Sequence Number=SeqID_218330
atgggggcatacgcaaaagatgagaaactgctgatacatttcttccaagaaagtcttactagggtagctgttacctggtacactaacttggaaccttcccgagtccattcttggaaggacctaatggttacctttattaggcagtatcagtacaattctgatgtggctccggataggatgcaactacagaacatgtgcaaagagggggcacgaatccttcaaagaatacacccaaaggtggagcgatctggcagcccaggtggcacccccaatgacgaaaagggagatgataacaatgatagtagacacattaccagtattctactatga

SEQ ID NO: 101553 - DNA, 267 bp, Glycine max
  Peptide Sequence Number=SeqID_218331
atgagcaacgggcgcctgtaccagaggcgggtgaagaatgcttttgacaaaaaggtacgcccgtgcaaattaaacgagggagaccttgtgctgatgaaagtatctcaagccttaagggacaataggggaaagtgggctccaaactatatagggccattcattgtaaagaaggccttctccggaggagtcctggtgctcgccaacatggatgatgaggagttaccttcacctgtgaatgtcgatgtcgtcaagcgatactacgcttaa

SEQ ID NO: 101554 - DNA, 339 bp, Glycine max
  Peptide Sequence Number=SeqID_218332
atggcatgcaacctttgtttaaccgcttcgaggtacttggcaccctttgttgcgcaatacgtgaagtttcgagacatgccggaaatcacaaggaagcattgttacgcaatccgcccacttgggccttctagattgttcctccagaaggcggttgcttctggaggaagcaacctggctcgcccgggcgagctgggtggcaagctcctcccctattttcctataaatagagggaggagtgaagaagaaaagagttcagcccttctggtacttcgtaatcacttgaaattagtgaggaaaattgtttccgtgaagaaaatccaagccgaggcgcttccgtaa

SEQ ID NO: 101555 - DNA, 583 bp, Glycine max
  Peptide Sequence Number=SeqID_218333
ggctcaacgccctcaccttcagagagctacacgtcctcgccttcacctcttggatactagtactctcaccttcagagggctacgcgccctcgcctttagaaggctacgcgtcctcaacttcagaggtgtgcacgcccttgcctctagaaggctgggcacccttgcctttagaagactacacatcctcacattcagagggctgcacgccctcgccttcagaggactacacgccctcaccttcagatggctacacgtcctagccttcataggactacacgacctcgccttcagaggggatgcatgtcctcgccttagagggctgcacgccctcaccttcagagggctgcacgccctcaccttcagagggctacacgtcctcgccttcaaagggcgacaggtcctcaacttcagagggctgcacaccctcgccttcagaggactacacatcctcgccttcagaggggtacacattgtcgccttcagaggactacacgtcctcgccttcagaggactacacgtccttgccttcagaggactacacgtcctcgcctttagacggctgcatgtggcgtccctaaattaa

SEQ ID NO: 101556 - DNA, 447 bp, Glycine max
  Peptide Sequence Number=SeqID_218334
atgaaggattcgggaattttctccaccgaatccttgaggaggattttgaggattccgctcggattaaaacattcttcttggtgtggaggttcgacggcaagcaacaacgactcgtggaggccaccggtggtcgtgggtggtggagaaggaggtgttagggtttgggtgatctcgcttagcgagcttgtctcgctaagcgggagtccacttttcgtgacaattcgcactaagtgcaactccttttgcactaattctcgcttagccgcgctaattctcgctcagtgcaattccctctgggttggaattgcgcttagtgcgcccctcgtgcttagcgagacatcaaaagttgttattttcgaaatcccaacggtcagactggagaattgtcttaggaagctccagccaaaatttgaagacaatccaacggttaacgaatcgggatcatga

SEQ ID NO: 101557 - DNA, 237 bp, Glycine max
  Peptide Sequence Number=SeqID_218335
atggataagcagatcaactaccctaagcactacacaaagccaccaacaatggaaacacaaatgacagtgagggagaagagtgcttacctcgacaatcccgacgcgctgaagaagaagaagaagaagaaaacaacgttcatgccgcggagggagaagaggacgctacagaacgaagctgctgaagaccaaaaccaagctcaagaagaggacactgatgctgggtgcacagggtcatag

SEQ ID NO: 101558 - DNA, 246 bp, Glycine max
  Peptide Sequence Number=SeqID_218336
atgaccaccgcaacagtgaacaccggtaccttcaccttcaccgaacctaaccgttgccaaggaaccgaagaaaatacggcaccgaagagagaaaagcgagaagaagagtgcacaaaaatggctggtgcatcgacaatgatgttgggtgcacctagcaactcccttcaccatgtcgtgtcggatacacgtcacatcttacgaatactaaacaaagccatcataacatggacatgggtcagtgggtag

SEQ ID NO: 101559 - DNA, 1047 bp, Glycine max
  Peptide Sequence Number=SeqID_218337
atggatgaagacactgtgagaatagttgaggaattaagaagacctccaaaaccaatttcttccaagtctcaaaagggaaagaacactccttatgtagatgattattttatgcctagaacaactcctggagctcaacctagcttaaagagtgtcttgcaaaataagcaaattgtagaaaagtgtgacaaagccattgcaaaatggatgatagatgcttcaatgccatttaatgcagttaactcgacatattatcaacctatgattgatgctattagtagcatgagtccagggttattggaaaaagagtttcctaaaatatattggtctccttgtgctactcactgcattaatttgatgttgcaaaactttgggaaatttgaggaagtaagtgagattgtttcacatgcctcaaaaattactaagtacatatataatcattgttatgcattattcttgatgagacaacatacaggtggaagagatatgctccgtccagctcttactcggtttgcaactaatttcattgccttgcaaagcatattggcccaaaaggatgcattaagggccatggtgacatctagggattggataggctcaacttatgccaaagactccaaggctaaaaaatttgtgaagcaaatcctagactctagtttttggaaacaatgtgctgctattgtgaagcttacggagccattagttcatgtgttatgtattgttgacaatcaacataaacctgccatgggttttctttaccaggctatgtataaggccagagagaagatggttaagagattcaatgctgaagaatttaagaagcataggaacacacaatctagcattttgaaactcattgatagttacacacttggagatcttgagttgcaagataaattaaatgaaggcatgaggatatataaaattttgaaggagattttgcaagacgagcttcaatacgtgaagggaacacagtcatgccagatcaattgtgggattgttatggatgtagtgctccacaattgcaaaaattggctattcatgttttaa

SEQ ID NO: 101560 - DNA, 689 bp, Glycine max
  Peptide Sequence Number=SeqID_218338
gacttcagcaaaacaatcttttcaaggctcgggaagaaaaataccaatcgagaataagagtactcgaggcacttgcatctggaactatagataagagtgagggtgagaagatcaaagagaaagtaaagaaggtagatgagaatgaagttgttaggttgataaaagagcaggaggacaaaaatttggaaatttcagctttgaaggtagaactggaaacaaccaaaagaacatatgaagtacaattctcacagatggaagaagaagctaatagttttaaagcagcattgacacggaaggtccaagaatatgagcatcaattggaagaattaagaaatgaggacaaaagcataaatgtacttgaatggtctgccaagcaaaagattgcagttggagaagctcgtggcttgagataccaaaattctcaggcgaggctcacgagcgcgtcttccaaaggaggaaaatgcgcggagtcgccaccaacgtttatttgtggaaaatgtcggaaaaaccgaaggaaaccggtcgtgaagaatattccagattcgggagttgtatttatgtttgaggatggtattagcacctctcacgtcgacaacagcggggctcttgctcctatgtaccctccatcgaagaggaaatcagacctatgtagttctttctatcaagcgattctttttacttggaaggag

SEQ ID NO: 101561 - DNA, 612 bp, Glycine max
  Peptide Sequence Number=SeqID_218339
atggctacaccatcgagctcccctcctcttgagtcagcaccttcatcgtctatgttgaagaggactagaaaagccacacaacttagatcattgtctaccagacccatgggggtggagagaccactggttcatatggatcctaccacttggaaagctaatggtccccacaaaaagaaattaagggccgcctatttggggtcaaatttgacctccaaatgggctctagcacaaggcaaggaggacgacgatgacaaagtttgtgagaagtacaatatcaacaaagagaagtggaaccaattttgccaaagccgtagagacccttcatgggaggatgtactgactactttcgttgggcgaccagagcaccctggccatgtccatgctactggagtcggtgaaattgtaccccctactaagcttgaggtagctccttttgctgcctgtgtcagtacaaaagaaagttgtgttgatcccttaggacagaacccagacacggcagcatcagacaggatattgtatgttgatgacaatcctacctgtgtggtgaaggtgggtgttgaggaagttcaagatattgatgcttgcatccttctacccactaaagagatttag

SEQ ID NO: 101562 - DNA, 483 bp, Glycine max
  Peptide Sequence Number=SeqID_218340
atgttgtctcagttagggggagtagaagaaccagtggagagcttcaagttactgtggatattaaaagttccaaacaaggcaaagcttcttatttggagagcactcaagtatcgtcttccgactattgacaatctggtggagaggaatggtgagttatctagttttgttggagtgcttttcttgaaagtctctaaatttacctctcgtgttgccaacctcggtgaaagctcttctatggctacattcagtggtcttcaaatacaacatcttgtcttcaaggatggttgggataaggaaatacatttctttgggtttgatattaaccattatatgctccaaatttattttataagaagtgatgtagctccatgtggagcttgtaggccttggatcttcttcatcaatggattcctttgcttcttgaggtctaattgcagcggaatggagaaggagaaagatgaatggagacgccacttcaagtag

SEQ ID NO: 101563 - DNA, 324 bp, Glycine max
  Peptide Sequence Number=SeqID_218341
atggggacatgttgggaagtcagggtcggggattggggggagacaatacccgtccccgccctgccccgtcccattgccatgtctaggagaatgcacaactatgagagggtaaccattcttggtgacttggaaatgaaacgcccaatggggaagatgcacagtcaacaacctttgagatgccaaaggccaccaatgctgggaccctttgtgaataacctatgcaagaaacatgctttcgatatggacgagctacagtgtcgagtagccaagtacatgcagaattggctgaatacaggaaccatgttcaagtcaaggctacattaa

SEQ ID NO: 101564 - DNA, 255 bp, Glycine max
  Peptide Sequence Number=SeqID_218342
atgactaaaaggttatatggattgacaatctgtataagttatacgattgacaatacacaaattgaagttgtagaaaaaaaacatacctctgtcgttacacacaacactaaccaccacgacaacaaaaaattgccaatgaaccatcgtaacaatgaaccttggccaaaccagacacaaaaacgaaggaggagctcacgaaatgaatgctttatgaaaaaaacaatgaatggtcagaatagagaaggagaaagatga

SEQ ID NO: 101565 - DNA, 285 bp, Glycine max
  Peptide Sequence Number=SeqID_218343
atgaggcttcactgttatcaagcgagtcggagacctagcatgaccacaaatcaacctccactccctatgtctcacacagacctgggtatagggcctagtacctcaatgcgtgtgcaaagggcgaggcgaaaagaaaaaggcatgtcttccaaaaaggagaacgcatgggagtcaccaccaacggaaggtattagcacccaacgtgcccgtcacaagggacaacagcctttaatcaagtatgcaaaaggtgttgcccttgctcctacgtatccacaggtgcaatga

SEQ ID NO: 101566 - DNA, 474 bp, Glycine max
  Peptide Sequence Number=SeqID_218344
atggctgagaacatgagacataaatgggcactgggagggggggggggggcaaagcaatggtctcgggtatctggtgttttaggagggaagtcacacacaaatcaagtggcattagagttgacggggcatagggatgacacagaacatatctggtttccttgggacttgcacgtagatctagtgtgcttggttcatgcgcatggtgatggtgctggttggtgtggctcgcgcggtggaggaggtggttttagcggcggcaggacacggaggagatgtggggtggagaacagtttctacatcgattatatgaataatcaatgcaaaaaagttgagaaaattaaaattttcccatcaacctacaagaaggagatcatcatcaaagtcatggcgatggtggctagagatccatatgttagacttcttcccaaggtagaagcactaggagatggagtttttcagaagcttcttgcatag

SEQ ID NO: 101567 - DNA, 354 bp, Glycine max
  Peptide Sequence Number=SeqID_218345
atgagctcgacaaagacctcaattagggttctaacgcggttaaggaagatgaaagatgtcatggatgatcttgaccttgtagagggaatccgccacatcaacaccatttcatggaagacaacaactctgccacggaagttcttatggcgtgttgcggttgtgggaggtgaagtgcaccggggtctctatgatgagtgggtggtcgaggatgatattgaacaatgttgtaaagagaaaagatttgattgtgatagtgatgatgaaacaatgcgcgacagagacatttggactgaaaacaaaatgagcaccaaggacaaccatgatcttgccatcactggcctcgccggaaattga

SEQ ID NO: 101568 - DNA, 207 bp, Glycine max
  Peptide Sequence Number=SeqID_218346
atgaaggccgacatagaggccatgaaagagcagatgaccacaatgatgaaggccatgatgagtatgagaaggatgatagaggccaatacaactacaattgttgccgcaagtgccgccattgaggtgaacccgactcacccacctggcttcaatcaagtaaatcgtctagccttggagacacatcaagtgccccacaagaaacaataa

SEQ ID NO: 101569 - DNA, 285 bp, Glycine max
  Peptide Sequence Number=SeqID_218347
atgaatcctcctttgctcgtgccaccggtgcccggaagaccccttatcctatacatgattgtgttagatgagtcgatggagtgtgtgctgggacagcacgacgagtctgaaaaaagggaacagactgtctattacttgagcaagaagttcacggcatgcgagatgaactactttttgctagagaggacgtgttgtgctttggtatgtgctttggttgtgctttggttggtatccaaaatggatcccgtcaagtacatctttgaaaagcccgctctcactggatga

SEQ ID NO: 101570 - DNA, 1869 bp, Glycine max
  Peptide Sequence Number=SeqID_218348
atggtgatgcacgaggaaagtcaacggtgttattactggaacattgaaactggggaaacttcatgggaagtgccccaggtcttggctcatgcggatcagttggctaatgactcaatacctcatgcttttgtcaatgataaaacaaagagtgctgctgttggtgataattccaatgtgctctccgcggtgatgcaggacacttcttctgctttcataattgactgttcgctggaagccacagtggcttctcataaagaattgtatggtcacgggtcccaaattaatggtggtagtgttgaatgtacaaatcagaatcaaggttctgatgttaatggaaatgaattgacaagaaatgatggtcatatgagtttatctgataagggacaccattcatctgtttccaagtttggtgttgaagaacagcaattggacattgtttttccttctcgtcttgtcgaacaaagtgagagtttgttagagaggctgaaatcattgaaaaatgtgaaaagcttatatcttccagttccagatttaactaacagaatactacacaggtcaaaggacaatctgcaaggccaagacttcttgtcaaagtacatgctagagattgagattaggctctctgatattaggtctcttgcatcatatggatcatctttgcttccattctgggagcattctgacagaaagataaaattgcttgaaagtttgatcactgatgatttgatgcaaactggtaattcttcacatgatgaagttgaggatgttgaggataaacttgtccctgtctctgaagaattggctgaccaactgaatggcatgggacatgagtccgaggtagataataataagaacaaagggagccttcttacttgtgatgtttctaatgaatctcaggttgatgcttcggctgcagttctagaagatatcaacaataatatttctgccaatggtcagcatgttccattgtctagttctcctggtagtcatatggaaacagatgtagaaattaattcaaaggttgaagcaattataaatcctcaggaaccaattcataaacatgggtataatgttggggaagatgttgatatggatgtggacatggaagtcgaagatatgaattcctcaggcaatactactgtcatcgatgtacctgttgcaaacgattccgtgcacacagatcaactggttcagttgaatccacctgttgactaccattctgtgttgcctgaggagggtgaatttgttcctcctcctccagatgatgaatggattcctcctccaccccctgataatgagcatgtgcctccaccaccaccgccagacaatgatcaggtgccccctccacctggtgacccactagcaccttcttatagtgttctcccatgttacgcagagacagggcagcccctttcttatgctcaatatagtctatatcctggtgttgctgctgaatattatgggcagacagctgctgaagtcccaagcagtaatatatatggacaaattgctatgccacctgcacagatctactataatactgcagttcctaacatttatagtgaaaatcctcaatttatgatcaatccaactggcactgttgcttattatgaggttcaagatggagctggttcaaagtccatacctgctatcaatattaatgattctggtgttggtgaggctgactgggcatcttgtgattctccgtccacctcatctagcatccatgcacctgcaactgtttcagttgacgaaggtgtctcattgcctcctgctactgccaaatctgctgcagaaaacaacacatcatcattagttcctaaagcccaaacaaaaggtacagatactgaacaagtctactgttactga

SEQ ID NO: 101571 - DNA, 675 bp, Glycine max
  Peptide Sequence Number=SeqID_218349
atgtatttgttgaatgctgttcatgccccttgtgagctacttagctgcatgataaatagctatcctgtcatttatgattacttacctttcccctccttgttctcagttgcacgcaataggaaacgagcagttgcagttggatcctcattaaaatctaataagaagtggaaggcagctaaagaggagttgctcgaagaagaggaagaacctgatagtgtgtttgaggtcttagaaagaaagcgtcaaagggaaatagaggagtggcatgccaagcaaattgcaagtggagaggccaaagataatgctaattttcagcctctagttggtgattggcgagagaaggtcaaacgcaggagagcacaagcagcaaaagaatctgttagtacaccgcaagatgcaattgagcataaccagcagcaacacgatctgagtgaacactctaagggtctcccaactaattggcaggcttactgggatgatagcacaaagcaggtttattatggaactggtccggatggcgcttggaaccggacatcatacaaaattagtgaactgctcagaactggtgcttcaccgtttgtagcagttcctagaaaagactttctttgcaaattcccaaaactatgtcctcataattgtgcccttctatcatccaggaacaatttgttaagataa

SEQ ID NO: 101572 - DNA, 486 bp, Glycine max
  Peptide Sequence Number=SeqID_218350
atggaacatttacgcaagaaaattgcggccgacttagagtccttgaggcaaaagcacaaagtgaacatgcggcggttaaaggaggagaatgggaaccttaaagcaaggcttgtcgtccatcatccaccaccacccccaccaatctctccatcctttcaagcacccacccatgccgaaatgagaaatcaggaaaatcatactcatctctccttctatagtaatcgggaggaaatcccaatccactccaaacttaggtctctcaatatccacaatgatgtcttctccaccttcctcaagggaccagcactaacgtggtacaaattcttacccttgcgatctgttgattcattcacaaccttagcccaatgtttcgaagttcaatatgcaatcagtcgtcctcattcacaaccttacaccatatttgtagctttggtcaatctgcgtcaaactaatgacgaatcgtcgtggtcattcatggagagataa

SEQ ID NO: 101573 - DNA, 598 bp, Glycine max
  Peptide Sequence Number=SeqID_218351
catggctagtgcacaaaatagtcactctcctgcttcctcaccttctttcatgactagagtggccatgagaatatctagatcaagatggttcaccttcttgagaagagtattccattaccaaaatggaccgagatccgatctcggctccaaccctttcaattccagcacttggatgatgctggagttgattgctttgttggtccagataacaagcacaacattcactttggccatttcaaagagtgagaagccaatttggcctatgagggtgtggatagcaggttatgatattggttgtgtccttaatcttcttctactttgtggccgctaccatcaacttcatgtcactcaagggaataacgctcttaccctctctgaattggagcagcagagaaacaatgaagaatcaagggagagccctataattgtagtgggcctatgggagtgcacatggtgcacatggggaaacaagagaggaatgagagctggaaaaggggggcatctgaagatcaaatctcacaactcccaagttggagatataaaggggttcacaccaacttggaccttggcaatgactctcaaagcagtgaaagattga

SEQ ID NO: 101574 - DNA, 625 bp, Glycine max
  Peptide Sequence Number=SeqID_218352
agggctgcatgccctcgccttcagagggctgcacgccctcatcttcagaggactacacgtcctcgccttcagagggtcatgtacctttatcttcagaggactacacgtcctcgccttcagagggtcatgtaccttcacctttagaggactacacatcctcgcctccagaggactacctgtcctcaccttcagaggacttcacatcctcaccttcagagggctgcatgccctcacttttagagggctgcatgccctcactttcagagggctgcacgccctcgcctttgtagggctacacgccctcaccttcagaggactacacgtcctcgcctccagaggactacatgtcctcgcctttagagggccacacaccctcttcttcagaggactacacgtcctcaccttcagaggactccacgtcctcaccttcagagggctgcacaccctcgccttcagagggctacatgccctcgccttcagagggctgcacgccttcgccttcaaaaggcgacatgtcctcaacttcagagggctgcacgcccttgcctttagagggctatgcgtcctcactttcagtgggctccatatccacaccttaagagaatttaaggtcttctgcccttaa

SEQ ID NO: 101575 - DNA, 306 bp, Glycine max
  Peptide Sequence Number=SeqID_218353
atggtgaagaatgatgtaggaatcgatcgcggttgcgatttggaagcatctctgcctcaaaagaacacgaaaaatacccaaaagggagggcaaaagggtcatttgggagtttttttgatccttggctcgctcaggctagcctctggctcgcctggccctagaagacttaggggtgaagtaaccaactcacctacacgagtaaggaagaggttcaaccttcatatattgaaagcatttagcgaaattaaggagaagaaggagaaagaagaaaaacgaggacgaggtgctttcgaatcgcaaccgtga

SEQ ID NO: 101576 - DNA, 246 bp, Glycine max
  Peptide Sequence Number=SeqID_218354
atggcccacggaggaaggagtcagggacaagcgctcctagggatcacgcctcccagacatccagtggacccaaagaagtccaacagagcactggggtttccggccttgatcacgggcctctgccagttctatggggtatcgattactcccaccaagcttatctggcctcccattaatagggccttcatagaaaaatattgcatgccaaggcaagtagaacaacagcaagaggaggaccagcagtag

SEQ ID NO: 101577 - DNA, 285 bp, Glycine max
  Peptide Sequence Number=SeqID_218355
atggctcccaagaagcttctagctaagaggtcaaggaaagatgtcactggagaaggatctagtgcagccccacaagtggatatggagtttgatgggcatcagtttcgaagcgaggaacaccagcatcgttttcaggcaatcaagggttggtctttcctcaaggagagacgggtccaattgagggaaggagaatatactgacttccaggaggaaattgccaggaggcagtggactcaacttgcggcgcccattgtagaagcaagcttcatgatgaatcaagattga

SEQ ID NO: 101578 - DNA, 1986 bp, Glycine max
  Peptide Sequence Number=SeqID_218356
atggaacttgttccatactctgacccatcctccaccaccccagcatggcaggacatgttccgatccgcctctgcccgccacccctcctccacccctccaccccacgcgcctccctcccaatcccacgcgccctccccctcaccccacgcgccgccgaatccgccatccgacgccgacccagatggaaaaaacacattttccggcgatccccaggtgcgcttggccctctacatcgccatggcccatgcgggtctcgccttcgccattttcatcctctacactttctcgaagcttctagaacagtatttgagaccccttcaatgggcagtgttgtgttctattcctcttaggggcattcagcaaaccctcgttaagttttggtccgaaccccttcgtctgggtctcacagaaaccgttctcgctgttcccgttgctgttttcagggcttttgttggcacactcgttgagattcgtgaagcttcttttagagttattttgaggaaaccaaagcctcagcagaatcgcccttcgaggaagcgaagtgggttttccaagttgcttcgtttgcttgtaagttttggaattttcaccattgcttatgagaggcttggtggctttggggcattgtcacttttgggcttggggtttttgttcagttcaaataatgtggattccactatgcacactttgtcttcttataggagccttagtttcaggcgtagtgcaattagtgcctttttcaccagagggatattgaggaagttgaagattattgtggcaattgggctaattgtttgcatgattgtgggttttttgagtggggtgattttcttctcttataagattggtgttgaagggaaagatgcggtgatatcattgaaattgcatgtggaggagaacaattatgctgagaggattggtgtgaagaagtggatggacgagaatgatgttgctgggatggtggatagttacactacgaagatatatgagactgtgtctgatcagatagatgggttggctctgcagtataacatgactgaatttgtgactggcattaagcattttgtgatatccaatccggttaactattcggcaccttcgaaggttttgatgactccctcgccgtatgcagagaagttcttgagcttgaaaacccgggttaggaaccgtgaatggagccagatttatgcagaggttgactcgattttgcgcgagcttgtgatcactcgtgaggatttggttgagaaggcaaaagggtttgccttcaaaggaatggatgtgtctcagcggattttcactagtagtagaactgtgcttggaagcagtacaaagtttatgttctccattgcgaattccataatctctggagccgcagaggttttcaattttgtgtctcagtcgatggtgtttatttgggttttgtattacctcatcacatcagagagtggtggagtgacagaacaagtgatgtgcatgcttccaatttcgaactccactagggacagatgtgttgaggttttggataaagctatttcaggagtccttttggccactgctgagattgcattttttcaagggtgtcttacttggcttttgtttaggttgaacaaaatacatttcttgtacatgtcaactgtgcttgcattcataagtcctctcctgccaatatttccatcttggcttgcaacaatcccagcagccttgcaactagtgctggaaggcagatacataatggccattgtgttgtctattattcacctttttctcatggactatggtgcatcggagattctagaagacgtgccggggaatagtgcatatcttactgggttgagcatcattgggggaatgacattgtttccatctgctctggagggagcaattatggggccattaataactacagttatgattgcactgaaggatttgtatgctgaatttgttttgcaagaacctaaggacaagtccaagcagaaagccagctag

SEQ ID NO: 101579 - DNA, 951 bp, Glycine max
  Peptide Sequence Number=SeqID_218357
atgagttttgatgttgtgtctggagataataatagtactgctgaaactgtgattgacaatcctcaccatctttccttgaatgccttgaaagaaagtcttggtgttggcactattagatttgtagctcatatcaataccttacctgtgagggtacttgttgatggtggcatgattagagaacttagcattcaagctcaaggcaacaagtttcaattacctgtattcttgctgccaatttctggtgctgacttgatattaggagataactggttgaaaacacttggttctcacattgcggatcatgattccttgcaacttaagttcttacatgatgggaaatttataaccctacagggcgatgatgatgaatcggagttgccacttctctttcatacatatgaatctgtttttgagactcccacatccttaccacctccaaggtctcacgatcaggctacacccttgttggagggatcaaaaccagttaaagtcaagccttatcggtatttacatagtcaaaaagatgaaattgagaaattggtgcaaggaatgcttgaggaaggcatcatccagacgagtgcaagagtgactacggaaaccactaagctggaagccattactaattggtcacaaccaactattataaaacaattgagaggatttctaggactcactagttattatagaagatttgtaaaaaattatgcttctattgctcaaccactcactgatttattgaagaagaactcctttcagtggtctaattgtgcttctcaagcatttgtgcagctcaagaaagctatgacttcagctccagtgttagcaattcctaattttagagaaccatttatatttgagactgatgcttttggttcgggtattgaagcagtactgagtcaatctcagcatcctattgcttatttttctaagaagttgtcccctagaatgtag

SEQ ID NO: 101580 - DNA, 1257 bp, Glycine max
  Peptide Sequence Number=SeqID_218358
atggtggatgaggatcatgaaagaacactctcaactgatattctgtttggattagtgaagggattaaaatggttgcttactctgtttttgttacgggatattgctcatttccggcctgatctcaagctgctgatatcaagtgctacacttgatgtagagaaattcagtgattactttgattctgtgccaatattcagaattccagggagacgatatcctgttgaaataagctataccaaagctccagaagctgactacttagatgcagctattgtcacatccctttcaaatccatgggcacgaaaggttgtcctagctactaatattgcagaaacgtcattgacaattgatgggatcaagtatgttattgatccaggattctctggtcgttctggaagaacgggtcctggtaagtgcttccgactgtatactgcatacaattatcacaatgatttggatgataacactgtaccagaaatacagaggactaaccttgcaaatgtagttttgactttaaaaagtcttggtattcatgacttattgaactttgattttatggatcctccacctgctgaggccttattgaaagctttggagcttctatttgcattaagtgcgttaaataagcttggtgaattaactaaggtgggtagacagatggcagagttcccacttgatccaatgttgtcaaaaatgatagtggcttcagaaaattacaagtgttcagatgatatcatttctattgctgctatgctttcagttggaaactcaatattttaccgtccaaaagataaacaagtacatgcagacaatgcaaggctgaattttcacactggaaatgtgggagaccatatggcgctgctaaaggtaagtagtatgaaacgggctagggatattcatgatcaactggcagggtttttcccacactctgcacggctgcaaaagaatggatcatatcgaactgttaaacattcacagactgttcacatacatcctagttcggggctcgcacaggagtcaataccttctcaggtctttcaatggctccttgacctggaagaaggcgatgtacttggacagttgattggggcaagagatgaatctaaaggattggatgaaggaggagacacggggaatagaggaaacaatctggggtgggagttctgtgggcagagtagcattgttctcagccgaaggagagaaggaaaggctggtttcgaaggagagaagaaagggctggtttcaaaccttttgtag

SEQ ID NO: 101581 - DNA, 333 bp, Glycine max
  Peptide Sequence Number=SeqID_218359
atggagagtgacgacagtctaaagacatgggtatcagataagttgatgtctctactgggatattctcagcccacagttgtccagtacatgattagactatccaagcaagttatttctccagctcatttggtgggcaaactagtggagtttgggatctcgtcaatggacactcatgcatttgcggaagaaatttactcaagagttcctcgtagatcatctgataaatcttcagtaactactgcatcatctagaaggtctgacaaccataaaaaatgtttcaggaaaaaaactgaagttcaagatgatcaagatgatgaggcaatgtgctcataa

SEQ ID NO: 101582 - DNA, 453 bp, Glycine max
  Peptide Sequence Number=SeqID_218360
atggctggctttaagaggactgttgcttgcttcttcctgacactattcagtattctgttaattgccataacaagtcaaggggcaggagaactatttggagctgcaattatgagtgttcaaagagcagggacagctgcttctttaatactaatgttattccttctcacaggtggctactatgtccagcacataccaaagttcatgaagtggttgaagtatttgtccttcatgtactatggcttcaggcttcttctaaaagtgcagtattcaggtgaccaattatatgattgtgaaagcaagggagggtgcaggaccctgcagagttcacctacatttggcattgtaaacttgaaaggtggattaaaagaagtgtggattctgctagctatggccttagtctttcgattgttagcttacttgtgccttcgtagaagaattgatcattccaactaa

SEQ ID NO: 101583 - DNA, 432 bp, Glycine max
  Peptide Sequence Number=SeqID_218361
atgtcattgcagaaaggtttcaaggcaagaatacttgaagaaaagggaggaaaagaaattagaagaactaagcattgtcactgcatagatgatatagaagatgagcaatatctatttgaaggtgtgaagctttcagaagcagaatatcgcgaactgaggtacaagaaagagatatatgaacttgtgaaaaagcggtcagaggaggctgacaatgcgaatgggtatagaatgccagaagcttatgatcacgaaggtggtgttaatcaggagaagagattttctgtggctatgcagcattacagggatctaaatgctgaggataagatgaatccatttgttgaacaagaggcttgggaagaacatcaaattggaaaggcaacactgaagtttggttcaaaaaataaaaaacaagtctctgatgattatcagtga

SEQ ID NO: 101584 - DNA, 933 bp, Glycine max
  Peptide Sequence Number=SeqID_218362
atgatgacattaaaagatgatgacaaaggtgatgaacaaaaagctcaaagatcaaagaacaactcaagtgaatcaagaacaagtcaagagttcaagaatcaagaagaaagtctacaatcaagaatcaagattcaagattcaagatctcaagaatcaagatcaagattcaagactcaagattcaagaatgaagaaaagactcaatcaagataatgacactggcagcacaacgacgggaaagcagaaggacaaattggagggatgcatcgaacgtttgctccttctatttcacaagatttctagaggagatggtggtcagaagtatggctttgctagattcaatggagtggttgacgtggggatgcttgaatatcaactggacaacatgatcattggggggcaaaaaggaaacagaacacacgttcaggaacaaaggactactaaacacccacaacgaatgcaaccaccagtctcatacgcgatagtggtggcgaaaggaaacaacaacatggagaagagatggtttccaaggcacacaattctaacgagatcaatctctcatttgacattgcagctgaatatacccatagaggaaactaaatggtacagtaatgcatgggttggaagattaagtaacctggtgctattcgataaaatggaagaggaaatcatgtgggttggaggagaaggcatcatgccaaaatacctaggtgatgatatggtattactgatggtactcactaatacaagagctgaagaaatgtgcagagagggagctgtgaatggaatgaccttattctactgcctggagaaatggaactcgagcatgcggaccgaatataggctggtggatgatgagattgacaaactttggcggctagatagggctcgggtgttgattaaaacaccacgaaatagaatggacttggcttag

SEQ ID NO: 101585 - DNA, 426 bp, Glycine max
  Peptide Sequence Number=SeqID_218363
atgactctcaaccctggtcatgaaagagtcttcatgtctcattttggtgctaactcctttggggttaaaattgagggacagaatcttcatgagtcttcttacttgggacctcagacacagaacatggaagaaactcaaagggagaagcttccaaatccatttcaagttgtgctagcatcaccattggcattttctgttggtgctttggtgccaccgatagttgctgtttttataaggaatcaagatattagaatgggagttgttgctactgtgattagcttggcattgttggtgtttggaggagtaggagtagttgttggaaaaactccagtgacgaggtcttgtcttagggttctggttggaggttggatggctatggccataacatttggcctcaccaaattgactggctctgctgatctttga

SEQ ID NO: 101586 - DNA, 555 bp, Glycine max
  Peptide Sequence Number=SeqID_218364
atggcatttgaagagaaagaactattggtagggttggttagctcatttaggtatgggggcagtgaaattaatgcaaaattggcacaatctgaagctgatgctcttcatgaggctataaaaaacaagaataaaagtaatgacgaaattattaggatccttactactaggagcaagacccaacttgtggctactttcaatcgctacagggatgatcatggcattgccatcactaagaaattgtccgatgaaggatctgatgaatttcataaggcagcaaatttagccattagttgcatcaatgatcataagaagtactacgaaaagaatttttaccctgagcccattgtgcaggttcttcgcaatgccatggaacatcttggaactgctgaggatgccctcacacgtgtgattgtcaccagggctgagaaggacctgaaggagatcaaagaggtgtattacaagagaaacagtgttcaccttgagcatgcagtggccaaggaaacttctggagactacaagaagttcctcctctctttgatggggaaagaagagtaa

SEQ ID NO: 101587 - DNA, 480 bp, Glycine max
  Peptide Sequence Number=SeqID_218365
atgactcctcatcaaaaagcgatttggttttggctgttggtgaacaactacaacaacattttgaactgttttgcacaaatcaaaatgcatgatggtggtgttagaaccttaattgaagtttgtcatgttcctgagcttaagaaaatcttgtatttgtgggtgccatggattcaaatggtttctcttgctgggttgaagatggggttattcatattagaggaaaatgaaagtttgtgctcctttattaggagtggtaagacttcaagatgggtggagcccagagccaagaagggattctttatgggctatggagatggagtaaaagaatttcaagtctggtctccatctgaaagaaaggtctttctaagtagatatgtcatctttgacgaactctctatgctagactcaaaaactgatgaagatttaggcaaggctgaggatgtcaccaagcaggtggagtttgagagctccaaagtctga

SEQ ID NO: 101588 - DNA, 141 bp, Glycine max
  Peptide Sequence Number=SeqID_218366
atgaacctcggtgatgaagtagcaaagaggggcataaatcctcatggcaaagttgcaacagctgctaaacaaaaaataagtttgagaaggaaagtaaaacttgggggctgtgatgtcctccacaagaaaaggacagcataa

SEQ ID NO: 101589 - DNA, 195 bp, Glycine max
  Peptide Sequence Number=SeqID_218367
atgtccgaatcaaataacaaaggggagatggaagttttaataacaataacaccaacttcttccctgaaggttgccttgctagactatggacagctgaaggatctcccagatcagttgagagttgcctatgttaatctagttcttgtgattgctaatggtgacccattaagagctgcagagagctatgggtactga

SEQ ID NO: 101590 - DNA, 201 bp, Glycine max
  Peptide Sequence Number=SeqID_218368
atgcctaaatcatctcccaacatgcatgtgaagcaagaagtatcaacaagagtcaagccaaggctattgtgtaagcaatcaattgggcaaaacacaccgaataaaatagatgatgatggctcaaattctcaccaaaggcggtgtccattgaccttgaagctcttatatgtggattcacttttgatctcaattgtaccataa

SEQ ID NO: 101591 - DNA, 189 bp, Glycine max
  Peptide Sequence Number=SeqID_218369
atggatcctaccactaggaaagttgatggtccccacaaaaagaaattaaggacccatttgggagtcatcgctcgagacaaggctgaatttgatattctggaagcgtccgataaaaggatgaagaagaaaatcctccagattgtaggagaacgattaaggcaatttaagtcagatttgacctccaaatga

SEQ ID NO: 101592 - DNA, 1014 bp, Glycine max
  Peptide Sequence Number=SeqID_218370
atggagccccagacacttgaaatagaggttaccaaggatgatgtctccatcaatcgggccaacaaagatgagtccagctctaggatggaaggttttatcaaggatgaatttgattgtgtattaaatgagaaggaaccacctgaagggcaggttgatgctggaggaggttcatttggaaatgaagagaacccttttcatattggggatggacctttgacagtcttgaaacaaaaagagaaaaaacttgttgatgaagtatctgtaaggacttcagaactagcgcatcttgaacaagagttggagttgatgaatgaaacagctgaaatggcatttaataaccaacattcgattgacttctacattgaccagttgaatgaacaagtacaagctaaaaggaattacctattgactttggaatcagagtgggacactgtaagaaaacccttggaggagagaaagagaagtctcgaggagtctctttattcaaacaatccagatgcactagaaatgcttcaaaagttgagagaagcgcagcaggaagagcagttcattttatctgaaattatgaagagggaggaggaacatttgaaactttctgcagatattgaaaagaagcagaaagtagcatccaggaaatcctatactgaccggataaaggagattacaaaaaatagtcgcaaacaagacgctgacattgagcggatcttaaaagatacaagggtggttcaactggagagtaattctatccaggaaagcttgcatcgaacatatgctgtcgcagatgaaattgtctttagggaagcaaagaaagacccaacagggctgcatgtttataggctcctggttagcatccacaaaggttttgaacaaatatctgagaaaattctggcaactgatagaattagaagagaagtagctgaatatgaaacaaaactggcagccacggcttccagaagcttagatgtgagcgaactaaaagctaatcttgatgccattattagagaaaaagaatag

SEQ ID NO: 101593 - DNA, 1029 bp, Glycine max
  Peptide Sequence Number=SeqID_218371
atggaaattgggaaagaggatgagattatggacatgtcaatgtcacccccattagttggttccactaacaatgacacttgtcacaacaaagacatcatgtctcaggcatatcttcaaaataagtactcagagattgacataaaaattgaaggttccaatatggaacaaaatcgccccctccccatatttctcaagtttgaaaatgtggagtataaggtgagaaatagaaaagcaggctctagtaaccttgtgaaaacaatggtgtcaaaggtatccacacaactcactgtggaagaagatagatataagaaaattttgaagggcatcacaggaagcataggccccggtgaaattcttgctctgatgggtccttctggcagtgggaagacaaccttgttgagagtcataggaggaagaatagttgacaatgtaaagggaaaagtaacatacaatgatgttcgttttactacagctgtcaagaggaggattggatttgtgacacaagaggatgtgctttacccacaattaactgttgaagaaactttagtcttctctgcactcttgaggctgccaaccaatatgagcaagcagcaaaaatatgcaaaagtgaatacaactatcaaggagctaggccttgaaagatgccgccacacaaaaatagttggaggatatctcaaaggcatatcaggaggagaaaggaagagaacctgcataggctatgaaattcttgttgatccttcactgttgctacttgatgaaccaacttctggccttgattccaccgcagcaaacaaactccttctcacacttcaaggacttgctaaggctggaaggactataattacaacaatacatcagccatccagcagaatctttcacatgttcgacaaacttcttctaatatcagaaggctatcctgtttactatggaaaggctaaggacacaatggagtacttttcatccttgagattcaccccacaaattccaatgaatcctgcagagttcttgcttgacttggcaactggacaa

SEQ ID NO: 101594 - DNA, 636 bp, Glycine max
  Peptide Sequence Number=SeqID_218372
atgaaatggacaaaatcagcaacaactcttgtagcaaaaaggacagaagatgattttctaggggttcagtctatacgttcacagtatcctattataactagtggtggcctccattcacaaaaggatgaagctacacttcatgaggaaactatagatgtgcatgataaggaggacaaagatattgagagatataaaagggatctggaggaatctctgaataaattggagcatgtgaaggaggaaagaaagagactaaaagaattgaggacttgcaacttgcaagggcatcataatcaggaggagcagaaatcagcttgtgttaaagagaagttaaattatgcactcaggaaaggggtgtcattggtgcaacaagacagtctacaacaaatcattgaagagatgattgttgagatggagcacttgaaatctgagatcaacaatgaggaaaccactcttgcagagcatgaacagaagttgagacagttttcaacccacccagataggttagaagctcttcaatctgagattttgaataagttaagtgaaattgaggttggaggtgaaggtcatctaagtgatgcagtgaagttggattgttggaatgggttgggagattatgctctgatctacaaatga

SEQ ID NO: 101595 - DNA, 507 bp, Glycine max
  Peptide Sequence Number=SeqID_218373
atggatgaggggagatcatgtgatagaattcagattgttgtgggagaatccaagcctctcaaaagtctagggaatgatttgtacacctttatgttaatacaagcttttcactctaaaattttgatccagtttgtatcaactggtgtgggaactctgatcttaaagctatctatactttcattcaagtttgacggccacttcacaattacaagacaaaagtatgaatctggacctttgatcaactacagagatggagggaatagatcattaagagccaaggatgactctacaactaatgaacctggggatggtaattgtgatgaaggtgatgctcaggatgatgaaactgtaaccccagatgaaataggtgatggagagaatgctgatgagctaactttggacaaagacgcagcatattcacatcgcattgcgttcaagcctgatgtgctggatcaaacttcttacacgaatatggatttggacgtaaataaagatgcatcatcttga

SEQ ID NO: 101596 - DNA, 99 bp, Glycine max
  Peptide Sequence Number=SeqID_218374
atggctgacgtattgggttctctattctttgatatcacactctttgagctcacatttgccaaagttcaagaagtatctcttgatagtttgctccaatga

SEQ ID NO: 101597 - DNA, 522 bp, Glycine max
  Peptide Sequence Number=SeqID_218375
atggccatttccacggttaaagacttggcttcgaatgacttcaacacggagaacaaagagttagataagctcttgggagttcctattgttcttgttgttgccgctgctcctgcccctactattaaggttcctacatgtgggtggtttcaagttccttcccttcggagaattgtcattcctgctcgcactgcttgggttccttcccctcaaggagttgcaaagtcactggatgagatattcaatgggatttcatttgatgaggtgaaggtgccgagaatctacccacaccacttgctgccatataatttggagtccaatcacctcaatttatcccatgactccaatgacttatcccggttatttctcattgggcttgagatatgtggtgagagaaattggaaagacatttcacaacaatttgttctatcaaaaactccatctcaagttgcaagctatgctcaaaaatacttccaaaacaagaatgtcccaatgaaagtgagaaaaagaaaaaagcatccatga

SEQ ID NO: 101598 - DNA, 951 bp, Glycine max
  Peptide Sequence Number=SeqID_218376
atgaagcctatccctacggatttgtacaaagccatacgggattctcaacttataggaatgtctggttactcaaaggaggatctacctgtcattgctgttggtgttgggctcagtacatatgataaagcatctccaacagctacaaggaaacatggacgatacattggcacctgtgttaaagtgttggatatgtctggtttaaaattttctgcattgaatcaattgaggttgttgactgctatatctacaatagatgacttgaactatccggaaaagacagacacatactatattgttaatgcaccatatgtattctcagcgtgttggaaggttgtgaagcctcttttgcaagaaagaaccaggagaaaaatccaggtgctgcaaggttgtgggaaggaggaattactaagggtcatggactatgcatcccttccacacttctgcagaaaagaagattccaagtcatccaaacatcatgcttcaggaaactctgaaaattgtttctccttcaatcatgccttccatcaacaactctacaatcacatcaagcaacaagccatcattatggagtcaatttcaccaatcagacaagggtccttctgtgtagacataccagagccagaccctgatgatgccaaaatagccaagaccatagaaaatgagttccacaaattggagaatcagaagaatggttttaccaactcactaactggtcttttacagttaatggccattgaaagctatgctactaaagctagtaactgtttttggcctctcctgagccacttttatttgttgattactttatggtcccttttggaaaaggagggttatacttgtaggtcatacttatacccggttattagatctaatattgtaatgtttgcatcaactagatgcaaaattcttcaggcagaccttaatctaatttctacaaccaccttgagatga

SEQ ID NO: 101599 - DNA, 255 bp, Glycine max
  Peptide Sequence Number=SeqID_218377
atggggggtggaaatcaagaggcagtcaagcagctgcagaccctgatggaaaatgtggatgatgagcagctgaagaatacattccagattatgcaccagggttatcaaacggaaacgttaatacggtttctcaaagctagggactggagtgttgccaaagcccataaaatgtttaaagtgttacagttaattgattgtttgaactggagggtggaaaatgagattgacaatgttttaagggatcttgctaactag

SEQ ID NO: 101600 - DNA, 726 bp, Glycine max
  Peptide Sequence Number=SeqID_218378
atggcattcttaggagaaacttcctctcagacgatcgttaactcaaggttggccttcacttttccaaatggatccatcattcacaacaagtgtggggtttattttcaaagttcaacttcagtgcccatgcgagtaccaaacatgtgcgattttgcaactcttaaaagcagaatacacaacacccttcaggtaaatgacaatcaagttgtggatgaaattcattaccggcgaccactcgaagatacaagtaacaaaattcacttccaatgtatgcaattgaaagatgacatggatgtgaacacaatgttaatgtgtaatgatcgattttcatgtgttggaccgattgagttgttatgcaccgctagtagaacaccaaatggaattttaaacttacttgaatgcactatgacccctactcatgatgcggttctgtattataacggaaggcggaacatgccacgccaaaacaactttataggttacgcgttcacgagaaaaaatccccaaaaatttgatattccaaaaggatgtagcctagataaactgaaggatttgatcaagcaagtagcacctaaagggaatcctcctcataggattcatgaatcccaagttgtgttggtagagtccaattactggaaacaatttgtgccaatagaaattttggctctctttagtaaactggtaatggaaaatgaggacgaggtggttacgtcattgcaggattga

SEQ ID NO: 101601 - DNA, 108 bp, Glycine max
  Peptide Sequence Number=SeqID_218379
atgcgtctccccaagaaatgtgttccccataaaggcgcaattggtagcgctactgcagcaggcgcgttgggtcgtgctagggacccaggcgcgttcagctggcctgtg

SEQ ID NO: 101602 - DNA, 375 bp, Glycine max
  Peptide Sequence Number=SeqID_218380
atgtcgtcgtcttcgtcggaagatgaatctatgtcggaacagagcaatgaattaggacttgatttcatcttgagcttggacaatgttccatcaaagctccctccacacctcgaactcttcaaaacacgcgttctttgcaacaatgatgctcctgtgcatacggatactgtacaatattctggtgcttatgctattttaggagttgataatagtgtgcgtttggatagcttctgtgaaaacttcaaggttgaagtgaagcgacttacggatagcgatatagaatttgatatgattggaatcgatccggcaattgccaatgcatttcgaagaatccttatagcagaggtgatgtatctttgcttcccctcactgtaa

SEQ ID NO: 101603 - DNA, 981 bp, Glycine max
  Peptide Sequence Number=SeqID_218381
atggaatggaatgacttttattatactttaaactatctaaagattctaaacaatggaatccagtatcatttggttgcattccttctcatcaatccaaatgtagcctatggtatgaggagattaacccattttgatgttgagacatttgttgaagaagttctagtcaaagaaggaaactggcttcctggaaaccctgaatcattaaaagcgtcatatgttttcgtatgctcacatggatcccgtgatcgtaggtgtggggtttttggacctatcttggtcagtagattcagggaagagatagagttacatgatcttctaggcaaagtgttgattagctcgtgctcacacattgggggaaataattatgcaggaaatgtcattatatttggatcaagtatcaacagagaagtcactgggcacttgtatggatatgttactccagatgatgtacctttattgtttcgccagcatatcattcaaggggagatttttgactcactatggagggtgagccctagtacagcagtaaagttgtgccttgttgactgtttggtcattggttcaaatccggaaacaacttccttgtatatgcaagggggtcaaattggtttatcagaagatgaacagaagaaaaagcaagaacaaaggcttcagctgaatggtggaagaaatttaggaggcatgggtgctggctgctgtcaaacagacggagagagctgttgccaagacaacgaagactcttgttgttgtcagaatgatgtattagaggaaatgacagagctctcagctgataataagaggagggagaatgtgaatgtgatttctcggatcaacaagggtaaaggagcgtcacttaagtttagttccatgccaacatggcttgacagctgggagcaggaggatacttatgctgcttttgctgttgtttgtgccgctgtgtcagttgccattgcctatagctgctacaaacagatgagatga

SEQ ID NO: 101604 - DNA, 1992 bp, Glycine max
  Peptide Sequence Number=SeqID_218382
atggtagcaaaaatccggcaaagtgctactgagtctcctaatccaaaacctgaggttggagagattgacaccagcccaccttttcagtctgttaaagatgctgtctctctatttggtgaaggtgctttctctggtgaaaaacctatctttaagaaggcaaaaccttattctgctgaggtacaggtttcaatgtacttaagagttaagagagttttggccaaggagacacaacttcatgttgcccaaaaagagctgaacaagttaagggaacaagtaaagaatgctgaaactactaaggctcaagctcttgtggagcttgaaagggctaaaaggacagttgaggatctgacacaaaagataaaagttatcagtgattctagggagttggcaattgaggcaacagaagctgccaagagtcaggcaaaacagcttacggaagaaaagtatggtgtccctgatggaacaaatgttgcttggaaggaagagttagaagctgctgttaaaaggtatgcatctgtcatgacagaacttgatgctgcaaagcaagcactgagcaagactcggcaagagtatgattcatccttggacgcaaaaaagtctgctttcaagctagcagcagaagctggagatgcatcaaaggaaaacacagaaagagcatctgagctttctaaagaaatttcagctgtaaaggagtcaattgagcaagcaaagcttgcttctattgtagcacagcaacagcaaacaatgattttagctgagaaagatgttctaagacaatcatataaagctaccttggaacaatctgaaaagaaattgcttgctttaaagaaggaattcagtcccgagcttgccaaaaatcttgaaatgcagctggcagagacaatgtctgaaattgggacgctgcaaaaggaaatggaaaataaaagaacatcggacttggactccgtgaaaagtgtcactttggagctagatgatgctaaggagtctttgcagaaagtagcagatgaggaaagctctcttagaagcttggtggaatctcttaaggtagaactggagaatgtaaaaagagaacattctgaattgcaggacaaagaatctgagactgaatccattgtggggaatctgcatgtcaagctccgcaaatgcaagtctgagcttgaagcctgcatggcagaagaatctaaagttagaggtgcatctgaggaaatgatcttgacacttagccagctgacatctgaaactgaaaatgcaaggcgggaagcagaagatatgaagaacaggacagcagaattaaagaaggaagttgaagttaccatgcttgcattagaagaagcagaaaaaaatcttaaagtggcgctggaagaagcagaagcagcaaaagcagctgagaaaagtgctcttgaccagattacgattttaactgaaaggactactgctgcacgtgcatcaacatctgaatctggtgctgtgattacgatctcaaaggaggagtttgactcgctaagccataaagttgaggagtctgataaattagcagatatgaaagtggctgctgccaaggcacaggttgaagctgtgaaggctagtgaaaatgaggctctcaaaaggttggagacaactcaaaaggagattgaggatataaagactgcaacccaggaggctttgaaaaaagctgaaatggctgaagcagcgaaaagggcagtggagagtgagcttcgaagatggcgcgagagggagcagaagagggccgcagaagctgcatctcgaattctggctgaaacacaggtgtcaacagaatcgtctcctcagcactataggattcaaaagcagaatcctcctcgaacaatggtggaggtgaaaaagtttgaaaaggagaaggtttcagtttcaaagaaaaccctcttgccaaatattagtggcatcttccaaaggaaaaagaaccaggttgagggtggttctccttcttatctgcctggtgagaaccctgtatga

SEQ ID NO: 101605 - DNA, 300 bp, Glycine max
  Peptide Sequence Number=SeqID_218383
atggtgcgagggttagccacgtcatcggtgacaccgtccaagaaaacaccctcgggtgacgatgagtcgatgaccccatgtaagaaaacgaaagagatgcttgggttggaactggctcagagcgacctggtccaacttacaagttggaaaatcctaggccctagtggtgctaggccaccacaaggtcaggacgatggtggcggcaacacgacagcgcgacgcgaccttgtcaaagttgtccagaaggaagaaaaaaatatagtgagaagaaggaagatgacgatgagaacatttgaataa

SEQ ID NO: 101606 - DNA, 354 bp, Glycine max
  Peptide Sequence Number=SeqID_218384
atgtgcatgatcagattgaggttgttggctctcaatgagtatgggagcggagttattgacatcctcactaggagtgtatgccacattgggtggtgtatagttgggaggcaagccatatggcgggaaggttggatgattcatttggttgaggtcagatgggggctcgggttcactttagcaacagcactggtagcggcaactgcaaccgcattggcttccaataccttcttcatgctcatcatggcctccatcattgtggccatttgctctttcatggcctccatgtcggccttcatctgcttttgcacctccactacttcacccattactctagctctagcacgggttcggtaa

SEQ ID NO: 101607 - DNA, 561 bp, Glycine max
  Peptide Sequence Number=SeqID_218385
atggatttgaaggaaggttgtacttatgtgatgcacaattttagagtcagcaagaatgatggaaagtacagagtttgtgatcatccatataaattgacatttattggagttacgattgtcagacagtgtcaattggatgggcttccttttaaaaattatatatttgcagattttttggatgtcattgttggccaattacagtctaacctattagtaggatcctatccatgctcagttagcaattctttgaaggcttctaaattgactattaatgagccagtggcaccaattgaagaattcaataagaagctttcagaattgggcattgagatctgctcagttttgacacgtcgttcccagtggagttcacaaccttcaggttctgctcagttatcatcaagggaaacattcatttccaagtcagaggcaaagaccatttctgagataaacaacttttgtgaagagtttgtttgtgttactattggtacaatcacgagaattgttatgaacaatcattcatggttgttatgcaacttgcattcaattgccataagaaaatag

SEQ ID NO: 101608 - DNA, 849 bp, Glycine max
  Peptide Sequence Number=SeqID_218386
atggtgaaattcccggggtttagaaggcaaggttcaaggcaaggctggtggctaaaggatttactcagaatcttgatgtcaattgtcaaccagttcaatttacacctggaacaattggatgtcaagacaaccctcttgcatggagacttggaggaaaccatttacatgaggcaaccagaaggctttgccttggatgataggaaggtagtggagaggtctatgatgcatcagtccaaccttgtgggcacacctttggggcaacacatgaagctctcgaagagccaaggtccaatatcaaatgatgataagaagaagatggatgcagttccctatactagtggggttggaagcatcatgtatggaatgaggaaccctcaaggtagagcagtgatcgaagggtttgtggatacatattttgcagggtgcttgaacacaaggaaatcattgtcaggatatgtgtttaccttgtttggaactgcagtcagctggaaatcaaacctccaattagttgtagctctatctaccactgaagttgagtataatgccctggctgaaggagtaaaggagggtctatggctgaaagggatgctgcatgaattgggaattgaacaagagactgttcagatacattgtgatagccaaagtgctattcatctggctaatcatcaaatgtaccatgcaaggaccaagcatattgatgtaaagtgtcacttcattcgtgaagtggtggaatcaggagcaatcaaactagtgaagattgcatttgaagacaatccagttgatatgttgactaaatctctcccaagggataaatttgagaagtgcttaagcttggtaggatttgtctga

SEQ ID NO: 101609 - DNA, 735 bp, Glycine max
  Peptide Sequence Number=SeqID_218387
atgcctctaaccttaatgcaggcagagaagaagagcatgattgataaggccaaaagtgcaatcatattgtgccttggtgataaggcactgagggaggttgcaaaggagaaaattgcggctggaatatgggcaaagctggaatcgctgtacatgaataggtctttggcccatagattgtgcctcaaacaactttattcattcaagatggcggaatcaaggacgattgaggaacaacttgcaaaaatcaacaagaacattgatgatcttgagaatatcggggtgaaactagaagatgaagataaagttgtctttattctaaatgctttacctaaaaccttcgaacactttagatatgctcttttgtatggaaaggatcagttaattaccttggaggaggtggtcacctcaattcgaaccaaagaattccaaaaactccaagattcgaagatcacagaggaggtgtcatctggtctagcagttataaagggaaaaagaaagaagggagaaggatatgaatctgttggggtcttggtggcttcatctgacaattcacagaagagttgggttatggactcaggatgcacataccatatgtgtcttataaaggattactttgaggatcttgaacagaaggagtatggaacagtactccttgggaatgacaaggcttgcaaggtgcatggcattggaattgtcagactgagaatgtttgacaacaagtactgcaagatgtga

SEQ ID NO: 101610 - DNA, 384 bp, Glycine max
  Peptide Sequence Number=SeqID_218388
atgggtgataaactccataaactggagttgtgtgaccagtgtgtcttggggaaatctcacagggtgaaatttgggacagatctatgggcagcatcgaggatccaaacacatgggggtggatcctatttcttgagcattatcgatgactattcaagaagagtatgggtctacatcctaaggaacaaaactgaaacatttcaaaagttcaaggaatggcatactcaaattgaaaatcatcaaggaaccaagttgaaggtcttaaggacagacaatgggcttgaatttgtttcagatcaatacaatactttctgcacacatcatggatcaagaggcacaaaacagttgttggtactcctcaacaaaatgaccttgcagaaaggatga

SEQ ID NO: 101611 - DNA, 306 bp, Glycine max
  Peptide Sequence Number=SeqID_218389
atgtcaggcttaagtttaggtgttgaatacatttgccaggtagattttgagcttgtagcaagctccaggtcaattctgggcttgaatgttggtgttgggctgttttcgagattgaatgatggtgttgagttagctccagccttgcttgctagggcttggtttttggtgtcgggtcgattttgggctttgttattggtttcaggatttgaagatggaatgttgatgttagactgcttggtcattgaaactgaaatgaccgtgagatgcaagtactggcttgaagagaaagggcaatgggctaggtaa

SEQ ID NO: 101612 - DNA, 225 bp, Glycine max
  Peptide Sequence Number=SeqID_218390
atgaactggagcatgatgagagctctagaggaagagatgcatgttttcccttataatgaagttattgatcctatcattcatgttgaaatccctcaacaacaagttgttgatgatgagcaaaacgaagttgaagacttggttccacacaaaaggtcagaaaggcctcataagcctactaaacctactaaatttaaagactattatgtttatctacaagagcattag

SEQ ID NO: 101613 - DNA, 171 bp, Glycine max
  Peptide Sequence Number=SeqID_218391
ggtggtgctgacaaggactacaaggaggtacccccacctcctttgtttaaacctgcagggggacacatcaaccaagctgtgaccttcaacagatcttattacaaggttcaaattataggacaattgtgcacgtactataacctgaacagccatccacaaggcttgggttaa

SEQ ID NO: 101614 - DNA, 228 bp, Glycine max
  Peptide Sequence Number=SeqID_218392
atggccagcgctcagctctcagcaatatcttcgtcgatctctacggcgtcgtttgaagggcttcgaccttcggctgttcagtttgcttccgcgggcagaattagaattggcaatctctcccaaaggtctttccggggcttggttgtcaaagccgccaccgttgttgcccccaaagtgcttcttcatcttgataagtttatccaaacatgccgtaaggttcttaattaa

SEQ ID NO: 101615 - DNA, 1196 bp, Glycine max
  Peptide Sequence Number=SeqID_218393
aaattgcatcacaacattcagccccacttcagccaaatgatatacaagtattagcagcaagggtaagcacgaagggaagctgtgcaacagcagagacaaatgcattagctaaaaaaccctctgagttgaatggtgacaatgtcgggctgcatgtaaccgttgagaactccaacaaattagtggcagtgggcaaacggtgcgacagttttggcaccatccacaacgtgccctatgctgatgatgttgttcgcgtgagtgtggtggaagttattttcggtgatgcggaggttccaatccctacatcagaaataaagtttgtcaaagaagctttaggtagttttgttccatggccaacacatttggtcaaacccatcttgcctgaggaagcagagaaggatgtgagctcaccattgaagactgttgaggaggaaaaggcagctgaggttattgatccattgggagagttggtgaagaacttgttcgacatttaccaaaggcctgttgaggtgtcatgggatggtgctaaatttgggatcaataatgtcaaagatggcttcttcatcacacacgctgatgtgagcaagataatattaggagacaagtgtttaaacatctccattctacagctatggcttatgtttattcatgattggagtgcgagcattggttatggatcattgtatgggttccttgaacctcagtgtatccacaatgcaagcagtagacgtcaagagtgtgaaaattacattggaaggtggttgaaggaagcaggaaaacaaatttacatagcaccttatttaaaccaggcccattggcagctcgttgtattgtgcccaggcgacaatgtagtggtttggttttgttctttgaagaagaagccggatgctgccatcaagggtgcagtaaacagtgcaatgaaatcagtcaccaaaactgcagagggaaagccacctcagcatgggcctcagtggattgaagcaaagagtcatgttcaaacaggaaattacgagtgtggatactatgttatgcaatggatatggtgcatcgtaagtggtggattgaaggatgactggattcactggttttctgatcgatcaccgctaacagaagagaccatgaccacactccggcataaatgggcggcctattttatccaaatgaagaaatgcgaaccaagaaaaaatttgataacttag

SEQ ID NO: 101616 - DNA, 318 bp, Glycine max
  Peptide Sequence Number=SeqID_218394
atgcgacttgagtttgcatcaattttcgtagattgtatgtatgcaaatgcttttgatgattccaaacatttgaaacaagtattcccaattttaaatttccaggaaactataaacttctcccctaccaaacctctaaatgaaaattggaactttcaggaaattaaggccatgttaattcaaaaggaaggaagattaaagaaaatgaaggataactcaattcatctcacaacttatgatggaaccagtaccattaagagcaagtcaggtgaaaagggcaaaggcaatgcccaattaaaggttaaagagggaggagtctaa

SEQ ID NO: 101617 - DNA, 246 bp, Glycine max
  Peptide Sequence Number=SeqID_218395
atgaagagggagaaacttttggtggagctagaaaaggagcttcaagtatatagaatgaaggttcatgaatatgaggtggaggatgttgatgaagagaaggagaaggaagaaaaaaagaaaaagaagattaaggaagtgtcacatgaatgctccttggtgaacaagcacaagcccatttggatgagaaagcctgaggagatgacaaaggaggagtattctgccataatgaaagagtctcaccaatga

SEQ ID NO: 101618 - DNA, 3027 bp, Glycine max
  Peptide Sequence Number=SeqID_218396
atgtctgtgcctgctacaggggaaaggaagaccatcaattcagagttatggcatgcttgtgctggaccactggtttctttacctcctgttggaagtgttgtggtttacttccctcaaggacacagcgagcaagttgctgcatccatgcaaaaggaggctgacttcatacctagttatcctaaccttccatccaaattgatttgcatgcttcacaatgttgccttgcacgctgatcctgaaactgatgaggtctatgcacagatgacacttcaacctgtaaataaatatgacaaggaagcactattggcatcagacatgggtctcaaacaaaaccaacaacctaccgagttcttttgcaaaacacttacagctagtgacacaagcactcatggtggattttctgttcctcgtagagcagcggagaaaatattcccacctctggatttttcaatgcaacctccagctcaggagattgttgccaaagatttgcatgacaatacatggacatttagacatatttatcgaggacaaccgaagaggcatctattgactaccggttggagtgtctttgttagcacaaaaaggctctttgctggagattcagttctttttatcagagatgaaaaacaacaacttcttttaggtataaagagggctaatagacagcagccagcactatcttcatcagtaatatccagtgacagcatgcacattggcattcttgctgctgcagctcatgcagcttcaaataacagcccgtttactatattttataatccaagggccagcccttctgaatttgtaattccattggccaagtataataaggccctgttcaatcaagtttcccttggaatgagattcagaatgatgtttgagactgaggaatcaggggtacgcagatatatgggtacaatcactggtatcactgacttggatcctgtccgatggaagaattcacagtggcgcaatcttcaggttggatgggatgaatcgactgccggtgagcgcccgagcagggtttctatttgggatattgagccagtggtgactcctttctatatttgtcctcctccattttttaggcctaagttccccaagcagccaggaatgccagatgatgagtctgatatagaaaatgctttcaagagagcaatgccctggcttggagacgaccttggcatgaaggatgcctcaagttcagtcttccctggttttagtttgatgcaatggatgagcatgcagcagaataatcagttctctgctgcccaatctggatttatacccccatccatgctttcatccaatgcactgcatggtaaccttaccactgatgatccatccaaattattgagctttcaagctcctgtcctctcttcaccaaatcttcaatttaacaaacctaatttagcaaaccaagtcaaccaattgcaacaatccccaacgtcatggtctccgcagcagcagcagcagcaacaacagcagaagctgcagtcaatgttgcaaacacccttaaatccgctccagcaacagaggcaacaacagctgcccgtaccacaaaacctgccacaaccacagcaacaacaaccccaaatgcctcaacagagagcgcaacagccacaagaacagcaacagcagtcgtgtcaacagaccatcatgaataacggggcagttgcttctaaccagattccgaatcagtgtgtacagcaaccagtatcatactcacaacttcagcaacagcaattaatctcaggaagtatcccaccccaacaatgttttccatcgcccaataagaatacattgctgatgacatccttaccacaagactcacagtttcagcaacaaatagatcagcaagctagtctcttacagaggcagcagctgcagcagcagcagcaacagacacagttgcaatcatctccgttgcagttattgcaacaaagcttgtcacagagggcaccacagcaaccacaaatgactcaaatgtcacagcaaaacagctcagaccaacaaccacagttacagatgctacagaaattgcagcagcaacaacagcagcagcagcagcaacaacaacagaaacccctttccacttctagcccacttttgcagtctcagcttctacagcagcaaaatactcatcaacaaaaccagcaatttccgcagctgcctctatcacagggtcatcagcctcaacagcttggcaacaatgctttctcaatggagaagcttctcaatggcaacaactactcttcttcatctctgatgcaaacacagcagctttcggtgaaccaaccccataatacacagaaatcactaactaatactagagctccctctactcttacagatggagatgccccatcatgctcaacttcaccatctactaataactgccagatatctccgaatctgatgaaaagaaatcaacaagtatcagccacattaggaggaccttcggtagttgaacccaccaatcatctgatgcaggagcttcatagcaagtctgagatgcagatcaaacatgaattgcccagtgtaagaggaactgatcagctgaagttcaaagggactgttgctgatcagatggaagcttcttctggaacatcttactgtattgatcctaataatatccaccagaacttcccacttcccaacttctgcatggatggggatgtccaatcacacccaagaaataatcttccatttgcctctaatctcgatggattaacacctgatactttgctctcaagaggctatgattctcagaaagattttcaaaacttgctgtccaattatggtggtgctccaagagacattgaaactgagctgtccactgctgcccttagtccacagccatttggggtgccagacatgccttttaagcctggatgctcaagtgatattgccatcaatgatcctggggttttgaataatggcttgtgggctaatcagactcaacgaatgcgaacatatactaaggtttttcatttactcattcgtttaaaaatttatagatctatttaa

SEQ ID NO: 101619 - DNA, 369 bp, Glycine max
  Peptide Sequence Number=SeqID_218397
atgccaacttgccaagcaacaagatttaatcttgttccccaagtcttccacaataacaacaacaattctaactcaaactcatactccaaaaacagcaataacactacttccccagaaacaaacaagaagacgcagaaccccctttggtgcctaccacaaagttctccaataacatggagcagaatcaacaaaaaaacacacccctttttcccaaaaatgccaccaattgtttccttagcctccactttctccaattcactcccccaacatcctaggactcaatggaattcctccaaaaacccaaaagcaagaaacttccagctgaaaacaaatgaagctgagggtgtccaagaagccaaaacctgttaa

SEQ ID NO: 101620 - DNA, 204 bp, Glycine max
  Peptide Sequence Number=SeqID_218398
atggagcatggagtcaacttaagcttcaatttcggccttctgaaaatgagggtagcgatatgggcggacattgactggtttcgaattcggaatgaggtgtatatagtgattgagattgaattttcgagagtaatgtacttggatgattttggacaaaaccatttcaacccacctgatccttatgacccgcttaatccaaactag

SEQ ID NO: 101621 - DNA, 675 bp, Glycine max
  Peptide Sequence Number=SeqID_218399
atgggactattgtgtcctttaccagtaccgtgtcgatcatgggaggacctttcgttggattttatcactagcctattggcattttgcggttacattaccattttggttgtcatcgacaagttctcgaagggaattcacttggttaagtggaacatgcttatgaatgagctttgcgtatcgtccatagacggatggacaaatagagatgtcaagtttgaaatcggcgattgggttatggtcaaactccgacctcacaagaaatcctctgtttggggtcaatccactgaatatttgaaacttgctaaaaggttttatgtgcccttccaagtcatagatagaattggcccaactgcctacaaacttcaattactggaagaagcgtgtatacaccccgtattccattgttcaatactcaaacctttccatcacccaccttctaatgacaaccttccttctttagctctactagtgacttttgatgatgatcacctcataatcactcctctatccattttgtacacgcgcaaaacagttgattccaaattgcaagttctggtccaatgccaaagattgtcactggacgacacctcgtgggaagattgggatcaactccaatctgattaccaccttgaggacaaggtgcttttggatggcaaagggaatgataacaattaa

SEQ ID NO: 101622 - DNA, 339 bp, Glycine max
  Peptide Sequence Number=SeqID_218400
atgtcgcgacctacccttcgcaggagggcgtcgcgacctacccttaggtgggagggcaacacgaaggctcacgggtgcgtcttccaagggaggaaaacacgcaaagtcgccaccaatgtttatttgaggaaaacgttagaaaaccggaaatgtgggtctacaaactttaagtatgaaaggttcgggagttgtttttatgcaccgggaagtcaaacccaagtagatgtaccctctacttgtaccacaaaggatgtaccctccaatgtgttaagacaaagttctcaggcagttaaacctttgaaactttgtgaatggggatacaaaagaattctcaagtga

SEQ ID NO: 101623 - DNA, 401 bp, Glycine max
  Peptide Sequence Number=SeqID_218401
atgatacatgttgtaaaaaatgtgaggatccctaagtatttggacttggaatggttctttcaacaagggttcaacatctccaatatgctagaagtacaaggattgccaaagctagtgcagatgaaaaaaatattttatccagagctagtcaaggttttctactcttatgcatgtgttgaccttgaaggtaacctcttctctattgttaatggagtagatatggtcattgatgtttctatgtggaaggaaataatcggtttggacatgggtaaagtccacaagttcgatgaaacgcctaatgggtacaacaagatgcaaacctataggggaatgcttcttgaccctgctaggaacttgaggaatcgcttaggagttggtggactgactatagaggatagaat

SEQ ID NO: 101624 - DNA, 237 bp, Glycine max
  Peptide Sequence Number=SeqID_218402
atgaaagtggggctatcaaaatttgccactgcaatggtaatcttttccagcctgaatgcagtgcttgggatcagatttgtgattgacagagaagactgtttctctcataatgttcaatatgaaggggatagagtccaggcttcatttgttgtgatcaagattgatacatcttggcaatatactaatgatggtgtagacctttcgagattcctcattttaattttatatgctccttaa

SEQ ID NO: 101625 - DNA, 327 bp, Glycine max
  Peptide Sequence Number=SeqID_218403
atgtcagagttgcttgataatttttctgaatttaccgatttttttgatcatgtggctgctcccactgctcaagttcctacccctgagagggttcctggttatgtatctgctcctcggaagaaagacgggcgttggacggaagaagaacatcggttatttctccttggccttgatagatgcagtggcaaaagaaaatggaaacagatttcacaacaatatgttgtatcaagaacttcaattcaagttgcaagtcatgctaaaaacacttcatacacaatggggtcctggggtcccactgaaagagaggagaagaagaagcatcaatga

SEQ ID NO: 101626 - DNA, 654 bp, Glycine max
  Peptide Sequence Number=SeqID_218404
atgggtagcacacattggagtcatgatagtaatatgctcttgcgtgtatgccacttgttgtgggtggcacatgctggaggcttgttaggagtcataatgctaaaaagagggatcaccaagggcgaaccttgggctttaggagcctcagagttgaagtataacttcagatgggcggcattccacgttcgtgggattgctttgtcatccaactcttgtagtcggtacactccgttgtcgaggttggttgtgatcctagagagaccgtcccagttgggaccaacctttcccgctcagggatcttttctggccatacgaggtcgtcgggttgaaagtagtcttcttgtcgatggttccccgacttccatgaggattatggcgtttgttccatatggacctgaggatgactctattagctacctctacctgtctgttagtctatggattgacaatggcgtatgggaggccgtacctgcatatgaggtgcttccaagtgaatttttccacctcgttggtcctaagactgtgaaggttgtcaggaggagtgtgtggcacgtctgcaaactcttgacatcgtctgcatctcctagtaaagtcgagggtgtttgccttgagtgttggccagtaatagccagctcgtaccgctttggtggctaa

SEQ ID NO: 101627 - DNA, 498 bp, Glycine max
  Peptide Sequence Number=SeqID_218405
atgactgggcccttctcatgggatgagacatatcaacaagccttcttggcttccaagaagaccacagccacaccgtcagttttgagcgacccaggccaggacgtcatccttgacgctgcgaagtgctaccaaatgataaaaaaggtggcactagcaatcgtcaccttggcaagacgacttaggccctacttctggatcatcaagtggtgttttgatgataacaaagatgatgacaaaaaggccaagagaatgatttcaagattgagtcaagaacaattcaagaatcaagagtttcaaggtacatctacttgggttgttgtgactgagaacaagagagggtacatctcttgtggatcagttctagtggagggtacatccattaggttgttcaaagagaacaagggagggtacatcccttgtggatctttgcttgtaaaggattttacaaggttgaaaataaatctcaaggaccgcaggtcacttggggactggatgtag

SEQ ID NO: 101628 - DNA, 990 bp, Glycine max
  Peptide Sequence Number=SeqID_218406
atggcagacacgaacactctaaagcaactccaaaatcgcattacagagatagagcgacgccacaaggaagagttgagaaagctaaaggctgatcatgaccacctagaggctcgtggacacgagcaatcctcccacaccttgcctgagcgcacccaagggggatcacatccccgatgcataggtaacaatgcaaacgacctaagtccctcctacatgcatcgtcaagcaatacagattgtccatcgacatccttttgtcgaccgcattatggtggcagacatacccttggggtggaagccacttaaccttgagcggtacaatgggacaacagatccagacgagcatctggatgccttcctgacacaggtgaacctctacaccaatgacgacttgattctatgtcatctcttccctacatctcttaagggagtaacattgacctggtctcactgcatgacctcaactgccttggccagtctgccacatgcagatgatgagtccctcagaaagttcatagacaaatttgggcgcacggtcgtccagatccaaaatctaaatcatgaggtagcgttacattccatgctcctcaccttatgccctagaaagttcatagacagtttgtgcgaaaaaccacttgatagcatggatgaactgcgccaacgagtcaagggctacatccagatggaagaaatgtccaaatttcggaatgaagtccgccaagccggacaaaagcacgataagtgcgaagcacaaaccaaaactgacgcgtacaagtcagataataggcacaatctagacaagtgccaacctctcttcaaagggcataggtacgagtgttacacacgcctaatggccaatcacgccacgattctcgaggaagcattcaacctggagatcagacaactaagcaggagtgagactcgaaggacatctagaggagcagaacaggaaccaggaagcagacaaaaagagagcagaagaccgaagtag

SEQ ID NO: 101629 - DNA, 945 bp, Glycine max
  Peptide Sequence Number=SeqID_218407
atgtcattgtctactgctactccgtttgctagagaaaggggtcaacctgctagcaaggttggtcttactgctattgctgctgagatatgccttccgactccaccagccatcgaggctcctgttgctactgttgtgacttttgctactcctgttatccctgctccttcccctcctcctattgttgattttgtgcaggatattcctactactactgaagttgttgtgtcagctgctcaagctggttctgctatggttccaccatccaccgcgtggctcctttgtttagtgtcggctggagcagaagacctcgactggctttgtgtcaggcttcgacaaaaaccttatcaggagtttggccattatggaggagaatggattgcaacaccaggaggaggtcaccaagtggagggctattgctcgaactatgtggctgagaagttggacctgggtggcaaagtggagagcatggcgactgagaaggacggacttgccaagagaattgctgagttggagtccaagttgcaggcgaccaaggaaagggaggccagtttatttgagaaagaccttgacttaggtctctttgaccccttcaaggacgtgaaggagggtgtcctacttgaggaggagattactgcggaggaggaggaggctgttgatgagggacagggcgctgcgaagcaagacaataatacctctcatcctctgatggttatgaggagtgagtgtgagtggcacctgattgaaggtcctatcatgcaatcgggtggtggttcgcttggtggaactttgacccttgatggtggtcgttgtttgcttccagcaagtgcaccggatcacacaagtagtataaaacgatgtgtttactatgaacaggatactctctatttaacaatgcttatgcgttctatggtgtctcctgaaatgctaaaccccaattcctcatga

SEQ ID NO: 101630 - DNA, 378 bp, Glycine max
  Peptide Sequence Number=SeqID_218408
atgacaagtgaaatattcgaatttgtggctcgagacaatggacctcatcgcttctgcttcaccaacaagtctccctatcatgaaacaattgattttgatgtccattctaaccacgttcatttcactgatcagcatgcaaaagatgagcatttaactcctttgttagatcagataacgaagttagagcatgcacttttcaacattcagtatgaacagcattggcttgaggctcagacagaacgccaggcaatagtaagcaatgcattgagctccagaacacttcacaaggccatacttgaatcaatggcactaatgggagccagcgccctccaagtttatcttcttcgtcgcctctttgaaagaaagcttgcaatatag

SEQ ID NO: 101631 - DNA, 150 bp, Glycine max
  Peptide Sequence Number=SeqID_218409
atgggccttacggagagtgtaacgggattcgtcgaacgtcgttacgtgtccgaggggactgaacattgtgccgttagatttagcgtcacgcgtgacgtggagtgggggatgcacggccatatgtggtgttatagtaagaagccagcttaa

SEQ ID NO: 101632 - DNA, 246 bp, Glycine max
  Peptide Sequence Number=SeqID_218410
atggagagagtctataccatggatattaaaccactgaacagtgaaaagggccggccacttccaaaatttggtgaatgggatgtcaatgatccaacctcagctgaggggttcacagtgatttttaataaggccagggatgagaaaaagacaggtggtaacccagattcaccaggaaagactgccactgatcctcatagcaaacctgctgtagagcctggcaaaactcaaactgtgagatgttcttga

SEQ ID NO: 101633 - DNA, 171 bp, Glycine max
  Peptide Sequence Number=SeqID_218411
atggaaggaattcagattgtttctcctacaagaagcaaaggagacagtgataagagcttacaggagcacggttgcacagttgaactttgtggaagaaggcttggagataagttgagcggtgttgtgtggcagtttgaggttgagatatgcgaaaggcatcgtcccatgtga

SEQ ID NO: 101634 - DNA, 807 bp, Glycine max
  Peptide Sequence Number=SeqID_218412
atgggtaaaatttacttcaattctttcttacctatgatagtggcaggctttgggaatgtgttcattttccccaaagataaatataatggaggcctctacggagactttgtttctttgcatccaatgctaaagacagctgaggaaagaaccagtgcagttggatatgtagtagaacgtttgggagaggagcatattccagggatacggaatgagctttaccctgtgatatcatcatttggtgcacagattttcttttcattagaacgtgctgcagctccttattttggcataaaggtttatggaacccagatgaatggctatgttgagctggatgggcagaagcacctatggatagggaagagaagtggtacaaaatccacatatcctggaatgcttgatgagctagttgcaggaggactgccgcatggaatcaattgtcagcagaatcttgcaaaggaatgtgaagaggaagcaggaatacctagatctatctctgtcaacgccataccggttggtgctgtttcatacaaggacattgatggatatagatacaagagagatgttctgttctgttatgatctaaaacttccaaaagatttcattccgaaaaataaagatggagaagttgatagcttcaagttgatccctgttacacaagttgcagaaatcatacgcaagacacagtttttcaaggcaaattgcgctcttgtaatcattgatttcctgtttcgacatggatacatcactcctgaatatgatggatatttggatctcctacgaagcttaagaataggagattgctcctga

SEQ ID NO: 101635 - DNA, 1665 bp, Glycine max
  Peptide Sequence Number=SeqID_218413
atgtcaggaatatcttatttatccagagaacaagaaaggaaagcattaaggagtttgaattctacatatgatagtgagtggtcagacattggtaaattaaaagatgttagggatataccattgctcagcgcggccgacattttgttcactgcacggatgaaaaataaattcagtgaatggcgtgatgggttatttcaggagcaaaatcaagaagaccaaattcaaggaatttcaaatgactcaaaatttcaagtgactttttttgagatgcatccagctcttaggcttaatagattcacatctcaccagcttaaattgattcagttgctcatcagaaaacacttcaaagatctttcatatgtcagtgtgaacagtgaggcttctggttcacaacaattagtcgtatatacagacttaaaggatgaattaaacttacttctgaagaaggtgaaagaagaaaatcacagagcagaagagatgaagatccaagctgccgttggattccgccatgttattgatctcctttcatcagaacagaagttgatagttggatacaattgttttttagatattgcacatgtctacagcaaatttataggccctcttccggggactcctgaagagtttgttgcctctgttagcaagtgctttcctcacattgttgacaccaagatactcctgagcactaatttgatgttccaagaaaagatgaaaaggtccagaaaatcactggcctctgcattcacttcattttgtccacaaattgcagctggctccagaagcacagatctaggttcactctctcatgtgaaagtgaacgttgaggttgatgattcaagatcatgcagctggagccctggaggcaagcatgaggcaggatatgatgccttcatgactggatgcatctttgcccagttatgcagtgatttaggtatcgattttaaactccatgattcttcaaaaccattagccctcaatgagaaactgcagaagtacgttaatcgtctatatcttagttggatgcacagggacattattgatctaaatactggtaataaggttgcagattcttcactcaggagcctgacgaagcggtacccaaaaattatgtttgagaacattgttattatttggggattttcttctaagctgaaggcaaacgaaataagagagtgcatatctaaagtatttggaccaacttctgtagtttctgtcttccacttggatgcaactgcagcattcgtccagtttagcaaaactgagttagtttctgattttcttttagtgaaggattccttggagagaagtggtggtgcaatctcggttttgcatccactgtcaaaacttttggaaggtggaaatacatgtggtgccaattatgatacttacagagaaatatgtggttcatccttatcagaaggtctgttcgctgatcaggcagaggcagttggtataaagtggaagaccaaattaacagaatacaaggtagcatcgagaggcaaagaacatgaaaatcctagtgtacaagataatgtaaatacggttatgaagaatgtagaaaggaccaagccaaacacaattgatcagttaggaaatgctccatcttgtgggcaagtctcaacttttgagattgaagattcttatgttgcagaagccaatttgtga

SEQ ID NO: 101636 - DNA, 1835 bp, Glycine max
  Peptide Sequence Number=SeqID_218414
tcaccaacaccacccccaccacctcctcctccaccttcaccttcttcctctactcctcccacaacctctccctcatcttccaccccaatgatgataaccacctcaccctagacttaaccactccaaactccaccctaaccaacattccaacaacattcactgatctcaacactcagaataataatattccaatcacttcttggcttgactaccatgctcacaccaaaaaactcaacgttttcttaaactactcttcagtaccttcttccaagcctcaaaatccaatcttgagcgttgaccttgacctttctcactacttcaaggacaatctctatgtggggttttcgggttcaacgctaggaagcaccgagcttgtccaagtcatgagttggagcttcgagtttgagtcttttcagaaaccgggttcaaacttgcaccccgacaacggttctagaacccccgcgagtgttgcggtttcggacattccttctccttcaaactcaaccgagggtaatagttataaccgtggcaagagatttttctttggtgttgctgttgccattgctggccctgctttcttctgcgtggtgcttgtggtgttggggtatgtttctttcctcaagtggcgtggcgtgaggaaattacagaagagttttggaacagtggggtgttgtcctaaggagtttggttacaaggaggttaagttagccaccaaggggtttcacccttcgagggtaattgggaaaggatcgtttgggacagtgtacaaggccttgtttgagtcttcaggaaccattgccgcggttaaaagatcaagacaatattctcatgaaggaagaaccgagtttctggctgagctttctgttatagcaggtttgaggcacaagaatttggtccaactcctaggttggtgtgttgagaaaggtgaattgttgcttgtgtatgagtttatgccaaatggaagcttggacaaggtactttaccaagaatgtgaaagtgggaataatagcaacaatgtgttgagttggaatcatagggtaaacattgctgttggtttggcttctgtgttgagttatttgcaccaagagtgtgagcaaagggtgattcacagggacattaagactggtaacatattgctagatgggagcatgaacccaaggttgggtgattttggtttggcaaagcttatggatcatgacaagagtcctgtttcaacactaactgcagggacaatggggtacttagctcctgagtatcttcagtgtggaatggcaaatgagaagactgatgtgttcagctatggtgtggtggttcttgaggtggcttgtggaaggaggccaattgaaagagaggggcagaagatggtaaatttggtggattgggtttgggggttgcactctcaagggacgatcattgaggctgctgataagagattgaatggggattttagagaaggggaaatgaagaggcttttgcttttggggttgagttgtgctaaccctgatagtgctcaaaggccttccatgagaagagtgttgcagatacttaataataaccaaggagtggctcttgttgtgcctaaggagaaacctacacttactttctcctctggcttgcctttgagtcttgatgagattgtttctgatgcagaggaagagttggattctggccaggttgtgttgtcacatataatactagcgaaattcacttcactaactggagttcaagctattacattgaacttcatggagccagatgctattgacttacgtaacggccatatgaggcaaactctgaaacccattatgattattgaccaaaacgccaagaaataa

SEQ ID NO: 101637 - DNA, 261 bp, Glycine max
  Peptide Sequence Number=SeqID_218415
atggctcaaggattgtgctgttatttgtccttacaagagatgaaacaagcgaccaagaattttgatgagtcaaatgtgataggggtaggagggtttggaaaggtttacaagggtgttattgataatgggttcaaagtggctatcaaaagatcaaatccgcaatcaaggaggcatcaattgaccaagaaatcagatgtgtactcatttggggttgttttatttgaggcactttatttgaggaaggtagctttggatacttga

SEQ ID NO: 101638 - DNA, 312 bp, Glycine max
  Peptide Sequence Number=SeqID_218416
atgactaatgataatgccacctctagcaccaccatggacaagctttctacgtcaggacttctacgacggttgcaaagaaccgtcgtagaagctacacagaccttcttctctgacaaagagcttcgtctccgacaaacagcatctcgtgtccgttgcctcttgttccgtttgcagccgccgccgacaaagtgtttaaggaagataaggtggttccataagtggggtttaaaatccaaagacgagcttcgggaacggcctgctgcaatccttcatcagtggtgtcatcctgtgccacattatcagtttcgttga

SEQ ID NO: 101639 - DNA, 234 bp, Glycine max
  Peptide Sequence Number=SeqID_218417
atggaaaatgcggaattgattaaggaaaggatggaaaataaggtggttaatttcgtgggtcttaataaggtggtttctggcataaaaatggatgaatgggatgaggtggattttctggaattgtggtttgaaagaacaagggtggagatgataggaaggaaagaatcactctttccagcgagggcaacacacaaaggttgtgaaagtcctttgatacagccagggtgttcttga

SEQ ID NO: 101640 - DNA, 573 bp, Glycine max
  Peptide Sequence Number=SeqID_218418
atgtatggtgttaagaaaagtgaagacatgatgataaaattggatgatctcataaaaaatttgtttgcggaatatgtaatacaacatcccgtttccattgatagtagtacttctagtactctagcttcaaacattgcctcaacaattaatgcaaacaatggtgatgaggatgagggttgggacggtcaatttagattgaaaatgaagaaaaaacatggtgaggagaaaaggaaggagttcaaaaggtatttggaggatgagattgaagaagacaaccctggatttgacgttttggcaaggtggaaaatgaaagcaaccaaatatcttgttctttctttcatggctagagatatacttgcccttccagtgtttactgtgtcatttgagtccgtattcaacacaggaggtcaattacttgatccatttcgtagttgcttgaatcccactatggttgaagctttgatttatgcccaaaattggcttaaaactgagttgtatggtttggcttcaaatactgctaatgttgggactaatactaggactactattgggacatttagtattgggagttag

SEQ ID NO: 101641 - DNA, 1131 bp, Glycine max
  Peptide Sequence Number=SeqID_218419
atgggtggaagatggagaaccctctctttgatctataaccgcataaacacttcttcttcttccaaaccccactttccctccttctaccgctccctctctctcgccgccgcaacttctgaaatacccgacccggatccaatcgggttcggagccccggaactcgacccctgcgtcaaaatccccgtcaaagcttatttcctctccaccagtataaatttgaagggcattcaggctgataatcacagaaatgttgttcctccatcttcccgctcgtcttcaaactatgttgctctccgtttctgtgacttcaatttggactccaatgttaagggtgagataagaggaagttctggctccatattctgttattctgctaatttctccttttggatttggggaggaaggcatttgattcagggacatgggtttcatgtgaaagcaagcaacagtcgttacatggttgtttatcagtatgggtcagctgttttgtttaatatcgaggatcatgaagtggaaagttacctggaattagttaagaagcatgcatctggtttacttcaagatatgaggaaagatgattatgcgataaaggagaagccactgcaagttgaggacatgcaaggaggtccagactacatagttctgaaatcgttggatactgatggtatccgtataattggaagtgtattgggacaaagcatagctctggattattttgtctcacaggttgatggtttagttgaagagtttgctggcataaatcgcggaatggagaaaactggaaccttcactatggataagaagaagctacttcagctagttgggaaggctaactcaaatttggccgatgtgattcttaaagttggtctctttgagagatcagaaattgcttggagggatgcaaagtatgctcaaatatatgagtatcttagggaggagtatgaagttgcacaacgctttggaaacctggatttcaaattgaaattcgttgagcacaatattcattttctccaagaagttctccagaacaggaaatcagatttcttggaatggtgcattattggtctattgactattgaaaatgttctatccttatacgagattcttggagcttcaaatacagtttcttag

SEQ ID NO: 101642 - DNA, 330 bp, Glycine max
  Peptide Sequence Number=SeqID_218420
atgttgctgaaaaatttgaacaagcttcttatcgctttgagtatgttaaggcagcatatgtgctcactcttcttactagtgaaggaggatgtcctaaataggttgattggaaacatgctcgtgtttttccatcctgatgaggacatgaccaagagcaagggcaaggatccacttgaaggacttggaggacctatgacaagggctagagcaaggaaagccaaggaagctcttcaacaagtgttgtccatactgtttgaatacaagcccaagtttcaaggagaaaagtccaaggttgtgagttgtatcatggcccaaatggaggaggactaa

SEQ ID NO: 101643 - DNA, 1143 bp, Glycine max
  Peptide Sequence Number=SeqID_218421
atgacgagcagggacaccaataccagcaagttcatccacaaaccctttgatttttcacaagtactcctcaattgttttgttgtcaagagtaataattgctctcatggcagtgcagagctgtcgtgctcgagttttcggatattgtatagtgatcaaaagcgtcaaacgattctgcagcagattattgattttaaatggcttcaacaaaatgaggagattgattattctgcaaagatcaataggctacaagaaaaagattcatctccttcagtatatcagactcttaagaaattggacgacaaattcaatgagcaagcacaaaattcccaagatcttgctactaatgttctggaaaaagactgtcccattatggagctgaatcctgaaactttgccttctacgttttctcaacttgacaatttatattcttcttcaactatcgatcttcccttgcatggagaattgttctggacatgcaaaagtccacttcaaagtaatcagtacagtttggaagagaacattgggttgtatacatcccttgaatatattcagagtatgatcatgatgaagaatgggaacagagagccaactatcatcaataagacagataatatgcttcgtatagggaactcaaaggacattaagtccaataagacaagccgcacaagctttaaaactcaattgtggtcccaaaatattcaagaccttgggatatgcaaagaacttgtttgtcaagatgattttaacatccctgatgttgacttaactttccaaaactatgaggaactatttggaggagatcaagatccaattagaatactgcttgatgatcaagatgtctcctgctcttctttagagaaggataagtcagttgacaagtcagttattgacaatccaagtgcaatggaggaatcttctgcagctgcgtccattactatctcccaatctgatcttgacaacaaggatatgaatcctctcagccagtactgtccaagaagcatggatcctgctcatgcaattcgaccatttgattcaactataccattctctgttctgagattcaatgaggaaagcagttgcacaaaccatgatgacagtgccctttctccctacagtgaagggagggcttattcaggtagttaa

SEQ ID NO: 101644 - DNA, 378 bp, Glycine max
  Peptide Sequence Number=SeqID_218422
atggttttgcaagttcaacgttttaatagccgcaaacaaaaataccctcaaaaggtatatgtgcgtggagggcagaaagaggaagagcctcttgaaatgatagtgtataaccaagggatgttcaagactgagctgtgtaataagtggcaggaaactggaacatgtccatatggagaccactgccaatttgctcatggtattggggagcttcgcccagtgatccgccacccacgctacaaaactgaagtctgcagaatggtccttgctggggttgtgtgcccatatggccatagatgccatttccgccatgcacttactgaacaagagaaagctgtcgtatcacagcctaagcccagatcaatgaagctcgaaagataa

SEQ ID NO: 101645 - DNA, 714 bp, Glycine max
  Peptide Sequence Number=SeqID_218423
atggaaattagtgtggaccatgatagtcctagaccacctaacaatttctcatgcttaaagagatgtgatactgcatttatgttttctgatttttcagtagagttgggacaggtagattttcatcctttcttgaaaggggcatgtagcatctctgaattcaccccaaaatgcccttgcctaacaattgtacgatgcaataagcgtgggtattgcaagccagtttctgcggtctttggaggtcctaaatttacatcagattctgttagccaagaagccgagaactttctccttgacgctgttaaaatgaacttctttgagcggttaaatttggcttggaagataattttcccatcggcaacatctaggaaaacctccaatgctaggattgccaagcaacgcttgaagatgattttgttctctgatcggtgtgaagtaagtgatgaggcaaagcgaaaaattgtaagcaatgttgtgcgtgctctatcagattttgtggaaatagaatcacaggataaagttcagctgagtgtctctgctgatacagatcttggaactatttactctgtcactgtccctgtacggcgggttaagccagaatatcaagaaatggatgaatttgggacaataacaaatgttgagtataaggacactggagagagttctggttctgttgatgttagatttgatttctatgttgcagacgaaagttcttga

SEQ ID NO: 101646 - DNA, 474 bp, Glycine max
  Peptide Sequence Number=SeqID_218424
atggttcctattattcgtattcttgatgcagaggtggactccatgtctgtctctggatttaatgttaccgtagccattggagcatcaatgcttgtttatgatttacgttactttgaccaaccagttgagtcaaaagaggcattcaatggaacacacttaagatgtgtcagttcaattccagatgcagaagatattaagtctgatgctcttgcaggattcgcagttgggtctgtagacggacgagtatcactgcagatttccaatccattcagttcaaacgacattagtgtatctggtgcctttgccactggtgacaatgaaggttatgttaccatatgggatgctggaagtaggagaagactagttgagttgcccaggtatccaaatagtgttgcatccttatcatacaaccacacaggtcagcttctggctgtagcatcaagccatacttaccaagaagcaaaggaaatgtga

SEQ ID NO: 101647 - DNA, 342 bp, Glycine max
  Peptide Sequence Number=SeqID_218425
atggaaacatttatcgttagtggcagttcattgtcttttgaggaagaggcaatcataagggacaatgtagaagagtttagtgaggatgatcttcaagatgaagtccctgatgaagcaaaccaagacacaaaagatgagtttaaggttgacagtgcaagttctaacattttcggtggtgtggaagacctgtctagtttcattctggatcgcgtgttttggttttttaagctatgcactgaaggttttaaatgttgcaaacctgttatgcaagttgatgacacattttcaacagggaaatgccatgttactttattgaatgtcattgcacaagatgaaaattga

SEQ ID NO: 101648 - DNA, 315 bp, Glycine max
  Peptide Sequence Number=SeqID_218426
tgtctcgggaggaaggcaaacaggttctcagatggatctagagaacaatccaacgaatatgaatcattcccttcgtgggataatggaagtgtttgtggggatgacgctggtgactacggaggtgatcttcatagtgacatggaggactccaacactctaattactcagcctcgtcaggtcaataaaattgaagtccagtatgacaagacttccaaacaagttgatgttcatgcactgaaaattactctttgggaccatgttcaagaatctgttaaacttcctttagaggtatgtcaagatttctccatttcctag

SEQ ID NO: 101649 - DNA, 221 bp, Glycine max
  Peptide Sequence Number=SeqID_218427
aggagggtgccggaggaggaggcggggacgggggtggagagggtgaggccgacgacaccgtcacggaggaaggagtcgccgaggagggtgatgttgcggagagtgaaggaggggaagatgttggggggaggaggaggaggaagaggatgaagatgatagtagatggtaagtacatgatgatgtgtgggaagattggaagaatgtgtgaagggagagactag

SEQ ID NO: 101650 - DNA, 1178 bp, Glycine max
  Peptide Sequence Number=SeqID_218428
atgggtcggaagcagagactccgcatccagtctccgaccagccctttcgtcttgggctccaacaacgaccagctcgaacgcgcccgggcacgagacgcacgcgccgccgccaaccgccgcaagagcctcgccctcaaccagcccctccaggccaattcccatcctggcctcaacaaacagcagatcctcgacttgttccaaaactgcatcaaactcgccagcgaaaacaaaattaatcagaaaaacacgtgggagttgaacctgattgaccatcttactgatatcatcaaggccgaagaagagcatgatgcggagactaattttcaaaaggcaagctgcactcttgaggctggagtcaaaatttattcattaagggtggattcagtgcattctgaggcatataaagttcttggtgggatgaatagagcaggccaagaagctgaggaagacactaccctggatggtgttaatattgaaagtagacaagaagaaagcaggaaagaaacgagcaaaaagttgtcacctttgtcaacattggaatcatcttttgaggcacttaatgtaaagaagtttgatggtgatctcaaatcctattctgtttctgttacttgtttgatgaggcgtgctgcatttgtcgtggatcctctctatcgccaaacaacagcaaaattcgatgaaggtggagccaagggtcttttaatgaataatcttggtgtatatggtggctgtagggtgctctttgattcacaagaagtgcctgctaagtgtatggcaagccaaaatcaatctgatatttcagatactattgatctttcttttctcaaagattgtattgatcagatggtgttggacatgcgtgtaaaggatgaaatttctccaagtctcaggactatagtaaaccaatttgatgaaagtaacagaaggcccactgatattcaacttcaaggcccgagttcagctgaagatcttgacaatgctgataataatgaaaatggttttgatagagaagaatacgagaactgcacggcctggagtgatgatcatgatgaccaaacagttgttgccgatcttgactataatgatgcagatccaagtttttccagttaccctcaggacaatgctgagcaatttccttccccagaaactgatatggatgacagatttgaaaatgttgaggg

SEQ ID NO: 101651 - DNA, 702 bp, Glycine max
  Peptide Sequence Number=SeqID_218429
atggatagaggattgtttgaatatactagtatggtcttgattcttgtcaatgggagtccatctaatgagttcaaattgcaaaggggactaagacaaggaaatcctttcgcaccctttcattttgttatagttgcggagggccttagcagtttaatgaaagaagttatatcaaagaatttattctctagttaccgtgtgggaatagatgaagtggaagttaatttgctccaattcatggatgatactattaatttgggagaagtaacattggagaatgtgattaccattaagtgtatcatgagatgttttgaactagtatccagcttgaaagttaatttctccaaaatctcttttggggcggtgggagtggagagtagtgaagtggagaagtttgcaagattgttaaattgtagcctacttacattgtctttcacatacttgggaatgtctattggagccaatccaagaagagtgacaacatggaatagcatgtctaaatggtttgatacaaggtttaggtggaaagtaggtgagggtgacaaagcaaggttttggttggataattgggcgggggaggagagctttgtggaagaggatgcctcgggagcctactcggtgaaaagtgcttacaaagcattgcatgaagagatggtgggaagccaaaatgtgaagttgatgccaagcatttggaagctcaattag

SEQ ID NO: 101652 - DNA, 706 bp, Glycine max
  Peptide Sequence Number=SeqID_218430
gaaaggggcagctgaaactagtggtggagggggtgagagaagggaactcaaccaattcattgccgatatgggagtagaagacatcccaatgcatggaagaaaatttacttggtttaaaccaaatggaaaggctatgagtaggcttgatagaattatggtgaatagagaatggcttggtagattccaaaaatttgttgaggatgcatggaggaaattagaagtgcaaggttggggagtgtttgtattgaaggagaaacttaaatggttgaagagggaattgaagaagtggaataaggagcattttggcaacttggaaagcagatttgaagaaggtcaaaaagagatgaatgaaattgaattgaaaggggaaatcacaagccttagtgatttggaaataatgaggaaaaaggagttgcaaaagaaatggaagactgtgcttagagggatcaatgtggacgggtgttgggttaaagaacctttgagcaacataataatgttagtggctaattttgatgaggggaaagttaaagaagtggatgatgctatgcagttcttggtggaatttcatagcatggagtgtttccaagagattttggctaataggttgaaaagagtacttgatggtgtcattgacaagagacaaagtgcatttattggaggaagaaatcttgtgtatagtgtagtggttggcaatggaagttattga

SEQ ID NO: 101653 - DNA, 456 bp, Glycine max
  Peptide Sequence Number=SeqID_218431
atgcctcaccaagtcatggtccgttcgcagccagcgaacggccaccggaggcgcggcgtcggcgaagtggccggcagcgccgcggcagactgcactgccgtgtgctgctgctgcccctgcacggtcgtcaacctcgtcgtcctcgccgtgtacaagctcccgaaggggctcgtggaaaaagctgcgcacaagagacgacgccgtatgccgaagaagaacaacaccggcgacgtaaaaaacggcgtcgttttgttgcaggcgcagcgttcgagcagcgtggaaacgctcgatattgcggtggggcccacgcgcttggaggagtttatgaagaaggagtgggaggacgaggagaaggggaagtgcgagaaggaagaggaagagggattggagaaggagatgtgggcccggtttgcaggaactggattctggcggagcgagtctcagcgtcaaccataa

SEQ ID NO: 101654 - DNA, 894 bp, Glycine max
  Peptide Sequence Number=SeqID_218432
atgaatcacacttggactctcactcctctgccacctcacaagcaagttgttggctgccgttggatatacaagatcaagtataatgcagatggtagcattgagctgtacaaagcgagacttgttgcgaaaggatacacacaagtggaaggcttagattgccttgctactttctccccagttgccaagctcaccacagttcaactcattcttgcccttgcagccatttttgattggcatctcaagcaattagacgtgaataatgcatttctttatggagaattgaatgaagaagtttacatgagtcttcctccaggaatgcatccagcctattccaaccaagtatgcaaattgcagaagtcaatatatggcctgaaacaagctagcagacagtggtttgcaaaattatcttcttttcttattcaacatggatatcatcaatctgcaccggatcattcattgtttctgaaattctctggttcctctactacagtcctcctcatatacgtggatgatattgttttagctggcaataatctttttgaaattcagcttattactggtcttctcgatgctgccttcaagatcaaagatttaggcaatattaaatactttctagggcttgaagtagctcgcaacaattcatctgaagctgaatatcgtgctctcgccaccacaacttgtgagcttcaatggctcacttatctcctcaatgatctgcatgtttctgctaaacaaccagctctcctctattgtgttaatcagtccgctttgcaaatcgcagccaatcaagtattccatgaaccttgccgacatcttcacgaagtctctctcaccttcaatgttcacaactttatgttccaagctgggaatgttgaatctctattcccagcttga

SEQ ID NO: 101655 - DNA, 205 bp, Glycine max
  Peptide Sequence Number=SeqID_218433
agttagcgaactaagagtcgttgaacttcttgatggcctttgcgaaaagatgcaagattatacactcaagatagatacaaatacctatgaatggttcaaagtggatagctgggataacctcacaacaaataagcaagaagctcgggcatattcaaaagatatatcttcttattgtggaaggaatacttatggtattattctgtaa

SEQ ID NO: 101656 - DNA, 882 bp, Glycine max
  Peptide Sequence Number=SeqID_218434
atgttcacgactctcagtgctaaaaacaaagtagaattcatggatggcagtgctcgacaaccgtcttcctttgatcgtgtctacagtgcatggaaacgatgtaataatatggtggtctcctggcttgtacactttgtttcttcttcaataagactaagcattctctggatggactctgtagaagagatttggtgcgatctaaaatcacgttattcccatggagatcttctgcgcatatcttctctgcaacttgaagcttcctcgatcaaacaaggtgacttatttgtcactgactattttactcagttacggattatatgggatgagctcgagaactttcaaccagacttgatttgtgtatgcactgtgaaatatgtatgcaaagtttcatctattctcgctcaaaggaaattgaaggatcgagccatatctcatgttttgttaatggatcccttaccccctatcaacaaaattttctcctacgttgcacaacaagaacgacagtattctgctcctgattccttagctgaagttaatgctaccatcatgaattctacgtgcaatttttgtggacgaactggtcatactaaaagcacttgttactgtaagcatggattcccttacaagaatggcaagagcacctctaatcatggaaaagcttgctcccactgtggaaagaatggtcatacagtagatacatgttataagaaacatggcttccctccaggccatcgtttctccaataacaaatctgcatctgctaatagtgttttgaccactgaggtgaaggccaatgagaaagatgtttctaccttcactaagcatcaagagactcgtttcactcctcaacaatatcaagctttgttagccttaattcagtag

SEQ ID NO: 101657 - DNA, 183 bp, Glycine max
  Peptide Sequence Number=SeqID_218435
atggctacttttaaagaagaatgggaagctgttctggatgaccttgaaaccaaaagtgcccacttactggtggaggagattgatgatgttgatggcaattctatggatccatttattgcagctgccattgcaaatgaaagagaattagatctttcttatgagcaaatgaggcaatttaaaaag

SEQ ID NO: 101658 - DNA, 879 bp, Glycine max
  Peptide Sequence Number=SeqID_218436
atggatttaagtgttaaaattctccctgccaccaatgatgtacatggaggagtcattgtggacttaaaggagcctatggactctgaagattttgctactttgcttagatcttcacttttacattggaagcaacagggaaaagatggtgtttggatcaagctacctattgagcttgttaatcttgctgaaactgcagttaaggagggtttttggtaccaccatgcagagccaaactatctaatgctagtttactggattccaaaaactggctgcacaatacctccaaatgcttcccatcgtgtagcagttggcgcaattgtcctgaatgataagaaagaggttcttgtggtcaaggaaaagagaggtggatttcatgggattggtgtttggaagatacctactggattagttgatgcaggtgaggagatttttgaagcagctattagagaagttaaagaagagacaggaattgacacagaatttgtggaagtactagcattcagacacacacacaattcattctttggaaaatcagatatatcttttatttgcatgctgtgtcctctttcttttgacatcaaaaagcaagaactggaaattgaggcagctcaggaatctaagaacatacatgatagaggatatttttggttccaagttcttcaaaagatagttgataagatgatgtggatgccgttcaaggaatttgctgatcaaccttttaatcagatgcatgaacccttcaagtacatgattgaattatgcttggcaaaggttgaaaaagtctataatggattctctccgcgacctgtctcgtcgtatttcgtgaaggagttgaattatctatatttgaatagccatggcctggacaaatcttcttaa

SEQ ID NO: 101659 - DNA, 240 bp, Glycine max
  Peptide Sequence Number=SeqID_218437
atggtattgaggacaaaacagagcttcttcaactggtatgaaagtgcatttgaggatccagacattattcatgttgatgatattgttgacccagttagggatttagaggtcattactgaagaattgcggttgaaggatattcaattcatggaaagaaagatacaagatattgagaaaagcatgaagaggagcaatgacaagcagttaaaaatcgagcttcaatgttgtcaaagggtttga

SEQ ID NO: 101660 - DNA, 321 bp, Glycine max
  Peptide Sequence Number=SeqID_218438
atgacagaaaccctagctagcctagtgcttatcaccattactaggggagaaagggagaggtgcaaaaatgagcggaaacaattgcaagaagatgaggtgcatcttgcgcattcctcctcctccgtcgccgcgatccgcgccctcaaggagtgcatcgcgagatccaggccctgctcatcggcaaccagcacctcgcccgcatccacgtggcactcaagcaggacctcatcgccactcaggatgagctccgctgcctctccgccattgccgccgaggtcaaggctaagcgtgacgtcgaggtcctcggcattgtcaccatga

SEQ ID NO: 101661 - DNA, 997 bp, Glycine max
  Peptide Sequence Number=SeqID_218439
atgatgataacaaaagatgatgacaaaggtgatgacaaaaagctcaaagatcaatcagagaacaactcaaggtacatcctttgtggtacaagtagagggtacatctacttgggtttgacagagaacaagagagggtacatctcttgtggatcagttctagtggagggtacatccattaggttcaaagagaacaagggagggtacatcccttgtggatctttgcttgccactcaatccaacactgaggagagacagttgtcagacagagctataaaggattggttgaaaaagctaagtgatgcagcttacgagctggatgacttcatggacgagtatgcccatgaagaattgaggttggaatgcgaaggagtcatgtgttgtctatcagaaatggtattaagttctttcttaccctctattaatcctgtgcatgtttttttccactacaagattcctaaggaaatgaaaagggtaagtgaaaaattagacgaaatttctgaagaaaagatttcagtaggcaaagggtgcttccattttgccactattggtctttcaaaagttgcgacaatcatgggatcaactccttcttataaattatcagagctatcccacaatgattgttgggaattgtttaaacaccaagcctttggaccagatgagaaagaacgggtaaagcttgtggccatagggaagaagatggtgaagaagtgttgggaaatgtcacttgtagcaaaagcacttagaggtagcctgaaactatcaagcttgcctactcaaatagggaagttgacttccctaaggagtttaactaggtacgctgatggcaaggaaagaaagttccttttggctgaattgggaaaactgaagcttaaaggatttcttgatatcgagcatctagagagagtaaaaagtgtaaaggatgccaaagagttcaatatgttaatgcttcaacctgatacccaacaacttgagagtttagatgtggtgggatatgaag

SEQ ID NO: 101662 - DNA, 162 bp, Glycine max
  Peptide Sequence Number=SeqID_218440
atggggcaaaaggggtttgaaggttcagaagtgaagagaattgagagaattaagaaagaagaagaaagaagaggaaacgaagtcggggcgctaccgaatcgcgatcgtgatcattccctacattgttccctgttcggtgttcttcgtgtgaccgtcgattag

SEQ ID NO: 101663 - DNA, 420 bp, Glycine max
  Peptide Sequence Number=SeqID_218441
atgggtgaaacaagtgtaattttgggaattaaaatcataaggaagggagacaatatattactatcccaaggccattatgttgagaaacttcttaggaagtttggctattatgactctaagtcaatgaatacactcagtcctaatcagaaccattgggatgcaattgcaagactcctgggatatttgagaggtaccatgaattatggtatcaaatatagtggatttaccattgtactagaagggtataacaatgctaactggatctttgatacaaatgaaacaaaatcaactagtgattatgtatttacacttggtggtgttacggttgcatggaggttgtccaaacaaactattatagctagatcaacaatggagttagagtttgttgctctaaatatggttggtagtgaagctgagtag

SEQ ID NO: 101664 - DNA, 426 bp, Glycine max
  Peptide Sequence Number=SeqID_218442
atgaggattgatgatgttcataaccctttgaaaaatgagaagaaagaagatgatgatggtgttcgagactggggtgtgcaaatcagagtagacaataggaggtacgacggtgtcgctgagaggaaggggatgaaggaagggaatcaattagcagctggaaatatcaatataattaatgttgttggtggtgtaacaccaaatttcatgaatgcagtggttggtgaagcatctatttctgttaatactgaaactagaggagaatatttgctagttattgtgaagggtgaggccaacacaattactagaattgaacgtccctcttggctgatcaacggattcagggaagcagtgatggattgtagtcttcttgatattccaatggaggcggtatcctttcacccagtccaaaagcaagggcactcctaa

SEQ ID NO: 101665 - DNA, 303 bp, Glycine max
  Peptide Sequence Number=SeqID_218443
atgaccgtgaaggaattgaacgaagagcagcaagaagcacatgttgaagaagttgttactgatgttgagggttttccaggcggaccccatgacacatcagttctaaaggattttgaaaatcacattgctctaagagaacatcctgacctgaagttatcttcccatggaaggaagatggctaagttcgggaggcctactccagagattgaaggccttgtggttgctagcaaattaagtcctttgatcgcgtgttccctagatacgggcgatcgaggactaatgtctgcttttgtggaatgttga

SEQ ID NO: 101666 - DNA, 1287 bp, Glycine max
  Peptide Sequence Number=SeqID_218444
atgtcgaactccaacgaaaacactgctcctgccaccaccattattaccactaacaccaccactattcacactgatggagaacctattgttcatgtcgaacactatttcaacatcaacatgctagaaggccttggcctcaacatacaacatactctgcttctctatggaattctcgaggtcgtgttgtccatggacaccatcgcacaagtcgctaggtgcatcagggaaggaagacctactatgaaaactgggagaagacctgaggtagatgggaaaaagaaggttcaatacaaccttttgggtgacatggccaaaatctggtccaacatcactcagaagagtttcatgcataaagtaggttcaaaagactctatgtctgacctacacaaatttgtgctcttccatctgatggatgagattccattcaaccttccacacatgaactacatcaaaattctcaggaacatgaagaccttgggaggagtggatgacatccataatgctgccttcatcaacaaactcctttgggaacatcaagtattccatgtctttgaaagactggacgaggactccaagcactccatcatcagcaaaagaacctttgttgctagacagttacacttcggtgttgtcaacctaaaggcaatgaagtttgacaatataagaaacaagctcattattctagttgatcaagatgatattcaacataagaggcagaagaagctagccaaatctatgggcaaggtatcgactaggaatcaagcccaagaagaagaagaatttgtgtccaaggagcaaagaaccaagaaaatacatgaggggtccaaaccttcttgtctagtcaagtcccaaaggacttgtccacaaactactccaattaggagaagtcaaaggcaaatcactgagcaggctacaaaggctcaaaggctaagggatatgagtgaaatagaggacgaagaccctttgatcatccccaggaagcagaaagaagaaccagtcgaacccatcaagatcccatcctctgccggctatagttcctctgataatgaggcaacaccaactcccactccacaaccatccagtccaccaccaaccctgggtctaacaaacaagggaagagattgcttgcatgaagttcctgaaaaagacaatgggactaaccaaaccaagagtgagggggtagtgactccacctcaatggatgcggtacaagtatgtttataccccatctgctaaacatgttgcactgccttcaaatgctatagtggctctggataccccctactag

SEQ ID NO: 101667 - DNA, 1344 bp, Glycine max
  Peptide Sequence Number=SeqID_218445
atgactgagattattccaggactgcaaggtgatatcccaccaaactcaagaaagggtgttccatttgttgctggaaagaagaaagttgcagcctgtgccaagcactatgttggtgacggtggaaccacaaagggaatcaatgagaacaacacagtgataagcaggcatggattgcttagcattcacgtgccagcctattataactcaatcatcaagggcgtttcaacgattatgatctcttattcaagctggaatggacaaaagatgcatgctaatcataatctaatcacggactttctgaagaacacactacgcttcaggggttttgtcatatcggattggcagggaattgataggattactaccccttctcatgctaactacacatattccatttatgctggaatcactgctgggattgacatgataatggttccctataattacacagaatttatagatggcctaacctcacaggtgaaaaataatctcatacccatgagccgaattgatgatgcagtaaagagaattttgagggtcaagttcattatgggcctgtttgagaacccgttggctgattacagcctagtcaagcagcttgggagtaagaagcatagaaaattggctcgaaaagctgtgaggaaatcattggttctattaaagaatggtgaagatgctgatcagccactgctccctcttcctaaaaaggcttcaaaaattctggttgctggaagccatgctgataatctaggatatcagtgtggtggctggacaatcgaatggcaaggacttgaaaccaacaacctcactaaagattccttttcaacttctttggcttttgtaaaccttgctaaaggtacaacaattctcagtgctatcaagaacacagttgacaaagacacggaagtggtctacaaagagaaccctgatttagactatgtcaagtctaatggtttttcgtatgccatcgtggtagttggagagaaaccatatgctgaaacaaatggtgatagcatgaatttgacaatatctgaacctggaccagacaccataatgaatgtatgtggaggagtaaaatgtgttgctgtgatcatctctggtcgtcctgtggttatacagccatatcttcacctaattgatgcccttgttgcggcttggcttccaggaagtgagggacatggtgtgactgatgtcttatttggtgactatggtttcagaggcaagcttccaaggacatggttcaaaactgttgatcagttgccaatgaatgtgggagattctcattatgatccccttttcccctttggatttggtcttgaaaccaaaccccccaaagccaattag

SEQ ID NO: 101668 - DNA, 216 bp, Glycine max
  Peptide Sequence Number=SeqID_218446
atggaggttggagagctgggcggtttttgcggtgacggagtggtgaaggtaggagagctcagagcaaaggcagcgaacgaaggactggagcgaggactagatctgtggggatacatagcactgcacccaccagtcaggggagcagttgtcgctggctatcacgcggtggaggtgctcaccgacgcagaggggctgggtcatgtcttgcgtcgttga

SEQ ID NO: 101669 - DNA, 237 bp, Glycine max
  Peptide Sequence Number=SeqID_218447
atgaggaagaagatggaggcaaaagaggagaagagtgtagttgttgctgaagatgacaagtcttctggatcttggactatgatggaaggcgtaatactcgtgtggacatgggagcggtggtggtcaaaggagggggaggcgaggaggaggaagatgcaaggagggggcgacgatgtagttcatgcatttggacgtctgacgtggctccacacgtgtactactgacatgtccaactaa

SEQ ID NO: 101670 - DNA, 357 bp, Glycine max
  Peptide Sequence Number=SeqID_218448
ctcccagcgatttccgacagcggtttccgccatcgcctgcaacactggaccataaaagctaaggttcacggtgcttacctcgacggtggacgcgctaacctcctcaacgaccgttgctcttcgcggaagcttcctcgcagcaccaccgcaagctacctcggcaacctcctcaacgaagaagaagaagaggcacaaagaagacgtgcaagcaatgaagaagaagacgcaggaagaagaagcaggaagaagaagaagcaggaaggtgatccgaaagaagaagaagcagaagcgcaaacgcggggagggagggagagagcaattgctgggtgcaccagcaaaactgctgggtgcacctag

SEQ ID NO: 101671 - DNA, 429 bp, Glycine max
  Peptide Sequence Number=SeqID_218449
atggccaaaattcccatcttttcggtggggattatgctcttgcattgttgggcagccatgacaggggcagagtacttgaaatataaagatccaaaacagccactcaataatcgaatcaaggatcttatgaacagaatgactttagaggaaaaaattggccaaatgacgcagattgatcgcaaggttgcttctgcagaagtcatgaacaagtattatattggaagtgtgctaagtgggggtggcagtgttccaagggcacaggcttctgcaaaggattggattcacatggtgaatgattttcagaagggtgctttatcgactagattgggaattccaatgatatatgggattgatgcagttcatggccataataatgtctacaaggcaacaatttttcctcacaacgttgggctaggggctaccaggtga

SEQ ID NO: 101672 - DNA, 725 bp, Glycine max
  Peptide Sequence Number=SeqID_218450
ggtacaatctttgtggtacaagtagagcgtacatctacttgggttgtaatactgagaacaagagagggtacatctcttgtggatcaattcaagtggagtgtacatccacttggttgttcaaagagaacaagggagagtacatcccttgtggatctttgcttttaaaggattttacaaggttattggaaatctcaagaaccggtggttgcttggagactagacggctgagtgtctgtgctcctgttccaaggctgacatggagggttgacacgtgtctcagaataccattagaagttgatgagtttgtcgagcccccagcctggacaagtgttgtccgagttgtttctgtcaagttgttcgagatggacatgtatttgatcttgcaggctaagtttggcatgtcaggcgtgtgtggtgcacatgcaatactcttgcatatgtttcactcacggagtgggcacaaactggagtcgtggtgcatgggtcaccgttactttgatttcttgcttcctttccttctgcttgcaatcccttttcttcttccttcactttcttcgattcttcaagcaaccatgatggaccgggaggtcatttcaattggcagttcctcctcggaggatactcgtcgtggtgtctctgatagtaagtcctcctcttcagagagggtgaggtcttcgtgttgtactggcggggacacttctaaccctgttatcattgacatttaa

SEQ ID NO: 101673 - DNA, 177 bp, Glycine max
  Peptide Sequence Number=SeqID_218451
gtgccttcagccaggctcagcgcaaggctagcactaagcccaattccacttactcgcgctaaccgcgagggtggtgctaagcacttaggatacacaccttttgagacttggcacagaatttttagaggcactggtgcacagcattccacagttcctattttaggaaaagagccctag

SEQ ID NO: 101674 - DNA, 177 bp, Glycine max
  Peptide Sequence Number=SeqID_218452
atggttgaggtaggaaccggtgcatctgctcaaagaaataggaaccagtgtagttgctcaagaccctcatacaaaagaaatggttcacaagtcgagggtctacaaatccaccttgcactttgtgccaatagcaaagagataaggccaaccggcatcaactctgacaatgcacaatag

SEQ ID NO: 101675 - DNA, 201 bp, Glycine max
  Peptide Sequence Number=SeqID_218453
atggaggagccaaacataaggagctggaggggtgcagcactgaacacctgcagcaggagggcacttgctaggagtaaccataaggtggaggagatgatggttgtagtggtggtggagcaagatatggaagtggtgttgagggttgttgttgacaagggtattcacatttggagcaattcagacatgttgggggttgagtaa

SEQ ID NO: 101676 - DNA, 1199 bp, Glycine max
  Peptide Sequence Number=SeqID_218454
atgcatggaggggaaaacaatgtgtcccctgtatcaaaagtctacttgacgagtgagtccatgcacgaaaggctgagcgacgtgtctcgtagccatgaaacagtggagagtggcgatcaaggcactagaacatgttggcgacaatggctaggtaaggtcgggacaaccacgttgctagagattcctaagagggttgaaccatgcaatccaagacctaaggccacatccacacctaagcctagattagtgattccagaattgactaaattggctacttttgcacttttcattagtgttaaagatccttccacctttcaagaggctatgaaaaaccaagagacagatagattaatgggtggtttagtggaggagatagagtttttgcataagaatcatacatgggagctagttgagctttatgagggcaagaaagccatagagcaaatgagtgaacaagatgaaacctttagtatcagaaaaagaaggggaaaagttcaaggctcgcttagtaaccaaggggtatgcatagtagaaggggatgtgaagacaacctttcttcatgatgatttagaagagaaaaattacatggagcagccagatgggttcaataaaggtggaccaagacaattggtttgtatgttggagatgtctctgtatggattgaagcagtctccaaggcagtggtacaagcagtttgattcctacatgcttcagattgactactggcgatgtgagtatgactattgtgtttatgagtttgacatgaaggacttggttcgtgccaagaagattcttgtgctggagggctacattgagaaggtgttaaacaggttcaacatgaggaatgtgaagcatggtgatccttcagttgtgagatatgtgaattctgactatgttggtgatctagatgatagaaggtctacaacatggtatgtctttactcttagaggtgggcctgtttgttggaagtccattgttcaatctcttgtggcaatgccgacaactaaagcagagtacatggaggagctgggcattgaacaaggtggagttcagttgcattgtgatagtcaaagtgctatcgatttagcaaagagtcggattcacacttcaaagaatacagttgatatgttaaccaaggtgatcacaactaagaagttcaagcatttcttggacttgttgaatgttgttcaatgcaagac

SEQ ID NO: 101677 - DNA, 255 bp, Glycine max
  Peptide Sequence Number=SeqID_218455
atgaagttggtagtggatccatggacatcgagatcccttgtaccgaaagtcttcctgaagggtgagtccatggatagaggtcagacagcgagtcccgcagatgttgtggtagtgcaaataactaaagtctaccatagaatacttgtggataaaaatggcttccacttgagggagggtctaccatgtgaaaaagactcacacttgtgggagagattgttggagtacaagtgtgaggtgaagtttcacatcgagtag

SEQ ID NO: 101678 - DNA, 1032 bp, Glycine max
  Peptide Sequence Number=SeqID_218456
atgaagaataagaatggaaaacttaaatttgagaagttcacatggaggattcagaacttctctaaattggactgcaagaaactgtgctccgacaagtttttgcttgatcaccatacatggaggattcttgtctatccaaagggggctgatgtgggctacttgtcaatttatttagatgctggtgttgttaatttgccttttggctggagcaaatttgcacatttcaagttctctttaattaatctggccaacggaaaaatgactaaaataaaggagactacaaaaatgttcaatgcaacagaaattgcttggggttttccaaaattcatacccttagatgaactttgtgactctagcagtgggtttattgtgaatgatacctgtataattgaagttcagattttggttagcaagtcagaacaggataatcaagtaaaccaacaaattaacaagattgataataatcatgatattgataagcctattaaacacacggacaatttcttacccaaggaaacgctcacaacctcatttggtgagctagtcgattttcggggtttagggaaaatagagcaagtttttgttccattgttagaagaagtatgttctcgacatccctcactcattgacagtcagcagaaaagaagtggcaggtttgttgaatgggcattcacagctttgggtcgagttctacattttctcaagactaaaaaggtgaaagatatgaatggtgatgcttgcaatcatcttcaaattttatgggaggagctgaagatgtttagatttgatttgacttggctggaacctcatgttcaatctgccttgggtatgaaaacttgtattgaaagatctgttcagatgaaaaggatgggggaggatgtgactgctttagagatggaaacaaagaggttgaaggcaaagatgattgaagcagaggtaaaccttgaaatagcaagaagaaacttaatgaaagaaaaagaaggctttgaagagtgtgatttggatgctgaactgggatatggacgaccataa

SEQ ID NO: 101679 - DNA, 1295 bp, Glycine max
  Peptide Sequence Number=SeqID_218457
gttgtcagcattagctttgattaacttgaaggcaagatttgggtggagtgacaaaagcttcactaaattgcttgtgttattgaagaaaattctccttgaagataacacgttgctgaaagatcagtacaaggcaaagaagattttatgtcctgtgggaatggagtaccagaaaatacattcatgccctaatgattgcatattgtacgaaaatcaatttgtcgaaatgtgcaagtgcccaacatgtggggtatcacagtacaaagtgaaggatgaagaatgttgtgatgataaagcaacaaacaatgatcatccaacaaagacaattgatcgtttgtatccatattttggagatgagccaagaaacctaaggcttggtcttgcttcggacaaaatgaatccttttggtaacttaagcactaaccacagttcatggcttgttttgctgatgatttacaacctccctccttggttgtgcatcaagcagaaatacattttgttgtgtatgatgatagcaggtcaaagacggctaggaaatgatattgatgtctatctcattccgttgattaaaaacttgagaaaattgtgggaagacggggttgatgtgtgggataggaatctccaacagagcttcaggttgtgttcaatggacatcgtaactagctctgggaagacccaaaagaaggcatcatctgacaagaacatatggaagaaaaggtcaatatcattggatcatccatactggttcgatctagatatgcgacattatataaatgtaatgcatgtcgataaaaatgtctgtgatagtttaattgacacccttcttaacattaaaggcaacacaaatgaaggtttaaaatgtcgtcaagacctggttaacaaagaaatagagtcaccacaagaagatgcagttcatggtcatgttagtcaagactctgacactgcaatggaggtagacataaacaattcatctttaagcacaaaagatgtgaatgtttggaattctgattatgatggaaatgctattgttcagttgctattagatcatttccttgtcaaatgcaacccctcttatatctgcagctacaagggggcatacaatattgttgaacttttcttgtcacatgaccctagtcaactcgagttatgtggatcaaacgggaagaatgctcatttgtctgcctgcacatggctgtacgggaagttacagggtcttaataagcaagagactgcaaaaagatacgggaaggagaaggtgcacgaatggcataagagttttgacattcctcctcccaagg

SEQ ID NO: 101680 - DNA, 492 bp, Glycine max
  Peptide Sequence Number=SeqID_218458
atgcctcagatcatagccaaagcgacccaaagtgccacgccacccaaaatcatcggagccctgcatttggaacttgaacccgattcatcaccaaccgaaccccgtgaactttccggcgaactcgccggcgcagttcccggcgaggcactgctggatggtagtgtgattggtgaacctgccggcacggccgatgaaggaattccggcaggagaatctggcgtaggcgcctctgccaccggcggagtaccgaccggagaactcaccggagcaaccgtcggcggaggagtcgctggggatggagccgacttcgccggaggggcagtcgccggcggcggggtggacccagatggagaaactgccggagattgtgaaggcggtgataaagtcggagactttgcaggaggcgccggatgggtcgccggagagggtggtttggccgtcggcgacgagggtgatgacttgggtgaaggggcaggagcattgtctgcgtga

SEQ ID NO: 101681 - DNA, 681 bp, Glycine max
  Peptide Sequence Number=SeqID_218459
atgtggcgtcttaacaaacataatggtcgacaatccattgagatggtgttgatggaccatacgggtacaaagattggggcaactctatggcaagaattgttccctgaatttgagcccaagttgcgttgtggtggtgcatatgttattcaaaacatgaaggttgttgatactcattctgactacaaaacaacgtctgtcaaagaggtggacagacctgagattcctcctaatgttcatgccattacttcatttgctgatataatttcaggcgttgcaaaacctgatactttagttgtgattgaacgcaaaacagttaatccagcatacagagtgactatcaagttgagagacaacagtcatgttgagatcatcatgactgtgtgggaggaatatgctcttcagctggatgatgctattgagaaaaaccattttgtgcaaaagccattggttgttatgctaactcttgttaagatcaaagaacccaaggacaagtatcccctcagtgtacaaaatataaagcatggttcgaagttgtatgtgaatggtgacaaaaacgaaattcaacagttccatgatagtttatgtgttccattttatattggcggtctagatgatgagggtggtgtttctcagtcacagtctacccagaattgccaagataagtttttgcataatgcttaa

SEQ ID NO: 101682 - DNA, 1311 bp, Glycine max
  Peptide Sequence Number=SeqID_218460
atgcatctttgtttgacggaaattgaaaacctcttgcaagccaacaggaaaagcttacgagattttccttcgatgccatatccactaggatatgccgccaagatgcaccaaaataatcttatctacaatgaattggcttacaacagggagatattggctgccaaatttgacaaatgctaccagtcgctaacagatgagcatgcttctatttttaataagattatgcatgtggttgcaactcaatcaggtggagtttattttctatatggatatggtggcacaggcaagacatttgtgtggaaaactttatcatctgctatacgctctactggcggaattgttttaacaatagcttcaagtgggattgcctcaatactattgcctggtggtagaacaacacattctaagtttgctattcttgtccctgcaacaaaaaattcgacatgcaatatccatcaagggagtgatttggctgaattgttgcatatcacaaaactcatcatatgggatgaagctccaatgtgtcatagatacagtattgaggcccttgacaaaagtttacaggacatcatgcacaacaacaatccttttggaggaaaggtcattgttttttgtggtgatttccgtcaaattctacctgttgtgccaagaggtaatcgttctgacattgtctatgcaactttaaattcatcttacatttggaaccattgtcaaattctaaagctgactaaaaatatgcggttgcaatcaaatcctactgatcattccaacttggatgaactaaaacaattttctgagtggttgctagacataggtgatggtaaacttgcagaacctaatgatggttatggtgaaatcaccatcccatatgagtttcttatcaaggactttcaagatcctatccagacaattgttgaagcaacatatccaaacttattacacaactacagcaatggcgatttcttgcaaaaaagagttgtccttgcctctacaaaagatgttgttgataaaataaatgactatgtcctgtctttgattcctggtgaggagaaagagtattgtagtgctggttctgttgacaaatcagatgaactactcagtccttcatttggagtactaacagctgaatttctaaactcattgaagacatcaggcataccaaatcacaagctcataatcaaggttgatacgcctatcatcctactacgaaatctggaccaagctgatgggttatgcaacagaactaggcttattgttacaagacttggttcaagtgttgttgaagcggagattattactggcctaacatag

SEQ ID NO: 101683 - DNA, 879 bp, Glycine max
  Peptide Sequence Number=SeqID_218461
atggacgaaggcgagggagggtacggtgagagcggcgatcccatggatcagttccaccgtaacgaagctatatccgccgtcgccgacgagggtttcttgggcgaggaagaagacgacgattacgaggacctttacaacgacgtcaacgtcggcgaagggttccttcaatcgttgcgcaagaacgacgattcggggttccgaaacgacgaggtcgaagaaaagaagcctccgccgccgccgccggttccggatgccgccggggtttcgattccgggtgtcggtggcggtggaggaagcggggttgtggaatctagggtttcggggagggttgatgggtttcagaatcaagggtatagagggaacgaggtgggtgccaaaggtgggattaggattgaattagggaaccaatctggaaatttgagtgaaattgaggatcagggtgggaatgatggtgctgcaatgcaggggattggacagcaacctcatggtggggttgttgggattgtgggaaatgagggtttggtgagacaaggtcaaggtggtgttggtggtggtggaggaggagggaatgttaatagggttggtggaaatggtgttggaaacagtgtgagtgctgttactagtgttaatactggaggagttggaggtgctggtggtggtggtggtgctgccggttctggtggtactatattgtttgtgggtgatttgcattggtggactactgatgccgagcttgaaaccgagcttagtaggtatgggcctgtgaaggaggtgaagtttttcgatgagaaggcgagtgggaaatcaaaggggtattgccaggttgagttttttgatccttctgctgcaactgcttgcaaggaagggatgaatgggcat

SEQ ID NO: 101684 - DNA, 786 bp, Glycine max
  Peptide Sequence Number=SeqID_218462
atgtgtcatagatacagtattgaggcccttgacaaaagtttacaggacatcatgcacaacaacaatccttttggaggaaaggtcattgttttttgtggtgatttccgtcaaattctacctgttgtgccaagaggtaatcgttctgacattgtctatgcaactttaaattcatcttacatttggaaccattgtcaaattctaaagctgactaaaaatatgcggttgcaatcaaatcctactgatcattccaacttggatgaactaaaacaattttctgagtggttgctagacataggtgatggtaaacttgcagaacctaatgatggttatggtgaaatcaccatcccatatgagtttcttatcaaggactttcaagatcctatccagacaattgttgaagcaacatatccaaacttattacacaactacagcaatggcgatttcttgcaaaaaagagttgtccttgcctctacaaaagatgttgttgataaaataaatgactatgtcctgtctttgattcctggtgaggagaaagagtattgtagtgctggttctgttgacaaatcagatgaactactcagtccttcatttggagtactaacagctgaatttctaaactcattgaagacatcaggcataccaaatcacaagctcataatcaaggttgatacgcctatcatcctactacgaaatctggaccaagctgatgggttatgcaacagaactaggcttattgttacagacttggttcaagtgttgttgaagcggagattattactggcctaa

SEQ ID NO: 101685 - DNA, 258 bp, Glycine max
  Peptide Sequence Number=SeqID_218463
atgaagacctacgatgcaaatgttgatggtaaggaggtcaaactagcggagggtcttgcgcatgttgttgctagaacgatcattgacctagctcatctcatggtaggagagggcacgttgaggtgtgagggggtgggagagggcattgagaaagaaagaaaagatggcttttggtttggtttggaagaggagcgaaagggtggacatttctgtggaacctttctttgtggtggcattattcaccatgaccaagcctga

SEQ ID NO: 101686 - DNA, 462 bp, Glycine max
  Peptide Sequence Number=SeqID_218464
atgacccttcgctcagcgcaaatgcacaactcatccttctttcggattcttccttgcgctcagccgaggagtgttgcgctcagcggatggctcgctaagccagaagattggcttagcaaaaggtcatgtcaatggtggcgacaagatggaggcaatttaagttcaccctcactagaaaatttgtgtttgctaacactgacggccaacaaacacatgatccttcatcaaaatatgggtatcaggaaatgggcacaggaaattcaaaaacacaatgactgcccccacgtactatctcgtgggggttatgatttgcttgagaagaagctattagacgagaaaagaaggagactacaagaggaggcaatgctgactgaaaatacaacaattattgacaacccccatctccaattcaaagacatgttaaatggaaggtggcccgcaccaagcgttatggccatatga

SEQ ID NO: 101687 - DNA, 204 bp, Glycine max
  Peptide Sequence Number=SeqID_218465
atgacaaaattagaacaaaaggcagagatgaaagtggctgaatttagaagtatagaacccaaggaagagaccatattacagttgcagatagccaaaatcacaatacaaggcagagatgtagatggccaaacggcccgaacccaaggcagagatcaaaatgtgaatgcccgaagtcataatgcacaaaaagaaggaacaaagtag

SEQ ID NO: 101688 - DNA, 162 bp, Glycine max
  Peptide Sequence Number=SeqID_218466
atggggaggaagccacgtggtgtgagagggctagggttgaataaaggatcatggataccggaagaagacatgaagctcgtggctaccaatgtaagacaattcacctgcagcgaaagctcactctcatttggaagcattcagaatagcaagatcaatatgtga

SEQ ID NO: 101689 - DNA, 423 bp, Glycine max
  Peptide Sequence Number=SeqID_218467
atgaccaagaatagcgtgttgaaagagcataacaagactttcctaaattggtttaaagatccaatctttggtgacgataatgcttctaaaacgctaaggaagttagcaaataagcctaaaagaaatcttataacttggcacatggatacaccactcagcttccctcttcctcatcttgagtcagcagcaccttcgccatctacgtcgaataagacaagaaaagcaacacagctcagatcattggctactagactagttgaggcagagagatcagtgattcatgtggatcttgccactgggaaagtcgaaggtccccatagaaagaaattaagaacgtatttggggatcgtcacttgcgataaggtggatgtcacatatgataattggaaacaagtccctatagctcaaaaggatttgatctag

SEQ ID NO: 101690 - DNA, 321 bp, Glycine max
  Peptide Sequence Number=SeqID_218468
atggcgggaactgattcacacacaactatgattgatggcctgggtgttgctggatggggagttggtggaatagaagcagaagctgcaatgcttggccagacttgtgtggttttgaccattggaggagttattcccatgagcatggtcctaccaggtgttgttgggttcaaattattaggcaaactacgagatggtgtcacaactactgacttggtgttgattgttacacaaatgctaagaaagcatggggttgttggcaagtttgtagacttttatggtggtgataacaaagaaaaccattttccttttaggaagcattaa

SEQ ID NO: 101691 - DNA, 504 bp, Glycine max
  Peptide Sequence Number=SeqID_218469
atgactaagtatgctggaatatcaagcaagcttcacccgcgaggaagtatccagcatactgacattgactcatatttctgcacaacatcaaagatttctcatttagtttttaagttgctagcatacccaaatacttcaggttgcattcaatgccacaaaaaaactgatgttaaccttggcaacggttattgcactcctgctcaattgagaaaccatcagcttcagcccatctcgaaaatgagcataacattgtcaacaatgacaagtaggtgggcaccacactacccgaactttgcccactttagctatgacggagccatgtacgaagtacaaataagacaagaccaagggaaatttttctttgctgatggcctcaaaaccttcagaaaagacttagggatctacgagtccaccaccatcaattttttggcctatgaacaaaaatggatattcaacctccacttcactcctccactggatcaacaatcatgcgacagacattaa

SEQ ID NO: 101692 - DNA, 447 bp, Glycine max
  Peptide Sequence Number=SeqID_218470
cccaaggtagcagattttggcttgtccaagctacttaacaaaaataacctcaataacaattcaagcttttcaatgatcagaggaaccagagggtatatggcacctgagtggatttacactttaccaatcacctcaaaggttgatgtttccagctttggaattgttctcttggagatgataactggaaaaagtccaacaatggacattgaaacggttgatggaacagagccacacgatggtaggctggtaacatgggtgagagagaaaaagaggagaacatcttggatagagcaaatattagatccttcaattgaaccaagttgtgatgtgaataagatggaaattttggctacagttgctttcgactgtgttgaggaagacaaagatgttaggcctaccatgaagcaagtgattgagatgcttcaaagctatgaaagtgatgcataa

SEQ ID NO: 101693 - DNA, 825 bp, Glycine max
  Peptide Sequence Number=SeqID_218471
atgaaggggatacatttgaattccccaacccagtgttctttacgtcaaagcgagacatcacacttgaagcctttgaaaaggagaattcaccaaaaggtcatacttcaaccacatgaccgaatcagtgatatctcattagaatacccccaactagttggatgcggaatgctcaagtttacgtcagtaaaagttgttgacgatgatgacgttaaagagtttggcttacctaacaaagaacttggtccctttagtgatgatgaagataaaattttatgcaaccaaccccatgaagaacgtgatgaagaggctgatcttataccttcatcaacaactgcaccaacatactacattgcagcacacatgcataatgttgactttaaatctaatttccaagattttgaatacggtcatacgttggatcgtgaagatgttcaacattcgatgggaaccctctttgaagggatgtgctttgaaatcaaagaagaagttcaacatgttttgcaacaatatcatctaattgtcaaatgtgatgacgatggatgtgcttggacgtacaaaacagcatacatcctagcaagtaagaaatgggaaattagaaagctccatgaaccccatacatgctcaaatcctgccatatcacaaggtcatgtaaaattatcttatatgctcatcagtaaaagtatccgcatgttgatcaacaactatagatcaacttcagtgccaaccttgatagcacatgtcaaaagcactgaaggatacactatgatgtataggaaaacatggttggcaaagcaaaaaaccattgaaaacatctatgacaactga

SEQ ID NO: 101694 - DNA, 186 bp, Glycine max
  Peptide Sequence Number=SeqID_218472
atgggaaagtttaaattgaattgtgatggggcagttgctgttggtgatgtgactggatgtggaggaattatcagggaccatgaaggtcatatggttgtagcttttgcaaacaacttaggggatgtttattcttggatgcacatatatcttgaagccaatcaagtggcagatgttctgtccaagtaa

SEQ ID NO: 101695 - DNA, 795 bp, Glycine max
  Peptide Sequence Number=SeqID_218473
atgttctgtgctggcttctctcaagttcgtgaaaatgccttctcctttgatatatggttcaacgagtcccacactcataacaacagcaacaccgtggtttggattgcgaatcgcgaacaacccgttaacggaaagttatcaaagatttccctcttaaacagtggtaaagttgtcttggttaatgcaggtcaaatcatcacttggtcatcaaacacagcaccacatgccccagttgagttgcatctccaagatgatgggaatcttgtgttacgtgagctccaaggaaagatttgtggcaaatttcgattccacaaccgatactcttcttcccgccagactaacctttcttctggtttctataagctgctctttgacgatgacaacgttcttcgtcctgtttatgatggttctgatgtttcaagcacatattggccacatccttggctaagaagttgggaagctggaaggtttaattacaacagcagcagagttgcagtgttagattctcttggaaatttcaattcttcggatagttatgccttttccacggatgatcatggcagggtgatgccaagaagattaacacttgattctgatggtaacgttcgtgtgtacagtagaaatgaggctctaaagaaatggtacgtttcatggcatttcatatttgatacttgcaccattctcgggatctgtggcgctaacagctctagtaattatgatcctcaaaagcaaagaagatgctcctgtctaccaggttacagagtaaagaatcacagtgattggtcttatgggtga

SEQ ID NO: 101696 - DNA, 414 bp, Glycine max
  Peptide Sequence Number=SeqID_218474
atggagatgcaaaaagaggccgaagaaaaacaacaacagaaaatgcttgaatctgaagagctattcgacaatattcatgcacaccttggacctcatgtcaatgctattgaacctttgctaattgaagctaacttggaagaacccatggaaagaaggttccttgctgaacatatggagaccaatttactgatcaagaacaccctggttgcctccattcgtcaaacactagtctacacctatacctcaaccacctccaccaccagcaaccacattatgcaacctcaccttaaggttcctgcattaatggttcctacatcagaggttgtaatccttactgatcctgttcctactcctctgccttcaccaccaaagtcaccacgttctacccctcaaccttcgtccactgaaggttga

SEQ ID NO: 101697 - DNA, 1341 bp, Glycine max
  Peptide Sequence Number=SeqID_218475
atggctggcggcggaggtggggaccggccgccgtggaaggaggcggcgccgccacgacccaccatcactctgccgccgcggtcgggttccatggagacccttttcaatggagggttcagccctggtcccatgactctgctttctggctttttgggtgatggggatgatggaaagtccttctctcagctcctcgccggagctatggcttctccggtggccggagctgtcgccgacggagtgatggactcacctagtctcttttcaccttctcaggccctaacacaggtctcagctcaggcttcacaagccaactcaaatatgcatatccaggctgaacattcattgacacaggcttctgcagctactttcaatacaacacaacagctgattccacccttaaatgcagactcttgggccacaatgactgaatcagcagatcattctcattctgaacaaagattgcaatcttcattgttgaatgttgataagccggcagatgatggctacaactggaggaagtatggacagaaacaggtgaagggtagtgagtttcctcgaagttattacaagtgcacgcatccaaactgttctgtcaagaaaaaggtcgagcgctcacttgagggtcatgtaactgcaattatttataaaggagaacacaaccatcaacgtcctcatcctaacaagcgctcaaaagacaccatgacttcaaatgcaaattcaaatatccaagggagtgtagattcaacttatcaagggacaactacgaactcgatgtctaagatggatccagagtcaagtcaggcaacagctgatcatctatcaggaacaagtgaaagcgaggaagtaggcgatcatgaaaccgaagtggatgagaaaaatgttgagcctgaccccaagaggagaaaagcagaagtctcgcagtcagatccagcttcttcacataggactgtcactgagcctcgaatcattgtgcaaacaacaagtgaagttgatctcttggatgatgggtatagatggcgaaaatatgggcagaaagttgtcaaaggcaacccttatcctaggagctattacaaatgtacaacccaaggttgcaatgtgcggaagcacgtggagagggcttcaacagatcctaaagctgtcataacaacatatgaaggaaaacacaatcatgatgtgccagcagctaagaataacagccacactatggccagcaatactgcatcacagttaaaatcgcataataccaatcctgagaagcataattttggcagcagaggtatgggaggaaatgaacaacagccggttgcacggcttcggttgaaggaagagcagatcacctag

SEQ ID NO: 101698 - DNA, 291 bp, Glycine max
  Peptide Sequence Number=SeqID_218476
atgtctaagtttgttcccttagactatggccatcaagctctccccctaactaaggatgatgtatataatgttgggatgatgaagatgcgatgtgggttgacatatcaatggccaagctatcctccaggtctatatatctattgcaaaactactatcaaattcatgcctaacagaatagctccaagattgccacccttggacctaatgaagcagaaaaacaaagttcctccccacaactttgattacacattactgctccataacttttattcctataatcaaggactttaa

SEQ ID NO: 101699 - DNA, 1111 bp, Glycine max
  Peptide Sequence Number=SeqID_218477
aggattgcctgtgaggtcgaagtttaagcaagacccgctctctgggttgatagctcatatcatgtctcttgctatcagcttgcattttcatggttgcttgcgctttcaaaagtttcttgcgaatggcctgaaaagtttcctctcaaatggccaacatgttgtcgacaacatcaagattagaggaccctactatgtactccgaaaagttgaaaggcttgcaaccaaaggtggtagcattcctaaatgcacgcctttcgaaaatcggtccatcactacaaggatgacggtgttgctgtggtacggtggtagtttgatgatgaaatcctgggagaggtcctcctatgggcagtgcgggaccgtcttgaccagtagaaattttctgaaactcgagctatggtcttcacgatccctgtatgtccgcctgtgggtgtggtgtgatattccgttagcagagtggaaattatcaaaagttcccttggatgattatccaactgacgttgaagttctttcaaaaaagtcaaacaaggaaccaaaaggatcatggaaagagagggtccatgttcaggcaatcgagaaagtgcatcagcagcttggttgtgagctccgaagcgatattgaatctgatagttgtaccctattaaccgtgccaggtgccgtggtattcaaagaactggttgatcttgaagatccaaccaagggagctacgagatatggacgagggaattggtggagcagtggacaacaaaggggaaacacggtggaggagttcatcaattttgtgggtcatcatggtcaagacaaggagagcaccaatgatatgggtctgcaatcagaagttggtttcgaggaccatggcctccatagacaaggaagagaaatcaggaaaaaggaaaagggtaagggtgagggagggtattattggcgttacaaagaagcaatggctttgacagctgatcctattacttcacaggttgtcttccgaggattcaaagacactaaaactcctttatatgccactggagatgtaaccaacatagcagtggatcctttattcatgtttgtattccgcttagatgttagtggtgcagccatcacccatgttatatcttag

SEQ ID NO: 101700 - DNA, 1632 bp, Glycine max
  Peptide Sequence Number=SeqID_218478
atgcaggggattggacagcaacctcatggtggggttgttgggattgtgggaaatgagggtttggtgagacaaggtcaaggtggtgttggtggtggtggaggaggagggaatgttaatagggttggtggaaatggtgttggaaacagtgtgagtgctgttactagtgttaatactggaggagttggaggtgctggtggtggtggtggtgctgccggttctggtggtactatattgtttgtgggtgatttgcattggtggactactgatgccgagcttgaaaccgagcttagtaggtatgggcctgtgaaggaggtgaagtttttcgatgagaaggcgagtgggaaatcaaaggggtattgccaggttgagttttttgacccttctgctgcaactgcttgcaaggaagggatgaatgggcatgtttttaatgggaggccgtgtgtcgttgcatttgcttcaccttttaccgttaagaaaatgggggaggctcagataaacagaaatcagcagatgaaccaatctgctgttcctcagggaaggagggggcctgctgacgcaggggctaaacctggtgggagtaatatttcaacgggtggtaattaccaaggtggagaggggaatagaggttatggaagaggaggaggtaactgggggagaggaaacaatcctggtatggggaatagagggcctgttaatccaatgaggaacaggggtggtgggatgggtggtagaggtataatgggccatggtggaaatggatttggacagggtatgggtggtacccctccaatgttgcatcctcagtcaatgatgaatcagggttttgatcctgcatttggtggtcccatgggcagaatgggtggctatggaggctttcctggtgctccggcgcctccgttttcgggtattttgccttcattccctggtgttggaggtgttggtttgcctggagtggcacctcatgttaatccagccttttttggaagagggatgcctgttaatggtatggggatgatgcccggatcagtcatggatggtcctaatatgggaatgtggtcggatccaaatatgggtggatggggtggtgaagagcccggtggtgggaaggctggagagtccagttatggggaggaagctgcttcagaccaacagtatggtgaggtgagtcatgatagagctgggtggcctatgagggaaaaagatagaggttcggaaagggactggtctggttcttctgagagaaggtacagagatgatagagatcaaggatatgagagagatgcatctagagaaaaagatatgggtcatgatcatgaatggtctgaaagaaggcatcgtgatgatagagaaacgggcagagaacgatcccgtgaccgtgaacgatctcgagaccgtgatcgtgatcgtgaccgtgaaaaggatctccgtgagcgtgacaggcacagagaagatagggatgggtatgcagatcatcataggttcagagaccgggaagcagagcacgatgatgagtgggagaggggacggtcatcaaggactcacagcaagtcacgattatcgcaagaggaggaacaccattctagaccaagagatgctgattatgggaagaggcggcgtcttacttctgaataa

SEQ ID NO: 101701 - DNA, 636 bp, Glycine max
  Peptide Sequence Number=SeqID_218479
atggcggactcggacaacgactccggcggcgcgcacaacgccgggaaggggagcgagatgtcgccgcgggagcaggaccggttcctgccgatcgcgaacgtgagccgcatcatgaagaaggcgctgccggcgaacgcgaagatctcgaaggacgcgaaggagacggtgcaggagtgcgtgtcggagttcatcagcttcatcaccggcgaggcctccgacaagtgccagcgggagaagcgcaagacgatcaacggcgacgacctgctctgggcgatgaccactctcggcttcgaggactacgtcgagcctctcaagggctacctccagcgcttccgagaaatggaaggagagaagacagtggcggcgcgtgacaaggacgcgcctcctcctaccaatgctaccaacagtgcctacgagagtcctagttatgctgctgctcctggtggaatcatgatgcatcagggacacgtgtacggttctgccggcttccatcaagtggctggtggtgctataaagggtgggcctgtttatcccgggcctggatccaatgccggtaggcccagtaaacatatatggtggaaagatctagctaagattgagcataaggaaatattgatcgccacgcgaatggtatga

SEQ ID NO: 101702 - DNA, 3366 bp, Glycine max
  Peptide Sequence Number=SeqID_218480
atggaaggcagaacagaaaactccaatgacactacatgtcccaagaaatcaagatcactggatcttaaaagtctatataaatcaaaatggacagaaaacacggcaaagacgaacttaaagaggatcggcaatagtagtgggggtggtgatgagaagaggaagaaaaaaaaggctagaaaggaagtctctttaagtagcttagaaaatggtgatggtagcagggagttgaagttagggttgagtcaaagatttagtagtagttgtagtagtgtgctaaataaaatttcatttagtgttggtgatgatgatgttcagattcccaagaggaagaggagttttgtggggaggaagaaatcggaacttggtcaagcatcaaaactggtggagcagcctggtctgaaaattggctatggcgatcaggtgccaaagttaggtagtgatgatttgggcaatggggttgagtctttcaagattaagcataggaaagaatttgatgaatttaaggaaaataggattagtgattcaaattcagttcagcatgatgtatcaaaaaattcagttcagcatggtaaggagaatggggattgttcatttcattctgttgtaaatagtggtgattcttctttatcaaagtcacgaaggaagaataggaagcgaaaggcttcagcattagatagaactaaggtttccaaggaggctgaacctttggtttcaagttgtaaaatatctgatgatttgcaagaagatgaagaggaaaatcttgaggagaatgcagctaggatgctatcttcaaggtttgatccaagctgtactgggttttctatgaaaggttcaaatggtttgtctgttttccgatcttctagtcaaagtattgttaaccgtggtttgaattctcagttaggttcagaatcagcatcagctgatactgctgtcagagttttgaggcctaggaaacaatatagaaacaagggtaattcaaggaagaggcgccatttttatgaaatccttttaggtgatgtggatgcatattgggtactgaatcggagaattaaaatcttttggccattggaccagagttggtattatggcctcgtggataactatgatgaaggaagcaagctttatcatatcaaatatgatgatcgagatgtagaatgggttaatcttgaaactgagagattcaaactcttgttacttcgtagtgaagttcctggaaatgcaaagggtgagagagccttaacgaaacgtagcagttttgatcaccaaaagggaagcaaatccagaaaagaaaggcaaagaacagaagcgaatgcaggggatgatcgttgtggtgatagcagtttggactcagaacctataatttcgtggttggctcaatcttctaatcggcttagatcttttcagggcattaagaaacagaaaacttctgttacagttccaagtacaatgtcatcattcttatatgatgaacctgttacagcaaaggggcatttagctaagagttctttgaggggtgttgaaaataatttctctagttgttgtgtatcacaagataaatcaagtgatgattttaaggataagtcctcattgcaatgtgtcactcgtgctaaagatggaaaacagcctatggtctatttcagaaggcggcggatttttaagccagctccaatatcccctcatatctctgaaagaaaccatgctagtataagtgcatccggttctgttgcctttgaccatatgtttggtggggttgagaatgtgaaaaatccaattgacaacagggttgaggttgggggcccattgttcttcacttacaaggctggagtatcaaattttttttgggacatggagtcagcatcattcaaatttggctttaactttccaatgcgtttggtgttgagtgacttttttcaatcagaaaatgtgtggttgctttacactgttttgctgcttcggttcggtacagttatggccaagtggcctagagtttgtttggagatgctttttgttgataatgtggttgggttgaggtttctatcatttgaaggctgcttgaacatggctgcagcttttgtcctttttgtccttagggtgtttcatcaacctgcttgccaagggaagtatgttgacttgcaatttccatgtacatctattggattcaagttttctagtgttcatgttattaagatgccacttgtgtttgagttctataatttctctgaagtgaagaattcaaagtggatgtacttggattctaagctaaaagggcattgcctgctcagtaagcagctccagctttctgaatgcacatatgataacatccaggcacttcaaaatggatcaagaaggttctccataacttctatcagtgggccttcctcagtcaaggtcacacagaagagtaggccagggattaacatcattggtgtttccaaagggtccactcaagctgatactcttccatattctgatgctggcgagaggaaacttcctccatttggtctctcttttgctgctgcacctacattttttctttgtttgcatctcaagttgctgatggagcagtctgcaacatgtataagattttgtgatcaaacaccaatatttgatcaggaagaccctggtttgatgacaaatggatgtactagcactgatgattgctcaaacaggaattctgaagttattcttaggagaggtatggagactttgtcaaacagtgctgcagatgatggagggtcttgtgctgactcagataatccctctacttgtaatgaccaaattctcactcgaaattaccagaacattggtcttaacggtgctattacttccatttctcatgattttgagaggctttgtaaaactcacttacccgaatggcaatcccactatttggagcaagagttagtctctttaccttcaagttctttaaaacatcaagataaggctaatgatggttctcattcttttattggtgatctcagtattcaaattcctgctgttgatcaatttgagaaacctgatgataacggtgatttatgtgatgctgaacactctcctgatttctcttggaatataaatggatgtggtattccaagctccaatccaactgctcacagaagttcttggtatcagaaccggaataattccttgtcattgggatttcagtctcatgtgtggtctgataaaaaggttgattctctttgcaatgatttgagcaatggacctaaaaaaccacgtacacaagtatcatactcagtgccttcagcagggtatgaattcagttcaaggcaaagaaaccatcatcagaaagggctttctcacaaacgagttagaaaggctagcgagaagtcatcagatgttgctagg

SEQ ID NO: 101703 - DNA, 669 bp, Glycine max
  Peptide Sequence Number=SeqID_218481
atgaccaagaacaatgccccttctaatggatgcctggacaaggttacaactttggagaagccggccatgtttgctttctgtttgaaacctaggggtctggaatcactgaacaagggattgaaacatcgatcccaaaagaagatttcagtctctgggaatgcaaacagtaatctagatcaggatggcttccacactttcagaagaagacagaatgctttaccttttggcgatgaaaaccaaggccacagttacgattcttttgatgattcatcattggctctgacctcagcaagggtattcttacctcgtgatgctggcagcttgaaatactatcctactagtaatggagcaggatatagaaatcatatcccaaaatttcacaagcccagatatgattcgcctggtagcaggcatcactttcttgctggccctaagaggcaagggattgagcagttggatgcttccgtccttgaggagttaagacaacgtgatgccatggccgaggctcgttttaagtgccatttggctaagctgaagagagatagggctaaaagattgctatataaagtagatgtagcaattcacaaggccattgctactctaatgactgcagaagcaatgaaagcttctgaggactcccttggtgaaattaaagcttatgaggactaa

SEQ ID NO: 101704 - DNA, 651 bp, Glycine max
  Peptide Sequence Number=SeqID_218482
atgatgtggaaaggagggaaggattggatcttggaatttccggataggagtcagtgggctcttttcaaggagatgcatgaggaatgctacaaccgtaacatccgttctgcttcagttagaaacatacctattcctggtgttcatttgatagaagaaaatgatgataatggatctgaggaaacttttattcggagctgtatgtactttcaacaagttgaagcagatgctgagatggctttggatccatgccgtgttctgtatgacatggatagtgaggatgagcagtggatttcaaatgctcaaaattctgtaaaagacaacagtgaattttcttggatctctgaggagatgtttgagaagacaatagacgtgtttgaaaaggctgcatatgctaagaagcttgatcattttactcctgatgagatagaggacctcatgcttaatgttgggcctttgtgtgttgtcaaaatcatttatgaccattggcagcagaggaggcagaagaagggaatggctttaattcggcactttcagtcaatcacgcagcaatcgtgcacgaactcagaggtgcgtcatggaacagcacagcacccctccgctactgaagaacccattgtgtctcaccttgcagtagtggttgttacgctgtga

SEQ ID NO: 101705 - DNA, 267 bp, Glycine max
  Peptide Sequence Number=SeqID_218483
atgagaaaggaggaaagcagaagattgatgatagtgatgaaagtccaaatccaaaggaaaaaaaaggagaaaggaggaaagcagaagaggtcaacaccaacaaagtctgcctccaaagagagaactgaaaaggtcactaaaggaaaaggaaagaagaaagagaagtccagcctcagtgataatcagttacgtgatgcaatctgtgaaattcttaaagaagttgacttcaatacgctaaagatagtgaaactgaataatcttgtataa

SEQ ID NO: 101706 - DNA, 2205 bp, Glycine max
  Peptide Sequence Number=SeqID_218484
atgagtgaggaagaaccagcgaatgaagtttctaagattgattcaaatggaaagagcttgcagaagataattttggatgaaattactgagaaagaggatttggaaactgatggaggaaaagtcttggagaacaatggaatcaaagagttgaaagaaaatattgtaaaagaaattgaagataagaaaactgatagtgtggaaaaggtagaagaggacaagaaagttggtgttgtggaagaagcaaaagaggataagaaagaagatggggtgaaagaagcaaaagaggataagaaagaagacggggtgaaagaagcaaaagaggataagaaagaaggggtggaagaagcaacagaggataagaaagaagatggggtggaagaagtaaacgaggataggaaagaagatggggtgggagaagtaaaagaggataaggaagttgatggtgtgtcatgtgtgaaagaagttgaggaggatggggaagttgatggtgtgaaaaaagtagaagataaaaaaggtgatgagttgaaagaaatagaagaggataagaaagatgatcatatatctgaaaatgataaaatggatgaagacactgagattaaggaaacaatggaaggtgaaccagaaaatggaaaagaggaatctgagaaaccagtagtagatgctatggaagtggagggtggtattaaggagaaggaggagagcaaagaaaatgagaaagttgaagtggtgatggaggaggatgagaaggatgaagatgaggataaggataatattgataagtcaaaagaagagaaggcagaagatagtaagggtgagaaaggatcaaaaaaacgtgggagagggaagatcaatggggagaaagtgaaagaaaaaagaaaagaactgaagaaaacagagccaaggactcctactattgatcgccctgtgcgggaaaggaaatcagttgagaggttggtagcatcaattgataaagatgcaaccaaagaatttcacattcaaaagggccgtggtacacctttaaaagatataccaaatgtggcatttaaattatctagaaggaagactgatgataccttcaaattgctccatacaattctctttggaaggagagggaaggcagttgaaatcaagagtaatatatcaaggttttctggttttgtgtggcgtgacaatgaggaaaagcaaatgattaaagtaaaagaaaaacttgacaagtgtaataaagagaagttactggaattctgtgatgtgcttgacataacaattaacaaggcaacaacgaggaaggaagatattattgctaagcttatagactttttagttgcccctcatgcaaccacaactgtgttacttgcagaaaaagagaagcccagtaagggaacaaagcgcaagcgtgttgtaaaacggggttcatcaagatctgggacaacttcaagacgttctgtgaagaggcagaagaaaaacgaagattctacagtagcgcggagaaagagtgcatctgacacagatgagtcagaggaagacaagaaagatgaagaaaacgaggaggaaaatgaaattggtgttgctgacaaatctgaggatgaaacaccagagaaatctgaaagtgaagacaaaagtgattctgggagtgaatctgaagatataaaagaaaagaaaaaaccttctgaaacatcatccacaaagaaagaatctgctaagaaaagtaaaaatgaaaaaattacagttcccaataaatctcgctcaccaccaaaaagagcacctaagaaaccatcatccaatctctcaaagtctgatgaagacagtgatgaaagtccaaaggtcttttcaaggaaaaagaaaaatgagaaaggaggaaagcaaaagacggcaacaccaactaaatctgcctccaaagagaaaactgaaaaggttactagaggaaaaggcaaaaagaaagagaagtcgagccccagtgacaatcagttgcgtgatgcgatatgtgaaattcttaaagaagttaacttcaatacggccacatttaccgacattctgaagaaacttgctaaacaatttgatatggatctcactccgagaaaggcatctataaaatccatgattcaggaagagctgacaaaactagctgatgaagcagatgacgaggacagagaagaggatgctgagaaagatgaagccccatctacaggccaagaggttgaaggctga

SEQ ID NO: 101707 - DNA, 5053 bp, Glycine max
  Peptide Sequence Number=SeqID_218485
ggtttcaaatcggctagagattctcaaaccctaatccgtcaattcgcgctcgtgatcttcgatgtctgtgggatgaatcaattgttcggtggcatgtcggttgagatccaagaaaatgtccatatatgtatgatggcatgcatagcagagaactccaatgacactacaattcccaagaagtcaagatcactggatcttaaaagtctgtataaatcaaaattgacagaaaacactgcaaagaagaacttaaagaggattggcaatagtagtggtggtggtggtgagaagaggaagaaaaaaaagactagaaaggaagtctctttaagtagcttaaaaaatggtgatggtagtagtgagttgaagttaggggtgagtcagagattgagtagtagtagtagtagtagtatgctaaatagagtttcatttagtgttggtggtgatgatgctcaaattcccaagaggaagaggagttttgtggggaggaagaaatcagaacgtggtcaagcatcaaatctggtggagcagcttagttgtaaaattggctatgatcaggtgccaaagttaggcagtgctgatttgggcagtggggttgagtctttcaagattaagcataagaaagaatttgatgagtttaaggaaaataggaatagtgattcaaattcagttcagcatattaaggaggatggggattgtgcatctcattctgttgtaaatagtggtgattcttctttaacaaagtcacgaaggaagaataggaagcgaaaggcttcagctttagatagaactaaggtttccaaggaggctgaacctttggtttcaagttgtaaaatatctgacgatttgcaagaagatgaagaggaaaatcttgaggagaatgcagctaggatgctatcttcaaggtttgatccaagctgtactggattttctacaaaatgttcaaatggtttgttcttttttggatcttcttgtcaaagtattgttaaccacggtttaaagtctaagtcaggttcagaatcagcgtcagctgatactgctggcagaattttgcggcctaggaaacaatataaaaacaagggtagttccaggaagaggcgccatttttatgaaatccttttaggtgatgtggatgcatattgggtactgaaccggagaattaaaatcttttggcctttggatcagagttggtattacggccttgtggataactacgatgaaggaagcaagctttaccatatcaaatatgatgatcgagatgtagaatgggttaatctacatactgagagatttaagctcttgttacttcgtagtgaagtttctggaaatgcaaagggtgaaagagccttaacgaaacttaggagttctgatcaccaaaagggaagcaaatccagtaaacaaaggcaaagaacagaagagaatacagaggatgatcgttgtggtgggagcagtatggactcagaacctataatttcctggttggctcgatcttctcatcggcttagatcttcttttcaaggcataaagaaacagaaaacttctgttacaattccaagtacaatgtcatcattcgtatatgatgaacctgttacagcaaaggggcatttagctaagagatctttgaggggtgctaaaaataatttctctagtgattctgtgtcacaaaataaaagtgatgaatttagggacaagccctcatttccaagtgtcactagcactaaagatggaaaacagcctattgtctatgttagaaggcgaattcgaaagccagctccaatatcccctcatatctctgcagaaaaccatgctattacaggtgcatctggttccgttgcctttgaccaaatgtttggtagggttgagaaaatgaaaaatccaattgatggcagggttgaggttgggggcccattgttcttcacttacaaggagggagtatcaaaatttttttgggacatggagtcagcatcattcaaatttggcttaaactttccaatgcatttggtgttgaatgacgtttttcaatcagaaaatttgtggttgctttacagtgttttgctgcttcggtttggtacagttatgaccaagtggcctagagtttgtttggagatgctttttgttgataatgtggttgggttgaggtttctattatttgaaggctgcttgaacacagctgcagctgttgtcttttttgtccttagggtatttcatcaacctgcttgcctagggaagtatgttgactttcaatttccatgtacatctattgaattcaagttttctggtgttcatgttattaagaagccgcttgtgtttgagttctataatttctctgaagtgaagaattcaaagtggatgtgcttagattctaagcttaagaggcattgcctgctcagtaagcagctccatctttctgaatgcacatatgataacattcaggcacttcaaagatcaagtaggttctccgtaacttctgtcagtgagtcttcctcagtcaaggtcaggcggaagaggagttggccagggaataacatcatgggtatttctaaagtgtccactcaagctgatactcatcagtattctgatgctggcaagtggaaacttcctccatttgctctttcttttgctgcagcacctacattttttcttcatttgcatcttaagttgctgatggagcagtctacaaatcgtataagcttttgtgatcaaacaccaatatttgatcaggaagaccctggtttggtgacaaatggatgtactagcaccaatgatttctcaaacaggaattctgaaattattctgaggaaagatatgatggagactttgtcaaatggtgctgcaggtgatggagggtcttgtgctgactcagatcatccctctacttgcagtgaacaaattctcattcaaaattaccagaacattggtcctaatggtgctggtacttccatttcccatgattctgagaggcttagtacagctcacttaccagaatggcaatgccaccatttggagcaagagttaggctctttaccttcaagtcctttaatacgtcaagataaggctgatgatggttctcattcttctattggtgatctcagcattcaaattcctgcagttgatcaatttgagaaacctggtgatgatggtgatttacgcaatgctgagcactctcctgatttctcttggaatataaatggaggtggtcttccaaactccaatccaactgctcgcagaagttcttggtatcggaaccggaatagttccttgtcattgggatttcagtctcatgtgtggtctgatggcaaggctgattctctttgcaatgattttatcaacggacctaaaaaaccacgtacacaagtgtcatactcagtgccttctgcagggtatgaattcagttcaaagcggagaaaccatcatcagaaaggatttcctcacaaacgaattagaaaggctagtgagaagaagtcatcagatgttgctaggcgccttgaaaagaatgttgaatgcttatcttgtggtgcaaatgtcttgattactcttggtaacaagggttggagagattctggggcccatgttgtactagagctgtttgaccacaatgagtggaggctctctgtgaaacttttaggaattactaggtattcatacaaagcacatcagtttctgcagcctggatcaacaaatcggtacacacatgcaatgatgtggaaaggagggaaggattggatcttggaatttcctgataggagtcagtgggctcttttcaaggagatgcatgaggaatgctacaaccgtaacatccgttctgcttctgttagaaacatacctattcctggtgttcatttgattgaagaaaatgatgataatggatgtgaggcaacttttgttcggagctgtatgtactaccgacaggttgaaacagatgttgaaatggctctggatccatcctgtgttctgtatgacatggatagtgaggatgagcagtggatttcaaatgctgaaaattctgtaaaagacaacaatgacttgagttggatctcagaggagatgtttgagaagacaatagacatgtttgaaaaggctgcatatgctaagaagtgtgatcattttactcctaatgagatagaggaactcatggttaatgttggacctttgtctgttgtcaaaattatttatgaccattggcaggagagaaggcagaagaagggaatggctttaatacggcactttcagccccctctatgggaaagatatcagaaacaagtgagagagtgggaagtagccatgaccaagaacaatgcccattctaatggatgcctggacaagtttacaactttggagaagccggtcatgtttgctttctgttttaaacctaggggtctggaatcactgaacaaaggattgaaacatcgatcccaaaagaagatttcagtctctgggcatgcaaactgtaatctagatcaggatggcttccacactttcagaagaagacagaatgctttaccttttggcgatgaaatccaaggccacagttacgattcttttgatgattcatcattggctctgacctcaccaagggtattcttaccatgtgatgctggcagcttgaaataccatcctactagtaatggagcgggatatagaaatcatatcccaaaatttcacaagtccagatatgactcacctggtagcaagcatcaccttcttgcaggccccaagaggcaagggattgaacagttggatgcttcagtccttgaggagttaagactacgtgatgctgtggctgaggctcattttaaatggcatgtggctaagttgaagagagacagggctaagagattgttatataaagcagatgtagcgattcacaaggccatggctgctctaatgactgcagaagcaatgaaagcttctgaggactcccttgggctgggttcagtgaggggagaggagattctgttgctgcagactgcaactccctctaactgtctagtgtctactggaaccttttccagctttgagatctgctcagttcagagtaactgtagcactgctctgcatg

SEQ ID NO: 101708 - DNA, 320 bp, Glycine max
  Peptide Sequence Number=SeqID_218486
atgaaaaatttccaactaaaacgatgcgtgagaagggaaattggaagagaagcagcttacagaatcagatccagagagtataaagatgaaaaatttccaactaaaacgatgcgtgagaagggaaattggaagagaagcagcttacagaatcagaggttgcaagagaagaacattagaacagagctggcagtaactaagtgcgtgggggttattttgaagaatttatatttcggacttcaaatgcggatttcaaatgcggttaaattgccacgtaagatactgaaattcggatctaacggctcatatggggttttcgtggg

SEQ ID NO: 101709 - DNA, 195 bp, Glycine max
  Peptide Sequence Number=SeqID_218487
atggcttcccatggtggtgagtttgttcttgactcatcttctcctcaaagtggcatctctaatcacctttccaccttctcccttccgctgccattgatcttcaagaagcaaagaactccattggtgaagaagatccaaggtcaaaaagctctacaaggagccacattatgtggtatcaatgttagagtacattag

SEQ ID NO: 101710 - DNA, 614 bp, Glycine max
  Peptide Sequence Number=SeqID_218488
atgagcagcagaaagaggagctgcacccttcgcttgatgtcactcacactgaggtaaatcaacaaagtgaacctgatgagaatcatgagcagcaagctgaaccacattcagactattcatttccaacagatagtgaaagcagcaatttctcaatcatggatggaacttttgagctcaatgttcaagagcataggctacaagaagatttgcaatcagattattcacttccatcagatagtgaaagcagtgatggctcaataatggggggaagttttgagatggatcacattggaaatcaaaatgaggatattatatctgctagcttggattctgatgatgattatgaggaagatgaggatgaggaagaggatagcttgattgaaatcaaccttccaagcagccacttctctgacttgattgaagatcctaagcaaaaattgcaatccaagttgtcagattccattttcaagcagcaaggcctaatggagttcttagcagatattaatgacatgattgaggatgaaaacttgattgagattgatatttccatgggatccatcaataatccagatttcagattgaagcaggagttggcatattttcaagatgaatga

SEQ ID NO: 101711 - DNA, 471 bp, Glycine max
  Peptide Sequence Number=SeqID_218489
atgtttggtaaacttgtttcagttggcatgactttgtgctggatggtgcacaggcaatgtggaaggccttttgaggcaaaaatttatgaacaactggacaaggatgtttcaaggactctgcatgaatatcaatttattccagagaagccctctgttagaaatgagacatatgagagagttgcaccctctatccactatagttctcttgatggtgttccagattctaggactttattatctaatggacgatcttttctcaatggaaatgaatctgcaccttatggatacggaattcgaggtcagatacctggtctagatctttcctcgatgggaatgaatctgcaccttatggatacggaattcgagcaaggtaggcagaatcatcttttgccatctgcttcaggagagaatgacggtgttccacgaaagaacccatttgttgatgtaactgctgacattcataatagatga

SEQ ID NO: 101712 - DNA, 213 bp, Glycine max
  Peptide Sequence Number=SeqID_218490
aattttgttctccctcggttaaaatcttggccagcttctgatgagaacataggaaatcttctaatggtttggaggttcttgattacccttgctgatgttcttggaatatggccatttaccttggatgaacttatacaagcttttcattatcgtgttatctctttctttaaggtccctattcaaggtcttgtttgtcctaaaattattccttga

SEQ ID NO: 101713 - DNA, 414 bp, Glycine max
  Peptide Sequence Number=SeqID_218491
atggagacaaaatccaccagttcatttacaaacttagtagaccaatcagtgtgtcctggagatgtggttcttgatctttctaaaatgataaaccagacaattaaacttggaggcggtctacgacaggattgtgatgcaatttctgtaatgaaggctggcagactcaggttctcaaagcctcataaatactgggttgaaaattctcagaagaggtatgtgccatatgcagaggattctgttcttggaattgttgtagactccagatcagataactttcttgtggacataaaaggaccaactttagcatttttaccggtgcttgcatttgaaggaggaactagaagaaatatacctaggtttgagtgtactcaaagtaaaggattgaaggttcattttgtagtccttgtccattaa

SEQ ID NO: 101714 - DNA, 276 bp, Glycine max
  Peptide Sequence Number=SeqID_218492
atggttcgtttgatacctggtgcagcgggacctaactactttgagatagacctagatatacatcgctttagctatatatcaaggaaaggacttgattcactccgagaccgtgtaaagcatggaatacttgatgttggtctaactatccaggcacaaaagcaagaggaacttccagaggaagttttgtgttgcttaagattgaataaaattgattttgttaaccatggccaaattcctacacttgtgactcttgacgataactcaggcgtgcattag

SEQ ID NO: 101715 - DNA, 1173 bp, Glycine max
  Peptide Sequence Number=SeqID_218493
atgttggccggattagtgaagaagattacttccaccacaatggggagctgtgcctcaaatccaaacagaaagagcagttgtcagaaaagaagaaaacaaaagtctgggaaacgcagaggaaacattcccactgcacttcctgatttgcctttggaaagggttagcaatgccggaagccgtgtgggagacttctctctcagtgactttgttcacctggactttgagaatggtgcttcagccccctgcagaagatcagaggtttcaaacatgaaatttcatctcactcaataccatagtcatagtcaaattgatgcaaatggaaaataccaagaagaagcatggtttgactcagttagcattataggatccgattcagatgatgaattcagcagtgtgcatggagattgttttccctttcccaacaattctttgggaagtgccccaaatactcagctactccagtatgaaagtgcatcctgcattttagattcaggtcgtaaatatgaggagttttatgaaagctacctcaaagtagatggaggtaactataagagtggcgagaaaactcaagaaaacagcacaaagcaatcaacagttatcatgctttcagtaaaaaggacttcaattgatggacatgacaagactgaatcatgttcatctgagaaatttctttaccgtcctagggcggggcttcaaattccaggttctattcaagaaaagcctttacctagtacatggtctgcgatttcgccttcagtgtttaagcttcgcggtgaaaattttttcaggcacttattcagagataagcagaagtgccctgctccagaatcctgcccatacgtaccaataggtgttgatttatttgcttgtcctaagaagataagtcacatagctaagcatcttgaacttccacctgtgaaagaaaatgagagtttaccttccctcctcattgttaatatacagttgccaacatatgctgctagtgtgttccttggtgatgccaatggggaaggcttgagtcttgttctgtattttaagttgtctgagaattttgagaaagagatctcaccaaattttatggggatgatcaaggtatatcttctcatcaatagttacttcattaaactttcagatctgcaagcttacaataatgttaccctaaaaaggaagtaa

SEQ ID NO: 101716 - DNA, 239 bp, Glycine max
  misc_feature (96)..(96): n is a, c, g, or t
  Peptide Sequence Number=SeqID_218494
agaatgtttgtattgaagaggatgttttggcaccctttttgaagtttttcaaaggaagtagtgattctgtggtggaggaggaagaagtcggtgggntattggaaggttctaaagaaaggggtgatgagagtgaagaagctaagaaggtttgtgctgagtaccctgagcccaaacctgggcattttgtggttggtgttgttgttattgacgtatgctctgtaattcagttagttagttag

SEQ ID NO: 101717 - DNA, 375 bp, Glycine max
  Peptide Sequence Number=SeqID_218495
atgttgacaaaggagtgccagtgtcgagggggaactgttgtagagattggaaccattttgttttctaaggttgttggtaggacacttgctagtaggtcgttgctttcaactagaaggctctttcgccggattgcctggcatcggctgaggcggataaaacagcttggtgaacctatagaagttagaatcactaagtggaatactaagggactgctgacaaggattgagggtttgcgagctttcctacctaaagtcgagcttatgagaagagtaaatagctttactgagttgaaagaaaatgctcaattaaaatcttttctagctttggtttccttgagtgtgattgggagaagcctctatgagctatcctattaa

SEQ ID NO: 101718 - DNA, 895 bp, Glycine max
  Peptide Sequence Number=SeqID_218496
cactatacagagcaagctacgaaagtttcgtgttcttggcactcacaacaactacccccaagattcagaagttgaagagaagagtttgattatcaaattgaagttcaaatccgttttgggtggctattatttcagcaagggattttccacctccaccagcgttcaaaagggtggtggtggttctgaggaaggtttgaaatcattgaacctctgttctgcaattaatcaggctcttcacattgccttggactctgatccacgttcttatgtttttggagaggatgtaagctttggtggggtcttccgttgcacaactggattagcagaccaatttggtaaaaagagggttttcaatactccactctgtgagcagggtatcgtcggttttggcattggtctcgcagctatgattgtcaatgaagctgctaaatttagataccgaagtgggaaccaatttaattgtggcggtttaacagttagagccccttatggagctgtgggccatggtgggcattaccactctcagtctcctgaggctttcttctgtcatgttcctggtatcaaatggctttatcgtttggctgttgaagaagtaccagaggatgactacatgctgcctttatctgaggccgaggtaattcggcaaggaagtgatgtaacacttgttggatggggagctcaattagctataatggaacaagcttgtcttgatgctgaaaaagagggaatttcttgtgaattgattgatctgaagacactaattccttgggataaggaaacagtagagtcctcagttaacaagacaggaagattgcttgttagtcatgaagctcctataactggaggttttggtgctgaaatttcagcttctattgttgagcgttgcttctcaagg

SEQ ID NO: 101719 - DNA, 363 bp, Glycine max
  Peptide Sequence Number=SeqID_218497
caaaacaaagcatttggagtcatcacagctcgcccaggcaagctgttacttcattctgaagcaaccttgctcgcccaggtgagcagaggctatcctgggcaagccaggggtcataaaaagtgtaaaaatgaccattttgccctcccttttgagtattttctgcattcttttccaaaatgtcaaaaaaactttcggattgtgcggcaactggtgtcaagcagctcaattcgactagcaagaatcaaaacattagcaaatgaaggtcctcgaatgaaattagggtatgaaagttgccatctttacttatcttttattggaaataaaagggaagtaaagataaggacactaatttcgttcgagtga

SEQ ID NO: 101720 - DNA, 339 bp, Glycine max
  Peptide Sequence Number=SeqID_218498
atggtacaatatggtttagtaaaatcttgcattagtgaagaaacaaagataacaatcaaggaccacaaatggtctctatcggttcaaaaccccattttcaacaaataccctcatatgaacagatcgagaggaaaagatagaatatggaaacttacgaaggcaaggcgacacacgggagacgctatcagggcaccaccacagctgactgacgaaacgacggacactagggagtgcaccaccacagctaaggacgggggacctactggacgaaggcacgatagaaggcatgatggaaggcacgagggagggcatgacaatggaggtaacagaatgaagtaa

SEQ ID NO: 101721 - DNA, 402 bp, Glycine max
  Peptide Sequence Number=SeqID_218499
atgtacctcacaggtttccaaataagctttttttgtcaagtgcatgtgcgaaataaactaagagaagctaatccaggaaatgcccttcttgagttgcgtggaaatgcaggaagtcacgatcttgctttttctgttcaaactctagcagctttaaccaaattgacaagagaaggtggtggtatgaaattgaagttatcaagatatgataaagtaaggatgcttggtttgaagccccttccagttgacacagtaaaggttgttgatccccaggctgagattgccatgagggagacaggcaaccttggaatgatagatgatgagacttactttgttcagaaaaactgggtccttgaaattggtagattactagtcattgatagatgtctccttgaaattgggtga

SEQ ID NO: 101722 - DNA, 192 bp, Glycine max
  Peptide Sequence Number=SeqID_218500
atggtagccataaccctagccaaggttcctcaacctccatttttcctaggatacaactcgaatgtaacatgtgcttatcatggaggagttccggggcattccattgagcatttgacctacactcctgagttgatctccaagtctgttcaatcagaaattgctcgttctccatgtttggtgagggtgtcgtaa

SEQ ID NO: 101723 - DNA, 288 bp, Glycine max
  Peptide Sequence Number=SeqID_218501
atgcatcaccaaaagaggaaaactctagatgaggcttcactgttatcaagcgagtcgaaaatccaacatgaccacatatcgacctccactccttatggctcacatagacccggtccccagtggagtcaccaactgtcgcaacctacccttcggcgggggtgcgaaaaggccaaaacagatgggcaaaaggtgcgtcttctcatgaagaaaatgcgtggagtcaccaccaacgtttattcgaggaaaaccttagaaaagaaccaaaagatgaaggtctgcggattttga

SEQ ID NO: 101724 - DNA, 621 bp, Glycine max
  Peptide Sequence Number=SeqID_218502
atgtctataggaagcaacatcgaaagaaattcccaaaggttttgtagactacgaaggtcacattggactatgtccattctcattgttgggggaccttcgaaagttgcattgctaggaggggcaagtttttgggatgaagcagtgaacacaacgtgctatctcgtgaatctcatatcatcaactatcatagatttcaagactcttattaaggtatggtctaacaaacctatcaaatactcaatgttgaaggtgtttggatgttcaacataccatcacgtaagtgaagtgaacacaacatgctatctcgtgaatctcatatcatcaactatcatagatttcaagactcttattaaggtatggtctaacaaacctatcaaatactcaatgttgaaggtgtttggatgttcaacataccatcacgtaagtgaagaaaattcaggcatgtctaaagatgtcactaagcacgtggagtttaagagccccacaatcagaaattttagtgatcaaaagcagtttgaagcacccgatgggactaataaagatcttcaaatgcaacttcaacatcaaaatttagcaccagttgaggggtctcactggacgagtcagaaccatccgaagtag

SEQ ID NO: 101725 - DNA, 378 bp, Glycine max
  Peptide Sequence Number=SeqID_218503
atggagctctatgacattgatgttaagatagaagatgaagatatgttaatgattatgttaaactttctccctccttcctataagaattttataagttcacttagtgttgggaaagactttattatacttgaagaagtcatgttcgatctctattttagagagcttcgactgaaagcatttgggaatggtgataaagcctttgcatttagattatcaataactgattctgctaaaggacaaaagaagaagaaagacaaaggtagcaagaagagaaaagttgatccaaaggacatttgtaattactgcaaagaacctagtcatcagaagaaagattgtccaaagaaagcaaagaaagattatgttgttgttattgtttag

SEQ ID NO: 101726 - DNA, 360 bp, Glycine max
  Peptide Sequence Number=SeqID_218504
atggtacaagaaattgtctcttatgggtacaacaaaagtccctatgattcatatgtctatcatattaaggtggaagatggttcccacatttatctgttactctatgtggatgacatgctcataacatctcaagataagtctaaaattcataatctaaagttcctacttaatagtgaatttgtgatgaaagacatgggagctgcaaaaaagattttggacatggagatcaagagggatcgggcccagaataagtaccttaagggtacaactaatattgaactggtctatcaaggtgacacatcttgtgtccttggtggatattcaaattctgactacgttgtagatttagatgcaatatga

SEQ ID NO: 101727 - DNA, 294 bp, Glycine max
  Peptide Sequence Number=SeqID_218505
atgctaggggcaccatatccaatgcaactttcagcctctgacacacaatgcctaatccactgtggtgatcatatgacaattctcagaagattcagacctccattgcaatggaatgtagttgtgctcgacaaaggcattggtgataagtatgtcactctgctttggtataaattccttcaagaaggtgattttagcaatggagacgagctctcattctactataggcatgctaagaagatctgggaagttgtcatcaggcgtgcaattgatagggatgatagtgatatagattag

SEQ ID NO: 101728 - DNA, 351 bp, Glycine max
  Peptide Sequence Number=SeqID_218506
atgaggaagaatgggtggcagctaccttatcatcctctccaggtggtggctattgctgtgtttatggctctggggtttgccttctatgtgttctttgctccttttgttggaaagaagatgtatcagtatgttgtaatgggcctctacacacccctggcaaatgcatatgagctaggaaattattttcataattcaaacaagtttaagtttttgaagttcaagatagcactgaattgcccttgtcagaatccttttatggccttcttgataattctggcaaccatcactctctttggagggaggttgatattgttgaatctggaacatgttcatggaaggtaccttgaatga

SEQ ID NO: 101729 - DNA, 1314 bp, Glycine max
  Peptide Sequence Number=SeqID_218507
atggcactgaattgtccttatcatattccttttttggccttcttgataattctggcaaccaccaccctcctttgtcaaaactgggacgcattcatggaagataccttgaatgtgctacttaaagagagtgactctgaatttttcaatggcttcaacattctgcttaaaggtacagccacatctgatcctgcagatcctggggttttcaagtccaaaaaatatcttaaaattccagatagcaaaaagcttgatggactcaagaattctaaactaggaggggaatcaacttcgtcgatgcatgatggaaatgcttcaactgttggaccaaaatcggctgataaggaagaattgggaactgaagcaagttttaaagatgcttctatttttactgagaagaaaaatgcatcatcaccttcttcgtcctgtcttctattggtttgctctccttgtgcttatatctgtggttgctcaagttcaagtaacgaatcttctgaacaacaagcaagtgaagatggcatgttctattgcagtttgtgtgaagttgaggtcttcaagtatagcaagcactgtagagtttgtgacaagtgtgttgatcgctttgatcatcattgcaggtggctgaacaactgtattgggaaaaggaactacagaaaatttttcacccttatggttgctgctctcctcttgtttccttgtaaaatacttgatattcttcctagcaagtctcaaaagttgaaccatcctaaaacccaacttgttggaagcagcatgccaaaacctgaagaaaaccccagacttattcttcagtggttgactgggatacttgtgcttatctgctgttttgttgagaagaagaaattttctgtggatatctcctccaaattagggagcagtttctctctggttcccttcgttattgtggtggcagtttgcaccattttggctatgattgctaccttaccccttgctcagctgtttttctttcatattcttctcattaaaaagggaatcaccacatatgattacatcatagctttgagggagcaggagcagcaaggtattggaggtcagcagagtccccaaatgtctcctgttagctcccttactggaatgagcagtgcaagctcttttactacattccatcgtggagcatggtgcacacccccacgtctgttccttgaagatcagtttgatgtagtgcccccagaaacagcttctgtaagctcgctgggaaagaagacaatgagagatgagccggttaagaaaagaataccggagcagtcaaaatcagtccatggaccctggcgcggttga

SEQ ID NO: 101730 - DNA, 624 bp, Glycine max
  Peptide Sequence Number=SeqID_218508
atgagccccaggatcgagaccaacagaagacggcccggtaaacggattcgcctgcctgctgacttgcctgtggaggccatgccaaaattttctgccagcaacactgacaaaattttcagtggaacatctagttttgcgcttctccagctcgaagcacgaagtgcatttcaaccaagtcaagcagtgtcaagctcagctgggattgttgcttcctctcctgaaagcagtttagactcgcctgacattcacccgtttcgtgtgtctacgaccgaagccgaagaagcaagaaggcttgctggtctttctgctgccgccactgcgaacctgaagggaatccctctgtcaaggtcaactagtgatggatatgaggcctctggtggggaggatagtgacagggttcccaccaggattgttcagaggtccacaaattggactaatctgctcttcagtgctgatcaggaggagagagcttttgagacaaaatcatcatctagcatgattatattgatgggaattgttcattctttgatttgtgagcccaaaggtacttgttcaacttcaacaacccttaactcacctcttgaggttgagttgatgcccctcaaagttttggaggtaggctaa

SEQ ID NO: 101731 - DNA, 318 bp, Glycine max
  Peptide Sequence Number=SeqID_218509
atgaaggggtacgtggataggtcaaggttgaagggcctgtataaggcgcaacacaatgagacctcctccttccaccttttagttggagagatgaccatcactcttgatgatgtgtcatgtcttttacatcttcctatcatgggcagtttccttgatcacacatacacgacctacaccaggaaggagacaaagggcgaatgggagcaacatatggtggcagtaggtgaggttgttccacgtgcggctccatgggcctgcacttcagactacctgcctttgtattttgagcattcacatccacacatgcttctgcaatag

SEQ ID NO: 101732 - DNA, 270 bp, Glycine max
  Peptide Sequence Number=SeqID_218510
atggcacaagagggtcttgcagctggatgtaaatcaactgaggagtggccaccgtcgaggaagaaaaccatcataggtggcagaggaggcatgttgccagcacctcgcccttgtggcataattggtggtgccaacattgatctatttgttggaggcatggttgcatatgtctttgaagaggttgaaggcgtcgacgatggggtagagggtgaatttggggatgacgacgacagaggcagagaggaccatcgggtggcgtcaatggcgtga

SEQ ID NO: 101733 - DNA, 468 bp, Glycine max
  Peptide Sequence Number=SeqID_218511
atgaagctcacgcaattaggggtggaagggcttattttgcctgctgttcctagtgtgctagaaacatggacccgctcttttggcattgcaaagatgactaatcttgagagatctcaatttctggactacactttcctagatttccagagtgccatcatgtgtcaaaagctattgccgagtaatcaatctccagatccagtcttgttaatgggcaaaaatgatcatcaagttattggtgctattgatccagtcaccattgtactactttcttctcctaacttatttcttttagtgtgggttcttgcttcagctaagactctgataattttattggttcttaggtggagcaaccgagtccgggggatcaacagtgccagaatggaacaaccagctcagagtgctccattgataaaaaagttgacaggaataatgacctgtataagtgcgtctacacgcgaaggaaagtga

SEQ ID NO: 101734 - DNA, 402 bp, Glycine max
  Peptide Sequence Number=SeqID_218512
atgaatgtagaacaaaagatgtgtaagcttgccaaatatatggaaaggaaatcaagagatttgaaccaaggaacatttggagagataaaagaagctcttacgaggatgaataatgttggccctgatgggaatcaatttggatttatgccaagaaggtctacaacaaaagttatgtatctatcaaacatagcttacttggcaaagttgccaacttcacttgaaaaaagcccattgacgaatcaaatagagccgcataggttacgattacagaaggttcaatcatcaaatcctggcacaatattagttggtaatacagataaccaggaggagtctgccatggctgatgccagtcctaggactgatatttctacagatggtgacactgatgacaagaatcagccg

SEQ ID NO: 101735 - DNA, 381 bp, Glycine max
  Peptide Sequence Number=SeqID_218513
atggatttatacccttgtaattggagattaatacctctcttcttgagtccccaatccattgtgaagaatgtgatacagcagagtcatgattcaatgctaaaggaacacacattatctgaaggatcatcctgccaagctctggctgaccagggtcgaggacgttaccaagagtctgggatccttgctgaccagggtcgagaatgttaccaagagtccaagacccttgctgctagaaagtcaagggtaaagggaaacattgttagtatccttttaagctatacagaggagagcacaattgattcttttcatgtttctgactttggagcatttgatcagtcatatcgaataggggatgctgttgacctcagtggaaatgtttaa

SEQ ID NO: 101736 - DNA, 162 bp, Glycine max
  Peptide Sequence Number=SeqID_218514
atgtggaaggtgatctcaaataataactcaggaacaaccacaagaaaagggggaaccaggaaggcaacgaaggtgcaggaagtaaaatccgaaaataagctgggtgtaagagaaagaaaagggctgcgtcttgttgttatgtcaggaaatctcccatcttga

SEQ ID NO: 101737 - DNA, 249 bp, Glycine max
  Peptide Sequence Number=SeqID_218515
gactgtgaagagttaaattacccgtacacatctaaggaggtggtcattgcattgttgatggggttttgggagtggaccaagagaatgcatctttggagactaaacaatgtaaagggggtcatgttttgcaactataaagcaactcaatggttatgcaactttattagagacatggatctacgagcattttcctactattgggtagaaggagctgaatggaaaacatacaaagggattatcacaagctag

SEQ ID NO: 101738 - DNA, 186 bp, Glycine max
  Peptide Sequence Number=SeqID_218516
atgattgttggttgcggtgacatagttagcaaatttgagccagagatggtgggttgtgccgcaagcttgagctttctctttagaggttgtgctcatcggaggcggtggcctcactaccaaagcctccttagaggtaatcaaacttcatcgacaggaggaatgacggtggctccaatgagggtttga

SEQ ID NO: 101739 - DNA, 240 bp, Glycine max
  Peptide Sequence Number=SeqID_218517
atggaaaaagatggcaagagagacaacactcattcatccaccaatttgcaacaaacagctaggcatgtaccctgcacgaaaatcgctagtcaaactggctacatccagtgcacggctatatcgtcagcacaagcagcgagaccactggctattccacctgtgacagtaacgttttcgccacgtgttgcacacaggggcttctcgccagtaacactggcggtttgcatgtattttacgtaa

SEQ ID NO: 101740 - DNA, 1389 bp, Glycine max
  Peptide Sequence Number=SeqID_218518
atgtggtgtgtgggtgagtggggctgcattgtgttgcaaaaaattaaggcaccacttcagctcctgccagttactgaagagtctgtcttctttttaaatggagtggacattccatttcctcttccttcactttcttcaatccttcaaggtattccttctctaattatgtcttcatttttgtctaactctgccattggtatgggtggtagcgattctaggggttcgattcagcatcccctgaaggaccgagaagtcatttccattggaggtttctcctcggaggatactcaccatggtgcttctaatagcgaatcttcttcctcgaagaggttgagggtttcatgtcatattggtggaggcacctctcatcttcgtgggagggcacaacctttcactgcttcctcaaccggggagcctgtcccggtcactatgattctccccccttctacttctgggggagcaaggaagagtggtggcggggacgttagggtgtttcgccgcttgcaacctagccataatattaggttgtcgtcgtccttccctgtcgttgttggctttgagtgggtgaggggcgacgttctgaagtacaagtcctccatcacctctatggcaagtgtcgctacactgcaatgccaagtgaagttggaaaatcccaatgactcctgcaagatagtcgtccaggcttgtaggagtgatgacttctctttcttgagggcaatgtcgagcaatccacccttcttttttatgtacaagtttcggtttgaggtcttcttgaataacatgtcgaagaagctatttgagtttgactcaaacatttttcgccacttcaaagaatgcttctttaaggtcctggctactgatgtcgtgactgatgatctattaacccttgtagagagggtcgacaaggctatcttgcaacaactatcagcctcactggatgtacaggccattttgtctattccctcggcaaatgatcctctcgctgctttggatggtcacacctacaggtggggccgtgccaccgtctactttgctcttactactagagaagagggtcaacctattgttgaggttggccctatagatggtgctactaaggtttctcccagtgctccttcctatgttttaactaagaggaaacaagatgacagtgctaggaagtttggttgtaagaagtcgagggcccatttgagccttcacacattgaggcaggctgcaaggttgacatcctgttcgggtcacccttcaagtttgcaagatgcgcctccgaatccaccgaccattgaggcttctacttccgctattgttgttgatgttacatctgctcctctaccttggaatcctccatcgttgaggctcctactccacaaattccctttattatcctag

SEQ ID NO: 101741 - DNA, 318 bp, Glycine max
  Peptide Sequence Number=SeqID_218519
atgagtaccctgtgttcgtatgggacatgcgaaatgaaaatctgtataaccatacagattgacaatctgtatgatccatacggattatggattgataatccgtatgagacatgcgaaatgagaatccgtatggatcatacagactctcaatccgatattgagcatgtggatcatgttgcagacaaggttcatgaggagcctcacgagccagttacggatcatgaacgtattgagttgaagttggcctctcatgggaggaaggtggagaaatttggaaggcctgcacatgagattgaaggcatagtggctgctacatga

SEQ ID NO: 101742 - DNA, 1977 bp, Glycine max
  Peptide Sequence Number=SeqID_218520
atggaagctgacatacccctaggttggaaatcactcaacctagaacggtatggtagaaccatcgatctagatgaacatctgaatgttttcctcactcatgcaaatctatacaccaaggatgatacaacttcgacactcttgttaagcgcttcagtgtgcaatatgcaactagtcggtcacatcatatggtgccagcctttctggctagtctgcgacaagcagatgatgaatcttcggaaattcgtggaaaagtttagacgcattgttgtccaggtctgtaatctcaatccggagcgaaccaaatgctacatccaaatggaagaaatgtttcggttcaggaatgaggtccaacaagccggacaaaagtgtgataagcgagaaggaagcaccaagaccaactcacacaagtcagacaaaaggaacaagcccaacaagtgccaatctctcccaaagggcctaggccgaggttcgacacgaccaaatacagcagataccatcacagtattggtcacaacacaaaagattcctagtccttcaaaaacaaaatataaaagcttatacaggctagggacaaagaagaagatcaaggaagacagagacaccaccaacaaagacacgattgacaacctccacaagaataagagcccgcccaacaaatcagagtctcgcaaacgtcaccttcatgccatatgggacatcgacatcaactatgttgatacaccactaccacaaactctacctcctatcactttcattgatagagacatcagtggtatcatccccatcaaccaagacgaccccatggttgtctccatcataattggcaacttcatggtatccaaagtcctcattggccaggtggatggtaccactcaggtcatgagcatggacaatgggtctctagtccgagaccttactgtccaccgagcaagcctagatgaagaattcgatgtagattcgcgtgacgatacttttgatagaagcccaaagcctatcgaagaacttgtcaagctacagctcgaaccccagcccggggcgtgccctaaggatgcatacctttttcctagcattgacaggctagtcgatcgaatgtctgagttccaagtactaagcttcatgcacacctactctgggtacaaccagatccaaatgcactctctagacgaggagaaaacaacattcatcactaaagatcagcagatcaaacggaacatcgaggtctatgttgacgacatggttttcaagtctcaaagcatagcccaacatatggcaaacctggaaaaggtctttgaagagctctgcaaatataacatgcgcctcaacttgaaaaaatatacttcgggggttaacaaaggaagtctagaagttgaaaggaagactaacatccctgtccagacctacaaacaagccttcttaactttcaagaagaccattgccacactgccattgctgagtcgacccaggctaggagtacccctactcctatatctctcagtagctgacaaagccgttagctcaaccctcgatggtggcatggtttataaaactttcatagttcgatctccagtacgaaccccatggcaccatgaagacacaattcatggcagacttccagaaatcatcctcgaaggacctgactatgtctctctagagcaatccctcaagctcaactttaaagccttaaacaaccaggctaaatacgagatgcttattgcatgtctgaaactaacaagagaagtcggtgccaagaagctacgatattacacagacttggagagcaacactagagcaaacctactcttcaagcttgctagcaccaaaaagatagggcacctcaagactatcatccaagagatgttccaaaatcccaccatagacaccggggaagttatggatggagaagaggaagaaccatgcaaactggatgatcccctacaagaattttctaattcgaggggtgttgcaaacgagaattaa

SEQ ID NO: 101743 - DNA, 660 bp, Glycine max
  Peptide Sequence Number=SeqID_218521
atggttgctgggggaggattaaagcctttgaaatgggtcttgtgtctaaggccaaaccacgtgctaatcatggatgcgaaagagagagataaaaagatatcgcatggtatgttttaccacggccgcacggtgagcgccaaatgtacttaccaaaatccggagctaatacacgtcagggtggacgtgactaaggcagaagtgagggcgagccctggtgcagcggtaaagttgcgccttggtgacttgttggtcatgggttcgaatccggaaacagcctctttacatatgcaaggtaagactgcgtacaacatccctcccccataccttcgcatagcgaagagcctctgggcaatgggccccgtgaaggtgaagactagtgcctcgaatttcagggcccttgtgcaagaactcactggccaatactccaatgttgctgaaacctccatccctatggaagaggataatggccactccgagagagtgcacagaactcatcatcatcatgaaagtgaaactcaacaatggagggtgaatgttgatgagggcaccaatttgatgaaacctcatgagtacagtgagtttctctcaagatccttgatggagccattcaaccaacaacaactccttcaatacgatttgatgagttttgacatgtcatag

SEQ ID NO: 101744 - DNA, 396 bp, Glycine max
  Peptide Sequence Number=SeqID_218522
atgtcagaggtcacctgtaaaaccaaaagtatgtccaccccagataacttgatagaagcagctcagacaacacttctccaggctaaggggcttgacaagcttgatagacttacaactcccactcttgttaaggccaccactctagacatcggacgacatttgtttgtgcttggggtcttgaccgactcgtcaccctcctattcgttaaggctactaccctcgacatcaaacaatctccctcaacacgggacaatctccttcgacactggacaacctttttcgctcgcaagctggttcaaagcttcagggcttatgtattgtccagggtctaccaaatacatgtgtcatgctatgtggcactccgagacacacgtcaaccctccatgccagccctag

SEQ ID NO: 101745 - DNA, 531 bp, Glycine max
  Peptide Sequence Number=SeqID_218523
atgactgcagtagtccatatgtatgacaatctgaatgttgcatccaagcataccacaaagcatcttacaagatatatcactttgttgcagaagtgtgggaaggcattaccagtgatgacctattgtaagcacttagataggttgatgtcagatgttgtgtgctggataccttatggtgatcatcgtgcttttagagaattcgagctcatttcactattttctggacttatcaggatacctcacccattcatgagtctgccacaacttggggagcctcctatacatccgcccatggtgcatgatgatacatatattatactagatccacctatgttgcccattcactcaatagctatgccacaaccaattgcacctgcagttgctgatgcagacatacctcgacatgcagtggccgcttgtcaaaagatagtgcaaaacttggaacacatgatcaacatgaggatgatcactactagaactgatgcatacactctgattgagcactatctaagattagctaggtgtcattga

SEQ ID NO: 101746 - DNA, 458 bp, Glycine max
  Peptide Sequence Number=SeqID_218524
atggcgataatggaggcaatgctggtaatgaggctgaaccacaggagcacactttgtaggattatctcacccccatggtgggagtcaaatccagtattgtgcttccatggcttgccatttgaagaaatggaaggcactgttcttcatttgaagaaattcttgagactcatagatatagtgaggagctcagctaatgctcttgactacatcagattggcaactttttcattctcattggcggaaaaggctaaagattggctctatgacttgccaaaccagagcattaccaatttcggccaaatacttgtcgcaacctacccttcggcgggagggcgacgcggggctcacaggtgcgtcttccaagaaaggaaaatgcgcggagttgccaccaacgtttatttgaggaagacgtcggaaaaaccagaaaatgtgtggtctaagaactttaatcgtgaaag

SEQ ID NO: 101747 - DNA, 1528 bp, Glycine max
  Peptide Sequence Number=SeqID_218525
ctccgctgacgatactgtcgctggttttacgagcactctcgccaagtccctggaagatcagggattcccggcgagagtgctcgtggaccaccgcgacctgaagaaagcagagattgagacagtgagggtgttcatcgttgtgttgtccgaacactatgcaatttgtccgtttcggttggataagctggccgagatcgtggatgggttaggtgcccggcagcgggttctcccggtgttctactatgtgcccacgtctgatgtgcggtatcagactggtagctatgaagtagcattgggtgttcatgagtactatgttgaacgtgagaggttggagaaatggaagaacactttggaaaaagttgctggctttggcggctggcccctccaacggactgggaagacatatgaataccagtatatcgaggagattggtaggaaggtctctgaacatgttgcttgctctgttgaactgcattctcgagtgcagaaagttaatgaacttctgtattctgaatctgatgatggtggagtcaagatggttgggatatgtggagaagatggaacaggtaaaacaacagtagcttgtggagtttattactccaatgctgctggaaacaggtttgactatttttgctttcttgataaggttggagaatgtttaaggaatcatggatttataggtctcataggtatgcttctctctggaatgattggtgacagcaacaacaacagtgatatcatgaaatttggaaatacaaacaaaggaatgtcaatattaaagcgaaaattcttcgaagaagaaaagaaactttttttagttcttgaagacatttatgatgaaaagcaattgcaagacattgttaggctaactaactgctttagttctaacagcaaagtcgtcattacaactaaggacaactctttgctacaccgtcatgagattagattgtacgaggtagagaggttcaaaacaaaagatgcttttcaattgcttagtttgaaagcttttaattctaagaatttgaaatctatgtatttgagcattttagaacgagcagaaacttatgcttcagggaatccattcattctagaagtgatgggttcctacttgcgcggaaaaagcatagaggaatgtgtatctgcattagatcaatatgaaaaagttccaaataaagagaaacaaaggatagttcaaataagctttgatgctttggagaaatgtcatcagaagatgttgtcttgcattgccttttacctcaatagacaagatttgcaagtggttgaagaaaaactttataggcagtttcgtgtcagtccaaaagatggtattaaagtgttgcttgataaatctcttataaagattaatgagcatggtcgggagcatgtcaagcaattgaagcaagaaatccaacctgcctcgaatgatggaagcatttcaacagatggaattgggagaaagtacggtaagattgatatgaatggtttggagtatggcatacaagaaatccagcctgcctcaaatgattga

SEQ ID NO: 101748 - DNA, 525 bp, Glycine max
  Peptide Sequence Number=SeqID_218526
atggctagaggaataatacagggttgtggaaaagaattgggtggtgctcttctttctgctttccttcgggttgcatttgagaaacttgcttctcctcaaatcctggacttctttcgtggaagaaagcttgatcaaaagctgctcaacaacttggaaatcaagctgaactccatccaggttttggctgatgatgcaaaactaaagcagttcagagatccacatctcagaaactggcttcttaaggtcaaagatgctgtacttgacacagaggatctcttggatgaaatacaatatgaaatctccaaatgccaagttgaagctgaagctgaatctcaaacctgcactggctgcacttgcaaggtaccaaatttcttcaaatcttctcttgttagttcctttaacaaggaaattaaatcaagtatggaacaagtgcttgaggaccttgaaaatcttgatgattcaacaatagaaagggatgaaattttaactgagaatctacatccttccaaacactttccaaggtga

SEQ ID NO: 101749 - DNA, 315 bp, Glycine max
  Peptide Sequence Number=SeqID_218527
atggtccaagccctccgtgtcgatgagcaacttcgccgcgtcatgggtagcgatgactgctcccctgacgggtgcagttctacgtgccccttatgcccacacccgatcaatgctccacgagctcatatggtgtttcttaaagaagaggatcatcgacatgagagaagagttgctgtgaacgaacgaacgttggaatggaaaggaagcgactttgtgcagccgaaatggatgccacacagtgactttgtcatcatgaacgacaatggaagaggccatgacggcgactttgacttcaccaattgggtatctgtgaag

SEQ ID NO: 101750 - DNA, 483 bp, Glycine max
  Peptide Sequence Number=SeqID_218528
atggtcattggtttatacgttttggaggatgaagggggtgtcggtacaattgaagttccaccaaacgttggccctactattaaggcaaatgctgtctcgcagatggaggctgcaatggctgcattggcaattccatctgagcaagctacgtacaggaagggcatccccagatcaaaaaaccttgcagcgctatttaacaacttgactttcaagctcaatattaatcaactaatttactgcttcttcaccatgaaaatgaccagattgaccaaagagcatattcaggctatgactaagctggttgctaaatcatgtgaagatgctagtcaaagtattagaagagcccagcaaaaggcaatggatgcaataaagaagttgtattcaagtctccccaaagatgacataaaaagactggagaaagaagttgatgatttgacaaaaaaaattagcaagactgcagaagatgtatgcaaggtgaaatag

SEQ ID NO: 101751 - DNA, 519 bp, Glycine max
  Peptide Sequence Number=SeqID_218529
atgatgatggtggtggtggtggtgttggcatcgattgtagtagaaatatcaatgttggttgcagtgagtagaggtgatggcaacaacaatgcagatggtgtcaatgacaatggtggtggtgatagttgtgctagtggagccagccaatgcgatgacataggtggtattggtggtggtgatgatggtgatggtagtggtgatagtagtagtaatgttgatggtgccaatgatgatagcggtgacgatggtggtatgatgttagtggcggtggtggttgtggtggtgatggaggtgatattggtgacaatggcaatggcaatgacgcttaaaagctggttcaacgccatccatgctctaacctcagttatgatgaggtgcattgaaagtgtgaaaatggagaaacacgctatcagagtaccatgtttgaaaggtacctatgacatttataaaaatttaatgtcagcaaaagccaccattactggtctagttaaccaagggttgaagctctggaattgttaa

SEQ ID NO: 101752 - DNA, 1688 bp, Glycine max
  Peptide Sequence Number=SeqID_218530
agccccgtggtgcatctccaccatcggaaaaccaccctgaggctgctcagccgccatcgagaatcgacgctccggccagagtatctgtcggggaagaaaacaagcgaggatcagcccaacaagggcacaatgagttagaccaaaatcacggtgtccaagtagattcagccgctcttccttcctcccccgaacactataaccatataatgcaaagctttagacgctgggttgagccaaaagccttcagatacgacgtgttcctgagcttcaggggctgggatatccgcttcagcttcaccggcttcctctacaagggcctcttcgaccacggattccgcaccttcatggacgaccgtgagatcgacaaaggctcccaaatcccccaaaccctccgcgaggcgatcgaggactctagggttttcatcgtcgtcctctctgccaacttcgcctcttcctccttctgcctggacgaagttgtcctcatcctccaagagttcgccaagggtaagggtcgctggattttgccggttttctactacgtggatccgtctcatctcgctgatagtgattcctataaacgggcattggaggatcagaccgagtggtttgactcccagaggatacaaatatggaagactgctttgagtaaattggctaccttttcaggcttacgactcattcggaacgggagtatacttgaataccagtatattgagcttatccttaaagaggtttctagacatgttacttgtccagttggactaagtcatcggatgtcaaaagttaacaagcttttgttctctggatccgatgttggagtccacatggtagggatatgtggagaggctagaataggtaaaacaacagtagctcgtggagtttacaacttcaactctgacactggatttgatcactattgctatttttataacgtgggggatattttaagtcagtctagatttgtcaatgaaggaatggcaatactcaaccagaaaaaggtttttgcaatttttgaagatattaacgattccaagcagttgaaaaacattattgaactagcttatcagtttggttctggcagcaaagtcatcattacagctcggaataaaggtttgcttcaaagtcatgggattgaaagcatatatgaagtagaaaggttcagtaagacagaagcttttcaattgcttattttgaaagcttttaattctataagtgttagtgctgattatgtgaccatctttaaccgtgtcgagacttatgctcttggtcatccgtggactttggaagtaatcggttccaacttgagtggaaaatcagtagaaaattgtgaatctgcattacttaagtacgaatcaataacaaatagagacatccgaaagatactagaagaaagctttaatgctttggagaaatgccagcaggagatgttaattcacattgcattgaaactcaaagaacttgaattgggagtggttgaagacgaactttgtaattattataaagtctgtcccaaaaaagatattagagttttgcttgataaatctcttataaagattaatgagcacggtcaggtgacattgcatccctctacacaggacatgattagagataaaattacacgttttgaggaatatggcaagcaagaaatccaacctgtctcaaagaatggaagcatgattgggatttga

SEQ ID NO: 101753 - DNA, 2133 bp, Glycine max
  Peptide Sequence Number=SeqID_218531
atggagacttccacaatgttcttgaaagggaggacaaacaatgaatctcagcttaagcaaatgttgcagcagttggtgaagaatcaattagtcaaacaagaacttgatggggagagaaaaaacattcaaaattgcaagagtgagaatctagggttttggtattgttgggttggagctgaatccgcgaaagcttgttggatggcaggttcagaacgcagtagtagtagggtttggcactacgaattcgacgttttcctcagctttagaggagaagacaccaggctcggtttcgttggaaatctctacaaagctctgacggaaaagggattccataccttctttcgcgagaagcttgtgagaggagaagaaatcgcagcatcaccatctgtggtggaaaaagcaattcaacattcaagagtttttgttgtagtgttctctcagaactacgcttcttctacacggtgcttggaggagcttctcagtatccttcggttctcccaggataaccgtcgaccggttctgccggttttctattacgttgatccctccgatgtgggacttcagacggggatctatggagaagcgctcgctatgcatgagaaaagattcaactctgagtcagacaaagtcatgaaatggaggaaagcactctgtgaagctgctgccttgtctggttggcctttcaaacatggggatggatatgaatacgagttgattgagaagatcgttgagggtgtctccaagaagattaaccgcccggttggcctccagtatcgaatgcttgaactgaacgggcttctggatgctgcatctctcagtggagtccatttgatagggatatatggtgtgggaggcattggtaaaacaacacttgctcgtgcactctatgattctgttgctgttcaatttgatgctttatgtttccttgatgaagtgagagaaaatgcaatgaaacatggcttggtgcatctccaacagaccattcttgctgaaacagtcggagagaaggatattcgactgccaagtgtcaagcaaggaattacactactaaagcagaggctccaagagaagagggttcttttggttcttgatgatatcaatgagtcagagcagttgaaggcacttgttggaagcccaggttggtttggtcctggaagcagagtcatcattacaacccgagacagacagttgcttgagagtcacggggttgagaaaatatatgaggtagaaaatttagccgatggtgaagctctcgaattgctatgttggaaggctttcaaaactgacaaagtatatccagatttcattaataaaatataccgtgcactaacttatgcttctggccttccattggctcttgaagttataggttcaaacttgtttggaagagaaatagtagaatggcaatataccctagatctgtacgaaaaaatacatgataaagatatacaaaagatacttaagatatcctttgatgctttggatgaacatgagaaggatctttttcttgacattgcatgcttcttcaagggatgtaaattagcacaagttgaatcaatagttagtggtcgttacggtgacagcttgaaagctatcattgacgtgttgcttgaaaaaacacttataaagattgatgagcatggtcgtgtgaagatgcatgatttgatacaacaaatgggaagagaaattgttcgacaggaatcaccaaaacacccagatttctccaaacctgaagaagtggtacaatgggacggaatggccttcatgaagatgaaaaacctcacaacacttattattagaaaggagtgtttttctgaagatccgaaaaaacttccaaatagcttaagagtgctggaatggcggggttatccttcaaagtctttaccatctgattttcagccagagaaactagctatattgaaattaccttctagctgctttatgtcacttgagttgccgaatttacaactacacagatgtggaatggttcagttgccaagtagcattgtcatgtcagaacttgaggagttgcacaaggctggaaacaagagattttgttttccaggaactaggattccagaatggtctgagcattctagtgatatttatctgccttgctggactcgtgcataa

SEQ ID NO: 101754 - DNA, 220 bp, Glycine max
  Peptide Sequence Number=SeqID_218532
atacctgaaattctcggcggtttttggggcaatatcggcaaagagttccatcttgattcgaccggcgggaatgttaccgatggtgacatcgaagaagacgatggggttcttaagaacattcaagaaatcatgtcaaacacaatcaagattgagaaattcaatggaaagaacagtttcaatctgtggcggatcaagatgcgtgctttgttgaaggaacaag

SEQ ID NO: 101755 - DNA, 699 bp, Glycine max
  Peptide Sequence Number=SeqID_218533
atgatgaaccaagaactaatcttaaccctggcatatgaacgaaaaacgacgccgtcgaacaagcgcgtgtcacacacactccatttctttcatcgtaataaaccagttcccctgccgcaatggaagaagaacaataagaatcaaaagcagaacagaaccaagcgagttgttgtgactgactcagtgagcgagcgagcaaccgagttactcatggcgaacgcggcgcttcggaacgtgaaggtgctcccgaactcggcaaatatggaggaagctcgtcaccgagtcttccaattcttcagaacggcttgcagatcgttaccctccgtcatggaaatctacaacctctacgacgtcgtttccgtctccgaactccgctcctctgtctcctcccagatccgtaagaacatccacgtcaccgatcccaaaatttttgttgcctattgtcaatggagtaccttgaacctatgtttgtcttttcttctggaagctgaaacatgctgtatgaaaattcttgtgcaggtgatcgatatgctgcttttcaaggggatggaagagctgaagaacgtcgtggaccattcaaagcagaggcatcatatcattggtcagtatgtagttggtcaacaagtacaggattcagccacaaaagaccagggcacctctacttttctgaagaatttctataacaccaattacttttga

SEQ ID NO: 101756 - DNA, 168 bp, Glycine max
  Peptide Sequence Number=SeqID_218534
atgaagtatgaagatgttcccattcattttcattctcattatcagagcctccaactccaattgctttgggccgtgactcggttatgtggctctctaacgtgtgttctaacactagccgttagatggtgggagcttcgacagagacacgagtttcctgcaatcatctaa

SEQ ID NO: 101757 - DNA, 452 bp, Glycine max
  Peptide Sequence Number=SeqID_218535
gaccaagagagccttggcatgatgctcatgcttgtgttactggtgaggcagcttgggatgtgttaacaaattttgagcaaagatggacaaagcaatgtgatccttcttttctagtcccttctagcaccttggcaaatcttatgcctaggacaagctcaagcactcttatggagaggaattggaaagttcaagtatacaggtcaattgaccatgtctcagttagtgacttgtctacaaagttaagtgtggacaggagcatccatgaggcttatgttgaagcaattgggaaaaaccaagggaacatgaataagcttcttctctttgaaggccgtaccattaatgtaggagaaataacatgcactactgatgtcaacagtcacgacccacgaagtacggaagccgacgatggagtccacgacggccgcacggtggaggggaggtttctcggatga

SEQ ID NO: 101758 - DNA, 204 bp, Glycine max
  Peptide Sequence Number=SeqID_218536
atggcaaggctttcactgaatggttatgccttgcatttgtcaagattgccaacttggtattgtggaaaatgtgaccataaactcagtcccatatcccctaggaataacaagtcagtgagcataccccaagctagacaagcgcataacattgtcgaaaggcaaaccaagtccgagaatcatccagacttagcatcacaacactag

SEQ ID NO: 101759 - DNA, 435 bp, Glycine max
  Peptide Sequence Number=SeqID_218537
atggagtcgaagcttctcctcaagcttgactttgggattgggagatggttctcaaacatggcacggggtgttgcccactttatcagctacatgaggttcactgcaatgccccttttttactttgaggaagcaccagagttcggggagtattttatatggtgggtgcagcctacaccgccctactatcgtcatggcgttcctgtggagatcataaagatctcctcttcatcatcttcttcgaatgtgccaaactacgtgctaaggtcaccttatgtcggtggagattctgagcatattgtgtcagcctcgcttgccctagcacccgttggggaggacctagagatgttaaaggaggactcgccgaaggtgatagaggagcctcttgatcttatcatggaggatggcacagtggtagtccgtggggagcttccctaa

SEQ ID NO: 101760 - DNA, 450 bp, Glycine max
  Peptide Sequence Number=SeqID_218538
atgggtgaaaggatgaatggaaagggtgggtcgtcatcattgtcctcatctcttagtatggtgaagtgcaaaagtgaagtacccactgttatgttcatgttgcgtagtgtgaaccattcggggagaaggaatcaagttcttgtagattttttcaatggattggtgatacaggctggcaataacgtgtttgcagaaggtagtgagttggtttggtatgttcaggaaaatgaagagctgaagttgaaagttgcttcattaatggaggaagctaaagaaaatgcaaaagaaataacaaatttgaggaaaaaaaatgttgcacaagaggaagaatgttgtgcatgctcagttcaagttgtgcaattgaagagtaaaattggaaggaaaaagaataatcttgctgttgaaaggaatatagtgaagctattaggtttggtagttgtagttctttag

SEQ ID NO: 101761 - DNA, 1035 bp, Glycine max
  Peptide Sequence Number=SeqID_218539
atgcccaacatttgtgatgaagtggagggtatatctcttaaagggatttccctagttgattacacaattgcattaggaagtaccatgctgatgaggatcaagggtatacttactatccatcgcttcccaaggatgatttctggtgatgaggagctagaggctgagggaaactttgttgtaatagaggtaactaagtttggagttggtgagatggaggtttctaagcaagccatttccatgtccttggagcactctccttatgtggatgcttttgacgactcagcaccagattcaacatcttcaacctttacgataatttcttacgctggtgatgcctctgagtaccaaaactcaatccccaaggttgacaccattactattcacactgaggatgaactaactattcagaaagagaatttcttcgacatcccttctctagagagcatgggtctaaacctaaacgaaaccttgttttgttatgccaacatgtggcaaaatgtagttaacaacaacttcttacaccagttcatgcttttccacctaatggagtgcattccttttgattttccttacaccatctacctcaacatcttgttcattacaaagacgttaggaggtaatgatgacatctactatgttgccctactcaataaaattctatgggggcaaggtgcttatcttgccttcaacgcagtagacgattctaactcaaagaccttagtgaaccagaggaagaagaggttgctccactctaaaggaaagaaaggtaactgctcaacctccaagtcctcttatgcaagcatccaagggctactcaatcaaaaaggagtccccaagaagcaagttgaggaggaaaggaaggtaactgctcaacctccaactcctcttgctcccaaaaaggacaaggtaattaaggcacatcctactagaaagaaacatgtgcttgcacccaacatggtcaagaagttgaagacaatgacaatgtgtgcaaacccaactatctttcagaagttatgggatccatcacatcactag

SEQ ID NO: 101762 - DNA, 534 bp, Glycine max
  Peptide Sequence Number=SeqID_218540
atggtgaaggctggtcaaattttgttgacaatcaaatatcaagatcagaaaaatgtcatcaccatcaagacggatgatgtgttgcctcgggtgattgtcgctgatagagttcttgctctaatgaatgcattagaggttgtcttcccttctgcaaccaacttgttatgtgaatttcacatttctaagaatgtaagaacaaaatgcaagatactcatgactaaggcaaaagactgggaggtggtgctagaagcttgggcaagcttggagagatttgcacaagcatggactgatcgtgttatgcatctcagaaacacaataactaataggatcgaaggcatacatgcaagactgaagaggttgtttcatgatagcacaggagatttgtgtacttgttgggatgcaatgaataacatgcttatgctacaacatattgaacttacaacattgtttcagaaaagcatcaatgtggttgaccacaagttcaatacaccattttacaagagactacgaggctttgtttcaacgcaagcataa

SEQ ID NO: 101763 - DNA, 519 bp, Glycine max
  Peptide Sequence Number=SeqID_218541
atggttgtcggtggtggtgttgacagttacggcagtggtgtttgggttggcggaggttttgggtgggccccacttgcttgggagaggcaggggtatttggatctgttcatgtctttaggggcgtgcatgaagcaaaatagggggtgtaagaagcaaattccaacatctaaaatacccccatcaatgggaggaggaaccatcatgactaccattaccagtcatcgtgtgcctcagtttaggaacaccctcaacaacttctcttctccttctccttcttcttctgctcccaagcttaaccctgcactttcaactacaaacactttatcttgcacttgcagcgtctctcacactcaactttgcaccaaccagccagctccatctcaacgtgaagttgaagatgctgtatcatctcttcaagagggagtgatgtctcatggatataaaagactatatgatgcttttcagttgctgcaagctgatcccactattaaggtttccctcttgactttagtagtttaa

SEQ ID NO: 101764 - DNA, 1506 bp, Glycine max
  Peptide Sequence Number=SeqID_218542
atggctggttcaagtggttatgtttcaggcaacctacctatgcttgatggaaagaactccgatgattggtgtgaggggatgaatgcaatcttcaatttcaaggatatggaagaaatcgtcaagaatggatttcaagaacttggaagaagtgcatcagatgagcaaaagaaaattcacaaagaagccaagaagatggattgcaaagcccagttcttgattcaccagtgtgtagatgttgcaaattttggaaaaacttcaaaggctatgataataaaagaagcttgggacatcttgaacaaagcttatggaggtgcaaacaaaaccaaaaaggctcaaaccattcacaaaagcaaaggtgtaagtcattggaacaagaaaggaaaaggaaaatggatgggaggaagaagtggagaacacctagaatctggacgctctattgatcaacctgtcgatgctgggaaaagggtgtgcatctttagggcatgccctattcagattagtgtagttggtgcacattcgtcatttgtcgttggccttttttaccatgaggacgttggcgagccaggtttagcttgggggcaaatagccaatttatggcagattatgtcgggatggatccccgacatgtcagatggatctcatagatgggaggatacagtgctacttcaagctctttgcatagcactatcgctcttgcctttggtcaaccttgactgttacgatctctcttctcctggagagcttgccctgatcggaagtggtcatcaagtccacgtagcctctggtctcgactttctcgcatgcaagccgaggagtggactacgtgggggtggacaatattatgatgtcagcagaactaccttggtcgatgaggaccctaaacaccatgaagttcattatgacgatggagacaactacagaatcgtcttggttgacggggttgatgcccttgaagtccctatccgtaaaggtgataagagggagacttcactaaaaggggtggaggttgtcactattgctgctgtcttggtctatcatagtcttctactcttcttctatttgcttccttgttcctgttctactcctctagatgtcctccagggcccaacagtgtttggtgttgtgaccaatactgcgatgatatctgcaatatttggttgcgtctttggggtagccagatacgtacctccaggtggtcgaggtcatgcggtgaaacctgctagtggcatactgcgcattaaatcatttgacaagggtgttgaagctatctatggacctaggtggaagtccaccgtaccaggaaggcatacagatgctcatctggatctgttgtcccatcgtatcgctcgagtccgcgctgggcattgcatgtgggagagactcaaatcatctgcagtgttgcatatgcgtcagatgtgtgattcccctagggtgcattcaggccaagctttgtcaactcttcctcatggtgttgctccctgcgatgcggttttggagttgttgtag

SEQ ID NO: 101765 - DNA, 270 bp, Glycine max
  Peptide Sequence Number=SeqID_218543
atgtcctgctccaattgttcatccagtgcgtcgatcttgtacaagaacaaaattattacaaatagaacagaaaaatcaagagtgcagagggtgtgtttatctgatgcctcagactttaaactgagagccatctgcaagagtaacagaaggcaaggtgtccgaaaaagtcaaggtagagaaaagagattggttgtcaatcataagatcaaaggcaccgaaataaaaaaattcaaggtccaagaaaggaagactgaaaaacaaaggctatag

SEQ ID NO: 101766 - DNA, 231 bp, Glycine max
  Peptide Sequence Number=SeqID_218544
atggaatggttttacatgatatttcatcccttcatgactcttgcacaacctggggatcctcctaaacatccacctgtggaggcttgccaagcaatagctgaaaggttgaaaaggttgcttaacctaaggatagtgaccgaaggaacaaaagcatacattatcaccaaagactacctaaggattgcaagaggtgtgactgagcaacgaaatatatatgttcgatcgagatga

SEQ ID NO: 101767 - DNA, 264 bp, Glycine max
  Peptide Sequence Number=SeqID_218545
atggatatgtcagtcagggtcacgctgttttgcgagaatgctcaaatcaagtgggatcaggacaagcttaaaggagcactcaaaccgggtgtatttacctcaaaggcctatactctgaagagtctgtcagggcctctcccttctgattcaggtccaacccctaaaatattttttttgcatgcaaacattgctcatgaattttacaatacttacgacctcacactcgtgtttttaacatgtttaacacattgcgctacaatttaa

SEQ ID NO: 101768 - DNA, 516 bp, Glycine max
  Peptide Sequence Number=SeqID_218546
atggagcaaagcatgctagctatcatagggcaatacaaggaagagttgaaccagtctgtggcccatgaacaaaagctagtggaggattttgcacaagtgtacgccgaaaaagaagcaagagggagggtgattgatgcattgcatcaagaagcgactatgtggatggataggaatttcatcataactaagaaaacaccaaggcacccctataacactcgatccagaaaaatggataatgaagagggcgtgcaggaacagatgaaggccgatatatcggctttaaaagatcaaatggcttccatctcggaggtcatgctaaaactccagaaaactatagaggataaagccatggcaaccgcctccagtacagttagggaagcggaaccgatgctgcagcccgccttaaatccgggcgagacagaaacacggcagtgtttggtcgaaggtatagcccgcaagcttatacttatggcttgcctccggacttcactccccgtgccaccccggaagatttaa

SEQ ID NO: 101769 - DNA, 414 bp, Glycine max
  Peptide Sequence Number=SeqID_218547
atggcttctccacctgccttgcctcctcctcctcttccttcttatcctcctcctcctcctcctcctgcttctttcgacgcatcggcttcgccgaagaaattaagaacatatttagggattgtggtgcgtgataaggtggacgtcacctacaagaactggaaggaggcttctggcaataggacgaaaaggaagttacttcagactgtggacgagagatggaggcagtttaaatcagacctcacgaggaaatgggcccttgcagtcgatcaggacggtgtggacgacactgtctgtgagaaatacagcataagcaacgaaaaatgggccagttttgccagactcgcagagaacccttcttgggaggatgtatgcaaaaaggcacaggccatccagaaacagaacactgccccccac

SEQ ID NO: 101770 - DNA, 721 bp, Glycine max
  Peptide Sequence Number=SeqID_218548
aggactacacgtcctcgcctacatagggctacacgccctcaccttcagagggctacacgccctcgccttcagaaggctgcacatcctcaggttcagaggactacacgtcctcgacttcagagggctacacaccctcaccttcagaggactacacgtcttcgccttcagaggactacacgtccttaccttcaaaggactacacgtccttacctttagaggactacacgtcctcgctttcagaggactacacgtcctcaccttcagagggctacatgccctcaccttcagaggactagacttcctccccttcagaaggctacatgtcctcaccttcatagggctacacgccctcaccttcagaggactacatgtccacgccttcagagggctacacgccctcgccttcaaagggctacacgccctcgccattataggactacacgtcctcaccttcagagggctacacgtcctcgccttcagaggactacacgtcctcgcctttagagggctacacaccctcgcctttagaggactacacgccctcaccttcagagggctacacgccctcgccttcaaagggctgcatgccctcgccttcagagggcgacacgccctcgacttcagagggttgcacgccctcgcctttagagggctatgcgtcctcactttcagtaggctccacatccgcaccttaagagaatttaagatcctttgcccgtaa

SEQ ID NO: 101771 - DNA, 339 bp, Glycine max
  Peptide Sequence Number=SeqID_218549
atgggggagacacatgaagcaccccgagaccacaatctagctgactatgagccttgcctcggatatgccactgagcggcaagcagttggtgagaaaaggctaaaggccattgaaggaggcagagattatgcttttgctggcatggcagaactgtgcctagtttctaacgtcgttatccctccaaagttcaaggtgcaggacttcgataagtacaaggggacaactttccctaagaatcacttgaagatgtactgcaggaaaatgggggcatacacgaaagatgaaaaattattgatgcatttcttccaggaaagtcttactggggaagtcgtcacctga

SEQ ID NO: 101772 - DNA, 489 bp, Glycine max
  Peptide Sequence Number=SeqID_218550
atgcgtttacaaggcaatgcccaatcaattgatgatcaagaaactactaaatttgcaaagtggattctagatattggagatgaagttattgggaatcaaaatgatggatatgctaccgttgaaattcctgagtacctattgattactgaatataatgaccccattgatgctatagtcaaatcaacatttccagatttatatgaacatcacagtaatcctgaattcttcaaatgtagagcaatattagcttccaccaatgaaacagttgaagaggtcaatgattatatactttccttgattccaggtgaacagatggaatacttaagctctgattatatagagaagtcagaaaccattgacagttggcatttccaatcaattacaactgaatttctcaattcactaaacacatctggtctgccaaatcatcgtatcaagctaaaaatcggtagtcctataatgttgctaagaagcttagaccaaacataa

SEQ ID NO: 101773 - DNA, 360 bp, Glycine max
  Peptide Sequence Number=SeqID_218551
atgaggatcaaaaggtcttttaaggttgtaatggggccaaggacaaggtatggagaaatatggaataagtggctaaatcccaaaggaatagaggagcaaaggggaataacctttgagaaacaacatttcattcagcatgcttgtagtgagcttcaaaacaaggaaagggaaacaaggctcaaaagggctatcaaaggaattaattcaaggacgcatcaacaagaatcaagccaaggctattgtgcgagcaatcaatggggcaaaacacaccaaatgattataatgatggatggctcaaattctcacaaaggtaaaatcatcactttcaaattgagctttcaaaactatcatgacatgtag

SEQ ID NO: 101774 - DNA, 147 bp, Glycine max
  Peptide Sequence Number=SeqID_218552
atgcgtcctcctcccacgagtttggagccatgtgtagtgatcgctgagtgcaatcctccattctccagagtttttcatcgtcaagggcgtatcctcttgactaaaagaaaaaaagaaggagtagagacgagagtcgtcatggactaa

SEQ ID NO: 101775 - DNA, 306 bp, Glycine max
  Peptide Sequence Number=SeqID_218553
atggcccttcgctcagcaaacatgcacagctcatccttcttccaaattcttcctcgcactcagccaaggagtgttgcgctcagcggatggctcgctaagccgacaagttggcttagcgagagggtaataagacaatcattcttaactagggatatggctttaggtggtcaaagaaacactcagcctgcaacattatgcataaaaattccgcaacttcaccatagctttgacatgttatggcattatatttgtcaaacattctacaaacatctaaaaaatgtgagaccgttgcatttgaggccataa

SEQ ID NO: 101776 - DNA, 387 bp, Glycine max
  Peptide Sequence Number=SeqID_218554
atgcttaagtttgatatggccattgtattctatgaacttgcctttcacttcaatccccattgtgcggaagcttgtaacaatctcggagttatatataaagatcgtgaaaaccttgataaagctgtagagtgctaccagcttgctttgtcaatcaaacctaatttttcacagtcgttaaataacctcggtgttgtatacactgtccagggtaaagtggatgctgctgcaagtatgattgagaaagctattattgcaaatccaacatatgcagaggcatacaataacctaggtctttttatctcttctttggttattatttatttgtttgtttgtggtttcactgcacttagaagttattgtcttagtcaaggttgtgctagtttatga

SEQ ID NO: 101777 - DNA, 579 bp, Glycine max
  Peptide Sequence Number=SeqID_218555
atgaaagagagcgcaatctggcagattgccgtgctggacgatcatccgctgattggtaaagccatgcagtaccgcttagcgcaggagccgcagctcgatctggtcggggcttttgcccagcgccagcagctgatggccttcctgcagcgccacccgctcgatatcctggtgctggattacatgctgggggaagaccagcttgacgggctgcaaatggtgaaacagctgcgcctgcactacccgcagctgaagattctggtgtcgtccgcggtggagaaaccggcaattgtccagctattgctgaaagccggcgtccagggatttgtcggcaaaagccacgatcaggaggtgctgatcgatgccatccatcaaatctgtcgcggcaagcgcttcctgacgccggacatgatgctggagctggataaatttcaggagagcgatcgcgagatgcacgactacctgacgccgcgccaggcgggcgacgacatcacgctgctgctgcgcgagctgagcccgcgcgaaatcgaggtgattcgctgttatctcgacgggttgagcattacgcagatcggcggttaa

SEQ ID NO: 101778 - DNA, 312 bp, Glycine max
  Peptide Sequence Number=SeqID_218556
atgacggtggatgacataatgcagctgacaatgcggtggtttgggccgaaggaagacaaggtttcgctggaatatattcgccaggtgccgggcgtacgcggcgtggtgggcgcactttacgatgtgccggtgggcgaaacctggccgcaggagaagatccaggcgctggtcgatcaggtgcactcatccggactgacggtcgaagtgattgagagcgttaatattcacgacgacctcaagatcggcctgccgagccgcgatcgctacatcgccaattatcaacaaagtatccgcaacctggcggccgccggg

SEQ ID NO: 101779 - DNA, 302 bp, Glycine max
  Peptide Sequence Number=SeqID_218557
gctcatacttagcccatgggctcaaaatctatcctaaggctcatgagaaccctagggccttcccttggatctctggcccaatctacttggagtcttctatccaatacccttgcggggtaggattgcatcacttatgcgagcccgttgacacgcagagactaacatcgtcttctgcacctttgtcatccagagacggtgagtccgatgacatgcgggggttttacttccgtcatccagagacattcaagcctgacgacgcacaagattcttctttgccaggcagtgacgatcgagttcgatag

SEQ ID NO: 101780 - DNA, 297 bp, Glycine max
  Peptide Sequence Number=SeqID_218558
atgtcaaatgaagaattgaagttgcaggatccacgatgtcggatacaatgtcctgacatcctgcccgaaaatactggagttgttgcacaatgcataagtcaagataaaatgtcaaatgaagcattgaagctgcaggatccacgatgtcggatacgatattttcaggaaagtgatagatctcatccagcatcaagaagttgcagcccagaatcgtacacggctataaaaacatggaggctgcacgagttatgtaccaagtccgggattgaagagttattttgtgagtttgggacttga

SEQ ID NO: 101781 - DNA, 252 bp, Glycine max
  Peptide Sequence Number=SeqID_218559
atgaggggcatcgtacatgagcctcaagtgaacataggggcagatcaaaagttctcacctgtcgatgtttttaaacaagaaaaagaaaaggggggacaaaccctaggatttcaattgattgatcaaacatcaaacgactccattgccgtcactccaaaatgtccgcatttaccaaatttcacgacaaaggttgcatgcatctacatccctaaagatcatgttaactgcatagatcttgtggatttgggatga

SEQ ID NO: 101782 - DNA, 426 bp, Glycine max
  Peptide Sequence Number=SeqID_218560
atgaaggagttgattaacaaaactcaaatctctcccaaaatagtcccaacgtcatcacgttggcttgacgactccactaaagaattttacttcacgtactctactgctgtccatttgctcccacgaatgaaggttcacgatcatcacaggtaccaaccacatggcaactccccccctccccatggtgatcagcctgagcctcaagggagttccaaattgagtgacatgtccccaagtacaactatttccccttatgagaaactacaagtttacggaaatacgggaatggaaataacagaatttagtgcgtcgaaaataaaaaagagcctaggagacaaattcgcccaagtgaatttgttgcttactcttgaaggcatccactcacccaggcaagccgcagctcgcctaggcgagttgcttgcttag

SEQ ID NO: 101783 - DNA, 180 bp, Glycine max
  Peptide Sequence Number=SeqID_218561
atgtcaggacatcgtgtccgacatcgtggatcctgcagcttcacttctgcacttgacttttatcttgcattgtacagcaactccagtattctcgggcaggatcaactccagtattctcgggcaggatgtcaggacattgtatccgacatcgtggatcctgcaacttcattcttcatttga

SEQ ID NO: 101784 - DNA, 809 bp, Glycine max
  Peptide Sequence Number=SeqID_218562
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccaaagtgggagaatacaacagacagagcagattctgacatatatcgagagtcgaggttgccgatatacacgttacgagaagcaccatgacgagccacagcatcggcaatcagaggagatagcaaggaaggtttaccccagcccacctttacatccggagagagaatcatcagacgacgtgactggattgcaaaaagcagggcactggcagcagaagcatcaaggaatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 101785 - DNA, 726 bp, Glycine max
  Peptide Sequence Number=SeqID_218563
ggctacccgccctcgcattgggtactagttaccctcaccttcataggactacacgtcctcaccttcagagggctacacgccctcgccatcagaggactgcatgtcctcaccttcagagggctacacgccctcgccatcaaaggactgcatgtcctcaccttcgtagggctacacgccctcacctttagaggactacacgtcctcgcattcgtagggctacacgccctcaccttgagaggactacacctcctcgccaacagagggctgcatgccctcaccttgagaggactacacgtcctcgccaacagagggctgcacgccctcaccttgagaggaatacacgtcctcaccatcagagggctgcacgccctcacctccagaggactacacgtcctcgccaacagagggctgcacgccctcacctttagagggctacggaccagtagtttccttttaacggttcctgggccaccccctgatattggaggagggccaactgtgcgagcacaaccagagagggaggctatcacgcagctactatgcataccggggcaagatttcacccgggccgctgcaaagagacgagtggatcgcacccacaagacacccagtggacccggaaaagtccaacagggccctagggtttccagctctggtttcgggcctctatcagtcctacagggtgcccggattgcgcctgcaagacacccagtggacccgaagaag

SEQ ID NO: 101786 - DNA, 303 bp, Glycine max
  Peptide Sequence Number=SeqID_218564
atgatattgcacgagattagaaggcctaactctctaaaaatagtccccagtggagtcgccaactgtcgcaacctacccttcggcgggagggcgacgcagggctcacaggtgcgtcttccaagaaaggaaaatgtgcggagtcaccaccaacgtttattcgaggaaaacatcggaaaaatcggaaaggtgtggtctacgaactttaatcgtgaaaggttcgagagttgtttttacgcacgaggaagggtgtctccctcgctcctacgtatcctcaattgcgatgaggaaatcagacctatgtag

SEQ ID NO: 101787 - DNA, 294 bp, Glycine max
  Peptide Sequence Number=SeqID_218565
atggagcgttatctacagcatttggttcgccagcaggtggccaaccaccgtgggcaggtgcagatacatgaatgtctctaccggttcagcctcagtcagcaggggcagggtttcgctggttttgtatgccctaccccagagcagtttggggctgaagtcgcatggcctggagactggcccgatgcccaggcaggagaggagcctacaggatcccccggtgaggcagaggaggcccgtatggatgaagatatgactgacttgctcagtttcttgggaggaagcgaagccacgtaa

SEQ ID NO: 101788 - DNA, 180 bp, Glycine max
  Peptide Sequence Number=SeqID_218566
atgtccgacctgcctctggtgcggatgtggtttcatcgtgcccgggcatctgtacaggcagtgcaaaacctctgcgccagctcccgtgacgctgttcacaatccgtgcaatttaaaagacaccgcggatggtagtggaagccatcataaagctcaaaagcgtgctagaatcctctcttaa

SEQ ID NO: 101789 - DNA, 255 bp, Glycine max
  Peptide Sequence Number=SeqID_218567
atgaataagatgagttgtgacttgcatgagatgcttaatctgctaaatgattatgagaatcaaattgcttctgagaagaagaaaggaactgtcatggtagttggcaagagctccaagaagaaagacaaagtaccaaaaaggaagaatcttggacctaagggtggtatgaccaaacccaagaacaaaaggattaagattgaccaaactgatgctgaatgtttcttttgtaaggagaaagggactacaaataactag

SEQ ID NO: 101790 - DNA, 177 bp, Glycine max
  Peptide Sequence Number=SeqID_218568
atgcccttgcgggataggattgcatcattccctccaccttggaaaggatttgacctcaaaatcccgaggttcttcatactcatgggctccttccctcaacaccttaaggtaaggtttgaaaacccatttcctgggcatcttcccatgaaggaacatggtttctcaccaactcaatga

SEQ ID NO: 101791 - DNA, 528 bp, Glycine max
  Peptide Sequence Number=SeqID_218569
aggaccacatgtcctcgccttgagagaggctacacgccctcaccttgggtactagttaccctcaccgttgagaggactacacgtcctcgccttgagaggactacccgtcctcaccatcagagggctgcatgccctcacctccagaggactacatgtcctcgccttgagagggctacacgccctcaccttgggtactcgttaccctcaccgttgagaggactacacgtcctcgccttgagaggattacacgtcctcaccatcagagcgctacacgtcctcgccatcagaggactacatgttccccattttcaaaggggggcatgccctcaccttcagaggattgcacatccttgccatcataggactacactccctcgccttcgaaaggcgacacggccaactgtgcgagcacaaccagagagggaggctatcacacagctactatgcatactggggcaagatttcacccgtgccgctgcaaagagacgagtgcggatcatgcgcaccaacatgaccactcttacatag

SEQ ID NO: 101792 - DNA, 621 bp, Glycine max
  Peptide Sequence Number=SeqID_218570
atggctgaaactgcagtggcctttctacttgaccatttggttaagttactgagtgaggaagcaacaatcttaggaaaggtgcacaaggaggttgaggagatcaagaatcagctagaacgaataaactcttacattagggatgcagaaaagaagcagttgtcagatgatcaatcaagtgtcaaaagttggttgaaatcattgaggaacgtggcgtttgagatggaggatgtgattgatcactatttgctcaaagtggaagaacgtggtcagaggcatggtatccatggtgcagccactgaattaatagagaaggtcaaaactgtaacacatcgtcatgatattgcatctgatattaaaaaagtcagaaaaaccctagacggtctctacagtgaaggaatggtcttgaaactcgagccatcttctcgtgctccttatcgtgcaactccaaggttaggcgctcattttgtcaaggaacctcaacttgttggtattgatcgtcacaagcagcaactcacaaattggctaacagaaaggggagttccaatcagggtggtggttggcccaccagggatagatttgggctactacaaaatagttatttttattgatttgattctttaa

SEQ ID NO: 101793 - DNA, 678 bp, Glycine max
  Peptide Sequence Number=SeqID_218571
atggtgtttgacaccagttacagcatgaagcaaggaattacttggtgttttgatcgagaaaatgaaaagctaccaaggaagggggcaaaaggcaaccagctctcttgggcaagctctagctcacctgggcaagctcattccttctgggctaaccatgttgaggggagttttaaggagttccaagattcagaagtctacgagaaagaagaagaaagagaaaaagaagaagaaaaaggaggaaagagtgaagcagaggcgctaccgaatcacgaccgtgttttgatgataacaatgatggtaacaaaagatgatgacaaagatgatgacaaaaagctcaaagatcaatcaaagaacaactcaaaatcaagattcaaggttcaagatctcaagaatcaagatcaagattcaagactcaagattcaagaatcaagagaaggcttaatcaagataaggtacatcctttgtggtacaagtagagggtacatctacttgggtttgactgaaaacaagagagggtacatctcttgtggatcagttctagtggagggtacatccactagggttttcaaagagaacaagggaggatacatcccttgtgaatctttgtttgtaaaaggatttttacaaggttggaaaagaaatctcaaggaccgcatgtcgcttggggactggatgtag

SEQ ID NO: 101794 - DNA, 1080 bp, Glycine max
  Peptide Sequence Number=SeqID_218572
atgaacaagtgcccaaagtatggggtatcacgatacaaagtgaaggatgatgacgagtgttgtagtgataaaagcaccaagaaattccccctagcaaagcgaaaatacatgatgttgtctatgaggatatcgggcccaagacaatcagacaataacattgatgtttatctcagtccctcgattgaagacttgacaaagttatgggatgaaggggttactgtgtttgatgggtatcgaagtgagacattcaagttgcgtgcaatgctattttgtaccactaatgactttccaagatacgggaatttgggtggatacagtgttaagggccattgtgcatgccctatctgtgaagaagtcacaacttttaatggaagtcaagagcatgataatgcatcaataccattaactagtcaacaagttcttgggtgggttgagggcatcgatactatatttggaaagacccaaaagaaggtaaaaagtaaaacttccatatggaagaagaggtcgatgttgtttgatcttccatactggtttgatctagatgtcaaacattgtattgatgttatctatgttgagaaaaatgtgtgcgatagtgtcatcaacatgcttcttaacattcaaggcaagacaaatgatggtttgaatactcaccaagatctagttgagatggatatacaagaccatttatatccaagatctgatgaaaaagctattgagttttgttccgagtacatcaaaaaggcaaaacctgatgagattttggagtctcatcataatgaaagagtaggagtttgtcaccaagatttagtcaaggaaactaacccaaaaatgaccaaggataggaccataagtgagaggtggaggcagtttaagtcaaatttgacctctaaatgggctttgacacatgacaaggagggtgtggatgacaaaaagaacaggcttcagagggaagctgatgtagcttcatgtggagcttgtcggccttggctcttcttcatcaatggattcctttgcttcttgaggtatgattgcagcagaatggagaaggagaaagatgaatggagatgccacttcaagtag

SEQ ID NO: 101795 - DNA, 2991 bp, Glycine max
  Peptide Sequence Number=SeqID_218573
atgcttagcttggcttttgctgtttatttccttttgactgcattttcagtgttatcttcatgtggccattcatcacttggctgcaatgaagaacagaggcaagctcttctaaggatcaaaggaagcttcaaagatccatcatctaggctttcctcttgggaaggaggtgattgttgccaatggaaaggtgtagtctgcaacaatattaccggacatgttgtcaagcttgacctcaggaatccttgcttcccactgaggcaccaaggagattttcaaccaaactgtaacgctcttgaagctcaatatgttcacccttccatattgcagcttaaatatctcacgtatttagatttgagtggaaacaacttccataatagttcaataccagtgttctttcaaactatgcagcatctacaagtcctttatctctcttattctaatttttctgggagaatcccacacaatcttgggaacctcacaaaattgcgccatcttgatttcagcttcaattatcttctgtatgctgatgaattctattggatttctcaactttcatcactccaatacctttacatgagcgatgtgtatcttggtaaggcgcaaaatttgttgcagacactcaacatgcttccttctttggtagaaatagaattgatgaattgtggactcaacaagttacacactcatcaacttgttagagccacaaacctttccagattggaagtcctcaatctagcagaaaatgaacttcaagctccatttctggatgcttttcaaaatatgaattccattgcagagattgacctttcttccaacaacttgaattccactccattttggttgggaacttgtactaaccttgtccatctatttctcgatagtaatgctctttatggctcacttccatctgctttagagaatctgacttccttagtttccctcgacctttcaaaaaacaattttgattctgttccatcctggttaggggagttaaagggccttcaatacttgtatctttcagacaatgatttaaaacatattgaaggatctctagcatctattctgggaaactgttgtcatcttcatacattggatatgtcaagaaacaatcttcaaggagacgcaattggagtctatatacagtctggatgcattaggtatgatttaattcaattgggtttgagtaacaacgaatttaatgatagtttgccaccatggttggggcaacttgaaaatctaagtgacttgcttatgtatgaaagtaatttggttgggaccctttcttgtgatatgatgacaaaacttgtcaatttggagtcattggtgcttttcaataataactttaccgggtctcttcctgactgttttgggcaacttgtcaagttagacaccgtagttctttctttcaatcattttcatggtgtcattcctaggagtctagagcaacttgtaagcctaaaatatctagatctttcaagaaactctttaaacggtacaattcctcagaatattggtcaacttaaaaatttgatcaacctctatctttctgataataatttacatggaagcattcctcatagtcttggtgaacttctaaacctgcaaaacttagacctgtccctgaatcatttggagagtttggtgtctgacataagatggcctaaacaacttgtctacctgaaccttaccaataaccatatctctgggtcacttcccccagatttttctgataggttgcccaatgctactcacatgcttctgggaaacaaccttataagtggttccattccaaattcattgtgcaagatagacacattgtacaatcttgacctttcaggcaacatgttatctgctgaaattcctaattgttggagtgcttctcaaatactcaatgagataaatttggcatccaacaaattatcaggtgttattccaagctcacttggtaacctaccaacgttggcatggttgcatttgaacaataacagtcttcatggggggattccatcatctttgaaaaatttaaaacatcttttaattttggatctaggagagaaccttatgtctgggattataccttcatggatggggagcattttctcctcaatgcagattctaaggctgcggcaaaacaggttgaatggaacaattccttcacaactgtgccaactttatgctttgcaaatcttggacctttcaaagaacaacttgacaggctcaatccctctctgcattggaaatctcacaggaatggtttcaagaaataaatcttttgtcacccaacctagtgaagggcctagatattctgaatggtatgaacaagaggtcagacaagtcataaagggaagggaacttgactataccagaaatctaagactggtagtcaacatggatttgtcaaataaccatttgagtggatctattcctgaagggataacattactttctgcattgcaaggcctaaatctatcctacaatcatctgtcagggcatatccctaaaaggataggagacatgaaatcactagaatctcttgatctctctcatgaccaactttcaggaacgatttcagacagcatgtctagtttaagttctttaagccacttaaatttgtcctacaacaacctttcaggaccaattcccaaaggaactcaattgtcaacccttgatgatccttttatttatactggcaacccatttctttgtggacctccactgcaaaatgagtgttatgctgatgatttccaacatggcaatgaagatgaggaaggagaaaaagatgaagtagagaaattgtggttctactttgtcattgcacttggctatggtcttggattttgggttgtgattggaagcttattgatgaagaaaagttggaggcgtgcttactttcaatacattgatgagttaacacagaggatgaacgtatcatgggcaatacatttagaaaatttcaaggaaagacttactggaaaccctgttgctgagtga

SEQ ID NO: 101796 - DNA, 192 bp, Glycine max
  Peptide Sequence Number=SeqID_218574
atggagaagagcaaagtcgatacattgatagcaatttctccaaacacatggcatgcatcaaattattggaagttgaaagttgaaaatggaagttggaagttggaagtggaagttattgcaagttggaagttggaagtcaaaagtgggagttactggaagttgaagttgggagtggaagttattggaagttga

SEQ ID NO: 101797 - DNA, 138 bp, Glycine max
  Peptide Sequence Number=SeqID_218575
atggcgacgactgatccatggacatggagatcccttgtatcgaaagttttcctcacgagtgagtccatgcatagaggtcaggtagtgggtcccacaagtgttgcggtgactttaaagtaccggagtggcataaggtga

SEQ ID NO: 101798 - DNA, 2145 bp, Glycine max
  Peptide Sequence Number=SeqID_218576
atgtctcggtctcaagttgatgatgagcaaaatatgctgataaggcagattatagaaaatatacttgagaaggaccccggtgcagctacattgcggagcgaaacaacaactctggagtctcgtataagaaaattaaaagaatacttcgaagataagaggtatctcattgtgtttgatgatatgcaggatttaaatttttggaatgttatccagtatgccctaaatcaaaatagcagcacaagcagcaaggttattatcaccacacgagatgaaagtgttgcaaatatgattggaagtgatcattttgtgtctgtatatagagtagaacctctatctctaagtgatgctttgatgctcttccgtcacaaggcatttcaatttgagaaagtggaataccctgaattgaatggtttgtccgaagagtttgtggagaaatgcaacagggtgccactggctattttggctattgcttctcaccttgcaactaaggagaaaactaccactgaatggagaaaggcactcattcaacttggctcacgattacaaagtaaccatcttcttgacattgtcaatcaagtaatgttagaaagttaccatgatcttccttcccacctcaggaggtgcatcttgtactttggccttttccctgagggctatttcattagttgcatgacactcattcgtttgtgggtagctgggggtcttgtagaggaaaaaagagatagttctgaagaagacacatcaatggaggaattggcaaaacaatacttagctgagcttgtatgtagatgcttggttcatgtttcaaaggtggattttgatggaagacccaaaacttgtcacgtgtataacctcatgcataagttaatagccaggatttgccaggagcagatgttttgtgatcaagtaaagatgaaagataaaaccacaccatcatcatctaattactccaagttggattcgtcagatcctagaggtttatcaataattataaacagtgatgctgctgccatgaaaagagtcaaaaactggaagaaggttaggtcttgttttgtttttgatgatgctaagaagtggctggtgacagaagaatttttctcaagttttatgcttttgagccaattagacttgtctaatgcacgccttgataaccttcctaaacaagttgggaacctattgaacttgaaatacttgagcctgagggacaccaacatcaagtcacttccagagtccattggcaacctagagaggttgcaaactctagacctaaagcggactcaagtgcatgagctaccaaaggaaattaagaaccttgtcaagttgtgtcatctccttgcttattttatctataatcaatattccgatttggaccgcttacaaggagtgaaggtaaatgaagggcttaaaaatctaacatcattgcagaaactttcatttttggatgcaagtgatggtagcataataaaggaactggaacaactaaagaagttaaggaagctggggattataaagctaagagaagtatatggtgatgcactgtgcaaggctatagagaacatgacccatctatgttccttaagcatcggggctatgggaaatgatggcatgcttaagttggaatctttaagaaatcctccatcttcccttcaacgcctttacctgtatgggcgtttagaaaagcttccaatttggataaaagaaattccaaatcttgtcagattatacttgaagtggtctagtctaaaggaagatccattaccttaccttaaagacttgtcaaaactgttgtaccttaagttctatgaggcttatggtggtgatgagttgcatttcaacaatggatggttgaaaggcctaaaggttttgcatctagagtccttgccaaagttgaagaccataaagattgctaaaggagcaattccttatcttgcagagttgaagatagggaaatgccagaaaatggtgacgtttcccagagatattcagaacttgacaagtcttcaaaagctttatctctatgatatgcaagaacaatttataaatgaatcacgaagtgaagactgcaagattatttttaacaaaatacctcttgtggaattctccaacgatgaccatttttccacttttaataatgctgatgcttga

SEQ ID NO: 101799 - DNA, 760 bp, Glycine max
  Peptide Sequence Number=SeqID_218577
ggagaatggtgttggccaaaataatggaacaaacattcgaaccaatgacagaaaacatgccaaggtttatccaagggaagctagaaatggcattttagacaacaagattgactacttggaaaacaagatgaagatggttgaaggagagttaagagaacctgctgctattgaggctggtttatattcagtagttgctgaccatatggccttgacaactggactaatggcctatgaagatatcacattgtcctacatttttatgatgactgatcatggtcatttttgcaatttgaggggtactgtgcttggaaatatgatgggagattcttgggacatactttcaccctccaatgtaaatgtgacaagccaagacttggcaaacagactaaatgctttcaatctagcttttgatgaaagagtgaatggaaaccatattccttatgctcacaatgtggttgcagtgaagtacctcaattgcggcagagacgaactcatttgcggtagttacaacttcaacggcaatggtagcttcagtagtgcagttttcggcagtcacagggtcaggaagaaggagaaaggagaaaaggtagtggggtgggggtgggtggttcatcagagggtgagggtgggggagcatgagataaaacaaaaaggagaaggaggaaagggtgagtggtgggggagcatgagagaaaacataaaagggaaggaagagtggtgtgggggaagtgactcagaaggaaaatgggaaaaaggatag

SEQ ID NO: 101800 - DNA, 252 bp, Glycine max
  Peptide Sequence Number=SeqID_218578
atggctatgaatatgaagatgtcatacagagtcatgctagttttgttttcacttttcatgttcgtcataccttcaaagcttagtatgcgttgcgatcggggagcgcctcctgagacccctatttcgtgtatagggcgacctggtacgcgtccacctaaaacatcagcttctagttttgaggtagcccgaccggtgccaccatcattcaataggcctcgaaacaagggtacaccttatgttcactatccctag

SEQ ID NO: 101801 - DNA, 329 bp, Glycine max
  Peptide Sequence Number=SeqID_218579
atggaatactttttcaaacatcttgcaccggaacaccccaacaaaacgggagagttgaacgataacatagacatattttggatgtggctcgagcactgggatttcaagaagaaacggatcacacaggaggaaaaggagtctgtcacttatactgacacggtgaaagacaatcggtggaaagatgcaatgaaaggtgagatacaggcacttgagaccaatggaacttggacagttatacatttgcctctaggaaagaaagcacttggctacaagtgggtgtacaaaataaagcataaatctaaaggaagtgtagaacggttcaaagcatg

SEQ ID NO: 101802 - DNA, 153 bp, Glycine max
  Peptide Sequence Number=SeqID_218580
atggcacaggagttatcgcggagttcattttgcggtgagtggaatgggtcgtcgttatcgaagagcggggaggaacacgaagaggcgagtggggcggcaatgagaatggaaaagtcagggtatagaaaaacttttaaatcaccagcattttga

SEQ ID NO: 101803 - DNA, 246 bp, Glycine max
  Peptide Sequence Number=SeqID_218581
atgcaagacaaaattgattgcaataacaaaaatgagataagggaagagagaatgcaaacacaattttatactggttcacccacttcccgtgcctgcatccagtactcaagcaacccacttgagatttccactatctttgtaaaatccattacaacgtttgaaccacacagggacaacccatcccttgtgttcaggaatcctttacaacaagagactcacagtctcttgaccaatctcattgaataa

SEQ ID NO: 101804 - DNA, 510 bp, Glycine max
  Peptide Sequence Number=SeqID_218582
atgagagagtataaccgtggtgacagctggtgcaagctgttcacgctggaggagtcgcgtgagttgagatcattcaagtgcgtgaggcccttgggatactcgagcgatgggaataaggttctattgaaacacaaccggaagaggatgtgttggtatgacctgagaaagaaagaggttacccttgttagaattcagggtttgcctaatttgaacgaagccatgatttgtttgggaaccctcgtcacaccgtatttcttacctcgtgaaatttgtaggaagttgcagactttaggatgcgaacatcccagtatatgcaccggtaaagattttacattaacatttaattatagactaacgtgtatggtaatgatcccaccagagctacttcgcacaactaagcgggtggagtctaatgatggttcagctacagtagtggcacctggtgaatctgtgacagagtctctgaaaacaaattgtggtcatcggatggttgcatgcccctgtaggtga

SEQ ID NO: 101805 - DNA, 486 bp, Glycine max
  Peptide Sequence Number=SeqID_218583
atgtactattaccattcatggttgagcagcatttatagccattataaagaaagtgtttatggaagaatagacaaaggcattgccgacactgccacgcatatatatgcgggtgaccctgccaatgatgactcatcggtgacctacgcattacccttgaagattgaacacacagctcagtctcagtgttttcaacttcaaacactctctctctctctcagattggggcttctaatcggacttgtgggcgtcgagaggagggtcgtggtggtggccggcgacgaagtcgaggagctcctcggcgggtttgggaagggaagcgtcggagttgagcgaagtttgcgtcttggcgaagaagagaacgagggcgagaaaaagcgcagtggagagaaacagtggccagaaataggcgaggatgttgaggaacctcggagcgaagtggagcacggagaagaccgagagggacacgaggagtgccactccgatgtg

SEQ ID NO: 101806 - DNA, 840 bp, Glycine max
  Peptide Sequence Number=SeqID_218584
atgggctcatacttagcccatgggctcaaaatctaccctaaggcccatgagaaccctagggccttctccaacatccctagcccaatcttcctggagtttcctagccatggctctggtgatgggtcaggcaagttggaggttaatcgtcaaattgtagaaaaacaaccttccaagaggtctaccaactctatagcaactagctcatccagccaaaatccagaggcagaagagttcactcaacatgaagttcaagaagaggtaagagaactcactggatgcatcatgcgaaggaatcatccagaaagtccaatcattggtgatccaacagatcatgttcaaacaaaatcatcacctagaacacaagggcacactatagtgatatttgaaatagaacccaaacacattgatgatgcaatacaagatgacaactgggttcaagcaatgcaagaggaactttatcatttccagaataatgatgtttggaagttagttgaattaccaaaaggaaataaatttgttggagcaaaatgggttttaaacaaaaaattagacaaaaatggtaaggttgtgaaaaacaaagcaaggttagttactaaaggatactcacaactagaaggtatagattacaaagaaacttatgcaactacaactcgtctagaggcaatacgcattttactttcatttccaacttatagcaatataaagttatatcaaatggatgaagtttatgttgaaaaccttcaagatttgacagtgaaactcttccccgacatgcttttaagctcaacaaagtcttgtatggacttaagcaagctcctaaagcttggtacaaaaaactaa

SEQ ID NO: 101807 - DNA, 144 bp, Glycine max
  Peptide Sequence Number=SeqID_218585
atgtcgttttacttggttgtgccagtttttctttcaaagatcgcaccttcaagaatacgtgcagcattgaatatacttttccagttgaatatcacccttggcattctcttttccaaccttgtcaactatgccaccaacaagtaa

SEQ ID NO: 101808 - DNA, 295 bp, Glycine max
  Peptide Sequence Number=SeqID_218586
ttctctttgaacaacctagtggatataccctccactagaactgaactacaagagatgtacctctcttgttctcagtcaacaacaacccgagtagataaaccctctacttgtaccacaaaggaagaaccctccaatgtgttaagacaaagttctcaagcggttagtcctttgaaactttgtgagtggggaaacaaaagaattctcaggcgggagaagggagacacaaaagaattcaggcggttagtccttcgttcttttggaaagggagaagagagacacaaaaagaattcaggcg

SEQ ID NO: 101809 - DNA, 348 bp, Glycine max
  Peptide Sequence Number=SeqID_218587
atgatgctcgccgcatggtctgcattgaccaagcggatatggccaacagactgcttgtcggttaaacgttcctttgctattggtgccggtgcagtaacctcctttggctaccgaaaggacatggatgggcaatggttgaagaaggacgccaaacctccgcaagacgaatgtactccttctcctccgcctcaacgagatgactcctcaaccctcatgttctttcggagttacgaggcctccacacctatgttggtgaacgctttgattccttggatggtcgtatatatgccattgatgctcgctttgaaggaatggatacccgcatcactcagcttgaggaggatgtga

SEQ ID NO: 101810 - DNA, 270 bp, Glycine max
  Peptide Sequence Number=SeqID_218588
atgacacatcacctggcactcgtggcatttcctcacatggatacaacaatcgttttccatggtgagtgttcgcttccggcaagtgcaccggatcacacgagtagtataaaatgggtacatctacttgggttgttgactgagaacaagagagggtacatctcttgtggatcagttctagtgaagggtacatccactaggttgttcaaagagaacaagggagggtacatcccttgtgaatctttgcttgtaaaaggatttttacaaggttga

SEQ ID NO: 101811 - DNA, 192 bp, Glycine max
  Peptide Sequence Number=SeqID_218589
ttctacggagtgcctgtcgcccccagcaagatcatcaggccccctactaatcgagctttcatcaagaagtactgcggccccaggcaggtgcagggcaaaacaccacagcagcctggggatggccggcagcgggcaacaaacgcactgccatcacctctagagttcaccgcagctcatccccaaaaagtttag

SEQ ID NO: 101812 - DNA, 525 bp, Glycine max
  Peptide Sequence Number=SeqID_218590
atggaagaaatcgcgattgagcacatcgtgcaacaactggccagcatacgcgaaagcgcattgcggcagcgacaacgcttgtctcaaccgcccaagctgcctgcgcgcaaggcactggggaaatgcgtggaatggttggcggcatcgctgtttcctaaccgtcttggcgactctgatattcaggcgcaggccattaacttttatgtaggcacgacgctggataaagccttacgtgaattacagcaacaagtccgcctggagctggcatttaaagccccaggcacacctgccagccagtttaatacccaagcgcatgccatctcgcatgcctttgccgagcaactgccgcatatccgcatacaactggatactgacctggaagccgcttatcagggcgaaccggccgcagacagcgtggatgaaatcctggtcagttatcctggcattctggcgctgattcattaccgcatcgcccaacgtgttgcatggcttgggcctgaccattattgcgcgcttgatcactga

SEQ ID NO: 101813 - DNA, 260 bp, Glycine max
  Peptide Sequence Number=SeqID_218591
atgcatcttcttcgttcttcttcttcacgccgcgattctgcatcttcttcccaagtgaaggcttattcttcgcgtttctgcttcttcatcttcgttgccgccattgttgtcgggatcaagtggaaagcttcttcttcgcgtttttgcttcttctttgagtttctgcttcttcttcgaggtacgtttctccttcgcgtttctacttcttcccccattgttgccggcgatggtggaaccgctatcgggaagttgctaggctg

SEQ ID NO: 101814 - DNA, 303 bp, Glycine max
  misc_feature (295)..(295): n is a, c, g, or t
  Peptide Sequence Number=SeqID_218592
atggtcattcccaagttcaaggtgccagactttgacaagtacaaggggactacttaccccatgaaccgtctaaagatgtattgtcggaagatgggggcatacgcaaaagacaataaactgctgatacatttcttccaagaaagtcttactggggtagatgttacctggtacgctaacttaaaaccttcccaagtccattcttggaaggacctaatggttgctttcattaggcagtgtcagtacgattcggatatggctccggatagtatgcaactacaatacatgtgcaaaaagngggcatga

SEQ ID NO: 101815 - DNA, 546 bp, Glycine max
  Peptide Sequence Number=SeqID_218593
atgggtgaagcagaagaggtgcaagagcagatgaaggccgatatggaggccatgaaagagcaaatggccataatggtggagaccatgatgagcatgaagaagataatggaagccaatgcggttaccgctaccagcactgttgctaagtgcgggcggccctcatttagtgcgaaaaacaagcatgccttcccaccatatggcttgcctcccaactatacaccacccaatgtggcgtacactcccagtgagaatgtcaataactccactcccatgagtcgacaaccccaaactgatcatgcacatgtctctcaaaccgtggaggagacacatgaaattccccaccacaatctagccgacttcgagccttgcctcggatatgccactgaagggcaagtagttggtggtatactcctacaaaacactttggagggccctcaatttcgcccccaaccacaacccttgcattccacagcaagtaaaatcccttctattatggaaggaatgggaaaagttggatcatctagaggaaaggctcagggtcgttga

SEQ ID NO: 101816 - DNA, 1311 bp, Glycine max
  Peptide Sequence Number=SeqID_218594
atggcgagttatcacgacgcgatattgtccgcactgcgcgaaattgagtggatagccaatgcagatgattacccggaagtggtgacacagttggaaacgccggcggtgtatttgtcgatcgctggctgggaaaatgcccccggttcggatggccaactgcgcgttgagtttgagcatgatctctttgttgttgtcgaccgcgccggcacaaacgaaatcacaaagccccaggtttacatccgaacggcggccgcggacttgagccaatggatccaggggagaacgtttgggcttgaggggttggagccggcggaatttgtcagagctggcccggatgaatttgatatcgcaatggaagattatatcgtctggcgtgtcacgttcagccaggtggctgcgatgggcgaagatccgtttgaatcgaaagccgggccattgaaaaagcgccgggttgccaacatggtccgccgaggggttattcattcggtaaagcacggtcctcagccattctgccgcgtggagattggcgagaatattacaacctggctcccgttatgtcagggattcgccggcgcccatcgcagtgactcaaacccctgtgcagtgggcgatcctgttacggtactttcagaaagcggggagctgaataacggccgcgttttccctggctggaatacgggcgccatgccggcgccagaaggcagcgacgcggaacacatcacccgattcagcgacggcgctgagtttcgttacaaccgcgaaacgcacgcgtttacgttgacgctccccgaaaatggcacctatgaaattatcggcaaagggacgttgcgcgggccggtagaaataacggacacgctgacggtaaaaggtaaaacggacctgcaggcagacactgccgttaccggcgacctgtccgccacgggggatatttccgacggcaaaagcacgctggcgcggggagttaatgcggccagcggtaagcgcctggccgggacagcgcacctgcgccagtccgtctttgacattctgacaacgccgatcggtagtcgcgttttagttcgagattacgggagccgcctgttagacctggtggacaatccccaggacgaaagcacacgcgtgcatattatcgcagcgactgccggcgccctggctcgctgggagccacgcctgcaggttaaatcggtgacggtgcagttttccggctccgggcaatttgacctgacgatttacggcatcaacacagaaacgggctacccgatcaccctgaaggagctaacgataaatggcgaccaattccgcaacgattaa

SEQ ID NO: 101817 - DNA, 513 bp, Glycine max
  Peptide Sequence Number=SeqID_218595
atgtcagagcttgatgaatcttttgcagatttaagactgaatgaagacattggaccattggtagaacaatctacaggaacgaatgtgtctgatcaagtaacaggacaacctcaagaacaaagagaaccaattggacaaattctaagcaagaaccatctagagagtcaaatcattggagacccctcaaccaaagtccaaacaagaggatctcttagacaacaaggtttcataactctcattttagaagtggaaaccaagcatattaatgatgctatggaagataagaactgggtaaaatccatgcaagaggaactagaaaaattcaagaaaaatgatatttggaagcttgtagagagtcaaattctaagcaagaaccatctagagagtcaaatcattggagacccctcaaccaaagtccaaacaagaggatctcttagacaacaaggtttcataactctcattttagaagtggaaaccaagcatattaatgatgctatggaagataagaactgg

SEQ ID NO: 101818 - DNA, 270 bp, Glycine max
  Peptide Sequence Number=SeqID_218596
atgagtcctatagggtgcctgtaccccccggcaaggtcatgccatcgtgacatagctctgattacgagcctttgtcagttctacgaagtgtctgtcgcccccagcaaggtcatcagcccccctactaaccgagctttcattaagaagtactgcgcccccaggcaggcgcagggcgagacaccacaacagcctagggatggccggcagcaggcaataagggcgtcgccgccacctcttgagttcacctcagctcatccacaaaaaggttag

SEQ ID NO: 101819 - DNA, 185 bp, Glycine max
  Peptide Sequence Number=SeqID_218597
atgtggaagaaacggtcaatattctttgatcttccatactggtttgatctacatgtgcgtcactgtctagacgttatgcatgtggagaaaaatgtatgtgatagtttaattgcaaagtcatcaaccctcaacaattggatgacttggagaatgaggctgccattgtcgctttgtcatttggagat

SEQ ID NO: 101820 - DNA, 987 bp, Glycine max
  Peptide Sequence Number=SeqID_218598
agggcacatgccctcgcctttagaggactgcgcatcctctcctttagagggcttcacatcctaaccgtcagaggcctacacgtcctcgccttcatagggctacacgccctcaccttcagaggattgcacgtcctcatctttagcagagtgcaagtcctcacctttagcagagtgcacgtcctagtcttcagagggctgcacgccctcaccttcagagggctacatgccctcacattcagaggacagcatgccctcgcctttagatggcttcatgtcctcagcttcagaggactacacgtcatcgccttcagagggctacacaccctcgccttcagaggactgcacgtccacacctttagagggctacacgccctcgccttaagaggactgcacgttctcgccttcagcggagtaaacgtcctcgcctttagagggctgcacgtcatcgccttcagggggctacacgccctcaccttgagagggctacacgctctcaccttcagagggctgcacgtccttgccttcagaggactgcacgtcctcgactttaaagggatacatgacctcaccttcagaggattgcacgtccttgccttcaaatggcttcatgtcctcgccttcagagggctacacgccttcagtgggcttcatgtcctcacttttagaggattgcatgtcctcaccttcagaggagtgcatgtcttctccttcagagtactacatgtccttgccatcagcggagtgcacgtcttcgccttcagaggaccgcacgtcctcacctttagagggctacacgccctcaacttcagaggatatcacgtcctctccttcagagggcttcacgtccttggcttcgaaggactaaagatcctctcctttagagggcttcacgtcctcgcctttagaggactgcacatcctctcctttagagggcttcacgccctcaccttcagaggattgcacatcctcgtctttagaagagtgcac

SEQ ID NO: 101821 - DNA, 777 bp, Glycine max
  Peptide Sequence Number=SeqID_218599
atgaccgagaacagcgccatgcacagcgtcaccatggtgaactcgatggcggtccattcgccgccactgaaaccgtgcgcgcgttcaaggcccatcacgtggtgctgcacgatgcacgacccgccgaagaccagggtggacagggcgaagatcttccagatcaggcgccagtccagcgcagtggcgaacaccgcagcggtccagttcgttccagcgcagcccgtgccagaggatgctgtagaaggcataggccaggcgcaggaagcagacgatcacgatgaaccgggcgatgcggtagcgcaggcggacatcgggctggcggcggatcagaaccacgccggtaaccagcagggccagcagcagcaccgccttcagcaaggtgtagggtgcggagccggcaagcggaacgatggcgaccaggatgctcagcaggacggtacgccaggtgtaacgaggttcggcggccatgcaggctgcagtcatgcttgttctttccatcaacgcccgcccggggtgagtcgccccggtttccatggaggccgcttggcggaaatcgccggggctgacactaccgtggggccccgtggaaatcaaccaaaccgcaggtgtacgggggcctgcgttggcgtacggacagtcgcgggcaaccgcccttgtctctgggcttccggtcgggatcatcgaccgccccaggtcgctacactaacgatctctccggccatgcctgcgcgtggccacgccccgacgccctgccaagacgcgaaacgccccaagtga

SEQ ID NO: 101822 - DNA, 934 bp, Glycine max
  Peptide Sequence Number=SeqID_218600
tcaatcggtaagataattgagcttattgaagggattaccattcttgctgaggattatcataattcagattccttgtacaaaagagataggaatatccgttcacataagaatcaaggaattcctacaggctacatggtccgtgttttccagtggaaaacatttgaactcagtaatgtcttgcagcaatttgtccatgatgtttctagaatgagggatgccattaaaaaacaatttcattgggatgagacactaagtgaaaatgaagctgaaatagggattggagaacaaaaatcaatattgtcaagaagtggaagtgcagaaaagttggcagagcgtcaagaaaccatccttaaccttgggaaacagttcaaggcattagctgcaccaaaggatgcatacctttttgacaacatgttggctgatgatgatactaaagtaaaggttagcaaagcaagagaaagaggctgcagtcccaccagcattccagtcttaattctatggacattgtaccagctactagaaaacattttacttttgaatgaacttaaaaatgttcaatacaaacacaacatcacagctgaagatgcgtctttgagagcatgtacaaaggtccaacttccaattaaagatgtgcctaacgctaacaacccattcacattcgtaactgcagatttctccactaaagtacaattaactgatgaatgtgcagcttgccactatcacagaggagggcagtgtcaacttgacagcagagagaaattttgttgtaccaacgctacactacaacaaaatcccgcttgcggtggcgcgacaagacacgatgcaggacgcgcgacaatctacttcattccttcggccgaggtcacgggggtgcatcggcgaggtcacaccagatatttcagacaaagggggagggagctcgagggcgagagag

SEQ ID NO: 101823 - DNA, 387 bp, Glycine max
  Peptide Sequence Number=SeqID_218601
gactacggtgtgaccatttcattttacagggctccttatttggttgagattgatgtggtccaaggaaagagaattttgaggctggaggaggttgatgggaatggtgacgcatggagaagtgcagatgtgctgtctttcaacactggacattggtgggatcatcaaggctctcttcaagggtgggattatatggaattaggaggcaaatactaccaagatatggatcgtttagcagctttggaaaggggtataaaaacatgggctaattgggtggactccaatattgatagtagcagaaccaaagtgttcttcctgggaatttctccttcacataccaagtatggactgagtctttctttctctctcttacattattgtactatataa

SEQ ID NO: 101824 - DNA, 225 bp, Glycine max
  Peptide Sequence Number=SeqID_218602
atggagaacacgaagaacggttccaagttgaaagagttaagtgatccacataacaacgtacacgcatttatatgcaaagggtggaggggaaacggtgtcgttttttgtctgatgtcgctttctgcaatgccgtgggaattgttaactggataccgggtggtcccggtcgctcacaccgggaccaccgaccgactctttcgtcttgccaaccgccacgtggtgtga

SEQ ID NO: 101825 - DNA, 261 bp, Glycine max
  Peptide Sequence Number=SeqID_218603
atggtgtcaaagcacataccaaagttcatgaagtggttgaagtatttgtccttcatgtactatggcttcaggcttcttctaaaagtgcaatattcaggtgaccaattatatgattgtgaaagcaagggagggtgcaagaccctgcagagttcacctacatttggcattgtaaacctgaaaggtggattaaaagaagtgtggattctgctagctatggccttagtctttcgattgttagcttacttgtgccttcgtagatga

SEQ ID NO: 101826 - DNA, 297 bp, Glycine max
  Peptide Sequence Number=SeqID_218604
atggttgagatagcaaataggactagtgagtcaagagcctgctttgtttgctaccacaatttgagaaaacataatcttggtcaacttaagctaatgttgcttggtgaaattggtccagtgaaaaatgcatattttgtgatggtggttgaaactattgttttgccaatgacccacaaggagcggttccagaaatttggaattggtccactgaagggagtgcccttatatggacctccaggaactggaaaaacactaattgtccatgcttgtacaacacaaacaaatgccattttctaa

SEQ ID NO: 101827 - DNA, 2304 bp, Glycine max
  Peptide Sequence Number=SeqID_218605
atgccgtttctctatttccagtccctcgcgtttctctgcacccgtcggggcccgttttcaaaagatgtcacacctacggaggttgactgtacgagcattgggttagccacgaccaactgtacagagaaaattgacattgtacataacagctggaaagatgtatcagacatgttaaaggagctggcctcattggaagaacaaacgagacaaggtacctttgtcccccatggtcgtgaagacatacttaacacggccatcgggcgaccagatcatggaggttgtgttcgtgcattgggatctggggtcacaataagtcaatactttggaagggcaccacgtggctccagttgctcatcaggctccatcaaccaagtacagttggctgaaataataggaatactacaggagcagtggaaaaatgatatacaggtattgaaacatgagttgaaggaacaaatcatacttgagatgtcgcaaaggggatcgccgatctcagaacctattcaaccaaatatacatgtgttaggagcacgagtaagcacaaaagggagcaatgcagaggctattgtcaacccatctccgcctaatcatgttgctccttccaaacccactatggggttgtatgttcattgccaagattctacagagttggtggccctaggaaaaacatatgatggaggctcgactatatacaatgtggcttatgcagatgatgtcgtaagggttagtgttgacaaagttattaacggtgacactgaagtcccatttttgacatcagagattaagtatgtcaggcaggcccttcacacattcgttgcatggccaacaacacttgtaaaattggcctctaatgagcatgagggcactagtccaagtaaagtcactgatgaagctgttgaatcggtgaatgatgttgttgtagatgacccactgcgcgagtttattaagaccctagttgacatttatgaaaagcctgtagagttggtgtgggatgtaactaaatttggaattccaaatgcagctgcatcgtttaaaaacttgggtgttggatcgatgtatggattccttgagctacaagctatactgagttcaaaggatagacgtcgacaatgtgaagaatacattcaaaaatggcttaaggaatcgaaccgagatgtctatctaggcactcatttgaattatacaccgcgatggattaaagtgaagagtcacgttcaaagcggaggttatgagtgtggctattatgtcatgcattggatgtcgaacatagtcgccgggcagcataagaatgattggacgctggtattgctgagagatccaacagatgaaaatgtgatccatgttgttgaggaactgcaaaggtggttgcctcgattgagtgccactagtcttcaacagaaaggagatggtaaagagtatcttggtggccaaaatgatgttgaagccgctgaagaagatgatggcccttatcctgcattagatgaacttacctctaagattagtagtcgtaatttggacagagttcgtaaactgaagagtgcaatgacaaggctgactgctagggttcaaagggtcagagatgagcttgaacaattgttggatgatgatgatgatatggttgacctgtacctgtcaagaaaggttggttcatcatcaccagttagtggatcaggtgctgcaaattggtttgctgcctcccccaccataagatcaaagatatctagagcaagtttagcaacaattcatttagatgaaaatgatgtggaagagcttgaaatgttacttgaggaaagcaccgttgtaaaaattgccaatttcaacaacgggcatgacgtcagcatcgacgaaacattgtttttctacaacggtggtttggagaccgatgttgaaacttttaactttcaacaacatcctattcaacatcggttgaccaccgatgtaaaatatggttttccaccgatgttgaaacacaaataccccacggaggaaatgaaattagtacttgctgaagagttaggattgacagaaaagcaaatatctggatggttttgccacaaaaggttaaaatataaaagattgatgaaagatgaagtcgttgctaatgggagacaagattgctcaagtggtgtcatccaagatcgtggtagtggacttgggcaagattcatgcggaagtagtaagcatgctgatcacaggtatctggattcgaaggaggttgagagtcatggcctctataatctggggcaatttgccacgttggatagtttatgtggcactaaaattgacaacaatgcacctcactaa

SEQ ID NO: 101828 - DNA, 441 bp, Glycine max
  Peptide Sequence Number=SeqID_218606
atggttgttgttttctttggtggggttatgatacttgtttttgaatatcttcatgatccagtcggtgatcacaatgaagtaaatctgacttcaaatgttgatcaaccaattggagaaaatttagatgatttcaacaacattgtttttaatgatccaaaagaagaaacaaatgacgtagaggaatttgatggggaatttgtaaaccttgaagaagcaaatagaataagttgtgcaagaaagaaaagaaggagacactctagtgattatgcaaccaacactattgaagagaatgatgacaatgatgttgagtatcactctaaagaattggaaagtgagcctgagtcagatgaggagggtaatgtaattgagaaagagaagttcccaccatttgttcctcaatctagcatggctatacaaatggaatattggtttattatttga

SEQ ID NO: 101829 - DNA, 183 bp, Glycine max
  Peptide Sequence Number=SeqID_218607
atggaagaaggcattaaagctgtgatttttatctacaataagcttcgatttttatctcaaacagggaaggtagaagaagacactaaagctgtgatttttatctacaaaaagcttcgatttttatttcatacagggatttcaatttacattttgatgcagaggctctcaacattcgcaacttga

SEQ ID NO: 101830 - DNA, 597 bp, Glycine max
  Peptide Sequence Number=SeqID_218608
atggagagagctctcactaaagttagcagcatgaaggtggggttggggagctcatggatcaccaagaaggccaaggaggagttctctaacatctctgaagacttctctagtatttcctgtgtgctttggttgaaggagagggaaggggaaatgagtgaaaggactttctcaaataccgttgaagaaaaggcaaaatggatcttcaacaaattgaaaggcaagccgcagaaaagcctaccggatctcctccgagagtacaatttaccgccagggctatttccacagaacataatctgttacgagtttgatgaaaccaagggtaagctgattgtctacttgccatctacatgtgaggtcagcttcaaggactcttctgtgctgagatacgcaactcgagtcaaaggggttctcaccaggggaaaactttcagccatagatggaatgaaaacaaaggttcttgtgtgggttaaggtgacaaacgtggcagttgaaggttacaagtctgacaagttgtggtttactgctggtgttaagaagtcaaggacaaaggatgcatatgatacacctcgtgatgctgtcagagtatcagaattctga

SEQ ID NO: 101831 - DNA, 1002 bp, Glycine max
  Peptide Sequence Number=SeqID_218609
atggatagtattttgctatcatgtagatcaactttgaacagtttctttttgtatagacatactggtaaaaagagggtggatgagagtaagaccttgactttagacggcatcaggaactctttgattaggcaggaggatagcataatagtcagtcttttggagagagctaagtattcttacaatgcagatgcatatgacaaagatgcattcttcatggatggctttaatgggtctttggttgagtacatggtcttgcaaactgaaaagcttcattcacaggtgggaagatacaagagcccggatgagcatgctttcttccctgaatgcttacctgagccagcgcttccacctttgcagtacccgcaggatctccttccaagattggtaaaagcgggagatgatgataactgtggatctgttgctgtttgcgacactctttgcttgcaggtgaaggagcatggatgtcttttttttgttacatttctagctcacctcctaaggggttggtctagtggagcaagggtcttgcctataacaggtcacaaattcgtgctctctctcatctctttggagcgagtacaaattccgagttttcgctataatgcttcggcaccattacaggctctctcaaaaagaatccactatggcaaatttgttgctgaggcaaagtttcaagatgccccttctgaatatgtagctgccattgaagcgaaagacaggaaacttttgctggatttgttgacatatgaaacagtggaggaattagtcaagaagagggtagaaattaaggcaagacaatatggccaggtggtgaagatcggtgaaacaggtgatatagccactcctgtgtataaaatcaagccaagtttgattgcaaatctttatggagattgggtaatgcctctcacaaaagaagtgcagttatcagtaagggatggcctgggacacttagactactttgtaaagcttaacactggacaacaatggtgcttttctggttag

SEQ ID NO: 101832 - DNA, 231 bp, Glycine max
  Peptide Sequence Number=SeqID_218610
atgttgacatctctggaaagggtgcagatgaccacattggtctctgcttgtcaatcggacttggggtctccgaatgacaaggtgcggataaccgttaccgtcaggtgcctccgcatgccaccggtctcttgggtcacggtaacaaaaggtggggtggtcgacaaaagcagggcttttgctcctacgtatcctcaatttgtgatgaggaactcagacctacgtagttcttga

SEQ ID NO: 101833 - DNA, 1549 bp, Glycine max
  Peptide Sequence Number=SeqID_218611
atgttgtccctaaagattagtttgactataggcatagtcctttccattgtatccatagtttcccatgctgaaacaagcttggatgttgaaattcaagcattgaaagctttcaagaactccatcactggtgacccaagtggggctcttgcagattgggttgacagtcaccaccactgcaactggtctggcattgcatgtgatccatcttcaagtcatgtcatttcaatttccctggttagtcttcagctccaaggggagatttcacctttccttggaaacatttcaggccttcaggttcttgatttaacttcaaactcattcactggctacattcctgctcagctcagtttttgcactcatctttctacactatctctttttgaaaattctctctcaggtcctattcctcctgaattaggaaatcttaaaagcctgcagtatttggatttaggtaacaatttcttgaatggaagcctccctgacagcatattcaactgcacttctttgttgggaattgcttttactttcaacaaccttactggcagaatcccatcaaacattgggaatctagttaatgctacacagattttaggttatggaaataacttggtagggtctatacctctttccataggtcagttagtagctttgcgagctcttgattttagccagaacaagttatcaggtgtaatacctcgagagattggaaatctgacaaatttagaataccttctattgttccaaaattccttgagtgggaaaatcccttccgagattgctaagtgtagcaagcttttaaaccttgagttttatgaaaatcagtttattggaagtattcctcctgagctaggaaatttagttcggttggagactctgaggttatatcacaataatttgaattccaccattccatcttccattttccagttgaaatcgttaacacatttaggactctcagagaatatattggagggaacaatatcttctgagattggatctctgagttccttacaggttctaaccctgcattcaaatgcttttactgggaagatcccttcatcaataacaaacttgacaaacttgacatatctgtcaatgagccagaatctcctttcaggtgaacttcctccaaacttgggtgtgcttcataatttgaagtttcttgttttgaactccaacaactttcatggatccattccctctagcattaccaatattactagtcttgtaaatgtaagtttgtcttttaatgctttaactgggaaaattcctgagggtttttcaaggtcgcctaatcttactttcctgtctcttacatccaacaaaatgactggggaaatcccagatgacctctataactgctcaaatcttagcactctaagtttggcaatgaacaacttcagtggattgataaaatcaggtatccagaacctgtctaaactcatacgcctgcagctgaatgcaaattctttcataggaccaattccaccagagattggaaacttgaatcaactcgtcactttatccctttcagaaaataggttttcag

SEQ ID NO: 101834 - DNA, 243 bp, Glycine max
  Peptide Sequence Number=SeqID_218612
atggaacaattacacaagaaaattgaggatgacttagaggtctcaagaaggatgctatctttcaatgttgttaatggtggatggcgattcatagcggaaagtcaaaaatccgtcataaaaatatggcagatacagggattgggatctcttaagctacactttccagatgtacctgtcatggcattgactgccactgcaaggcatgcagttcgtgaggtaatcagaatatcaaatcacctttag

SEQ ID NO: 101835 - DNA, 1716 bp, Glycine max
  Peptide Sequence Number=SeqID_218613
atggggaagcttaatcagcttttatcattggatctctctcacaaccagctcacaggatcaattcccagagatgtcattgcacacttcaaagacatgcagatgtatcttaacctttcttacaaccacttggttggaagtgttccaactgagttgggcatgttgggaatgatacaagctattgatatttcaaacaataatctttcaggtttcattcccaaaacacttgctggatgcagaaatctgttcaatcttgatttttcaggaaacaatatttcaggtcctattcctgcagaagcttttagtcacatggacttgcttgaaaacttaaacctctcaagaaatcatctagaaggtgaaatccctgaaatattagcagaacttgatcatcttagttccctagatctttctcagaatgacttgaagggaactattcctgagcgctttgccaacctttccaacttggtgcatctcaacctttccttcaatcaacttgaaggtcctgtacccaattccggaatttttgcacacatcaatgcatctagtatggtaggaaaccaggatctttgtggagctaagttcctatcacaatgcagagagacaaaacattcactatccaagaagagcatatctattattgcttcacttggatcacttgctatactgctattactagtgttggtgattctaattctcaatagaggtatcaaactctgcaattctaaagaaagggatattagtgcgaatcatggaccagaatacagttcagcattgccacttaaaaggttcaatccaaaggagttggagattgccactggttttttcagtgcagacagcatcattggttctagcagtttgagcacagtttacaaaggtcaaatggaagatggccaggttgtagccataaaaagattgaatctgcaacaattctctgcaaatactgacaagatcttcaagagagaagccaacaccttgagccagatgagacataggaatttggtcaaggtacttggatatgcctgggagagtgggaaaatgaaggctttggttctagagtacatggagaatgggaatttggatagcatcatacacggcaaaggggtagatcagtctgtgacctctaggtggacattatctgaaagagtccgagttttcatttctattgctagtgcattggattatttgcactctggttatgattttcccattgtgcactgtgatttaaagccttctaacattcttttagacagagagtgggaagctcatgtcagtgactttgggacagcacgaatacttggtcttcatgagcaggctggtagtaccctttcctcatcagcagctttgcaaggcacagttggctatatggcaccagaatttgcctacatgaggaaagtaacaactgaagcggatgtgttcagctttggtatcatagtaatggagtttctaacaaaaagaaggccgacaggactctcagaagaggatggtttgccaatcactttgcatgaagtggtgacaaaagcccttgcaaatggaatagaacaacttgttgatatcgtggaccctttgttgacttggaatgttacaaaaaatcatgatgaagtgttggcagagctctttaagctatccctgtgctgcaccctccctgatcctgaacatcgacccaatacaaatgaggtgttatctgcccttgtgaagcttcaaacaacactgtcttgttaa

SEQ ID NO: 101836 - DNA, 408 bp, Glycine max
  Peptide Sequence Number=SeqID_218614
atgaaagcattttgggttctcccatcttccttcaatctagttgtagccagaattgtccctcacaagatagcagtgaacctcctcaagcattcctctcagtttcctaagaatttccaacaatccatcaagacccttctcatttttaaacagatcatgtcactccagccaatgaagctgaagataatgatgatgacattgaacaggccaaagtgtaggaaggaggtgctgaggttagatgggtggatcaaccactttatgaatggtggtggggaggagaagcaagaacccttgagattggcacacctgcttttagggaaagctgcttttaattctgatggtgcttttggagaattggacttcccttcaggcattcaagaatttcttcatactgatcctccctgtaattaa

SEQ ID NO: 101837 - DNA, 891 bp, Glycine max
  Peptide Sequence Number=SeqID_218615
cacggcctcaccatcataaggctaaacgccctcacctttagaggactatacgtcctcgccttgagagggctacacgtcctcgccttcacagggctatacgccctcacctttagaggactatacgtcctcgccttcagaggactatacatcctcgccttcagaggactatacgttctcgccatcagaggactacacgtccttacctttagagggttgcacgccttctccttcagagaactacacgtccccaccttcagaggacaaaacgtcctcgccttcagagaactgcatgtcctcgccttcagaggactacataggactatacgtcctcctcttcagagagctacacgccctcgccttcaatggactacacgtcctcctctttacaggactaacgtcctcgccatcagtggactacacgtgcttagatttagagggcagcacgccctcgctttcagagggctacaagtcctcaccttcagaggactacacatcttcgcttttagagggctacacgccctcaccttgaaagggcttcatgccctcgtcttcagagggctacaccccctcgccttaagagcactacacgtactcgcctttagaggactacacgtgctcaccttcaaaggactacacgtccttgcctttggaggactacatgtcctcgccttcagaggactatatgtcctcgtcgttagagggttacacgtcctagccttcatagggctatacgccttcaccttcagaggactatacgtcctcgccttcagagggctacacgacctcgctttcagaggactatacctcctcatcttcagaggactacacgttctcaccttcagaggactacaggtcctcgccatcacaggactacacgtcctcgccatctga

SEQ ID NO: 101838 - DNA, 1152 bp, Glycine max
  Peptide Sequence Number=SeqID_218616
atgacctcacaagtcaaatttaagacattcagtccttgtccaaacaatcacggttttcttcctaattcccatgctgaaacaagcttggatgttgaaattcaagcattgaaagctttcaagaactccattactgctgacccaaatggggctcttgcagattggcttgacactcaccaccactgcaactggtctggcattgcatgtgatccatcttcaaatcatgtcatttcaatttcctttgttagtcttcagctccaaggggagatttcacctttccttggaaacattcctggccttcagaagagcatatctattattgcttcacttggatcacttgctatactactattattagtcttggtgattctaattctcaatagaggtatcaaactctgcaattctaaagaaagggatattagtgcgaatcatggaccagaatacagttcagcattgccacttaaaaggttcaatccaaaggacttggaaaatgcaactggttttttcagctatgacagcatcattggtgctagtagtttgagcacagtttacaagggtcaaatggaagatgaccagtttgttgccataaaaagattgaatttgcaacagttctctgtaaatactgacaagatcttcaagagggaagccaaaatcttgtgccagatgagacataggaatttggttaaggtacttggatatgcctgggagagtgggaaaatgaaggctttggttctagagtacatggagaatgggaatttggatggcataatacatgacaaagggaaagatgagtctgtgatctctaggtggacattatctgaaagagtccgagttttcatttctattgctagtgcattggattatctgcactctggttatgattttcccattgtacactgtgagttaaagccttctaacatccttctagatagagattgggaagctcatgtcagtgactttgggacagctcgaatacttggccttcatctgcaggatggtagtaccctttcctcatctgcagctttgcaaggcacattgggctatatggcaccagaatttgcctacatgaggaaagtaaccactaaagcagatgtgttcagcttcggtgtcatagtaatggagtttctaacaaaaagaaggccgacaggactctaa

SEQ ID NO: 101839 - DNA, 2364 bp, Glycine max
  Peptide Sequence Number=SeqID_218617
atggcgtcgaagctgagaacgtgcttcatgtgctggaacctgagcggtttcaactgcgttaaccaccacaacggcagaaatagggtagtgcgagtttcgtttccagcttcttgcgaaatgcgacaccgcgccaccttcagttcacagcataagagacaacagatcaagccttccgcagagggaggtctccgtcagaatcaagatgaagaagacgatgctgccgaggtttcgttgaacaacgatgattctgtggagaatttgaatgacgcaaccgcgcctttggccataaacataaatggagcagagcaggctgaacagttatctggtaggcaacttgaggatttgctgggaatgataaaaaatgcagagaaaaacattcttcttttaaacgaggctagagttcgttcacttgaagatcttgaaaagattcttgcagaaaaggaagcattgcaaggagaaattaatgtcttagagacgaggttggctgagactgatgcacagattaaagttgccaaccaggaaaagatacatgtggagctcttggaggggcagttagagaaactgcgtatgagttggcccaaaaggaaagtactgaaggaaaatattctgaattgcatgaccttcaaaatggagcttagtgataccaagaataatgatgaacgtttggtggcattggaaaaggaacggtcctctttggaatcagccctaaaagacttggaatcgaaactatcaatctctcaggatgatgtatcaaaaatttctacgcttacagttgaatacaaggatttgtgggataaggttgaaaatttgcaatcattgctagataaagcaaccaaacaagctgatcaagctgttattgtgctgcaacaaaaccaggatcttcgaaggaaggttgataaattggaagaatctcttgaagaagctaatatctataagctatcatctgataaactgcaaaaatatagtgaactaatgcaacaaaagttaaaactattggaggaccgtcttcaaaaaacagatgaagagataaattcttatgttcagctatatcagcagtcagtgaaggaatttcaagatacacttgatactctgaaagaagaaagcaagaaagggaatttagaagaaccggtggaagatatgccatgggaattttggagtcaactgttacttctaattgatggttggaaactagaaaagaaaatatcagtagatgatgcaagtcttttgcgggaaaaggtgtggaagagagacaggcgtattattgatacatatatagcttgcaaaaaacagagtgaacaggaggctatttctgcgtttcttgggcttttatcatctgcaacaagtcctggattacatgtgattcatattgcagcagagatggcaccagtagctaaggttggtggtttgggggatgttgtcagtggtctaggtaaagcactgcaaaagaaaggacaccttgttgaaattgtgcttcccaaatatgattgtatgcaatatgaccgtgtctgtgacttacgggctttggatgtgctgatagattcatactttgatcgtcaattatacaaaaataaaatctgggttggcactgttgaaggccttcctgtttatttcattgagccccatcatcctgataagttcttctggagaggagaattttatggcgagcgtgatgatttcagacgattttcattttttagccgtgcagctcttgagtttcttcttcgagctggcaagaagccagatatcattcattgccatgattggcagacagcattcattgctcctctgtactgggaaatatttgccccaaaaaaaggattaaattcagctaggatatgctttacatgccacaactttgagtatcaaggaactgcagcagcttcagagttagaatcatgtggtcttgaaagccaccgtctaaacagaaaagatagaatgcaggacaactcatcacatgatagagttaattctgtcaagggtggaattgttttctcaaacattgtgacaacagtttcacctacttacgcccaagaagtgagaactgaagagggaggacgtggtctccattcaacactctctgtccactccaaaaagttaattggtattattaatggtattgatactgatgcatggaatcctgccaccgatgcatttcttccagtccagtacaatgcaaccgatcttcaaggaaaagcagagaataagcaagccttgggaaggaacctaggtctttcatctacagatgttaggagacctttgaatgataagtctaaggctaactgcacttgtgtgctttatgtaacatttgagatgaatataccaagactctttcaaatagctttatcttgtgaaatctatctataa

SEQ ID NO: 101840 - DNA, 1896 bp, Glycine max
  Peptide Sequence Number=SeqID_218618
atgagaagtaatgtgttggttaagtttgcattttatttgaagcaagaggaagaaaagcaagtggcaaccaacattaatggtttccgtttctcttctgctatttatgatcactctctgacgcgcttctcctaccaaatcaagtgcttccgtctcttctccttcttctctgatttgaaggatttgtgtggctggagatggtggtttcggggccgatcacgccggggcaggttcgtcattatcgccactgttgtgattcttcgattcggtggcgaaaattcgaaaatgcgtgttttagtgaatggaattggtttcagttcgtgtgtggtgtctttcttgctgggggttattccagtttttgtttcatggatatattcagagtacttggagtacaagaaaccctcatctcctcccaaagttcattcagatgtttgtcttgaagagttggggaaggatgcaattaaggaagatgatcgggccattttgctggaatcagggcttacaagatcagcatcagcaaaattccatccatcatctgtcaaattgaatttgattcggtttttgaccatggatgattctttcttgttagaaaatcgagcaactttgagggcaatggctgaatttgggctgattctgttttatttctacatatgtgatcgaaccaacatacttggagattccaccaagagttatagtcgggatcttttcatcttcctctaccttcttctgattatagtttcagctttgagttctttgaagaaacataatgactcatcaacattttctggaaaaaatatactttaccttaaccgacatcaaacagaggagtggaaaggatggatgcaggtcctctttttaatgtatcattattttgctgcaacggagatatacaatgcaatacgtgttttcattgctgcatatgtttggatgactggatttggaaacttctcctattattatatcagaaaagattttagccttccacgttttgctcagatgatgtggcggcttaatttttttgtggccttctgttgtattgtgcttaacaatgactatatgctctactatatatgcccaatgcacacgcttttcactttgatggtgtatggagcattgggtatatataacaagtataatgaagttccctctgtgatggctgcaaagattttggcatgctttcttgtggtgatcttggtttgggaaatccctggattctttgacatattttggagcccatttgctttatttttgggttatactgatcctgcaaagcctgatctccctcgaatgcatgagtggcatttcagatctgggcttgatcgctacatctggataattggaatgatttatgcctactttcatccaaatgtaatctccaatactagcttgtgtggtggtcattgggttgagaaatggatggaaaaattggaagagagtgagatcaagaggagagctaccatcaaaaccagcattgtttctgttgcattatttgttgggtacttgtggtatgaatacatatacaagctggataaggtctcatacaacaagctccacccctacacctcatggattccaattacgtggcttggcaagattactttggagacatacatttcccagtttcatatttggttaaggtctaacatgccaaacggacagcccaagtggcttctttctcttatcccggagtatcctatgctcaacttcatgctaacaactgctatatacgtctttgtatctcatcgactttttgaattaacaaatacactcaagacagtgttcatacctacgaaagacaatcgaaggctgctgcataattttattactggggttgtactttgcctttctctgtattgcattgcacttattcttcttctgattcctcattcaacggtttaa

SEQ ID NO: 101841 - DNA, 1116 bp, Glycine max
  Peptide Sequence Number=SeqID_218619
atgtctgttgaacctaaggaactttactaccaggaccttgtcctagaccacaatatcattaataatcagcatcagggcacagaagcaggatctaatactactatgtacgaaaagcacttttcctctaccttaattccttcagtttcagcagcatatgattcatcacaagcctttgatccctcttacatgagtttcactgactgtttgcaaggaagcatggactacaactcacttgcaacttcttttggcctttctccttcctcatctgaggttttttcttctgttgaagggaaccaaaagccagcagaaggaggaggagatggtggtggtggtggtggtggtagtggtggcagtgaaacccttgcgacccttaactcttctatctcttcttcatcttctgaagccggggctgaggaagattcaggaaagagcaaaaaagaaaggcaagtgaaaactgaagaaggaggagaaaactctaagaaagggaacaaggagaagaagaaaggagagaagaagcaaaaggagccaaggtttgccttcatgaccaagagtgaggttgatcaccttgaagatggatacagatggagaaaatatggacaaaaagctgtcaagaatagcccttacccaaggagctactacaggtgcactacacagaagtgcacagtgaagaaacgcgtggagaggtcatttcaggacccaaccactgtgataacaacgtatgaaggtcaacacaaccatccggtccccacttctctcagagggaatgcggccgcaggaatgttcacaccctcttctttgctagccacaccaactcatccactcgcagccgggtcaaacttcccgcaagatctcttccttcacatgcattaccctcgtcaccaccaccaatatcatcacattcacaacaacctcttcgccacacaatccatgacaaatgctactactgctactactacaaccaccactgctaccatcgctccgtcctcgttttactcttcctataacaacattaacaactctcttcttaacaaccagtttcttcctccagaatacggcctccttcaagacatagtcccttccatgttacacaacaagtcccatcataaccagaattaa

SEQ ID NO: 101842 - DNA, 366 bp, Glycine max
  Peptide Sequence Number=SeqID_218620
atggctaaaccaagcagccccgcaaacttggcatcagccatcatttgtttctttgcctcaaagaagttctctcatagactaaaagcatcaccgggaaggtttgcaaggcaaaacccttcaccacaccctttccgtcatggtccatgttcatggatttttcaaagcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgagggtgcatga

SEQ ID NO: 101843 - DNA, 498 bp, Glycine max
  Peptide Sequence Number=SeqID_218621
atggctaagtttgacccagatatagttctagagttttatgctaatgcttggcccacggaggaggacatgcggtcatgggtaaggggccagtggattccttttgatgcagacaccctcagcctattcctgggtgacccgctggtgttagaggagggccaggagtgcgagtttagtcagataaggaaccgggccgatgaatttgacgaggaggccattgcccaactgttatgcataccgggtcaggattttgcccggaccgctgccgggagacgggtgcggatcttgtggcatggagcgggtttcactccttttgcgtgccctactccagatcagttcagggctgaggttgcatggcccggagattggcctgaggcccaggcaggggaggcgcccgtagaggctcccagcgatgcagagaaggcccgcatggatgaggagatgacaaatttacttggtttcttgggggggagtggagccacatcaccaagggatccctag

SEQ ID NO: 101844 - DNA, 991 bp, Glycine max
  Peptide Sequence Number=SeqID_218622
atgcggcaaggccagcatttgcaagcattacacactttgcagcaagaatggcagatgactattcctgcagtcatgccggatacgcagccttctgcgcagcagcaggaggctttgctggcattgttccgacagcaacaatacacgcaaatggagcaggatctgcaggcattcttgcatcagtatcccgcctggctaggtggttggaaaatgctgtctgacgtattgatgatccagaaaaaggatgcacgagaatctgctgcccaggcactgcttctgaatgtcgatgatgctgaggaacattgctattacggtttggcactcaaggcccagaatgatctggtcgcggcagctgaggcttttaaacatgcaatccagctcaaacccgcctacgccgctgcctacaacaacctgggtattgtgcttaaggatataggccaggtagaggaggcgatccagcagttcaaacaggcgcttatcttgcgccctgagtatgctgagggctttagtaacctgctgttttgcatgacacatgccgaacaggtggataacgaagctttactgcaggcgcatatcgcgtatgccgatttatatgaagcacctttgatggcgcattggcagccacatgccaatacacgtgatgccaagcggccattgcgtattggtttcgtctctgctgatttgcgcgcgcactcggtcgcgcacttcctgttgcctttgttacctggcctggcaaaagacgcttcgctggagttgtttgcctatgctaactatgcactggaagatgaggtatccgccgagatgcgtcagtatttccggcaatggcgcatggtgagccatatttctgatgatgacctggcagcctgcatcaggcatgaccagatcgatatcctggttgatttgtctggccacaccgctggcaaccgtttgttgacctttgccagaaagccggcaccgctacaggcctcctggctgggttaccttaataccacag

SEQ ID NO: 101845 - DNA, 600 bp, Glycine max
  Peptide Sequence Number=SeqID_218623
atggcatcaattgtatcctctacaggcgcatcgggtttaccgattgactcgctggtcactgcgcaaatgcagttagagcagcaacctctcaccgatattcaaaccaagatatcttcatataacaccaaactatccgcttatagcacgcttaaaagcggattaagtactttccagacggccgtgactaaattggctactgcagcccaattcaacgcacaatccgtgacagccagtgacgcgaccagcatcagcgccaccgcaaacgggacggctgtggtcggtaactacagtgtcagcgtcagccagttggcgactgctcaaaaattggcaacttcagcgtttagcagtgccaccgacaccgtgggtaccggcaaaatcactatttctttcggcacttatacggctgctgccggcagtgatcctgcttcattcactgcgaatagtgacaagtcagatatcaccatagacattaccagtagcaacaatacccttgccggtatccgcgatgcgattaatgcaaagaatgcctctgtttccgcatccattgtgaatgatggcagtggtaaccggctggttattacctccaaagataccggggaa

SEQ ID NO: 101846 - DNA, 180 bp, Glycine max
  Peptide Sequence Number=SeqID_218624
atggctggaagaaaatttgggggcgagggttttcgagagagagaagagttgcaggtgcagggaggcgttgtaatcgattacacaaaaatggtaatcgattaccagagagcaacattgccagaaataactgcttgtaatcgattacactattatggtaatcgattaccagtggttttttag

SEQ ID NO: 101847 - DNA, 405 bp, Glycine max
  Peptide Sequence Number=SeqID_218625
atgctgctgatgccgctggtacgctttgtcagctcgaccgatccggagtggatcgccacgctggatgcgattaaaacccatctggtgagcgacggtttagtgcggcgttataacatcagtgagacgcccgccgatgcgctgaccggtggcgagggcgcgtttgccgcctgttcgttctggtatgtggagtgtctggcgcgcgccgggcgggtgcatgaggcccacttcgaatttgaaaagctgctgagctacgccaatccgctgggattgtacgccgaggagtttaccgcgcacggcaacgcgctgggcaacatgccgcaggcgctgacccatctggcgttgatcagtgccgcgtttttcctcaaccgtaaactgagcggcgaagtaacgttgtggcaaccgtaa

SEQ ID NO: 101848 - DNA, 486 bp, Glycine max
  Peptide Sequence Number=SeqID_218626
atgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcaggcaggcttatatttcttagtttcaataggactccttacgagtgttgtttctatctactattatttaaaaataatcaagttattaatgactggacgaaaccaagaataactcctcacgtgcgaattatcgaagccccctttaagatcaaacaattcacatcgaattaa

SEQ ID NO: 101849 - DNA, 138 bp, Glycine max
  Peptide Sequence Number=SeqID_218627
atgtcgcggaacttcacggattgcttaacgatgggtgtcaagttccttgaagcggtcaagagaaggttgcatatcatcaaacaatggtccccggacgaaattagggtgctcttcaaattctctatatgggacccataa

SEQ ID NO: 101850 - DNA, 213 bp, Glycine max
  Peptide Sequence Number=SeqID_218628
atggtcaggacctgttcgaatcggaaagagagaagagtctttggaaagggattcccaggttcaaggaagtatttacgaagtacaaggctaggacaagaaagagggcttcgaatcattgggcgattcgagctggcgaatggtcgagtcgaagtcatcaagctggcgtatggtcgagtcgaaacacttggcattagggtagtgttcgaccgttag

SEQ ID NO: 101851 - DNA, 150 bp, Glycine max
  Peptide Sequence Number=SeqID_218629
atgggtggtacaaatcaattgtgtcaactaagatttggcaagaatatactacaaaggatgggaagggaaaacagtgaaggtgactcacaattcacaggctgtaagctaggcataggtgcaacttcaccatcatctacacttttaggttaa

SEQ ID NO: 101852 - DNA, 679 bp, Glycine max
  Peptide Sequence Number=SeqID_218630
ggccctcaatttcgcccccaaccacaaccctcacattccacaacggttaaaaaccctcatgctatggcagaaatgggagaagttggatcatctagaggaaagactcaaggccattgaaggaggcgaagattatgcctttgctaacctagaagagttgttcctaatacccaatatcatcacccctcccaagttcaaggtgtcggactttgacacgtacaaggggactacttgccccatgaaccatctaaagatgtattgtcggaagatgggggcatacacaaaagatgaggaactgctgatacatttctttcaagaaagtcttactggggtagctgttacctggtacactaacttggaaccttctcgagtccattcttggaaagacctaatggttgccttcattaggcagtgtcagtacaattttgatatggctccggataagatgcaactacagaacatgtgcaaaaaagggcatgaatctttcaaagaatacgcccaaaggtggagagacctggcagctcaagtggttccctcaatgacggaggaagaaatgataacaatgatagtagacatattaccagtgttctattatgaaaaatggtgggttacacaccttcaagctttccggatttggtctttgctaaatgatcgaagtgggtctgaaaagaggcaaatctga

SEQ ID NO: 101853 - DNA, 225 bp, Glycine max
  Peptide Sequence Number=SeqID_218631
atggagtggaagagatatttctcaaaattggaggtggaacattttcaatgggcatgcccttggtatcattcccaagatatggtctttagttgtggcaattttcctaatgtgtcattaatgaggccaagaggatgcgtagcctacaccccgacagttgcttttaggcaactcaaatggactcaaggtgatagtcataagcaacaggaagaagtcaaaatggcttag

SEQ ID NO: 101854 - DNA, 870 bp, Glycine max
  Peptide Sequence Number=SeqID_218632
atgtcttacactgagttattgcctcacttaattcaaaatggaatggtattacctatctcaatgaatcccgtggggtcaccatatcctaggggatacgatgctaatgcaaagatggttgaatttcaacctaatgttgggaataatcctttactaggccatggaggatggtttgtcaatgctattgaatttgtggaacaaaccatgaagttgaggggaagttcaaatggagatgttgggtgtggattacaccctattgcaggtcatgcaattggagaatctgttgattttaagcaaatcctgcaagacttgatgtataagaaattggtgcaaggtgtcaactccccgactcttagcgcacccggagtcggtagcatgactcaaagtggtcgaatatacactccaggaaaattaatggtcgaacaaaaaagggatgaggagaaaggaaaagaaagggttaatcctgaagtggtttggaagtatggtgcagaagaaaagaaaaggttgatcccaaagaagcaagaggaaataagaaaagaggtttctgatgaagaagctaatgaattcctaaagttcattagacaaagtgaatatgcagtgatagaccaacagaatcgcactcctgccaagatatcattgttgtcacttatactaaattcagaacttcacaggaagatgttgttcaaggtattgaataaggctcatgttattcattatatatctaaagagaaattcgaagggattgttggaaacatcactactagtaatcacctaacatttactaatgatgagatgcatgtggaaggagcagggcataataaggccttgcacatatcagtgaaatgtagagatcatatctgggaaaagtgctag

SEQ ID NO: 101855 - DNA, 540 bp, Glycine max
  Peptide Sequence Number=SeqID_218633
atggactaccaccttcaaagaggcatagaacatcaagttgatgtcctccttccaggagcttcattgcctaacaggccaacttacaaaagcaatccccaagagactcaatataaggatgcacaagctaaagttgagtatgtgaaaagattgcatgaccaagtgaaggcacaaattgcaaagaagaatgaaagctatgccaagcaagccaacaagaacaagaagaaagtggtacatgagccaggtgatggttctgaacatttgagggtaaatgctttccaagaaggagggaatgatgagaatccaaaaactgcccaaataccgggacctatgaccaaaaggtttgctaaccagcagatccttttcagcaaaaataattaccaatttttcatcaacaacaaatttgaccttttggtgaagggtagaaggcacaacccttgcataatgaatccatggtcttccaagaaggcagctataagttggtacaatgtccattacttgaaatactacctcaaaggtaataggatcgatttggataggtag

SEQ ID NO: 101856 - DNA, 252 bp, Glycine max
  Peptide Sequence Number=SeqID_218634
atggctggtgagattgccagtgaggtatccgggcttaggatgcagatgcctgtgaagtttcgggctttgatactgattgtcgatgatgctcaggatgcagacgtcggtgaagtttcgggctttgatactgattgtcgattatgtatcctggttgtgacgttgagtgccggtgaggtgtcggtgctgatttcgggctttgatgttgactatcaggctatgatgatgagtaccggtgatgtattcggactatga

SEQ ID NO: 101857 - DNA, 1827 bp, Glycine max
  Peptide Sequence Number=SeqID_218635
ggacttgagatcgccaatgtcacttatgtgaaggaggggaaaaccatctcaaaattccaaccatcaagtccatccatgatggtggcaaaagttaagcttgagaatgggtatcactatgagaggggattaggaagaaatgcacaaggcttaggccgactgcctgaccagattgaaaataaagactgctttcgtttgggctataaaccttcaaagaaggacaagaggaggattgcacatgagaaaaaagacaagaggatcagcactgataatgctagtatcgcaccacatagttttgagtatcttgagaatcaggtggatgaggaaattgaggatgatttggaaccttcccttgaactattgagattggtggaacaagaggctaaagagatccgatcccatgaagaaatgactgaggtgattaatttggggattgaagaagagaaaaaagaggttaaaattgacaaacttatgaaagggaatatgccaggtcttgatgctaggataatggagcataagttgccattaaagtcagaatgtcctccggttaaacaaaagttaaggtggatgaaacctgaactatctttgaaaattagagaggaggtcatgtcattctggctaaagaatgttggggcaacataccaaagagtgatgatgatcttattccatgacatgatgcatgaagagattgaagtttatgtagatggcatggttgccaaatcgaaaaatgaagaagatcattcaggaaagttgttagagtttgtagtcagccaaagaggaattgaagtggatcctcacaagttaacaactacgttcgaacctatcttcaagctgttatgcaaaaatcaaccattggaatggaacactgattgtcaggaagcctttgagaaaataaaacaatatttgcaaaatcccccaattttggttccactggtccctaaaaggcctctgattatgtatctaacagtgttggatgggtctatggattgtgttttaggacaacatgatgagtttggaagtaaagagtgtgtcatttactacttgaacaagaagtttattgggagaattgctagatggaaagttctcttattagagtatgagattgtgtatgtgactcaaaaggcagttaaagacattatggtggtgcttcaggaggaagaaacaccaaaagaaggaaaatggatcatgttgtttgatggagcatccaacgtactagggcacgagattggagctattttaatttccccagaaaaacaatacatcccaatcataacaagcttgtgctttgaatatacaagtaatgtggcaaagtatgaagtatgtactttggggcttcaggcaaccgtagaatcaaaagttaaaaaacttaaagtctatggtgactcgaccttggtcattaaccaattgaatggtgaatgggaaactcaagatgccaagctaattccttatcagacttacattaaggaattgatgaagcaatttgaggaaatttcttttgatcatatcattcaggaaaataatcagttggtggatgcattagccaccttgtcctttatgtttgcattgagcgaggatgaagacatgccacacacaaagatccaatgttgtggaaaaccagcatattgtcatttggtagaggaagagttagatggaaaaccgtggtactatgacatcaagaaatatatcaaaagtcgagaatattcaccaagtgatttagagaatgataagagaaccttgagaagtgcaaaggaatatcagagaagttcacaaaggctcctttggtacccactcaagtgggcaagccatggcaagaaagatcttgagagctag

SEQ ID NO: 101858 - DNA, 375 bp, Glycine max
  Peptide Sequence Number=SeqID_218636
atggccaatcccaattgtcaagggttccatcacagaggaccttctggctacaatcaagggggaaatttttctcaaggccaaggttggagatcccatcatgggaataacttcaacaaggatcaaggtggcccatccatccgaccttctaatcaagggcccaacatgtatgagaggaccaccaagctagaagacactctaactcagtttatgcaagtgtcattatcaaatcacaagagcactgagtttgccatcaagaatctagaggtgcaagtggatcaactagccaagcaactggtgagtaatgaggaaagagagactaaaaagagagaagagggtgatgaagagaaagaagagagcaaggaaatgggtggaaag

SEQ ID NO: 101859 - DNA, 348 bp, Glycine max
  Peptide Sequence Number=SeqID_218637
atggctaactttgttattgttgatgatcatcccattgtgcgcgtggcgataagactggtgctggaaaatgccggacatcgtgtttcagcagaggctggcgacggcgacaatataattagcctggtcaaagaacagagcgccgatgcggcaattattgatattgatctgcccggcattggcggtattgaagcggttaagaaccttcgcaccgtcggatcgttaattccggtgattgtcatgagcgggaaaaacgcggaattttatgcttatgagagcaaaaaagccggtgccaatggctttatcagtaaaaagaacaatctcaatgatctggcccacgccgtcgacgcg

SEQ ID NO: 101860 - DNA, 246 bp, Glycine max
  Peptide Sequence Number=SeqID_218638
atgacaacagagggtggcaaggtgagtaaacctgtagtcctcagcctacagcgtaacctgatggtttttatttgtctggcgattggttttgagacaggtcttaaagaggttaagacctgtctcaacgttagaattcagcccaatcccgtagctttaattattttgcggcatcaggtgaaggagaaaattcctatcgcatcgccgccgtttaaaccgttaggtcgtatccgtccgggttcgacataa

SEQ ID NO: 101861 - DNA, 159 bp, Glycine max
  Peptide Sequence Number=SeqID_218639
atggccggtcggctaggtttttccgtgagagctcaaccgagggttcgttccaacagacactggcatgttgttcttcagccggtgtcggtcgttatatggccccgactgatatctttcagccgacattgcgcaatttcttttacaaacgcttgccgttaa

SEQ ID NO: 101862 - DNA, 339 bp, Glycine max
  Peptide Sequence Number=SeqID_218640
atggtcatgggtggtgaaggaggagtttctagggtggtttggcggagttttgagagagaaaggtgtgaaaattgtgtttttcaccctgaagaacatatttataatctgctaatctcgcttagtgagctcgtctcgctaagcgagaatccacttttgacgttaagcgtgactttcgcgttaagcgcaaatccctctcagcacgcttctcacgttgagcgagttgcaaaaaattattattttttaaatctcaacggtcaaaacgtgaagaaatgggttatgaacctactaaccaaatttgaaggcgacccaacggttaacgaatttgggatcacggtttaa

SEQ ID NO: 101863 - DNA, 981 bp, Glycine max
  Peptide Sequence Number=SeqID_218641
atggcaaaaacaaagttgagctgcatcaaagacgaaagatggtcactccatggcatgacagctctagtgactggagccacacgaggcatagggcatgcaatagcagaagagttggcagaatttggggcagtggtgcatatatgtgcacgtaaacaacaagatattgatagatgtttggaagaatggagtaagaaagaatttcgcataacagggtcggcatgtgatgtactatatcgagaccaacgtgaaaatttaatgaaaaatgttgcttcaatctttcacggaaagctcaacattctgataaacaatactggaacaaatacaccaaagaacctcatagattatactgcagaagatgtaaccacgataatgggaactaattttgagtctagttaccacctatgccaactagcacatccacttctaaaagcatctggatatgggagcatagtattcatatcctccattgcaggtcttaaagctttgcctctttgttctatctatggcccctctaaaggtatgtttttcctatgtttaactagaacgccacgtgataaatttggagttgcaaaagagcataatcaatcagcatataaattttattcaggagctatgaatcaattgaccaagaacatagcattggaatgggcaaaggataatattcgtgcaaataccgtggcacctggacctgttaagaccttacttctggattctttcgtggttgcttcaacaagcaagcattgcttcaagattaattcaacatcgagctttgcttcaaaacaaagtatttccaagacatccaaggttgtgaaatctggtaatgaagcggataaagccattgaggctatagtgtctcaagcaccggctggtcgacttggagatcctgaggacatatcagcaatggttgctttcctttgccttccagctgcgtcattcatcactggccagattataaatgtggacgggggttgtacaatttaa

SEQ ID NO: 101864 - DNA, 181 bp, Glycine max
  Peptide Sequence Number=SeqID_218642
ttatcagcgactctgtgcatctttcctcctttggaaagcgcacccgtgagcctcgccttgctcgcccgcaaaagggcatgttgcgacagttggcgactccacttgggactgttttttcacccacgggtttgagtaaaaaaggggccctatacccgggttcatgggaatctaaggagtggag

SEQ ID NO: 101865 - DNA, 258 bp, Glycine max
  Peptide Sequence Number=SeqID_218643
atgcataaatgtgatattagcagaacctacacacatgctaggaagaagatgtggcatttggttaataaaacaaagactgcatctcttctcaagcaagagcatgtacaattaggatccaaagctaaatttttcctcaccggttatgatcagtctcccatcacaaaacttgggtggctagtcaactcaggatactttggcaaacttattcctggagctccacaaccattggccagagcatgtacaattatgcaccagtaa

SEQ ID NO: 101866 - DNA, 186 bp, Glycine max
  Peptide Sequence Number=SeqID_218644
atgggaaacgacaaggagaagatgaaggtgcatgagaatgagaacggttcgtatttggtgtctgcgtccacttgttgggccacgcatgatcgtgcatgttcggctgtccaaccgtgtacggtgacggtgaaagcacctaacaccgcatcgcaccagagtcgtgtccagtgtaggacacgctgctga

SEQ ID NO: 101867 - DNA, 549 bp, Glycine max
  Peptide Sequence Number=SeqID_218645
atggctgaaacaaagttgagctttaaggacaaaagatggtcactccatgggatgactgctctagtcacaggagctacccgaggcatagggcatgccattgttgaagaattggcagaatttggggcagctgttcatatttgtgcacggaaccaagatgatattgataaatgtttggaagagtggaaaggcaagggacttactgtgacgggttcagtgaacaatgctgcgacaactataacaaagaaaataatagattacactgcagaagatatatcaaccataatgggtactaattttgagtccgtttatcatttgactcaacttgcacacccgcttctaaaagaatctggacaaggaagcatagtatctatttcgtccattgcaggtttaaaagcccttcccgttttctctgtttatgcagcttccaaaggagccatgaatcaattcaccaaaaacttagcattggaatgggcaaaggataatattcgtgcaaatgctgtggcacctggacctgttatgacaaaacttttggactctatcatggattaa

SEQ ID NO: 101868 - DNA, 414 bp, Glycine max
  Peptide Sequence Number=SeqID_218646
atgagccttatgcttattgtgatgctcagtcctcaagtgttcaaagacggaccttcttcttcactctgttattgtcttccttctccttcactgtcacctcactttctcccttcctcctcgtcgtttaggttacactccattaaagccttctatcaaaacaaccctgcatttcacaccccctctcctccaaaccctaacctcgttcatcactgccactgccttcttcttcatgtgcttccaccacacaacccctcgttcttcgcctcgcaccaaaacacgtggctggcggatgagaagctcctccgacaccagattgacaccacgacggaggagattgtgcgcttgcatggccacatagtggagctcgatgacggaggaaaaacatttttgggaacagtaatggctttgatttag

SEQ ID NO: 101869 - DNA, 330 bp, Glycine max
  Peptide Sequence Number=SeqID_218647
atgcttcagagcattcatcagagacagatcattttattacagagtttatatgtggtggcacctccaggatctattcctttagttgagcagttcagggagatggatgagtcatctaaggccaccatcctagagccatttgttatagaagaagaggtagaggagacacagcgtacaacagacccctccactcctattctagagatgccagaggacccgaccacactagtcctggctatggacacttctcctccagctactccagtacttcatctaacagatgagcaggatgttcagacactggacacccaggaccagtcacaggaattctga

SEQ ID NO: 101870 - DNA, 732 bp, Glycine max
  Peptide Sequence Number=SeqID_218648
atgtactggggcaacaacccttcaatgctcctcgtcaattgcctctttcgcatgggcggctccgcggccctcctatcaagccaccactccgaccgccatcgctcgaagtacgagctcttccatacgctaagaacccacgttggcgctaacgacaacagctacaaatgtgtctttcaggaagaagacgaggagaaaaaggttggcgtgtctctatccaaagagctcatgaacgttgcgagggatgccctgaaggtccacatcacctccctcggcccggtggtgctcccgatctccgagaaattgaagtttttggttaacctaatagagaggaaggtgttgaagacgaagatcgagtcctacatgccgaacttcaagctcgcgttcaagcatttttgtatccacacaggaggtagggctgtgttggatcgcatgcagaagagcctcgaactcgaggattggcacatggagccttctagaatgacactttacaggttcgggaacacgtcgtcgagctcggtgtggtacgagttggcgtactgtgaggctaaggggaggatcaagaagggtgacagggtttggcaaatggcattcgggtctgggttcaagtgtaacactgctgtgtgggttgcgttgaacacgatcgaaccggggtctgtcaagagtccatggagggatgagatacatagttttcctatcaagattgatccacttcctgtgaagaataacaaataa

SEQ ID NO: 101871 - DNA, 678 bp, Glycine max
  Peptide Sequence Number=SeqID_218649
atgacactgttacttctcactgtgtcatggtcaggaaccatgtttacacacaccaaggacatcccatttgcaacatgtatgttatgggcactgtatgctaccgccctggtggtccgcgatatggagaatgtcagtggccgagcgattgtcctgcttggttttgccgtcggcggcgcgctgggattgcgtgtcgggggtgcctttgctgtcatttacctgatcttgctggtaattggccgcgtattgctcgaccaccatcaggagcatacacctatcctgtcacgtttactgcgcatggtggtggttttgctgccagcagccgtcctcgcatttgtgtttatggccatgtgctggccgtggagcgtgattgaggtagacaacctgctggaggctgccaaatcgttctcccattttgattttaatatgcagactattgcgaatggcgtggtctacaacatcagtgaagttcctcgcagctacttgttccaataccttgctgtcaaactgccagaatccgctttgctcggcttgttcgcgttgcctgtgctttacctgtgttgcaggcaggcactctgtatcgctgaccggccgacgcgcatggtcatgtacaccttattagtcggcaccctgtttcccttggtattcgtgatggatgaccggcctgcgctttataacggc

SEQ ID NO: 101872 - DNA, 673 bp, Glycine max
  Peptide Sequence Number=SeqID_218650
atgaggggcaacgtgcatgagcctcaagttaacataggggccgatcaaaataccctggtcttcagaggactacacgtcctcgccaacagagggctgcacgccctcaccttaataggactgtgtgtcctcactttcagaggactgcatgtcctcaccttcagagggctacacgccctcgccatcagaggactgtgtgtcctcaccttcagagggctacacgccctcgccatcagaggactgcatgtcctcaccttcagagggttacacgccctcgccatcagaggactgcatgtcctcaccttcgtagggctacacgccctcacctttagaggactacacgtcctcgccaacagagggctgcacgccctcaccttgagaggactacacgtcctcgccaacgtagggctacacgccctcacctttagaggactacacgtcctcgccttcagaggactccatgtcctcaccatcagagggctgcacgccctcacctccagaggactacacgtcctcgccttgagaggactacatgtcctcaccatcagagggctgcacgccctcacctccagaggactacacgtcctcgccttgagagggctactcgccctcgccttgggtactagttaccctcaccttgagaggactaaacgtcctcgccttgagaggactacat

SEQ ID NO: 101873 - DNA, 310 bp, Glycine max
  Peptide Sequence Number=SeqID_218651
atggggtatttcatatttctcccccatgggttgagagacatgtccaggatcagcctggggttgttggctctcaatgggtatgggtgcagagctgtctacattctcattgggagtgtgtgtaacattgggcggtgtatggttgggagtcaagccatatggtgggaaggaatgcttgttttgaacttacgcaaaatgggggccacccgtacttcccaattctttgcctctcttccctaccatatccaagacggcgtgatttatttggttgaggccagatgggggagtcgggtccacctcagcaacggcactg

SEQ ID NO: 101874 - DNA, 570 bp, Glycine max
  Peptide Sequence Number=SeqID_218652
atggatcctgatgtcaataggtacatacttctgaatgaagcaaaaggcctagttcctggctaccccgactccatgaggaagatactagggactaacattgctgaggttcatggtgccattcataaacgaattagagggtcactattatctctcattggtccaattgcagttaaggatcgtcttttgccagaagttgatgagttcatgagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 101875 - DNA, 369 bp, Glycine max
  Peptide Sequence Number=SeqID_218653
atgagtcaatctcttgcattctcaaaagggtggacccttgggtacacgccctcaccttcagagggctgcacgttctcaccttcagtggacccgaagaagtccaacagggtcttgaagttgccagctctaattacgggcctttgtcagttctacggagtgcctgtcgcccccaacaaggtcatcaggcctcctactaaccgagctttcatcaagaagtattgcgcccccaggcaggcaaagggtgagacaccacaacagcctggggatggccagcaacaggcaacaaatgcaccgccaccacctccagagcccctcagctcatccacaaaaaggttagagtattgcctacgacacatggccgacaaatag

SEQ ID NO: 101876 - DNA, 222 bp, Glycine max
  Peptide Sequence Number=SeqID_218654
atgtcttctgatggaatcggggagaaaatcttagattcaggtcatcatcatgagcatagttcaaaaaaggctttgctttgtttctttggagaacataaccaagggaaacttgttcttgatattattgtccggatatccttcatcgcacttacgtcatatctaggggaaaaggatttacaggtggtagttattggtgatgatcaatctgattatacacaatag

SEQ ID NO: 101877 - DNA, 441 bp, Glycine max
  Peptide Sequence Number=SeqID_218655
gacaggacaacacaaccaattccagaggaacctcaatcttctgagtcgtcttctatttttctagaaccaagggaacctgaattaggtgcatccatggcttatatcatggctggagatcaacctaggagggttactcttgaagattattctagctcatctgtgccacagttcttcgcaatcaaaattgctggtgttcctgaggatgctgtgcggctgagtttgctctcattctcactgcctggagaagcaaaaagatggctacattcgtttaaaggtaacagtcttacgacttgggatgaagtgtccaagcagctgttggacgcttctgttgggggaaaaatcaagttgaagaccccgaaagaggccatggaactaattgaaaatatggctgcaagtgatcatgccatactgcgtgatcggactcacattcccagaaaatga

SEQ ID NO: 101878 - DNA, 258 bp, Glycine max
  Peptide Sequence Number=SeqID_218656
atggaggggttattgatgcgattgcggcggcaaccgttgtggacttggtgctcaccggtgtggctgaacatggtggctctcattctcataactgtaccttcgaattcttgtcttttttggttgaacatgtgcggagatgtcgcggtggagatcttgttttccgggaggaagacgatgaaagggatccccgcagctgcgaagtatccggaaaacgcgacggaggtagcagtcgtggttgtggaagatgcggtgtcgtag

SEQ ID NO: 101879 - DNA, 285 bp, Glycine max
  Peptide Sequence Number=SeqID_218657
atgaggcttgcttctagcaatttgagcacttcttttcgcacttcttccttcatcacagggttcaatcttctttgtggctgtcttaccggccttgtggtcacttgggtgcttgttaaaaagaggctaagtcatgaagtgcaaaaagtgacagttgagctcagctcatcagttgggctaagtgcgcatccattgctaagcgcagcttcagtgtgcttagtgagacagaagaatttggcagagcatcaatatcaaggttgcgcggtaagcgcgagatcagtgcgttaa

SEQ ID NO: 101880 - DNA, 543 bp, Glycine max
  Peptide Sequence Number=SeqID_218658
atggaggcaagagagccaaagggacttatggtgaaatatgaaaggctctacaatatttgttttgcctgtggtcatcttgaccatcttttgaaagaattggtccctcctactatgggactgttgggtggtagaggggaaaccaagggacatggggaccccaagctcatacccacaccaaacctaccagatcttgtgacccctaatgccaaaagagaccatacaagttatagccaaggagaggacaaaggggagaaggaaagaataaggtgggaaagattggctcaggaggcaaagatcaatgagggcataagcattcatcttaaccactcattaaagaagcttatgcatgaactatcggcacatgttgtttttagactcgttgggagcaataaggctccaaagttggaactactgagggcttggaaaccttcatgcagtaagagctttgaagaagctcatcaacttagaagttaccgatctagtgttcttgatggaaaccaaaaagaaatctatggagttaaggacttttctcagaattgctaa

SEQ ID NO: 101881 - DNA, 435 bp, Glycine max
  Peptide Sequence Number=SeqID_218659
atggtgaaaaccccttactgtgacaaaaaaagtggactgaaaaaaggaacatggacaccagaagaagattggaagttgattgctcatgttaatgcacatggccacaagaattggcgccagttacccaagcttgcaggtcttgcgaggtgtggaaagagctgcagattgaggtgggtgaattatttaaggccaggcatcaagagagggaactatactcatgaagaagaagagacaattatcaaacttcgcacaagtcttggaaataggtggtctgtgattgcctctcacttacctggaagatcagacaacgagataaaaaatcattggcatgcccatcttaagaagcgctttcaacacgacgaagcttccacgccaaagctgcatctctccacagttgaatccattcaagagaataaattactcagtggaagttga

SEQ ID NO: 101882 - DNA, 450 bp, Glycine max
  Peptide Sequence Number=SeqID_218660
atgaagggaatcacaggagcaccttacagggcacgttgtgatgctttgaccgtcatggatgtgtcctggttgccatacactgagcatcggggggttagggcctttgagctaatttcatcattccagggtcagctgagatggggtcctatggtggtcacagctcgaccggagagggtggtacgacagtttggttacattcagagcatccctccgccgcctgttagtgctcgattgtcatatgatgatatagatgacaggtggatgcattttgaggagcacgtactacctatgggtgagctttgtctagtgcctgggcaagtatctgcggattacatagagtggtttttccgcatatctcacccattcatgataccgacccaggcaggtgaccagcccagagatgcaccagccgcagaccctgaggagtacatacagctgcccaacccccag

SEQ ID NO: 101883 - DNA, 522 bp, Glycine max
  misc_feature (213)..(213): n is a, c, g, or t
  Peptide Sequence Number=SeqID_218661
atggccccgaggaagcttgcctcaaagaggtccaggaaggacaaggcggccgaaggaactggttccgccccggagtacgacagccaccgctttaggagcgctgtacaccagcagcgcttcgaagccatcaagggatggtcgtttctccgggagcgacgcgtccagctcagggatgacgagtatactgattttcaggaggaaatagggcgccgncggtgggcaccactggttactcctatggccaagtttgatccagaaatagtccttgagttttatgccaatgcttggccaacagaggagggcgtgcgtgacatgaggtcctgggttaggggtcaatggatcccgttcgatgccgacgctatcagccagctcctgggatatccgatggtgttggaagagggccaggaatgcgagtatggccagaggaggaaccggtctgatgggttcgatgaggaggccatcgcccagctgctatatatggatgacgttgctcctcagcaacatcctgcccaccgatcataa

SEQ ID NO: 101884 - DNA, 192 bp, Glycine max
  Peptide Sequence Number=SeqID_218662
atggtgatttcgcgcgttttccttccttggaaaatgcaccgtgagcctcgcgccgccctcctgttgaaggccctatctcctcacaggaggaagtctatcaggtcagccatgtccctgcgggcccttcctgcgcctcaaaaacgggccaatccccgggccatgctactacagcctcaaactgctatggagtag

SEQ ID NO: 101885 - DNA, 145 bp, Glycine max
  Peptide Sequence Number=SeqID_218663
atgagactaccggtggcacgccaaggttatctaatgtcgcaaggatactccaacgcatgtgatcgacatgagccacatagagattccaaaccagataacaaccctaaggacaaagttattcttcaactcattcatgccttccttg

SEQ ID NO: 101886 - DNA, 216 bp, Glycine max
  Peptide Sequence Number=SeqID_218664
atgggtgttaaacactttgaggcggtcaagcgaaggtcgcatgccaacaaacaatggtccccggatgaaattaggaatcggacgaccaacatcatcccgataccatcgactcatttgccttggtcgacgaatggtgcggataaccataagatgacaaaaggtgcagaagacgacgttagtctctgcgcgtcaacgggctcgtttgcccctggttaa

SEQ ID NO: 101887 - DNA, 387 bp, Glycine max
  Peptide Sequence Number=SeqID_218665
atggagatggctagatcaatgctaaaagaaaaaggtttgcctaataaattttggacaggagcagtttacactgtagtcaacatacttaacaaatgcccgactaagacattagctacaagaggaatcttcttgggatacaatacacaatcaaaaggctatagagtctacaacttgcaaacgaagaaactcactgttagtcaagatgttgaagttcaagaagtagcaaacgaagcaagtatgcttatgtcacctctacaacaacaagattcttcaccagagtctactccaagtcgagtaagatctttggtggatatatatgactcttgcaacacaactatggttgacctaaatgctatgaagaatcctcaaagaagcaaaggcaactaa

SEQ ID NO: 101888 - DNA, 204 bp, Glycine max
  Peptide Sequence Number=SeqID_218666
atggattccacaaatactaaagatgcatggagtacactacaggaggagtttcaaggcaacgacaagattccagtgataagacaagtgaaaactggtacttggatagcggttgaagcaatcacatggttaatgatagaagcatcttcaaggaaattgacgacattgtcaaagtcaaaattcgattgggaaatcgcaccatggtag

SEQ ID NO: 101889 - DNA, 561 bp, Glycine max
  Peptide Sequence Number=SeqID_218667
atggctgggaaaaatgaacgtgagcgacttcttaccgaggctccaaacaacctagtgcaagtcatggctaatcagggagacgatggagaggtagttgcgtgccatggtttagatcaccttcggaggaatgacacacctaccttcaaggggggttatgatcttaagggtgctaaggcttggctgagggagattaaaaagatctttcggatgaagcagagtactggtggaagaacacacgcccatgtctggagggagcagacttttctagagaagtattttccagaacatgtgaagaacatgaaggagatggagttcctcgagctgaaatacatgacggtggcaaagtatgcagctaggtttgagaacctagtcaggaatgccaatgccgatcataggaaagaaaagaagcctatgactcacaatcgtgctaagtcatattatgcccctcctgggcaatatggtaatcattttgggggaaagaggatggatggattccagcccaccagtagaggatttcagttagctggtggaagttctcagccaactaacacggtgtcttag

SEQ ID NO: 101890 - DNA, 171 bp, Glycine max
  Peptide Sequence Number=SeqID_218668
atgacaacaattttggcagcgaatgtggtggcaattgatgatggtaatggtggtgacggtgacaatcatggtggtggcagcgatgacaacaaaggtcacgacaataaaggtggtggtggtggtgcggtgggcagggtggtggtagcaataatcatgatggtgatgggttaa

SEQ ID NO: 101891 - DNA, 357 bp, Glycine max
  Peptide Sequence Number=SeqID_218669
atgatgaaagagttacccaatgttggtaatgatttgaaacagggttcacttaaattgctactcccactctgtgtgaattcctttgctagtttctttcaggaaaatgctttgtcagaaagaaataacgaaaatggttttgtgctgactttgaagctaggattcgatgatctatttatacaacacaaatttgttgattctgcttctcaagctccattggagcttgtaggcctaggatcttcttcatcaatgaattcctttgcttcttggaagatgaatggtagtggaatggagaaggaagagagagaggagatgccacttcaaggagaagatgagtatagaagaagctcaccaccatag

SEQ ID NO: 101892 - DNA, 678 bp, Glycine max
  Peptide Sequence Number=SeqID_218670
atggctagaaagaaggtcaatcttacatacataagcaatcccgtgaagaggaaggcagtgttcaaccaaaggaaaaatggtttgctaaaaaaggttgatgaaatcactacgctttgtgacattcatgcctgtgctatcatttatactccagataaaccagagcctgaggtttggccttctgaccagggagtggaagatgtaatttttagatttaggggagtttctgaattggcacgaagcaaaagaatgttttgtcaagagaaatttttgaaaagaaacataatcaaagcccgggggcaactaaagaaactaaggaatgaaaataggaagaaggagattggccttttcatgtgtcaatactttttaggtggcaaccaccttgacaatgctaacattattgatttgaatgatattagattcttggttgataaaaaattggaggagattacaaagaaaatcgaaatgctccatgtccaagaggtgacatcagctactgaaaatagaggagaaaccatgattgaagaaaagcaagcactcatgaccaatgtggatgccatgccaaatctgaattggtctaatgacaacatcaatgctagtggtggggatagtatgttaacattggaagatattaatgttcagagcggttggcttaaccaattcatcctttcaaaaaggtga

SEQ ID NO: 101893 - DNA, 420 bp, Glycine max
  Peptide Sequence Number=SeqID_218671
atgtatcatcaaagagaaaaaactctagatgagctttcagtgtcactaagcaagtcggagactaagcatgaccacagattcgcctccacttcctatcttcccatggacccgagtatagggcccttaataactcattgtgtgtgccaaagtctctctaatatccccagtggagtcaccatctgtcgcaacctacctttcggcgggagggcgacgcgagactcatgggtgtgtcttccaagcgagaaaaatgcaggagtctccaccaacgtttatttgaggaaaatgttagaaaaaccgaaagcgggtctacggattttaagaacaaaggttcgggagttgttcatgcacggggaaggtattagcaccccatacgtctgtcacaagggatggcatcctttaatcaaatgtgtaaaatcatga

SEQ ID NO: 101894 - DNA, 222 bp, Glycine max
  Peptide Sequence Number=SeqID_218672
atggcaaatgatggaacatacaaatttggggatcccacggtcatgtggctccgcatgccaccaaactcttgggtcatggtaacaaaaggtggggtggtcgacaaaagcagggcttttgctcctacgtatcctcaatttgtgatgaggaactcagacctacaggaaacactgggtccaacaaagataggagaaaatcactcaaagtgtatcaatctcacacag

SEQ ID NO: 101895 - DNA, 270 bp, Glycine max
  Peptide Sequence Number=SeqID_218673
cttcgcttcggtggcgaaagcgcaggtctattggctgatcccgctgtttgcggcgtgttacctgactatctaccggctcaggtggaacatgaacattctctcgctgggggacgacgaggcgcgcattgccggcctgaatccgccccggctgaagatcctattgctgatcgccgcctctctgctggtttccgcctcggtgagtttggccggcgtggtggggtgggttggcttggtgatcccccatttggtgcgaagcgtgctgggatataa

SEQ ID NO: 101896 - DNA, 390 bp, Glycine max
  Peptide Sequence Number=SeqID_218674
ttcaccgccgctgatctggttgatatttttctgcgccagcggcgcgatctccaacgcgtgcaacaccgcctgcgccctggtgaaatcttgccgccgcggcccggcgaaccatcccgcatggcgggcgcagccgaaagtgacaaaatcgagtacgccataggaaaaatgtggcgccttcgcctgcggcacgtaggccaggcgcgcctctcgattatcgacgcggccgatctcgcacctgccagcgctgggtcgacacaggcccgcaatatttctcagcagcgtcgttttgccggcgccgttcgggcccagcacgctgaggatctcgccgcgcttaagctcgaagctgacgttgtcgaaaatgggctcccgccccttgaaaccaaaggctag
